United States Patent 6,610,836 (NUCLEIC ACID AMINO ACID SEQUENCES RELATING TO KLEBSIELLA PNEUMONIAE FOR DIAGNOSTICS AND THERAPEUTICS) - sequence listing, part 3

SEQ ID NO: 3975 - DNA, 456 bp, Klebsiella pneumoniae
ccgggcaggccatgtctgcccgtatttcgcgtaaggaaatccattatgtactatttaaaaaacacaaacttttggatgttcggtttattctttttcttttacttttttatcatgggagcctacttcccgtttttcccgatttggctacatgacatcaaccatatcagcaaaagtgatacgggtattatttttgccgctatttctctgttctcgctattattccaaccgctgtttggtctgctttctgacaaactcgggctgcgcaaatacttgctgtggattattaccggcatgttagtgatgtttgcgccgttctttatttttatcttcgggccactgttacaatacaacattttagtaggatcgattgttggtggtatttatcttaggcttttgtttaaacgccggtgcgccagcagtagaggcatttatcgagaaagacagccgtcgcagtaa

SEQ ID NO: 3976 - DNA, 474 bp, Klebsiella pneumoniae
gctgactgcaccagatgggtggtccatcctttggtctcgctctggaacttcagcgtaaccgaggcaagtttaaacagggaattactgatgcgatcgcgcatttttttgtttgaacgacgggagttaaatccgcacatcttaacgaattcgacgaacgacagttccagggtgtcactttttaccccatactccgacatggagcgaattatccccagccagactttaaaatccgtgtccatatcaagacgcgaaccggtgatcttaacgtcagtgtacccttcgcttttggcaatagacagctgtacaagctcctcagtcgcgtctgtaacgtttttccggttcgccttgctcttccctgttgatttcagagttgggacgaagagaccgagtctcatgagcgctactggctgcacggtactggtgctgttgacatccagcttaacaacttcgccggttgtcttatcaacttcctga

SEQ ID NO: 3977 - DNA, 366 bp, Klebsiella pneumoniae
tgctggttaacccgaaaagtggccaggttaagcctctcagttacggctttatcagtcaggacgacctggcgaaacagttcctctatgtctccagcgactttaaaccgaatttctaaggagtgtgtcatgcgaaatattcgttttccggatttagatatcaccgggatgtgggtgctggccgtgggcgtgtttttccacctgatagcccggcttgtcagaaagcagcctgagctggccgtccaggccggggaaatcttcgggctgggtatggtggtgtttgggggataccgcattcttaacgccctgattgctgaagccgaaaaagaggagaaagcctgtgaaaaacagcctgaagaacctcgctaa

SEQ ID NO: 3978 - DNA, 189 bp, Klebsiella pneumoniae
agcgtgaggttgagcgccgtgtgcaggagcgcatgctgctgtcgcgcgggaacaactacacgcgactggccactgtccccctataacattccttccttaaaaaatccggccggcgccggaggctttcgcacgcctgttggccggctactacgtattatcttatcttcaggcctgctttcctcaccataa

SEQ ID NO: 3979 - DNA, 1317 bp, Klebsiella pneumoniae
atgtctgtaacacgtataagagtgaaagaacgcgacgctattattcagtcacttaagtcaggtgtaacgccaaggataggcattcagcatatccaggttggccgcgtgaatgagatcaccgctctccatcaggatattgagaggattgctgacggtggtgcaagcttcagacttatcatcggtgaatatggttctggtaaaacgttctttctgagtgttgtgcgctctattgcgctggagaagaagttggtgtcagtcagtgctgacctttctcctgacagacgtattcactcatcgggaggtcaggctcgtaatctttattctgagctcatgaaaaacatgtccaccagaaacaagccggatggtaatgcgttacttagcgttgttgaaaggttcgttacggaggcaaggaaggaagctgacacggacggctccgaggtttcatcagttattcataaacgcctggcagcactatcagatatggtcggtggatatgactttgcgaaggtcattgatgcattctggcgggggcatgagcaggataacgaaacgctaaaatccaatgccattcgctggttgcgtggagagtacactactaaaactgatgcccgtcacgatctcgacgttcggactattatctcagacgcatcattctatgattctttgaagctgatgagcctttttgtccgccaggcaggctatgccggtcttttggtcagcctcgacgaaatggtgaacctcttgaagctgaataatacgcaagcaagaacagcgaactacgaacagattttgcggatcctgaatgactgcctgcaaggctcagccgagaacattggttttatcctcgggggtacgccagagtttcttttcgatccgcgtaaaggtctttacagctatgaggcgctccagtcgcgtctggcggaaaaccggttcgcgcaaaaagcaggagtgattgactactcatcccccactttgcatcttgccagcctcacccctgaggaactgtatattttgctgagaaatcttcgtcatgtttatgccggtggagatccagagaattatctggtaccagatgaggcactgactggattcctgcatcactgtagtaaaaccattggagacgcttacttccgtaccccccgtaataccataaaaggtttcctggacatgctggccgtgctggaacaaaacagaacgatgaactggcaaacactaatcgagggtgtggcgattgaagaggaccggcccagcgatatggatgacaccactacggaggaaagcgatgacgacgacggactggcgaacttcaaactatga

SEQ ID NO: 3980 - DNA, 990 bp, Klebsiella pneumoniae
ataaatcgaacttttgctgagttgaaggatcagatcacgtatcttcccgacaacgcagaccgttccgtggcaaagcaaaagttcaaaatcaccaactggcccacctacaataaagccctcatcaaccgtggctccataactttctggctggatgatgaagctattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccattttttctctgatgaacgttccgctacgctgcccggattacagctgtgtcagcaggcaggcaaagtcggttaatgtcagtttcaaaacgcccacccggggtgaaatcgcacacctggtaattgattccaccgggctgaaggtcttcggtgaaggcgagtggaaagtcaaaaagcatggccaggaacgccgccgtatctggcgtaagctgcatctcgccgttgacagtaaaacacatgaaatcatctgcgctgacctgtcgctgaacaatgtgacggactcagaagccttcccgggtcttatccggcagactcacagaaaaatcagggcagcatcggcagacggcgcttacgacacccggctctgtcacgatgaactgcggcgtaagaaaatcagcgcgcttatcccaccccgaaaaggtgcgggttactggcccggtgaatatgcagaccgtaaccgtgcagtggctaatcagcaaatgaccgggagtaatgcgcggtggaaatggacaacagattacaaccgtcgctcgatagcggaaacggcgatgtaccgggtaaaacagctgttcgggggggcactgacgctgcgtgactacgatggtcaggttgcggaggctatggccctggtacgagcgctgaacaaaatgacgaaagcaggtatgcctgaaagcgtgcgtattgcctga

SEQ ID NO: 3981 - DNA, 678 bp, Klebsiella pneumoniae
ataaatcgaacttttgctgagttgaaggatcagatcacgtatcttcccgacaacgcagaccgttccgtggcaaagcaaaagttcaaaatcaccaactggcccacctacaataaagccctcatcaaccgtggctccataactttctggctggatgatgaagctattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccattttttctctgatgaacgttccgctacgctgcccggattacagctgtgtcagcaggcgggcaaagtcggttaatgtcagtttcaaaacgcccacccggggtgaaatcgcacacctggtaattgattccaccgggctgaaggtcttcggtgaaggcgagtggaaagtcaaaaagcatggccaggaacgccgccgtatctggcgtaagctgcatctcgccgttgacagtaaaacacatgaaatcatctgcgctgacctgtcgctgaacaacgttacggactcagaggccttccccgggtcttatccggcagactcacagaaaaatcagggcagcatcggcagacggcgcttacgacacccggctctgtcacgatga

SEQ ID NO: 3982 - DNA, 252 bp, Klebsiella pneumoniae
aggacgggaacagggaggtcgcggcaagcctggcttacgaatccaacggtaagtagcaacctggaggcggggaatactccgccttttcagggctgcgttggtctgacatgcctgaagcgcctttatgaaggggttgccggttcgccggtagcccctttttcctgtaagcaggaaaaaaaacccgcgcgacaggcgggcaaaaatctttcatctacctacaacacagattcaatgaatcgcaagtcacattaa

SEQ ID NO: 3983 - DNA, 297 bp, Klebsiella pneumoniae; identical to SEQ ID NO: 2022

SEQ ID NO: 3984 - DNA, 333 bp, Klebsiella pneumoniae
aagtccccgaccattgaaggaccagcaatccacaaggtccccgagtcatgcgttgcataccgcgaggtatggggcgaagcgttgacaggggtgttgacaggccagccattgagccacgaaatgtatattaaattaccgggtgccgacgttgtactgttaacggaaggcaacatcatagggtgcgatactgcgagtgccacatggacccggcggggtctgagaccctggcatgtcaatacgatctctacgcgggaaccgggagatctcccctctgaccatctgccagtgtcggagatggcccgcaccgggaagacgaggagtcatagccggtga

SEQ ID NO: 3985 - DNA, 234 bp, Klebsiella pneumoniae
ctgagtcagacaaaaaagccccctgacggggggcaaaaatgtagcaacgttgtttcaggaaaatctatcagggaaaaggtaacagcacggatactaccgtcgcattcagcctgcattgatcatgcggcggtgcgcttcggccatggcctgatgtgggccggattgcccgttattcatgaattcatgagcaaccgctgctctttcatgctcattcatcgccgcgtaagacgttga

SEQ ID NO: 3986 - DNA, 2223 bp, Klebsiella pneumoniae
cgacgacggactggcgaacttcaaactatgagcagtgcctacgatagcctcgatccccgcgtccgtaagtgggtttacaagcaggggtggtcgacattaaggcccttgcaggagagttctatcccggcaattttagcccgtgatcgagacgtgctaatcagtgcaggtacagcagcgggtaaaacagaggctttctttcttcctgcctgttcggcagttgcagatctcacgaatggatttggcatcgtctatatcagtccgttgaaggcattgattaacgatcagtaccgtcgtcttgggagccttggagatgcattggaaatgccagtgactccctggcacggggatgtaccacaaagcaaaaagaagaaggctcggacgaaccctgctggcattttactgattacacctgagtcacttgagtctttgctcataaattcaatgggctggctcaaacaggcgttttcttcagtcgcatacatcgttattgatgagtttcatgcttttattggttcagagcgtggtgtacagctgctttctctgctcaatagaattgaccatgtgctaggatgccaggtaaatccaattccccgcgttgcgttgagtgccacgctgggggaactggagaaagtgcccgaaatgttgcgcccggacaaacgactcccctgcgtaactgttacagatagtaatagcatggccactcttcaggtacaggtcaaagggtacctggagcgagtgatccaaaatgaggaagaacttcagagttcagctgaacatgacgtttgcgctgacatttttagactttgccgtggcgattctcatttggtctttgcaaacagccgaaaacgcactgaaagcattgcggcaacgctgagcgacatgtgtgaggaacaaattgttccgaatgaatttttcccccaccatggttcccttgccaaggaattacgtgaggtgcttgaatctcgtcttcagaaaggaaatttgcccacaacagctgtttgtacaatgacgcttgagttgggaattgatatcggtaaggttaaatcggttatccaagttacgcctccgcattctgtttccagtttgcgccagcgaatggggcgttctgggcgacgcgattccccgtcagtactcagaatgctaattacagaaaatgagcttactgtgagtagcagtatcgttgatcacctacgactccagttggtgcagtcgatggcaatgatcaggttgatgatctctaaacaatggtttgagcctgccgattcccggcagatgcattactccacgctgctacaccagattcttgcaattaccgcacaatggggtggagttcgtgccgaccagctctggtcacaactatgccagacagggccgttcagaaatgtagatttaaacgatttcaaaagcctgcttaaacatatgggagcatgtggcctactcactcaacttgctagcggcgaaatggttgttggggcagagggggagaaactgactaaccattacactttttatgccgtgttcaatacaccagaagagttccgcattatcaccggaaacagaacccttggaacagtgcctgtggactccccactgctaccagaccaacacatcatcttcggtgggcggcgctggaaagtgacagagatcgagacagagaaaaaagttatctatgtagaggcaaccaaaggcggtcagccaccacaatttagtgggggaggtatgtctgttcatgatgccgttcgtcaggaaatgctcgctatctatagggaaggtgattaccgcatagcaataggtagcaagaaagtagattatgccgatactgccgccagaaacctatttgcggaaggctgtagtaactttcagcgttttaaacttcaaaatgagtgttttattacgagtggacaacactgttacgtaataccctggatgggggataaagttgtcaatacgattacagccttgctcatacgttgtggttttaaagcaaattcatttgctggcgttatagaaatcgataactccagtgtagcttccgttcagcacgcgctgaaagaaatgctgttgtcaggcttgccatctgcatttgatcttgccacagatgttccagaaaagtacttagataaatatgacgagtatttaccagagtcccttcttgcgaaagggtatggtgcaaaggcgtatgaaacagaaggtacgcgcatctggttgcagaaacatctttag

SEQ ID NO: 3987 - DNA, 366 bp, Klebsiella pneumoniae
atgctctctgctcctgtattccgtattagcggaatacaggacgtcatgccagggccgtcaatctcagccggccgggggcagggagcgaaggatctccgcggcatctcgaccatcaccggtaaagggaacggccagggtggcagccatgtccagcgcaaatacccgggtatagacttccatcgagcgcggatccttatgcccggccagtgcctggatgaccttcctgggctgccggtgataaagcatgtgcataatatagctgtgacggaaagtatgcggcgtcacggggatcgaaaaatgcacgccgtcagcttcagcccgcttcaccgccttgtttcagccagttgcgcattgtctcatccgtga

SEQ ID NO: 3988 - DNA, 222 bp, Klebsiella pneumoniae
agtatgcatgcctttatttttctggtgctgatgacgccgagtagtggcggtgggatttgggatattactcccatgcctaatacagatgtctgcataaaaatgctacgggtactcgaagcacgtggaggcagaggttacggaagtaatacaggagagtgcattgaaattaaaacacgcgagcctttgaacagcgtgatggaaacattgagtgagggtgggtaa

SEQ ID NO: 3989 - DNA, 2322 bp, Klebsiella pneumoniae
cggattagtgccatgagtttcaatgccaaagatatgacgcagggcggtcagatcgccaatatgcgctttcgcatgtttggtcagattgccaatattattttctacgtgctgtttattttattctgggtgctgtgcgggctgatgctgatgtataggcttagctggcaaacctttgtgaacggctgcgtatactggtggtgtacgacgctgggtccgatgcgcgatattattcgttcccagccggtatacaccattcagtattacggccagtctctggaatatacctcagaacaaatcctggccgataaatatactatctggtgcggagagcagctgtggaccggtttcgtctttgctgccgtggtttctcttgtcatctgtatcgtgacgttcttcatcgccagctgggtgctgggccgccaggggaaacagcagagtgaggatgagaataccggcgggcgccagctttccgataagcccaaggaagtggcccgtcagatgaagcgtgatggtatggcctccgatattaaaattggcgacctgcctattcttaaaaactccgaaatccagaacttctgcctccacggtaccgtgggttccggtaaatcagaagtgatccgccggctactgaactacgtgcgtgcccggggcgatatggccatcatttacgatcgctcctgtgagttcgtcaaaagctattacgacccgtcactggataaaatcctcaacccgctggactcgcgctgcgcggcctgggatttgtggaaagagtgcctgacgctgccggacttcgacaacatctccaacacccttatcccgatgggtaccaaagaagacccgttctggcagggttccggtcgcactatctttgccgaaggcgcgtacctgatgcgtgaagacaaggatcgcagctacgagaaactggtcgataccatgctgtccattaaaatcgacaagctgcgcgcctatctgcagaacacgccggcagcgaacctggttgaagagaaaattgagaaaacggccatctccattcgtgccgtgctgaccaactacgtcaaggctattcgctacctgcagggcattgagaagaacggcgagccattcactatccgggactggatgcggggtgtccgtgaggaccgacccaatggctggttgtttatctcctccaacgctgacacccatgcctccctgaagccggttatctcaatgtggctgtcgattgctatccgcggcctgctggcgatgggggagaaccgtaaccggcgtgtttggattttcgctgacgagctccccacgctgcacaagctgccggacctggtcgaaatcctcccggaggcgcgtaaatttggtggttgttatgtgttcggtattcagtcctatgcccagctggaagacatctatggcgttaagcctgccgccacgctctttgacgtaatgaacacccgggccttcttccgttcacccagcagggagatcgcggagtttgctgccggtgaaattggcgaaaaggaaatcctcaaggccagcgagcagtactcctacggtgctgacccggtgcgtgatggtgtatcgaccgggaaagaaaaagagcgggaaaccctggtcagttactccgatattcagacgctgccggacctgtcctgttacgtcacgctgcccggaccgtatccggccgtgaagctggccctcaaatacaagccgcgtccgaaaattaccgagggatttattccgcgccgactcgatacgcgtgtagacgcccggctcagtgcgctgcttgaagagcgggaagctgaagggagtcttgccagggcacttttcacgccggatgcgccggcatcggggccggctgatacagacagtcacgccggagaacagcctgagccggtcagtcagcctgccccagcagacatgacagtatctccggcaccggtaaaagcgccgccgacaacgaagatgccggcagcggaaccttccgtcagagcaacggagccgcccgtcctgcgggtcacgaccgtaccgttgatcaaaccaaaagcagccgcagcggccgctgctgcctcaacagcgtcctctgccggtatccctgcagcagctgcaggcgggacagaacaggagctggcgcagcagtccgcagagcaggggcaggacatgctgccggccggcatgaacgaggacggtgtgattgaagacatgcaggcgtatgacgcttgggctgatgagcagacgcagcgggatatgcagcggcgtgaagaggtcaatatcaaccacagccaccgccacgatgagcaggatgatgtcgagattggggggaacttctga

SEQ ID NO: 3990 - DNA, 420 bp, Klebsiella pneumoniae
gtaatgccagcgccttcgcagaccgtctttgatggctttcagagttgccgtcatccgatcccggcgggtctttcgtatcagcatgaacctgccgttgcgatctttcccgctgatgtgcgtgaacccgaggaagttgaacgtttctggtttgccttttcccctgatggcacggttttcggcagcgaagcggccgaactccatcagacgggttttctccgggtgaaccgtgagtccgaactccctcagtctgcgctgcatggctatacggaagcgccgggcatcgtatcgtttgtcgaacccgatgacgatgtcatcggcgtatctgaccattaccacattgcctgtggcatagcgacgtcgccactgatgcgcccacagatcgaagacgtagtggaggtatatgtttgccagcagcggtga

SEQ ID NO: 3991 - DNA, 870 bp, Klebsiella pneumoniae
gcgcaggaagcggtgactgatatccttcaaaaccactattcacaggttaaaaacccgaatccggtattcacgccgcgtgaagggaaaaagaccctgccgttctgccgtaagctgatggcgaaagccgaaggcttcacgtcccgttttgatttttccattcatgtggcgtttttgcgttcgctgggtaagcggcacaggatgccacccctgttgcgccggcgtgcaattgacgcgctactgcaggcaatgtgttttcactatgatccgctggccaatcgcgtgcagcgctcgattaccaatatggccatcgagtgtggactggccaccgagtccaggagcggcaacctgtcagtcagccgtgccacccgggcgctgaagtttctggccgagctggggctcatcacctatcagactgaatatgacccgcagatcggctgtaacatcccgaccgatatcaccttcaccccggctctgttttccgcgcttgacgtttctgaggtggctgtggtggccgcgcgccgcagccgtgtggagtgggaaaacctgcagcgcaaaaagcagaaactgaaacccctggagatggacgaactgatcgcaaaagcgtggcggtttgtgcgtgagcgttttcgcagctatcaggctgagcgtaaatctcacggccgtaagcgggatactgcacggcgggatgcatcacggcagcgtcatgacatcgagacgcgcgtgcgtcagcaactgacccgcgaatacgccaccggccgcttcatgggcgataaagaagcgctgaagcgtgaggttgagcgccgtgtgcaggagcgcatgctgctgtcgcgcgggaacaactacacgcgactggccactgtccccctataa

SEQ ID NO: 3992 - DNA, 282 bp, Klebsiella pneumoniae
acgtcgcgagcgcggttaaaaacattgttaactgggcctttccactcttttttttggggtggtctgctgtatcttgtttacgatgattacagagataacggtacagcgactgaagaacagttattaatgatttctcatgcaataccctgtgccggtgaggattttcgaacggcactccgtaatagccagggaccattaacccttcgcgatgcgaagaaaattgccgctaaatgtaacgagaaatataaacaacttaactcactgaacgctataagcaaataa

SEQ ID NO: 3993 - DNA, 1440 bp, Klebsiella pneumoniae
aggagtggagcgctgatggccaacttcaacacgctgatcaaacgtaagcaatatatctggctgggactcattctggcgggcggcgcggcagccgtcggaggcgggctgtatctgtcagatctgaacatgagctctgatgaggaagccccggctcagggcgaacccgcaccggatatgaccggggtggtcgacagcagcttcaacagtaaggtggagcagcacgcgacaacagaaatgcaggcgactgccgctgatctcaacaagcgttttgactccctgcagggggaagtggacctactgagtaaggcgcgaagcgctgaccagatacgtatcgacaaactcagcagtgacaatgaagccatgcagaatcagctgaaggcgctgggcgtgaaaccggctgtctctggtggcgagcccgcgccgactcctccgtcaccgccacccggtccggaaggggagccgcagccagccagttatccgccgcaaaccggcgccgcggtaccgcctccgacggcattctatccggggaatggtatgacaccgccgccgcaggtcagctaccagtctgtaccggtaccaaaccagatacagcgtaaaacgttcagttatgacaaaggaaagaaagcgaagtcattgccgtacattccgtcggggagctttgcaaaaagcatgcttatcgagggggcagatgccaacgcgtctgttaccgggaatgaatccactgtaccgatgcagctgcgtatcaccggtcgcgtggaaatgccaaacagcaaaacctatgacctgaccggctgctttgtggggcttgaagcctggggtgatgtatcgagtgagcgcgccattgtccgtacccgtaatatcagctgtatcaaaggtgataaaaccatcgatcagcccattaacggccacgtttcctttatggggaaaaacggggttaagggagaggtggtgatgcgtaacggaaaaatcctcggctgggcatggggggccggttttgttgacgggattggccagggcatggaacgcgcttcacagccggcagttggcctgggggcaaccgcatctgttggcgccggtgatgttctgaaaatgggtgtcggcggtggtgcatctaaagctgcgcagacgctgagcgagtactacatcaaaagggctgagcagtatcacccggtcattccgattggtgccggtaacgaagtgactgtcgtgttccaggatggatttcagctgaaaaccatcgaagagctggaagcggaaaagaacgggcaacagcaggctcagaatcaggaggcggagccggcaccgcaggctgatgcacatcatcagtcaggcggcggtatgaacggattcaatactgacgagatgctgaagaagctgggcaaacttgatccgcgtgagttctctccgggcgcagcgccgcagggggaaaataatggctaa

SEQ ID NO: 3994 - DNA, 453 bp, Klebsiella pneumoniae
tttaacggagccaatcgacatcatcagaagttccccccaatctcgacatcatcctgctcatcgtggcggtggctgtggttgatattgacctcttcacgccgctgcatatcccgctgcgtctgctcatcagcccaagcgtcatacgcctgcatgtcttcaatcacaccgtcctcgttcatgccggccggcagcatgtcctgcccctgctctgcggactgctgcgccagctcctgttctgtcccgcctgcagctgctgcagggataccggcagaggacgctgttgaggcagcagcggccgctgcggctgcttttggtttgatcaacggtacggtcgtgacccgcaggacgggcggctccgttgctctgacggaaggttccgctgccggcatcttcgttgtcggcggcgcttttaccggtgccggagatactgtcatgtctgctggggcaggctga

SEQ ID NO: 3995 - DNA, 999 bp, Klebsiella pneumoniae
tacccagtggctaaaagacacgccatcactgccgttgcagcagtcgctcaaagatctggagcgcggctacaagaatttcttccagaagcgtgcagcattccctcgtttcaagaaacgcggccaaaacgatgcccgcaaggcgtgaagctcgatcagaccaacaatcgtatatcgcttcctaagttgggctggatacgctatcgcaatagccgtgaagtcatcggcgaagttaaaaacgtcacggtcatccagtcatgcggcaaatggtacgttagcatccagacggaatacgaagtgcctgaacaggttcataaggcagcgtcaatggtcggtttggacgccggagtcacgaaacttgccacgctttctgatggcaccgtataccagccagtcaacagcttcaaagcaagccagcgtaagctggctatgcttcaacggcagttaagccgcaaagttaaattcagtgccagttggcagaaacagaagaaaaaaatccagcgtctgcactcacacattgccaatatccggcgcgactaccttcacaaagtcaccagtgaaatcagcaaaaaccacgcgatgatcgtcattgaggacttgaaggtcagtaacatgtcgaaatcggcaaaaggtacggcagagcggcccggacgaaacatcagagccaaatcaggcttaaaccgttcgatactggatcagggctggtacgaaatgcgcagacagcttgagtacaagcagctctggcgtggtggtcaggtactggcgatacctccggcatacacaagccagcgttgtgcctgctgtggtcatacggcgaaagaaaaccgtcaaacgcaaagtaaattcgtgtgtcaggtatgcggctataccgagaacgccgatatcaacggagcacgtaacattttagcggcaggacatgccgtgcttgcctgtggagggatgatacagtcgggccgcccgctgaagcaggaacccaccgaggcgagtcaggctccggtctga

SEQ ID NO: 3996 - DNA, 660 bp, Klebsiella pneumoniae
agaagctgggcaaacttgatccgcgtgagttctctccgggcgcagcgccgcagggggaaaataatggctaagtctctcattactgctgttctgtcagtactgcgctgggctcactggctggttaagtgtgcggtggtgtatccgctggccatgatgatgttactggttgttctggtgttccggacgggaccgtacacgttcggccagacgctggtgaaaaccgtagagtccgtgcagcaggagggatatgtcattcaggactgcacggggccgaaagaactcaatagtgatgcggtgaacgcaccactgcctccgcttttacaggaagactgcaccaccgtcattacagatgcagcagggtatgcagcctatatcgaccagagctatacgcataatattctctggctctggctgctgatggcggtggtgtttaccgggatcgctgtggttttccgtcggactcctgtccgcagggggatcatacggaaaaacggtgttgtcgtcggagagtctgttttgggttcttcagggctgattctagcccgatctgatgtcagccagattaagcgtgtttacgatgaaatgagtccgggtgaaggggataaatttgttcggacgattaaggaaaatacccaaatcaggatgaacctgaagaaataa

SEQ ID NO: 3997 - DNA, 468 bp, Klebsiella pneumoniae
gttgccggggccgcggttttgactttgtgcggggacctgctgaacctgccccctggtattaacttcacccgtttgagagccgttcgccgcgagggcgtaaacgagcacggcccggtgcagatgtccgggggtgagcgggaaatttttttcggtctaatgaagcggcagcggaatggccgggaaaaatttattgcgaaaggctctgccgtcccctggacagcaagacgggttgtgcttgtctcagccccggcgaatggactcaaacgggtgatacggcgccaggggaaaggagcaggcacccgccgcaacgacgaagagcgcgggcgcgaaacggcgttgccctgcagagtgccggcagtccttcgccggcacggtgaaagcggcgcggccggaacggtcgcagcaagcgctgccgttgaccctgacctcagacatcagacactagccggcaggcccgaaaccgcgtag

SEQ ID NO: 3998 - DNA, 195 bp, Klebsiella pneumoniae
caccaacttcttctccagcgcaatagagcgcacaacactcagaaagaacgttttaccagaaccatattcaccgatgataagtctgaagcttgcaccaccgtcagcaatcctctcaatatcctgatggagagcggtgatctcattcacgcggccaacctggatatgctgaatgcctatccttggcgttacacctga

SEQ ID NO: 3999 - DNA, 207 bp, Klebsiella pneumoniae
cgatttgtctatttttatttcatctacatcaagcgcagttaccagattaagattagaatatcctgtcccaaagtcatcgatggcaaacctgacaccatgatttttatatttatcaatgtgaattttcataccttcaaaatcccctccttgacgctccgtaatttcaagaaggattgttttatatgggatgttatattcagaaattaa

SEQ ID NO: 4000 - DNA, 420 bp, Klebsiella pneumoniae
gacgacccctattatggcgaaggtatcattcaggaagcgttgatgaaggattatctctgtaaaaagttattcaaccggctttccggtaccctggtgatcagagcgcgctgcggcaataacattactggcctggcatgttgcaatattctttatccctcgccccgatacagcggtcagctgcatattaaagagctgtatgtttctcagtgcgatcgaaataagggcacgggtaaagcgataatgcgctttatagcccggcttgcgcttgaacaggaatgccttagccttagctggaacgctgaaaaatccaaccccggcgctaaccgtttttatcaggctctgggaggcagaataaatgatcatatcgtcaattattacctccacggggagagcctgagcaaactggcctcaggcatttga

SEQ ID NO: 4001 - DNA, 651 bp, Klebsiella pneumoniae
caggagtctctcatgaaattaatgaatctgtttatggtcatgcttttgctgaccggacgagcagtgttggctgaaacctcctctgttacagacagagaatggctgaagcagcaggagaacctcagcgaacagctgcaccagcatccggataaacagctgcagcaggagcttgaggcgcaaatcaaccgtaatcctctgcccaaatcagaccgccagtttatcgataatctggtcagccagcagaaagcggcgaatcaggaaaagccggcagaaggggcgctgtactttgtctccttctcgatacctgaagaggggctgaagcggatgctgcacgaaacccggcagtacggcattccggcgacactgcgtgggctcgtcaataacgacatgaagaccaccactgacgcggtgctgcagctggtgaaggatggcgtgaccgacggagtgcagatcgacccgacactatatacgcagtacagcatccggagtgtgccgtctctggtggtacggtgtcaggccgggtatgacgtggtacgcggtaacattcacgtcaaacaggcgctggagaaagtcgcacaaaccggtgactgcgcacaggtggcccggcagatgcttgatgcgccctcgaatgccgccgggagccagccatga

SEQ ID NO: 4002 - DNA, 1338 bp, Klebsiella pneumoniae
tcgggcgcatatgccaggtgttttgatttttcagcgagaaattgtatggcttctttaaagataaaatatgctgcaataattatcagcagcctcatagcaggggggctgatatcggttactgcctggcagtatgtaaactcatcacaaaaaacagtacaaaccgaacaaaaggcaccggagcgaaaggtacttttctggtatgacccgatgaaaccggataccaaatttgataaacccggaaaatctccctttatggatatggacctggtgccgaaatatgctgatgaaagtggcgatgaaagcagtggcgggatccgtatcgatccaacgcaggttcagaatctgggattaaaaacgcaaaaagtcacgcgaggaatgctgaattattcccagacaatcccggctaatgtcagttacaacgagtatcagtttgtcattgtgcaggcgcgctctgacggtttcgtcgaaaaagtgtatcccctgacgattggcgatcatgtgaagaaaggcactccgcttatcgatatcaccattcctgaatgggttgaggcacaaagtgagttcctgctgttatccggtacaggcggtacgtcaacccagataaaaggggttctggagcgacttcgtctggctggtatgccggaagaggatattcaaaggctgcgttcaacccgcacaatccagacccgttttaccattaaagcacctattgatggtgtcattactgcgtttgacctgcgcaccggcatgaatatttcgaaagataaagtagtggctcagattcaggggatggacccggtctggatcagcgctgcagtgccagaatctatcgcatatctgctgaaagatacgtcgcagtttgaaatttcggtaccggcttatccggataaaacattccatgtcgaaaaatggaacattcttcccagcgtggatcagacaacccgtacgcttcaggtccgtctccaggtttctaataaggatgagtttctcaagccgggcatgaatgcctatctgaaactgaataccaagagccaggagatgctgctgataccaagccaggccgttatcgataccggcaaagaacagcgcgtgattactgttgatgatgaaggcaagtttgtgccgaaacagatccacgttctgcatgaatcacagcaacagtccggcatcggttccggcctgaatgaaggcgataccgtggtggtcagtggcctgttcctcattgactccgaagccaatattacgggcgcgctggaacgtatgcgccaccctgaaaaaacagaaagcagtatgccagcaatgtctgaccagcctgtaaatatgcattcagggcactga

SEQ ID NO: 4003 - DNA, 1491 bp, Klebsiella pneumoniae
ccggtgatgtacggagaggagaagtcggactcgctcatagtagcggcgaagcaggcgaacaacccgaaaggagcggagtcagtggagcgaaggagcggggccaaggggaacgcggaacagccacacatgcgccggacacagagccgggaaagcatgtcacagaggctgtcacgcgtgcgggaagctgcgaagcagcggaagaaagaacggtttacagcattgttccacctgctgacagtcgaagcactggaagccgcattcctctccctgagcaggaaagcggccgccggagtggatggcatcaggtggatggactacgccggaaacatgaagaacaacataacagatctgcaccggaggctacatcagggcagctacagggcgcagcccggcaggcgtcactacatcccaaaagcggatggaaaacaacgcccgctcggcatcgcctcgctggaggacaagatcgtccagtatgcgctggtgaaaatcctgaacgcagtctatgaaaacgactttatggggttctcatacgggttcagacccgggcgaagccagcacgatgcactggacgcactggccacagggctggtacgcactaacgtaaactgggtactggatgccgacatcagtcagttcttcgacagggtgagccacgaatggctgatcaggttcacagagcatcggatcggcgaccggagggtaatcaggctcatacgtaagtggctcacagccgggacgtcggaggagggtcaatggcgagcaacggaggaaggcaccccacagggtgcggtcatctcaccgctgctggcaaacatatacctccactacgtcttcgatctgtgggcgcatcagtggcgacgtcgctatgccacaggcaatgtggtaatggtcagatacgccgatgacatcgtcatcgggttcgacaaacgatacgatgcccggcgcttccgtatagccatgcagcgcagactgagggagttcggactcacggttcacccggagaaaacccgtctgatggagttcggccgcttcgctgccgaaaaccgtgccatcaggggaaaaggcaaaccagaaacgttcaacttcctcgggttcacgcacatcagcgggaaagatcgcaacggcaggttcatgctgatacgaaagacccgccgggatcggatgacggcaactctgaaagccatcaaagacggtctgcgaaggcgctggcattactcaatccccgaacagggaaaatggctcaggagagtggttcagggatacctgaactatcactcggtaccgggcaacttccccaccatgcagaagttcaggacacacgtaacaaacctctggcgccgggcgctcaggcgcaggagccagaaggatgatacgacctggacgaaagcaaacaaactggcagccgcatggctaccaagggttcgggttcttcatccatggcctgtggagcggttcaccgccagacacccgaggcaggagcccggtgcgtaa

SEQ ID NO: 4004 - DNA, 777 bp, Klebsiella pneumoniae
gagaatgtgtatttactcgtattgattatgtcacaaggattcaggatgaagcttaataaagtcatggctgtgatggtcgtcagctctgcgctggtgttatctggatgtagtgcaatgggaaccgccattaaaaagagaaatctggaagtaaaaacccagatgagcgaaacaatctggctggaaccttcaaataataagacggtttatctgcaaatcaaaaatacctccgataaggatatgagtggcctgcaggcaaaaattgccagcgccgtcacttcaaagggatatcaggtcgtcagtaacccggatacggcgggctactggatccaggcgaacgtgcttaaggccgataaaatggaccttcgtgagtctcagggctggttaagccggggttatgagggcgctgtgactggcgccgctttaggggcagggattaccgcttacaactccagttctgcaggggcgactctgggtgtaggacttgcagccggtctggttggtatggctgctgacgcgatggtggaagatgtgaactacaccatgatcaccgatgttcagatcgcggaaagaaccaaaactcaggttcagactgataacgtggccgtattacgtcagggaacatccggcgcaaaagtgcagacaagtactgaaacgggtaatcagcacaaataccagactcgcgtcgtctctaacgctaataaagttaacctcaagttccctgaagcccagcctgttcttgaagaccagctggcaaaatcgatcgctaatattctgtaa

SEQ ID NO: 4005 - DNA, 552 bp, Klebsiella pneumoniae
acatatattcaagcctatctcttatctggagatacagctactgtccggtgtttcagggggctacatcattatgggcgttggcctcaacacggttttacgtcacttaaaaaactcaggccgcagtcggtaacctcgcgcatacaaccgggcagtgatgtgattgtctgcgctgaaatggacgaacagtggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatggatgacggatggctggccgctgtatgaatcccgcctgaagggaaagctgcacgttaacagcaagcgttacactcagcgcattgagcgacataacctgaatctgcgacaacatctggcaaggctgggacggaagtcactgtcgttctcaaaatcggtggagctgcatgacaaggtcatcgggcattatctgaacataaaacactatcagtaa

SEQ ID NO: 4006 - DNA, 3177 bp, Klebsiella pneumoniae
atatgcattcagggcactgaggagacgacgatgattgaatggattatccggcgctctgtcgccaaccgtttcctggtcatgatgggggccctgtttctcagcatctggggtacatggacgattattaacacgccggtcgatgccttgcctgacctgtcagatgtacaggtcattatcaaaaccagctatcccggccaggccccgcagattgtagaaaaccaggtcacctatccacttaccaccaccatgctgtccgtacctggcgcaaaaaccgtgcgtggtttttcacagttcggggattcgtatgtgtatgtcatttttgaagacggcaccgatctgtactgggcccgttcccgcgtgctggaatatctgaatcaggttcagggaaaactgcctgccggtgtgagttctgaaatcggtcctgatgccacgggtgtgggctggatttttgaatatgcccttgtcgatcgcaacggaaaacacgacctttcagaactgcgctctctgcaggactggttcctgaaatttgagctgaaaaccatcccgaacgtggctgaggtcgcttcggttggcggcgtggtgaaacagtaccagattcaggtcaatccggtaaaactgtcccagtacggtatcagcctgcccgaagtgaaacaggcacttgaatcgtctaaccaggaggccggtggctcatccgttgaaatggccgaagcggagtatatggtccgtgccagcggttatcttcagagcattgatgattttaataacatcgtcctgaaaacaggtgagaacggcgtgccggtttatctgcgggatgttgcccgcgtgcagaccgggcccgaaatgaggcgtggtattgccgagctgaacggccagggagaagtcgctggcggcgtggtgatcctgcggtcgggtaaaaatgcgcgcgacgttatcacggcagtgagggataaactggagacgctgaaggccagcctgccggaaggcgttgaaatcgtgaccacctacgatcgcagccagttaatcgaccgggcgattgataacctcagttacaagcttcttgaagagtttatcgttgttgctgtcgtttgcgcactgttcctctggcatgtccgttctgccctggtggcgattatttctctgccacttggcctgtgtatcgcctttatcgtcatgcacttccagggactgaacgccaatatcatgtcgctgggagggatagcgattgccgtcggtgcgatggtggatgccgccattgtgatgattgaaaatgcgcacaaacggcttgaggagtgggatcatcagcatccgggtgagcagattgacaacgccacccgctggaaggtgattaccgacgcctccgtggaagtgggacccgcgttgttcattagcctgctgatcatcaccctgtcctttattcctatctttaccctggaagggcaggaaggtcgtctgtttggcccgctggcattcacgaaaacgtactccatggcgggagcggccgcactggccatcatcgtcattcctattctgatgggattctggatccgggggaaaattcctgccgagacaagtaaccccctgaaccgggtgctgatcaaagcgtatcatcctttgctgctgcgggtcctccactggccaaaaacaaccctgctggttgcggccttgtccattttcacggttatctggccactgagtcaggtgggcggtgaatttctgccgaagattaacgagggcgatctgctgtatatgccgtcgaccttgcctggcgtctctccggcagaagctgcagcgctcctgcagacaacagacaagttaatcaaaagcgttcctgaagtggcttctgtatttggcaagaccggtaaagcagagaccgcaacggattccgcgccgctcgaaatggtggaaaccacgatccagctcaaacctgaggatcagtggcgtcccggcatgacaattgacaagattattgatgaactcgacaggacagtccgtttaccgggtctggcaaacctctgggtgccgcctatccgtaaccgtattgatatgctctcaaccgggatcaaaagcccgataggtatcaaagtgtccgggactgttctgtccgatatcgacgcgacggcgcagagtatcgaggcggtagccaaaaccgtgcctggcgtggtgtctgtcctggctgagcgacttgagggcgggcgctacatcgatatcgatatcaaccgggagaaagcttcccggtacgggatgactgtgggcgacgtccagctgttcgtctcttcagcaatcggtggggctatggtgggtgagacggttgaaggcgtggcccggtaccctattaacattcgctatccgcaggattaccgtaacagtccgcaggcgttgagagagatgccaatcctgaccccaatgaagcagcaaattacgctgggcgatgttgccgatattaaggtcgtttccggaccaaccatgctgaaaaccgaaaatgcccggccagccagctggatttatgttgatgcccgcggcagggacatggtgtcggtggtgaacgatattaagacggccatcagtgagaaagtgaaactgagaccggggaccagtgtggcattctcaggacagtttgaattactcgagcacgccaataagaaattaaaactgatggtaccgatgacggtgatgatcatcttcatcctgttatatctggcattccgccgggctgatgaggccttacttattctgatgagcctgccgtttgccctggttggcgggatatggttcctgtactggcagggcttccatatgtcagtggcgaccggaaccgggtttatcgccctggccggggtggcagcagagtttggcgtggtcatgctgatgtatctgcgtcatgccattgaagcgcacccggaattgtcccgtaaagagacgttcacaccggaaggccttgatgaagccctctatcatggtgccgtactgcgtgtccggccgaaagccatgaccgtggcggtgatcattgcgggtctgctgccaatactctggggaaccggtgcaggttcagaagtcatgagccgtatcgcggcacccatgattggtgggatgatcacggctccgctgctgtccctgttcattattcctgccgcctacaaattaatctggctgcgcagacataaaaaaagcgtgtcctga

SEQ ID NO: 4007 - DNA, 456 bp, Klebsiella pneumoniae
tattttcatcatgctccccggctggctgctaatgtcattttattgcgcccacgatcgttatcaacggattacagcaaaaatgacaacattgtcattatcctgtcacccggcaaacagagagcgttcggtaaagtatccctatcaatactctggatttcgtttgaaccatttaccaggtctgcctgtacgagaagcgttatgttcaaattaaaattactcagcatcagtaccatattcatcctggctggttgtgtttctctggcacctgaatatcagcgtccgccagctccggttccccagcagttttcattgtctaaaaacagtctgacgcctgcggtaaacagctatcatgatacgggctggcgaaacttttttgtcgatccccaagtcaacaggctgatcggtgaagccctgaataataaccgtgatttgagaatggctgccctgaaaggttga

SEQ ID NO: 4008 - DNA, 300 bp, Klebsiella pneumoniae
tgcacgcatcacctcaatacctttgatggtggcgtaagccgtcttcatggatttaaatcccagcgtggcgccgattatccgtttcagtttgccatgatcgcattcaatcacgttgttccggtacttaatctgtcggtgttcaacgtcagacgggcaccggccttcgcgtttgagcagagcaagcgcgcgaccataggcgggcgctttatccgtgttgatgaatcgcgggatctgccacttcttcacgttgttgaggatttgtcttcaccacgggcggccgaaggatccgcactatgcgtg

SEQ ID NO: 4009 - DNA, 414 bp, Klebsiella pneumoniae
gcaaataatcagaggatggatatgatgctgttttttagaaagtatggatttttgtttatccctccagtctactggctcatctatctgggagctaggctgacttacaatggactggcaggagagtattctcctgatttctttcagggtattcgacatgaaggcatctatattatctgtagtttgtgtatcttttattttttctgcttagaggtggaagttagtgatggggagttctcagcgaacattctgttcctgattgttttctttcatgtggttttattatttatcactctgcttatttgtttgtggcaaggggcgatgttgttggatgcgatctttatgggtcagattattgcctccatgtgtttattgtttttcattcctgtgctttccattataagaaggagtttctag

SEQ ID NO: 4010 - DNA, 429 bp, Klebsiella pneumoniae
ctgtatctccagataagagataggcttgaatatatgtctaacactaacgccaattttgagatgaccgggatcctgttagggcaagaagcccgtaaacgtaaaactcctcaggagaagatcgccattatccagcagacgatggagccgggcatgaatgtctcccatgtcgcccgcctgcatggtatccagcccagcctgctgtttaagtggaagaagcaatatcaggaaggcagcctcaccgccgttgcggccggagaggaagtcgttcctgcttctgagcttactgctgctctgaagcaggtccgggaacttcagcgccttctgggcaagaagacgatggaagttgagatcctgaaagaagccgtggagtacggccagtcgcgaaaatggatagcgcacgcgcccttgttgccaaaggacggggaatag

SEQ ID NO: 4011 - DNA, 813 bp, Klebsiella pneumoniae
atacagtgtctatcagcatctgtcacgccagtcgcaataattcataaaagggtatttgccatgcgaacaatacatgccgccatgctggcgggatgcctttgctgcgccctgatgccggctttcgccaaagacgcgggctggcagtggtacaacgagaaacttaagccccgtgatgaggaaaggaaagccgcaccagcggcaccaccgccgcaaatggatattctggagaaactcgccacactccaggcggccaccaaacggtcgttgtacgaagccattctgtatccatcgtctgaaaacttcgtgaagtatttccggctgcagaactactggacgcagcaggcaggtttgttctcgatgagtgcgaagaaagcgatgctggaaaaccccgaactcgattacaacctgcagcacagctactacaacggcacggtaaaaaaccagctcgctgccgactatgccgaacagcgacaggctatctccaccctcgcacagcactacggcgtgatgttcttctaccggggccgggaagcgatcgatggccagctggtccaggtgattaaaaattttcgcgaaacctatggcctgagcgtgataccggtgtcggttgacggagtgattaaccccatgctgcccgatagccggacagaccagggccaggcagagcagcttggcgtgaagttcttccccgcgatgatgctggttaacccgaaaagtggccaggttaagcctctcagttacggctttatcagtcaggacgacctggcgaaacagttcctctatgtctccagcgactttaaaccgaatttctaa

SEQ ID NO: 4012 - DNA, 198 bp, Klebsiella pneumoniae
tacgggtaccaggggaaaggagcaggcacccgccgcaacgacgaagagcgcgggcgcgaaacggcgttgccccgcagagtgccggcagtccttcgccggcacggtgaaagcggcgcggccggaacggccgcagcaagcgctgccgttgactttgacctcagacatcagacactagccgtcaggcccgaaaccgcgtag

SEQ ID NO: 4013 - DNA, 198 bp, Klebsiella pneumoniae; identical to SEQ ID NO: 4012

SEQ ID NO: 4014 - DNA, 342 bp, Klebsiella pneumoniae
tacggaatacaggagcagagagcattcagccccctccctgctccagcacaccaggccatcatgctgatgactgaaccgccatggtcttacccggtgacctgcaatcctgcaggcatcaacataccgcagtcaagacagggcacaatgcaggcatactggccgtgcatcccactgtgcgtttttcctggaagctcagcaaatcatcccgttaaccgcgaaagtcattcaccatctgtggccaacacctttctgccatccggctcccgtttcctaatcgcatttagcagtgtgaagctggcgccgggttatacagacagctgcagtctcatcctgccgggctaa

SEQ ID NO: 4015 - DNA, 3096 bp, Klebsiella pneumoniae
caattcacacaggatacaactatgacaatgattacggattcactggccgtcgtattacaacgtcgtgactgggaaaaccctggcgttacccaacttaatcgccttgcggcacatccccctttcgccagctggcgtaatagcgaagaggctcgcaccgatcgcccttcccaagagtcgcgcagcctgaatggtgaatggcgctttgcctggtttccggcaccagaagcggtaccagaaagctggctggagcgcgatcttcctgacgccgatactgtcatcgtcccctcaaactggcagatgcacggttacgatgcgcctatctacaccaacgtgacctatcccattgcggtcaatccgccgtatgttcccacggagaatccgacgggttgttactcgctcacatttaatattgatgaaagctggctacaggaaggccagacgcgaattatttttgatggtgttaactcggcgtttcatttgtggtgcaacgggcgctgggtcggttacggacaggacagtcgtttgccgtctgaatttgacctgagcgcatttttacacgccggagaaaaccgcctcgcggtgatggtgctgcgctggagtgacggcagttatctggaagatcaggatatgtggcggatgagcggcattttccgtgacgtctcgttgctgcataaaccgagcacgcaaatcagcgatttccatgtagccactcactttaatgatgatttcagccgcgctgtactggaggcagacgttcagatgtacggcgagctgcgcgatgagctgcgggtgacggtttctttgtggcagggtgaaacgcaggtcgccagcggcaccgcgcctttcggcggtgaaattatcgatgagcgtggtggttatgccgatcacgtcaccctacgtctgaacgtcgaaaacccgaaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgcggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccactacggcctgtatgtggtggatgaagccaacattgaaacccacggcatggtgccaatgaatcgtctgaccgatgatccgcgctggctacccgcgatgagcgaacgcgtaacgcgaatggtgcagcgcgatcgtaatcacccgagtgtgatcatctggtcgctggggaatgaatcaggccacggcgctaatcacgacgcactctatcgctggatcaaatctgtcgatccttcccgcccggtacagtatgaaggcggcggagccgacaccttcgcaaccgatattatttgcccgatgtacgcgcgcgtggatgaagaccagcccttcccggctgtgccgaaatggtccatcaaaaaatggctttcgttgcctggagagacgcgcccgctgatcctttgcgaatacgcccacgcgatgggtaacagtcttggcggcttcgctaaatactggcaggcgtttcgtcagtacccccgtttacagggcggcttcgtctgggactgggtggatcagtcgctgattaaatatgatgaaaatggcaatccgtggtcggcttacggcggtgattttggcgatacgccgaatgatcgccagttctgcatgaacggtctggtctttgccgaccgcacgccgcatccggcgctgacggaagcaaaacaccagcagcagtttttccagttcagtttatccgggcgaaccatcgaagtgaccagcgaatacctgttccgtcatagcgataacgagctcctgcactggatggtggcgctggatggcaagccgctggcaagcggtgaagtgcctctggatgtcgctccacaaggtaaacagttgattgaactgcctggactaccgcagccgaagagcgccggacaactctggctaacggttcacgtagtgcaaccgaacgcgaccacatggtcagcagccggacacatcagcgcctggcagcagtggcgtctggcggaaaacctcagcgtgactctcccctccgcgccccacgccttcccgcaactgaccaccagcgaaacggatttttgcatcgagctggataataagcgttggcaatttaaccgccagtcaggctttctttcacagatgtggattggcgataaaaaacaactgctgacgccgctgcgcgatcagttcacccgcgcaccgctggataacgacattggcgtaagtgaagcgacccgcattgaccctaacgcctgggtcgaacgctggaaggcggcgggccattaccaggccgaagcagcgttgttgcagtgcacggcagatacgcttgccgacgcggtgctgattaccacggtccacgcgtggcagcatcaggggaaaaccttatttatcagccggaaaacctaccggattgatggaagtggtcaaatggcgattaccgttgatgttgaagtggcgagcaatacgccacatccggcgcggattggcctgacctgccagctggcgcaggtagcagagcgggtaaactggctcggattagggccgcaagaaaactatcccgaccgccttactgcggcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagtcaacagcaactgatggaaaccagccatcgccatctgctgcacgcggaagaaggcacatggctgaatatcgacggtttccatatggggattggtggcgacgactcctggagcccgtcagtgtcggcggaattccagcttagcgccggtagctaccattaccagttgctctggtgtcaaaaataa

SEQ ID NO: 4016 - DNA, 783 bp, Klebsiella pneumoniae
aaaattaaacaggtgaaggagaataatatgcgtttagcatcccgatttggacttactcattccattcgtcaggaacgcccactgactaacgatgaattggtcaaggttgtaccttctgtgttttcagaagaaaagcataattcacgtagtgatcgctatacctatattccaaccattacactgctggataaattacgtgaagaaggtttccagccattttttgcctgtcagtcacgagtaagggatgaggataaacgggggcatactaagcatatggtaagacttcgccgtgaaggggccaataaaggaacagaagtacccgaaatcattcttcttaactcgcatgatggatcgtccagttatcaaatgatcccgggtatgttccgttttgtatgcacaaatggccttgtgtgcggtacgtcgtttggtgagattcgtgtacctcataaaggtgatattgtgggaagggttatcgaaggtgcttacgaagttttgggaattttcgataaaataactgaaggcgttgatgtcatgaagtctattaccttaaccaaggaagaacagcgtctgtttggacaagctgcattaacctaccgatatgaagatgaaaataaatctccggtcagtattgaacagataattcatccgcgccgttatgaagataaaaaatatgacatctggactacatatcaaagggtccaggaaaatctgattaaaggcggtttgcctggccgaactgaaaaagggaaaaagaacaacaacccggccagtaaaagcaattga

SEQ ID NO: 4017 - DNA, 351 bp, Klebsiella pneumoniae
tcagcaaaacagacaggagtgttcatggaagagaaaaaagcatacgggctggtcatggtgtttgtcggggtgtttgtccttatcctggtcagcataatgtcgtacagcctgtggcgggacaggcaggttaacgcatttatgaccaccaaccgggcctgggggatccagtgcgacactgtttctcaggccgcgtgggtggtcagggacggggagcgggtggaccttcagataaatcatctgcctctgtactgcagcggttaccgctttgaagcccgtgatgatgcaggaaagatacagcgccagctcgataaatacagtgtctatcagcatctgtcacgccagtcgcaataa

SEQ ID NO: 4018 - DNA, 570 bp, Klebsiella pneumoniae
catatggaacatggtgccagacaaaataccacccgcgttatcgctgtgggatttatcagtctggggacactcctgaccctcagtcttgcgaccaatattatccagggcataaataattaccgtctgcagacggaacagaaagtggcggtgacaccgatgttattccgagccccctttgcggtgtctcagaaccaggctgacgcctcttatattgagcagctgggcctgtcctttgttgccctgcgtctgaatgtcacgccggaaacggttgatgcccagcatcagcagcttctccggtatgtattacccgctgcgcagaacagcctaaaggtccagctggctgaagatgcgaaacgcattaaagacaataacgttaatgccaccttttatatgacctcgatccgtgcgtggccggcagagaaccgcgtggatatccggggtgagctgaaaacgtggattggggattccaaaccctacagtgaaattaaaagttatgtcattcagttcagtcgtgtcgatggtgtcagctggctggcgcgttttggagaaataaataatgaaaaaaattaa

SEQ ID NO: 4019 - DNA, 309 bp, Klebsiella pneumoniae
acaccagcgcatatcgctttctgccaccgctatcttgcccttatgttcacgcttcggtcgctctggtttgtcatgcaacaacaacaggttatgctcgctcattatcctgtagagccgtttggcgttcacaggtggctgtccctctgtgcgacgttgcttgcgcaggatgccccacacgcgtcgataaccataactcggcatatcgctgatgatgtcgaggatagccgacagtatttcttcgtctgcttcgtcattacgccggttacagcgcttgtcctgccagtcggcagaacggttaatccgcagtga

SEQ ID NO: 4020 - DNA, 312 bp, Klebsiella pneumoniae
ggcgaagcgcagtcgcgggtgagccaaaggagagccagcatgaacttcacgataacatcccgtaaaaccggcgaaattttcagtttttacgcacccgacagtggcggttatgttcacctggagtccccgggacattctggtaacaccggcgcccagatttgctgtggtggagggttcatggggagtacgctttcctgtggcgcttctgaggacgatctggccagtgttgcccgtaaatggtaccgacagttcgtgagggagcggcgcaaattcttaatgatgtcgggccagtattctgaggataaccagtga

SEQ ID NO: 4021 - DNA, 243 bp, Klebsiella pneumoniae
ctacagattaaaatagtcatcaacaggttgacagcattaccgactgaccttatccatagcggtaacctgaccgttaacgaaattaaccgctcagccggatttctcatcaacagttttgatttgccgggcattggtatattcatgggcatcagcgcccgctttctgcgtatttttcgatttgcactgccgggggcactggcgggtatcgcgttccgcacacttttacatttatttatctggtga

SEQ ID NO: 4022 - DNA, 387 bp, Klebsiella pneumoniae
agttcctgtttggcttcgcgattatttccacctttatcaccatcggtatgtcggtcgccggttactgacaggaagcacgtgatgacgggagacgaattaaagcgataccgtttcccggaaacactgactaaccagtcccgctggtttggcttatatctcgatgaacttatcccggccgtgatttgtctcggctggggtttctggaccagcaagttcatttttggtatggctgcagcggcactggttttctggggtatcaagaaactgaaaaaagggcggggcagttcctggctacgcgacctgatttactggtatctgccaacctcccttcttaaaggtttctttcatgatgttccggactcctgtttccggcagtggattaaataa

SEQ ID NO: 4023 - DNA, 348 bp, Klebsiella pneumoniae
agacaaatcctcaacaacgtgaagaagtggcagatcccgcgattcatcaacacggataaagcgcccgcctatggtcgcgcgcttgctctgctcaaacgcgaaggccggtgcccgtctgacgttgaacaccgacagattaagtaccggaacaacgtgattgaatgcgatcatggcaaactgaaacggataatcggcgccacgctgggatttaaatccatgaagacggcttacgccaccatcaaaggtattgaggtgatgcgtgcactacgcaaaggccaggcctcagcattttattatggtgatcccctgggcgaaatgcgcctggtaagcagagtttttgaaatgtaa

SEQ ID NO: 4024 - DNA, 345 bp, Klebsiella pneumoniae
cggactttcaatatgttacccacacggttatcccccgttactgtggataatcaatatattgtgtctctggcagttgcttttcctaccatatgttgtccctccccgttctattttgtgatcgcacagtgtgaaaaacgacatcacagtggagacgctgctgacgggatgatgttcatccagggtcgtaagatcggccggtactggttacccgccggacgaagggccggccaacgcgcagcgtcggtagctggctttaaaaatgccggcggaaacttaaagattaagctgcatactctgcgaaattttgcaaatttcactcaacatgcttcgttcagatcccaatag

SEQ ID NO: 4025 - DNA, 225 bp, Klebsiella pneumoniae
ccacccatcaaacaggattttcgcctgctggggaaaactagcgtggaccgcttgctgaaactctctcagggccaggcggtgaagagcaatcagctgttgcccgtctcactggtgaaaagaaaaaccaccctaccgcccaatacgcaaaccacctctccccgcacgttggcagattccttaatgcagctggcacgacaagtttcccgacttgaaagcgggcagtga

SEQ ID NO: 4026 - DNA, 261 bp, Klebsiella pneumoniae
aaaagaggcaatattccactgcgacatacgcaaattcagcaaaagaagaaaaggtacgcagatattacgctcttaatccttaactggcgacctgttgaggtgaggccagtacgcagcgccgcaggtgtggcgaaccgcctcaccggcaggcgaagcctgccaggattttcgcgcggccgcaccgatctgcaaagccgggtaagctcctcacagatcgtgccgtctcagaccttaaacggggcgtcgggcgccccgatatag

SEQ ID NO: 4027 - DNA, 195 bp, Klebsiella pneumoniae
ttgccatgttttacggcaatgagagcagagatagcgctgatgtccggcagtgcttttgccgttacgcaccacgccttcagtagcggagcaggaaggacatctgatggaaatggaagccacgcaagcaccttaaaatcaccatcatacactaaatcagtaagttggcagcattaccaatcatctgttctccaatga

SEQ ID NO: 4028 - DNA, 381 bp, Klebsiella pneumoniae
aaggaaataaatatgaatgctgtattaagtgttcagggctctgctgtccctgaaaaaaccaaaccatcttttatgtcccgcgttttcaataaaaagaaagccctgaaagccgctaaagttgcgctgccggttgctgctgtggcggcgttcttcccggatgctgcgatggccaccaccacggcaaccgacctgatgaagtccggggatgcgaccgttaaaggcacgtttggtaagcagtccagcgtcgtcaaatgggtggttctggcagaagttgtcgccggcggcatcatgtacatgatgaccaaaaacgtgaagttcctgtttggcttcgcgattatttccacctttatcaccatcggtatgtcggtcgccggttactga

SEQ ID NO: 4029 - DNA, 531 bp, Klebsiella pneumoniae
ataagacaaaaggctgcctcatcgctaactttgcaacagtgcctcacgatccccttttcatgcgcggctctgacaacagccatacccaacggatgctgcgaacctttttccactgcagctgttacacgtaaaagagatatttccccacccggactgagactgataatccctgtcaccgtaggcgaaccttccgtgagcgtgcctgttttgtcgacaaccagcgtgtccactttttcaagacgctcaagggcttcggcattcttgattaacaccccggcctgggcgcctttgcccacccccaccattatcgacatcggcgtggccagtcccagcgcgcagggacaggcaataatcaggaccgacacagccgcaatgagaccgtgcgccatcctgggctcgggcccccagacagaccagatcaagaaagcaacaaccgcgataagtatcaccagaggaacaaaccagcctgaaacgctgtctgccattctctggatgggggcacgcgaacgctgtgcatcagcgaccatctga

SEQ ID NO: 4030 - DNA, 738 bp, Klebsiella pneumoniae
aaggaaaaaaacatgagagcacaacacacatttccaggtgcgacagaccgctggcttcatcgcctgctgacctgggcaccgggacaaacggatatgattaaaacggtcgcactggtactgatggtgactgaccacaccggcttactgctggccggaaacaatgaagtgatgcgcctgctgggacggggctgttttccgctgttcggtctggcatggggaatgaatctggcccggcacgcggaaatacgccagtcgcagctgaacagcctgtggggctgggcgctggtcgcccaggtgtcgtttatgctcatcgggtacccgtggtattccgggaatattctgtttgcctttgccgtcacgggccaggtcctgcggtgggtcagccagccgtcctggtattacaccctcccggcggctggactgctggtcgcctggatacccctgtcaaccgccagctacggcatggccggagtgggcatgctcaccgccagctggctgctttgtcgcgcacagcatgcacaggaacggctgggatacggggtgctgtgggccctcatggtgttgctgatgaatatgcatgacgtgagtgaatcagtggccgggctggcgattgcgctgctgacgctgatggtgtgctcatctgccggagaacgtgtgaaacgcttctggccgcggcagttcttcgtgatgttctatgcggtgcacctggcggtactcggtattgtcgtctcgatgtaa

SEQ ID NO: 4031 - DNA, 744 bp, Klebsiella pneumoniae
ataatgaaaaaaattaacccgttatttatttcaggctgtctgctgttggtcgcccccgcgatgtcagcgacccttagcggaacgctggcgccgacagtggttcccctgaccaatggcggtcaggcaaatattgccgtgagtaacaccgatccgaatctgttcacagtacctggagatcgcatcacggcgataaacagcctggacggcggtctgacaaaccaggagcagaccgacagcggcggcgccattctggcgaccgtcagtaaaaaaccattcaccttcattgtggaaaccgaacgcggactgaacttctccattcgtgccgtgccccgtgcgggctcaggccggacaattcagctggtcagcgagctggcagggacacccggtccggcaaaagcctgggaggagtcgaacccctatgaatcgttactggtttcgctgaatcgcgccgtgcgccagggcagcgtacccgatgagtatcagtctgtccccgtcacttctgaagtgctgcaggtgccggctggtctgcgcgccactgccgatcgggtctgggtcggtcatcacctgaaagttgtccgttacagtctggacaatgtctccctgtcggcccgtatggttcgtgaaagcgatttctggcagcccggaacacgtgccgtcatgttcagtaccccggcaggcctgctgactgccggtggtcgcatgcagatctgggtcacgacgtcagatgaaggagtggagcgctga

SEQ ID NO: 4032 - DNA, 354 bp, Klebsiella pneumoniae
ccagtgaaaaaagagatctcccgcaacccctctttcacaccttcgcctaagctgcgagcacatctgaactcccaccgggaaggggtgactgaacggctgaataatatctttgatcgctatgcgcatctggttcgcgcctgtgcccttcctctcgatgacgacgaaacacaggttctgcttaatgtgctgaatggctccgttgtggaacccgcctttattgaatatctggctcaggaaattcgggactcggatgattatctggaagggatacccgcagctaaatcactgtacgaaaagtgtcagtcagcgacctatccgcaattgctggccaccgtcgaacgtctggaacgataa

SEQ ID NO: 4033 - DNA, 441 bp, Klebsiella pneumoniae
gcgaggaaaaaaacgatgaagttcattcctgcagtatcagaagccagcatagtaaaaattcctttgttcacagagcgatgccctgcgggttttccgtcaccggcatcagactacactgagtctgaactggatctgaatgagtactgcattcaccggcgccactccacctattttgtcagggcgattggcaactcaatgactgatattggcctctattccggcgatctgttggtcgtggataaagcagaacagccgcggcacggggatattgttatcgcggaaattgagggtgaatttacggtaaaacgcctgcttctgacgccgcggccagccctgcaggcgatgaacccggacttcccttccctgtacccggatccggaaacgctgcaaattttcggcgtggtgacagccttcattcataaaacccggagggcagactga

SEQ ID NO: 4034 - DNA, 627 bp, Klebsiella pneumoniae
aattccgaaaaaataacaggaaggctccccggcatcttgccggggaggtcagggagtacattcatgcatcatggccttaaacaccgtattcaggcgatgcgggacaaactggaagggcgcgcccctgtcgctgaaattcagggtagttcgcagctttttgtcaccccctccccggaatgtcgccggctggttgagctggctgatgtccgggaaaccgatcgcattctggaacccagcgccggaacgggcgccatactgcaggcgatcagggatgcagttccccgggcgaagtgtgacgccgtggagctgcacgccgggttagcccgtcacctgcaggcgcatttcccggaggtccggatctggtgcggagattttctcgaatatcatccggagcgccggtatacacgaattatcatgaatccgccgtttcatcgcggtgatgatatccggcatatccggcgggcattaactctgcttgagcctggcgggattctgactggaatatgtctggacggcccgcgtcagcaaaaggcgctggagtccctggcggacgtctgggagccgttgccgcggggaacattcacgtatacccaggtagcgaccgccatcctcagaataaccgtctga

SEQ ID NO: 4035 - DNA, 585 bp, Klebsiella pneumoniae
atagcgagaaatatcatgaaggaattaatgctgttaattcctctgggcagcgctttgctcttaaccgggtgtgcgggcacagagaccgaatttcaatgtaatgccacgacgtcggatacctgtatgacgatggaacaggcaaatgaaaaagctaagctgaaagaggaacgcagtgacgcaaagccggctgcggccggattgccacgactggctgacggaaatttcagaacgacgtcgccaaactcatatccgctgccgccacagccagtaattaatccagggcgtaatacagcgccatctgtgacggtgagtaataaacccgggttcctgaatacggtaccggtcaattatgatgacgtcctgagaacacggactgctccggtatatatcaggccagttagtcttagtacttatacttctccggcgacaattccgggtaattatccccgaccattaagaaacggggaggagacaacgtcattgtggatagcgccgtatgtggatgcagatgatgtatatcaccagccggcaacggttctttttgtcgtaaaaccatcggcgtggggacaacctcgccttaattga

SEQ ID NO: 4036 - DNA, 246 bp, Klebsiella pneumoniae
aaatcaggaaaaagaaaaatgcaggatccttcattgcgaacgtatcggatcgcatttctgggacgcaatgccagcggcaatctgccgatgtttacccgggtgcaggccacgaccggaaaacgggcgataaaagcgtttattgaacgctgtgaacccgtcaaaggctggtttctgggcgcacctgaagacattaccgatcaagttaagaaggaggaagaagaggcgggaagcaaaccgcaggtatga

SEQ ID NO: 4037 - DNA, 207 bp, Klebsiella pneumoniae
gccgcaggaaagataatggcaaaaaaaattccgagaatgggcgtcagttttgtggcatatgcgggcgtgttaattgcgagatgtattaacctatggagagcagttccatctatactcctgtcagcccatgctggaaatattgttatcactagtcctatcacggaaaagttaattgtatattctaaccctacgcagtattccgcttaa

SEQ ID NO: 4038 - DNA, 1827 bp, Klebsiella pneumoniae
cataccctgaagacagaagatgcttcggtatgcataaggagagttactgtgaaaaatgacaatgcagtgcaacacaacaaccagactgcttctgagcagacattatccccggacgagggccacgtattgcataaggtgagagatcccgtgtgcgggatggccatcctgcccgacagggcgcacagcagcattcgataccaggaccaccaactttatttctgctccgccagctgtgagagtaaatttaaagcccatcccgatcgttatcttaccgaagatgccagtgaacattcccatcaccatcaccacgatcatcacgaagtcagccctgatcagataaaacagcctcacaaccaggcggaaaaagagaattctgaaggtgtgtggacatgtccgatgcacccggagatacgccgcagtggtcccggaagctgtcctgtctgtggaatggcactggagccgctcgtagctacggcatccacggggccgagtgatgaacttcacgacatgacaagacgcttctggctggggttgttgctggcgtttccggttctggtactcgaaatgggatctcatctgtttcccgacttgaggaatacagtaccgccacagtacaacacatggctgcagttgcttctggcctcccctgtcgtgttgtggtgtggctggccattcttcgcccgggccggaatgtcgttacgtaaccgctccctgaatatgtttacccttgttgcaatggggaccggcgtagcctgggtttacagcgtcattgcaaccgtcttcccctcctggtttcctgcatcgttcagaaacatggatggcctggtggccgtttattttgaagccgcagcagttattacggtgcttgttctgctgggacaggttcttgagctgcgggcacgggaacaaacctcaggcgccattactgcgcttctgaaccttgcccccaaaaccgccagacggctggatcatgacggtcatgaaacggatattaatgcggaagatgtcctgcctggcgataagctccgcatcagacctggagagagtattccggtcgacggtatcgtgatcgaaggcaaaacaaccgttgatgaatcgatggtgaccggggagtctatgccggttaccaaaacgaagggtgaccctgtcattggggggacgattaatcagacaggtagtcttatcatccgtgcagagaaagtcggtgatgaaacgatgctctcacgaattgttcagatggtcgctgatgcacagcgttcgcgtgcccccatccagagaatggcagacagcgtttcaggctggtttgttcctctggtgatacttatcgcggttgttgctttcttgatctggtctgtctgggggcccgagcccaggatggcgcacggtctcattgcggctgtgtcggtcctgattattgcctgtccctgcgcgctgggactggccacgccgatgtcgataatggtgggggtgggcaaaggcgcccaggccggggtgttaatcaagaatgccgaagcccttgagcgtcttgaaaaagtggacacgctggttgtcgacaaaacaggcacgctcacggaaggttcgcctacggtgacagggattatcagtctcagtccgggtggggaaatatctcttttacgtgtaacagctgcagtggaaaaaggttcgcagcatccgttgggtatggctgttgtcagagccgcgcatgaaaaggggatcgtgaggcactgttgcaaagttagcgatgaggcagccttttgtcttattcaaaggccttacatttcaaaaactctgcttaccaggcgcatttcgcccaggggatcaccataa

SEQ ID NO: 4039 - DNA, 219 bp, Klebsiella pneumoniae
cgcaaaatgaaagtatacggccatcaacactcatcagaggctttcttccgggaaacttccccatcctgttttgaaccaaaagcggaaaaggtgatcgcttttcatggaaaggatgccagttacgcctataacgtgctggccgatctgaaagccgcaggtgcttcatatacgcgccggaatatcatcgccgatatgttccgccgtctgggtgtgaaatga

SEQ ID NO: 4040 - DNA, 396 bp, Klebsiella pneumoniae
acagtgatgaaaaacaacaccgaacaaccggtcagtacgacctctcatacctttcgccggatatctgtcatcgttgctctcgtgcttttcgccctggcaaccagcgcgtttctctcacgcgtggttctggagtactccacgccgcgagtggtggcttttgatatgaagaagacgctcgacagctttatggacagtgtcagtcagaagcagctgacagaagcgcagtcaaaagcgctctctgaccggtttaacgacgcgctggagaagagtctggcggagtatcagcagcagcatcatgtggtcattctggtttcacctgccgtggttcagggcgcgcccgatgtgacccgcaacatccagcacgacattgcccgccggatgaaaggagaacagtaa

SEQ ID NO: 4041 - DNA, 297 bp, Klebsiella pneumoniae
accacgatgaagacgccccgttcaggcggggcagaaaaggagaaacacatggaccataacgttttgtccccgcttgtatccctgccggatggcacgtttacccgcgagcaggctcaggttgtcgcagcgcagtatcagaatgtggcgattgaagatgaccaggggacccattttcgccttgtcgtccgtcataaggatgacggcagcatgatctggcgcgtatggaattttgaaccgggcggcgaggacataatgaaccgctacatccgggactacggagtacgcaaaacgaagtaa

SEQ ID NO: 4042 - DNA, 372 bp, Klebsiella pneumoniae
ttaatcaggaaattaaaaatgcgtaattcacttaaagccgttttatttggtgccttctctgtcatgttttctgccggtcttcatgctgaaacacatcagcatggcgatatgaatgctgccagtgatgcttcggtacagcaggttatcaagggcaccggtgtcgttaaagacattgatatgaatagtaaaaagattaccatttcgcacgaagcaatccctgctgtgggctggcctgcaatgaccatgcgcttcacttttgttaatgcagacgacgctatcaatgccctgaaaaccggcaaccatgtcgatttctcgtttattcagcagggcaatatctccttactcaaaagcattaacgttacgcaatcctga

SEQ ID NO: 4043 - DNA, 717 bp, Klebsiella pneumoniae
aatcctgttgaggaggctcctatgtgttcgatggatcgtattgaaaacaccaactgtagtcaattggatttctttcgtgaaatgcaattaactgtcaacctttctagccatcctgcttgtataaggctccgtgatggatccttttcccatttcaatcattctttcgctacaacttttctgcacaatattaacgttaacatatggtttaaccgtctggaaatctcctcttctttacgtctgtcagctcttgacgccgaagtttactcaggcgatcgaaaaatgcttattgaggaaaatttgcccattaatgggaaccgatgggattttataatagaacggatgtcatttgatggaacggagttcactctgtggaagttctgtcatcttcaacgaggcggttttttactgtctcctgttcgttctggttttataaaaaaactcaacgaatttaagaatgcactcggttttttaactgatgttcagattgagactctggctctatattcttttggtgcctcccacaatcagatttcagaggttttaaatatagcggttggaacatcgaagaacagagttaatcgtattcttgcagctttaccaatccgcacgagagaagaggttttttattttttattcgccagtggaatggccttttcattctgtaaggttgttacagaattaattggaagtcgcgttaataaattgttaactaaatag

SEQ ID NO: 4044 - DNA, 414 bp, Klebsiella pneumoniae
aaaatgactgactcaatgaaatatctatggctgcttttgcgcgaggattcgtcatatatttttatgttgatgctggttattgtcactaccgtagtaatgtctttctttttgcagaggttgtttgtgtcctggtggggtaagtcaatcattctgataatgtgtattgtcgtcgcgattacagaagtttttggctttcttgagcctgagtcaacatacaaacagattcaaaccagaaaacaggatgtcatctatacgctgaaaaactgcagaatctccgcatttgaagcgcagcaggcagggtttctggctaaagcaaaagatgcctggtcttgcccggatggcgtaacacggtatatggatgtgagatacagagataaggcagagattaataaactcagtacggagggtaagtaa

SEQ ID NO: 4045 - DNA, 264 bp, Klebsiella pneumoniae
ccactgtatgatgatacttacctattcgctgagaatctcggcaactttatggcagggaagcttttagagactataccgtctcgaatttccgtttatcgctctcagcagaccttcagcatcctaagcttgtctgctgtaggccaggagcggtcatttatacgtagtagctcaatgactgcttcgtacataaagctgtcattggactttctgaccttacaaggtaatctggcttgcaaggaagccgaccttgcgggaccggtataa

SEQ ID NO: 4046 - DNA, 525 bp, Klebsiella pneumoniae
tatggccatgaatggcgtcggatgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacagtggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatggatgacggatggctggccgctgtatgaatcccgcctgaagggaaagctgcacgttatcagcaagcgttacactcagcgcattgagcgacataacctgaatctgcgacaacatctggcaaggctgggacggaagtcactgtcgttctcaaaatcggtggagctgtatgacaaggtcatcgggcattatctgaacataaaacactatcagtaa

SEQ ID NO: 4047 - DNA, 525 bp, Klebsiella pneumoniae; identical to SEQ ID NO: 2057

SEQ ID NO: 4048 - DNA, 216 bp, Klebsiella pneumoniae
ccccgtgatgaccacgatcagaataacctgcaccgtttcattgatgggcaccccgaaaagatggttcaaaccggcattcacctgcaaaacgccgtaacccagcgatgtcgcgacgccaaagaccgtgcctataacagcgaaaatatcaaccgcatggcctacaggcccgtatatgcgatcgccaataatgggatagagtgcggagcgcagagttaa

SEQ ID NO: 4049 - DNA, 2037 bp, Klebsiella pneumoniae
tgcgccctcgaatgccgccgggagccagccatgaaagataaaccgtacttcatggcgttaccggaaatggtgagggtggaaatgaagacggttatttccgtactgactgcgcatttttttgtcctgagcgcctttatctggctggcatcccccgcctgtgctgacagtggaagcgactataaagctggttcggattttgcgaaacaggtgcagagcaatggtctgaactcactgaaaaatttcagtggtgagcaaaacctgccggggtataccgacagccctgatcagacaaaatactatggcggcgtcactgccagcggagacagctctctgaaaagcgattcagccctggagttcagccagggagataccggcaaagcgattactgagtcgttcacgaaccggccaccggatcagatatctcaggatgcgccgtttattcaggccgcaaaggatacagaatcccgcgccgacagcattgtcggcgataccggacagtcctgtaccgcccaggttgttaaccgcagcgaattcacaaatcatacctgcgaacgtgatctgcaggtggaaaatttttgtacacgggaagcgaccctgaaggataacgccaccacgcagaaagttaaccgaacctatcagcaggtggtgacgctgaattatgcccggagtacccggcaatggagtggcaacctgacgatcccgaccaatggtcgtctgctgaatgcctcggtggatggtgagcctctggtgatcccctggattgaagaatgcgattccgaagggaaggtgcgggatagctgcaagagtgcagtcagtgaaagcctgaccctctttgaacgaacgttccccattgatgtgatcagctggccacgttcagaatcgatgtgttcaggcggtcagaacacgcattgtacgaaatatacctatgacgggaaggggaagattcatcagtcgtttggtgtggacaaagcggttaatgcaggccagaacttttcagtaagcaaaacatcacggaccgtatcatcggccagccagaaacccgtacaggtcacggtcaccctggtgatggaagaaaccgaaaccgtctacgcacctgaagtcgtctgggttgaaagctgtccgttcagtaaggatgaaggaaaaaaaacgggcgaggaatgtatcagcccgggaggaacgcgaaccatcaccctcggaggcggggattactcgttcacggaagcatgctggaaatataaggatacctggctcacgcaaccggcggacaacggctcctgtgaaagcctgatgaaaaatacggcctgtactctgtcatcccgccagtgcgccttctccagcgaggaaggcacgtgcctgcatgaatatgcaacgtattcctgcgaaaccaggacgagtggcaagcaaatgatctgcggcggtgatgtcttctgccttgatggtgaatgtgacaaagccacgtccgggaagagcaacgactttgggcaggcggtgtctgagttggcggcactggctaccgcggggaaggacgtcgcggcactgaacggggtggatgtccgggccttcaccggaaaagcgaagttctgtaagaagtttgctgccggcttcagtaactgctgcaaagacagcggctggggccaggatgtggggctggcacgctgcagcagcgaggaaaaggcgctggccaaagcgaaaaaagacaagctgacggtcagtatcggggaattctgctctaaaaaggttctggggatttgcctggagaaaaaaaggagctattgccagttcgactcaaaactggcgcagatcgttcagcagcagggaagaaatggtcagttgcatatcggttttggcggcgccagcagtcctgactgtcgggggattacggttgaagagctccagaggatcgactttaacatgcttgatttcaccaattttatggacgacctgatgaaaaatcaaaaaataccggaaaacgatgttctcaccaataagaccaaggaacgaattaaggaaatcatgagtcagcaatccgcgcaataa

SEQ ID NO: 4050 - DNA, 201 bp, Klebsiella pneumoniae
actctttccgagcggaaaagttgggggggtaatcatccagaagcgacctatcaattatggtggtttattaacagactaaaaatttcttttggttattattatctgtctaggttgttattggtttttacatctcgcttaaaattcgcatatagtgaatgcgcattccgaaatcataagagaatgtgtatttactcgtattga

SEQ ID NO: 4051 - DNA, 237 bp, Klebsiella pneumoniae
gtttcgcgtttccgcgcaattgcagcaagctgcctctcactggcagacattggcttacctttccggtatgcacgttttgcattcgtagaggaagtggttttatctgctgaacgtgacatttatcgctctcctgacacctcagaaatgtcttcggaacggaggatactacagaactctcagatcctgcaaatcaataacttactttcaatttgcaagagatcctttctaaaattgtaa

SEQ ID NO: 4052 - DNA, 414 bp, Klebsiella pneumoniae
atgattagcgatgccaataaagcggtgaatgacctggcgagtattgtccctctgctgggtggcagttcgtcccgcaaagattacgaagaggcacgtaaactcgttgaatatcttctggaacatgatccgggcagcccgctggttgatatgctgactgcccgcatcgatgcctgggaagataacgcggtggaatttgaagaatttaatacgcgcttcgaagcaggcaaaaacggtgtatcgttgctgcgggttcttatgcagcaatacgggctttctcagtccgatttcgaaaacgagataggtaataaatcgctcgtcagccggttcctcagtggtgaacgcagtctgacctttgatcacatgcgggcgctggcaaatcgatttcaaatcccggtctcgatgtttgttgactga

SEQ ID NO: 4053 - DNA, 498 bp, Klebsiella pneumoniae
caacccggcctgcgccgcctgataacggagacgccgccctgcggggcggcgataaggagactgaaaatgaaaacgttactgactctggatgtcctgaaaaccatgtcttctgatgagctggaagactaccgcgccgccggtgaagactttcgccgggagctgagtcacgctgtcatgcgcgatctgacctcaccgtccggctggtccgtgaatgccgaataccggtgcgaatttggcggcttctttcctgtccagatccgttttaccccccctcatggtcactttgatgtggcggtatgcagttcgggggagctgaatcctcgctggatagtggtctttgttacccgtgacagtcagccgttctctgtcgttcgcgtgatggatgcattcaaccctgaactcatcacccatactctggatctcatcgagtgtcttgacgccggtggctactcgtttgccagcatcatcagcacgctgtcacaggaaggcgcacaatga

SEQ ID NO: 4054 - DNA, 183 bp, Klebsiella pneumoniae
gtgcctgaagagtctgacccggtctgcgggctatctgtcccggatgaaagaggagccgcccgctatgatctgcaggggaacgccgtcgcgaccgtcactgcaggggaagcgcagtacgccagcgagcgcatgatgaaagaactcctgcgaactgagcgtatgcggagccagtcagctggctga

SEQ ID NO: 4055 - DNA, 264 bp, Klebsiella pneumoniae
gggtgtagagactcaggagcaggtgaactatctgaagacgttctggccacagagttatgctcagggctggtattactccagagcgcttccgctggaagaagcgagaaaacttaccatccgggaattgaactgaccggcactttcagcgcaaacactcagcaattgcttgccgatcagctggtagaaattgaagggcagtgtaatcacctgctgctggcgcaggggaaagcgttactgaaaagtcgttctgaactgcttaaataa

SEQ ID NO: 4056 - DNA, 246 bp, Klebsiella pneumoniae
gtgaatggagataacgaacatcccgcaaaacccaaccaccgctataagtgcacagtatatgaatgtatcacctctgttaactccaagattgaatttttcagggatggcaaccattgccagcgcaccgaccacaccaataacaaaaagaatcaggcatataccgttaagccatgcaacgttatgtccaagtatatagtacgttttcactttcttattccttatgctgcatactttcaaataacgtga

SEQ ID NO: 4057 - DNA, 585 bp, Klebsiella pneumoniae
tacgacctggacgaaagcaaacaaactggcagccgcatggctaccaagggttcgggttcttcatccatggcctgtggagcggttcaccgccagacacccgaggcaggagcccggtgcgtaaatcgcgcacgccgggatctgtgcggggggtatccggtaacgggtatccctaccgcgacattattttgcggaggccgtttttattcaagtcatcttgttgccgttgtctgtaaccatttgctgttcctgcaaaaacagggaaatttcagaaggatcgctgccagtccggagaatcgttatctaataaaatgtaatatactgaagtacagtgcatttattctgagtggagtgattatgaatacgggtttaaggcaggttctgcgatatgcaggcgtcccggttgacgccgctgaaccggtgcgccggcaattcggtagccgcctgattttaatcgtgacggttgctcttcttccgctgttgattgttgacgtccctctgtggctatttgtgctctctcagattatctggggaagcggtatgtacattggtatctccgtggccagtgataaaccagatcgccgataa

SEQ ID NO: 4058 - DNA, 264 bp, Klebsiella pneumoniae
cttaagatggataaaaaatatgatttttcgctcagttatgaagccttaacacgggtatgtgaaaatgcaatatgtgaacatattcgcagagcaggttctctggaagggttaggtttcgcacttgaatatacaaaggcctatgctatcctggaagtatggtctctgctggcagctgctggcgatacatttccagctctcattgagaaagacagaatatatctgttgcaactaatttccgggaaaaataatatagagctacattaa

SEQ ID NO: 4059 - DNA, 2409 bp, Klebsiella pneumoniae
cagcctccggatagctgtcctgaagcaataaaccgcacgccgtatttcagaaaattggaaaacaaaaaaaacaaaagaaggaaatgtgtgattggtggatttaactataacggtgagggtgctacgagctcaggccttagctctccttctgccagtgatgtggctaatcagtttaatagttttggtgggacgcaaatccgggcatcagatgtctcgaatattcgcagtgatggtaatggtgggtatatggcggatattcgggggcagattcacactgtgtcctctgaggaaggctcaacaactgtcagtggcttcgatggtgtccgcagttcttctaccggtaatggcggaagtcagggtgggcaggggccacagggacagtctcttgttatgcataacgggcagatgggatactgggaaaaccgatcatccggggctggtaataacgaacatactacccgcgcttttgtggctgtaggtccatcagaagcagaaaaagctgcacgagcggagaaggtagctaaggaaaaacagcaagcagaagaggctgcaaaagcattcgcagcgaaaacagcagcggcatccgccgctgctgaaaaagaacgtcagaatgcgatttctgctgcggctgctgcaggtcaacatcaaactgttcctgatgcgcgtaataatctgaatcaggcgactgctgaagcatcacgcctgaaaacagtggcagataatgcccttaatacagcgaagaataagcgaaaggaagctatcgatgccgtaccagtagcaactcaggctgagaaaaaatatcaggatctgcagcaaagcattaaaggcctcactctaaataataacggccaatacggtacccaaaaatgggaggttatcagttcgaataaagagcatgaccactggggataccggttctatccatctgggatcacaaaagctcaggttgatgcagcgcagaatgatgcggtgaacaaacgaaatgctgctaccagtcttgccagtcaggcaacggccgctgagcaggccagtctgcaggcatcagctgcctataatgctgcagaaacgcgccgtcaggctgcccaggctgcattagcgtccgcagaacaagccgccgctgctgaacgtaaacgccaggaggcggaagcagcagccgccgctgcggcagaaaaaaaacgacaggctgatgcagcagcgaaagccgctgaggaggccagagccattgctgaaaaagcaaaagcgctgcaggcccgttgtacagccgcagataaactgaaatcttcagagattcaggctgtcaggggtatcccggctacagcggcaccttttgctattcctctgacctggtcaactgcgtcacgtggaggttttactctgtcggctgatgctgcggccagcctgggagctttcatcagcgaggctctggcgacgttaagtgtcgctgtggtggctaacccagtagcattaaccattgccggtcttgtgttatcgaaatcagttggcgtcggtagtgatatggtgcccggtcgggatatcagttcgatgatgcctggcgatgcgtttggtctgcctgataccgcggcattgaataaagcagcagatcagaaaacatctgtcagtatgccggttcgtggccgtctggttatgaatgatagcggcattctggatgttcagctggtcaaaaccaatactgccggtgccgtgaaggtcgctcgtgctgtactggataaggaaaccggctactggggctatactcttcccgctgtcgcagatgtaccggcgcaaactatttttgtcagcccggctgacgcacttggtgcaaatggaccactgacgctaagcgggccggtaccactaccggagcgtattctgcataccggtgatcagatttcggcgccacaggctacagataaaaccgtgacgccggtagcggatgacctcgattttgacgatattattctggtgtttccaccggagtccggcctaaaaccgctgtatgtgatgtaccgtagccctcgtaacatgcccggtacagtaagcggcaaagggcagaacgttggcaataactggatggggggggccagtaccggggatggtgctcctgttccttcccagattgcggataaattacgcgggaagactttcggtagttttgattcttcccgtcgggcgttctggaaagcggttgctgacgattctgcactaagcaagcaatttagtgaagctgatattaatcagatgaaagctggaagggcacctactgcggactttttagaatcagtagggaaacgtgttaaaattgaattacaccacgaaaaagaaatatctcaaggaggggctgttatggatgtcgataacattaaggcgctaacacctaaaaatcatattgagacacataaaggaaaataa

SEQ ID NO: 4060 - DNA, 234 bp, Klebsiella pneumoniae; identical to SEQ ID NO: 2064

SEQ ID NO: 4061 - DNA, 234 bp, Klebsiella pneumoniae
tgctgccaacttactgatttagtgtatgatggtgattttaaggtgcttgcgtggcttccatttccatcagatgtccttcctgctccgctactgaaggcgtggtgcgtaacggcaaaagcactgccggacatcagcgctatctctgctctcattgccgtaaaacatggcaactacagttcacttacaccgcctctcagcccggtacgcaccagaaaatcattgatatggccatga

SEQ ID NO: 4062 - DNA, 2874 bp, Klebsiella pneumoniae
ctatcattttggggggaatctgtaatgcttgagatatatgccattgctggcggcgactggttacggggcaacctgaacgcgattgcggcgtttatggggaccagcacatggtcgactatagaaaagatgtgtatcgccatctcggtactcattgtggcggggaactgggtaaaaaaacacaacgtaatggaccttattggctgggtcttttccctcaccctggtctctatgctggttgtcattcgtacccctgtgcagatcatcgattacagtaacgttgcgcaggtctatgaagtcgataatgtgcctattggtctggcgattccggcgtcgctgacaacacgggcaggaaacgcgcttatccagagttatgagatggtcttcgctctgccggacagtgtcacgtacagtaaaacggggatgttatttggcagtaatctggtcgcgaaaagtacggattttttgtcacaaaatcctcagattacgacgctgttttccgattacgtacaaaactgtgtgatgggcgatattttcctcaatcataagtactcttttgaggaattactgaattcacctgatccgtataccctgatttttgcaaacccgagtccactgcgtggcgtgtttgacaaaaacaaccagttccagacatgcgaggaggcctcacgggatctgaaatcggctctcgtgctggatactcagacaggcggtaaaacctggaactactatgttcgtcagctgtttggcggcaaacctaatcccgatctgcttttcagccagatgattggcgacagctacaattacttctacagctcgggacagagcgccgggcagattatccgccagaacgtcacgatgaacgccctgcgcagtgggatccagagttatgcggcccgcagcggggacaccgccagtctggtcaatatggctaacacatcatcccttgaaaagcagcggctggcacaggccacaatggggcaccaggcgcttcgcacacttccgctgatgcagaccgttatcatggggataatgattgggatgttcccgatcatggtgatggccgccatgtttaatatgatgactctgcaggtgctaaaggggtatgtgtttgcgcttatctggctgcagacgtggccattactgttcgccatcctgaacagcgcaatggcctactatgcgaagcaaaatggcgtcccagtcgttctctctgagttgtcgcaggttcagctcaaaaactcggatattgcgaccaccgcgggctatattgccgtgatgataccgcctttgtcgtgggggatcgtgaagagcatgggagcagccttctccagtgcctacagccatttttcttcatcggggctcagtgcaacatcgcaggctgcctccggcgtggtggacggcaattactctttcgccaacatgcagatggagaacgtcagcggctacagctggggtaccaacagtacaaccagtttcggacagatgtcacggcagctggcgaatgggggcatgagcacgcagacgagggatggatcgatggtctgggacagtggtggtgcaatgtcaaaactgccggtggatatcaacgtcggtcgtcagatagccagtgcgcagcaacagatggcccgtgaggctgatgtccaggccgaaagcgcgctgcatggctataacagcagcgtgacaagtgcctggaatagtctgcagcaatttggtaccaataaagggaacagcgcctcaacaacgaccggagctgatactaccgagtcttcgcaggactcgatggccagaagcaagatgtggaatgcggttgttgctaatgcgaaagccaacaacatcagtaatgaggagtctttccagcagttgatggatgattcagctaaaagtacgcagggcgttgatttatacggatctggtaagtggagttcaggggatcagctgtttggtaagctaggtaaatggggaactgggttatctgctgaggccggagttaaaggcagtgcgggttggacccacagctcgggtaacacagataatgttggcacttccggtcgtgaatcgaatgacagccgacatgataccagtagtcaggcggccaaagactttaaggaagcatccgattactttaccagccgcaaaaccaccacatcgggcaacattaccgataataatgccagctcgcgtgttgaccagtttgccgcgtcactctccagtgccaaaaacagctatgaccagtatacaagcagccggacacgcagccatgagtacagtgagatggcgtcacgcacagagagcatgactggccagatgaacgaaaacctgactcagcagtttgcgaactttgttcagcatcgtgctccacaggatgcagaggccattctgaccaataccagttctcctgaaattgcggcgcagcgtgaagccctggcgcgtgaattcgtcaaagagcaggtagaacccagggttgatgctgcgtatcaacagggtcgtgaaagcattggacagaatatggctggggtgtcaggtggtggtgacaatggatcggtaatggccgactaccgacaaaattctggtcgtatcgatgctatgacgcaagatgcgggtattaaggataatgtggatcagaaagttggtgggatgattacagagaataaacaacagcagcaggaaacccgcgaaaacatacaacggcaaggcgcagaggtgaaaaatgagaatactgaaatggaaaaggaccataaaacaaaagcaaatgagtttaaaggtgattataatgaaagaaagagtaaggtgaaatctttaccaggagctgactcgcctactgagttagaggcaaaagcggcgaaaattcaaaaggattatcttgatggtaaaaggtaa

SEQ ID NO: 4063 - DNA, 5286 bp, Klebsiella pneumoniae
tgtcgagattggggggaacttctgatgatgtcgattggctccgttaaatcagcgggcagtgccggtaattactatacggataaggataattactacgttatcgggagtatggacgaacgctggcagggtaagggggctgaggcgctggggatcgacgggaaagccgtggataaggcgctgtttacggaactgctgaaagggaagctgccggatggcagcgacctgacccggatacaggacggcgccaacaggcaccggcccggttatgacctgaccttctcggcccccaaaagcgtgtcggtcatggcgatgctgggcggcgataaacgccttatcgatgcccacaaccaggcggtaaccgaagcggtgcggcaactggagacgctggccgcgacccgtgtcatgacggacggtaaaagcgaaacggtgctgaccggaaatctgattgtggcgaaattcaaccacgacacgaaccgtaaccaggaacctcagatacacacccatgccgtcgtcattaacgccacgcagaacggggacaaatggcagtctctcggcacagataagatcggtaaaacaggttttatcgagaacgtgtacgcgaaccagatagcgttcgggaagctttaccgggaggcgttcaaacccctggttgagaagcttggctatgagacggaagtcgtgggcaaacacgggatgtgggagatgaaaggggtccctgtggaacccttctccacccggtctcaggaggtcagggaggctgcaggacccgatgcctccctgaagtcacgggatgtggccgcgctcgatacccgcaagtcgaaagaagccatcgatccggcagagaagatggtggagtggatgaacacgctgaaggagaccgggtttgacatccgggggtaccgtgaggccgccgatgcgcgagccgcagagctggcccgtgcacctgccgcgccggtgaacactgacggtccggatatcacggatgtggtgacgaaagcgattgccggtctcagcgaccgcaaggtgcaattcacgtatgccgacctgctggcacgcacggtcggccagctggaggcgaaggacggtgtgtttgatctggcgagaaagggcatcgatgccgccattgaacgggagcagcttatccctctcgatcgcgagaaaggcctgttcacctcaaacatccacgttctcgatgaactcgccgtcaaagccctgagtcaggaggtacagcgccagaatcatgtctccgtcacgcccgatgcgtctgtggtgcgccaggtccctttcagcgatgccgtcagcgtgctggcgcaggatcgcctggtaatgggtattgtttccggtcagggcggtgcaaccggccagcgggagcgggtggccgagttaaccctgatggcccgggagcaggggcgtgacgtccatatcctggcggccgataaccgctcacgtgattttctcgccggtgatgtgcgtctggccggggaaacggtgaccggtaaatccgccctgcaggacgggacggcgtttattccgggcggaacactcatcgtggatcaggcggagaagctgagcctgaaggaaacgatttccctgctcgatggcgcgatgcgccataacgtgcaggtcctgctctcagacagcgggaagcgcagcgggaccggcagtgcgctgacggtgctgaaggacagcggcgtgaatacgtatcgctggcagggcggccaacagaccacagccgacatcatcagtgaaccggataaaggagcacgctacagccggctggcacaggagtttgccgtcagcgtacgtgaagggcaggaaagcgtggcccaaatcagcgggacgcgtgaacagagcgtactcaacggccttatccgtgactccctcagacaggagggggtgctgggtgagaaagacacgaccattacagccctgacgccggtgtggctggacagtaaaagccggggcgtgcgggattattaccgggaggggatggtgatggaacgctgggatccggagaaccggacgcacgatcgctttgtcattgaccgggtgaccgcgagcagcaatatgctgaccctgaaagaccgggatggggtccgtctggatctgaaggtttccgcggtcgacagccagtggacgctgttccgggcagagacactgccggtggcagagggggaacgtctggcggtgctcgggaagataccggacacacgcctgaagggcggggaaagcatcacggtgatgaaagtggaggaagggcagctgacggtacagcggccggggcagaaaaccacgcagaccctggccgtgggcgcgggcgtgtttgacggtattaaaatcggccacggctgggtggaaagtcccggcaggtcggttagcgagacggcaacggtctttgcgtcggtgacgcagcgtgagctggataacgccaccctcaaccagctggcgcagagcggaagtcatctccggctgtactcggcgcaggatgcggcgcgtacgacggagaagctgtcgcggcataccgcgttcagcgtggtctcagagcagctgaagtcccgatccggcgagacggacctggatgcggccattgcgcagcagaaggccgggctgcataccccggcagaacaggccattcacctggccatcccgctgcttgagagccaggacctgaccttctcccggccccagctgctggcgacggcaatggaaaccgggggcgggaaggtttcgatggcggacatcgacacgaccatccaggcacaaatcaggtcggggcagttgctgaatgtaccggtggcgcacggctacggcaatgacctgctgatttcccgtcagacctgggacgccgaaaaaagcatcctgacccacgtgctggaaggtaaagacgcggtggcccccctgatggaccgcgtgccggccagtctgatgacggacctgaccgccggacagcgggcggcgacccggatgattctggaaagcacggaccgcttcacggtggttcaggggtatgccggggtggggaaaaccacccagttccgggcagtcatgagtgccatcagtctgctgccggaagagacccgtccgcgcgtcatcggtctggcgccgacgcatcgcgcggtcggggaaatgcagagtgctggcgtggatgcgcgcacgacggcatcgttcctccacgacacgcagctgctgcagcgcaatggccagacacccgatttcagcaacaccctgttcctgctcgacgagagctcaatggtggggctggccgatatggcaaaagcccactccctcatcgtcgccggcggtggacgggcggtgtccagtggggataacgaccagctgcagcccatcgcgccgggccagccgttcaggttgatgcagcagcgcagcgccgccgacgttgccatcatgaaagagattgtacgccagatgcctgagctgcgaccggcggtctacagcctgattgagcgggatgtgcaccgcgccctgaccaccatcgagcaggtcacgccggagcaggtgccgagaaaagaaggcgcatgggcgccgggcagttctgtggtggaattcacgccaaagcaggaaaaggcgatagaaaaggcgctgagcgaggggaaaaccctgccggaaggtcagcccgcgacgctctacgaggcgctggtgaaggactataccggacggaccccggaggcacagtcgcagacgctggtgatcacccatctgaataaggaccggcgggcgctgaacagtctgatccatgacgcacggcgggagaacggggaaaccggcaaagaggaaatcaccctgccggtgctggtcacgagtaacatccgtgacggtgaactgcgcaaactgtcgacctggacggctcacaaggaggcggtggcgctggttgataacgtataccaccgtatcagcaaggtggataaggataatcagctgatcaccctgacagacagtgaaggaaaggagcgatttatctcaccccgggaggcatcggcagaaggcgtcacgctctatcgtcaggaaaagatcaccgtgtctcagggggaccgaatgcgcttcagcaaaagtgacccggagcgcggctatgtggccaacagtatctgggaagtgcagtctgtttcgggtgacagtgtcacgctgtctgatggcaaaatcacccgtacgctgaccccgaaggcggagcaggcacagcagcatatcgacctcgcctacgccatcaccgcccacggtgcccagggggccagcgaaccgtatgccatcgcgctggaaggggtggccggtggtcgggaacagatggccagctttgagtctgcctatgtggctttatcccgcatgaaacagcatgttcaggtctacaccgacaaccgtgagggctggataaaggccatcaagaattcacctgagaaagcgacggcgcacgatattcttgaaccccgtaacgaccgggcggtgaaaacagccgatctgctgttcgggcgggcaaggccactggatgaaaccgccgcgggccgggcagccctgcagcagtccggtctggcacagggaagttcaccaggaaaattcatttctccggggaaaaagtaccctcagccgcatgtggcgctgccggcatttgataaaaacgggaaagccgccggtatctggctcagcccgctgaccgatcgggacggacggctggaggctatcggcggagagggacgaattatgggcaatgaagacgcccggttcgtggcgctgcagaacagccgcaacggagaaagcctgctggccgggaatatgggggaaggcgtcagaatggcccgcgacaatcccgatacgggggtggtggtgcggctggccggtgatgaccgcccctggaaccccggggccatgaccggtgggcgggtatgggctgaaccggcgccggtggctccggtaccgcaggccggggctgacattatcctcccgccagaggtactggcacagcgggcggcagaagaacagcagcgccgggaaatggaaaaaaaggcggaacagactgcccgggaaatggccggggaggcgcgtaaagccggcgagccggcggaccgggtgaaagaggttatcggggacgtcattcgcggactggagcgtgaccggccgggtacggagaaaacgacgctaccggatgatcctcagttccggcgccaggaggaggcgattcaacaggtggcctcagaacgtctgcagcgtgagcgtctgcaggctgtggagcgggacatggttcgtgaccttaaccgcgagaaaaccctcgggggcgactga

SEQ ID NO: 4064 - DNA, 1083 bp, Klebsiella pneumoniae
  unsure (603),(636): Identity of nucleotide at the above locations are unknown.
aggagggattgccagatgttgatgcagcatatcggtgtcggctattttgggtattaccgagcaactgcttatgcgatgaaacactctcttatgcccgagattgcgaagttaagaatgaaggctctgaacttctgggataagcacgggatccgtgccgcagctgatgcttttgacgtatcaacgcgaacactctactggtggcgccggttactgcgcaccggtggtccagaagcactaattccaagaagcaaagcccctctggttcgccgttcaaggcactggcatcctgatgtactcaaggagatcaggcgtctgagaactgagttacccaatctcggcaaagagcagatttttgtcaggctgaaaccatggtgtgaagcgcggcattttacctgtcccagcacgtcaaccattggaagaatcattgctggtgctcacgataaaatgcggatgatccccgtacgcctcagcgccaggggcaaagcccggttgataaaaaaacgctcagtgaagcccagaagaccaaaacaataccgcccggtaaaaacaggcgaactcatagggatggacgcgattgaactcaggatgggggacctacgccgntatatcattaccatgatcgacgagcacagcgantatgcgctggccctggcggtcccttcactcaacagcgatattaccagccatttcttcagcaaggccacaaagctctttcctgtcgctatcagacaagttgtcactgacaacggtaaggagttcctcggtaactttgataaaacgctacaggaagcctcgattaaacacatctggacctatccgtacacaccgaaaatgaatgcgacctgtgagcgatttaaccggacacttagagaacaatttattgaattcaatgaattgttgctttttgaggacctgaatttgtttaatcaaagaatggctgaatatctggtgctgtataacagcaaaaggccacataaatcactcgaactgatgacgccagtggactatattttacgtgagagtaaaaattgcaatatgtggtggacccatacaacggtaagaggccatactggtgttgactag

SEQ ID NO: 4065 - DNA, 483 bp, Klebsiella pneumoniae
cttccgctctgcgccagctggttgagggtggcgttatccagctcacgctgcgtcaccgacgcaaagaccgttgccgtctcgctaaccgacctgccgggactttccacccagccgtggccgattttaataccgtcaaacacgcccgcgcccacggccagggtctgcgtggttttctgccccggccgctgtaccgtcagctgcccttcctccactttcatcaccgtgatgctttccccgcccttcaggcgtgtgtccggtatcttcccgagcaccgccagacgttccccctctgccaccggcagtgtctctgcccggaacagcgtccactggctgtcgaccgcggaaaccttcagatccagacggaccccatcccggtctttcagggtcagcatattgctgctcgcggtcacccggtcaatgacaaagcgatcgtgcgtccggttctccggatcccagcgttccatcaccatcccctcccggtaa

SEQ ID NO: 4066 - DNA, 372 bp, Klebsiella pneumoniae
ccgtgcatctgccagtttgaggggacgatgacagtatcggcgtcaggaagatcgcgctccagccagctttctggtaccgcttctggtgccggaaaccaggcaaagcgccattcaccattcaggctgcgcgactcttgggaagggcgatcggtgcgagcctcttcgctattacgccagctggcgaaagggggatgtgccgcaaggcgattaagttgggtaacgccagggttttcccagtcacgacgttgtaatacgacggccagtgaatccgtaatcattgtcatagttgtatcctgtgtgaattgttatccgctcacattttcgcataacatacgagccggacacatagagtgtaaagcctggggtgcctaa

SEQ ID NO: 4067 - DNA, 240 bp, Klebsiella pneumoniae
aatgaggtctgggcaatggaacacgtgaaaggaaaaatccagcagggggcagggaacgcctattttgcagggatgcagtggcgcggtattacacttggacacgccgatgctgcagcgcttaatcagtttgatatcgatatcagcaaagctcaggcacccgaagcacgcacctggttgcttcagaacaaagcagaattcatcgctctgatcctgggcattgaagtcgtaaaggtcgggtag

SEQ ID NO: 4068 - DNA, 414 bp, Klebsiella pneumoniae
aagaactcctgcgaactgagcgtatgcggagccagtcagctggctgaatacaatcgaggagaggaaatggattttgaagcgcggaaacaaaaggcgctggcgataatggccagctgtaagatgtggaaaagcaattatgcaccgcttctgatacgactgttgtggcggctggggataaacattcccccgctgccgtttgctccgttctggcaggtttttggcgtgatggcaggctctttctccgtcggatacggactgtggatgtactggatggtgtggcgggcccaggggatgccacccctgttcgcttgcaaaatcagtcttattgcgggcgtgttatttggcctgacgatggcactgtttcatctgtggcgccgaaaggtgaataaattacctgactggaaagatttataa

SEQ ID NO: 4069 - DNA, 210 bp, Klebsiella pneumoniae
cccgcagcctgtccctgccagacctgcggctggctggtattggacgcaaagcccagcttattgaagaagttattcatgtcaccgttaacatctgcagccgccgtcaatgacacccctagcaacatcccacaaagcaccgataatggtttacggatgaacatcaggctctccttctttcattttatttttccgtcgaaggttgcggtttaa

SEQ ID NO: 4070 - DNA, 426 bp, Klebsiella pneumoniae
gtacaatgctgtctgacaactcagatggccaaatacaaggaaagcagaactatgaggtactggttgctcgttatcttaatgaacgtgctgttctattttatcgtgaagcatgttgctccggaatggtatggttccccttgttattatgcaggccaaatcatctgcacactaatagctgcggtcatcacatggcgtgatccgcctgactggttagatggaatcctgctcggcgtaataaaattcggcgttctgattgccgggattatattctttgtctggggcatcgggtacaagctggcattctgggggcaacatgatcctaataccatatatgcaagtgcaaacgatgttattttgcctaatcttgcgctgggcacgggcgtcttgatcgcgggatgggtatacattagatatttaaagcgctaa

SEQ ID NO: 4071 - DNA, 327 bp, Klebsiella pneumoniae
ggccccggctgtttacggccccggtccaattacgcccagcgggcattgaccttcacgttaggtttctccatggtgccagggcaaaaagttggaaagggttacgcaagtacaagggcagccgtttttccatttcaggcgcatacggtgaacccaccggtaatcggtgaaggattgacattcattccgagttcaaccaagcatctcctgcagctcacggtaactgatgcggtatttcaagtacaagcgtacggcccacagaatgatgtcacgctgataatgccggccttgaatgggttcatgtgcagctccatcagcaaaagaggatga

SEQ ID NO: 4072 - DNA, 315 bp, Klebsiella pneumoniae
ggtaatagacttcatgacatcaacgccttcagttattttatcgaaaattcccaaaacttcgtaagcaccttcgataacccttcccacaatatcacctttatgaggtacacgaatctcaccaaacgacgtaccgcacacaaggccatttgtgcatacaaaacggaacatacccgggatcatttgataactggacgatccatcatgcgagttaagaagaatgatttcgggtacttctgttcctttattggccccttcacggcgaagtcttaccatatgcttagtatgcccccgtttatcctcatcccttactcgtga

SEQ ID NO: 4073 - DNA, 813 bp, Klebsiella pneumoniae
tccagacagtgcggggcgtgggctacatgctggagatcccggatgcatagcaaaccgtccagacgacctttctcactcgctctgcggctgaccttttttatcagcctgtccacaatactggcgtttatcgccttcacctggtttatgctgcattctgttgaaaagcattttgccgagcaggatgtcagcgatctgcaacaaatcagcaccacactgagccgtatactccagtccccggcagatccggatgaaaaaaaagtaagcaaaataaaggaatcaattgccagctaccgcaacgttgcccttttgctcctcaatcccaggggtgaagtgctctttagctcagctcagggggcggcactacgcccggcagtgaattcagcagattttagcgagcacagccgcgcacgggatgtctttctctggacggtggaggatcctgcgggaccgatggataccgggtccgaaatgaagatggaaacatacaggattatcgcctcctctggtcaggcgatatttcagggcaaacagcagaactatgtcatgctgactggcctatccattaatttccatctccattacctcgatgcgctgaaaaagaacctgattgcgattgccgtcgtgataagcctgttgattgttctgatcattcgaatcgctgtccgtcaggggcacctgccccttcgtaatgtcagcaatgccattaaaaacatcacctccgagaatcttgatgcgcgactggaaccgacacgcgttcccattgaacctggaacaactggttatctcgttcaatcatatgattggaaagattga

SEQ ID NO: 4074 - DNA, 339 bp, Klebsiella pneumoniae
tcggagtggtgtatgaagtggcgctattctctgcgctggaaactgccgcacaggccctgcccaggtccacgggaactgatttccgttgtcgtggaggctgggcaggcggcacctgaagaggtgatgtcacgctgggtggctggctcaggttacgctgtatgcgtggattttctcggccagaaacagatccaacgctggagcgatgaacggaaagcagcggtgagaaggcgcaacatgcaggcacgtattaatcgtgttgcccctttgtttgccgacgagttaatcgagcgtgaactggctgcgcgtccggagtatttcaatggcaagtccgcccgatga

SEQ ID NO: 4075 - DNA, 1026 bp, Klebsiella pneumoniae; identical to SEQ ID NO: 2067

SEQ ID NO: 4076 - DNA, 768 bp, Klebsiella pneumoniae
gacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaa

SEQ ID NO: 4077 - DNA, 444 bp, Klebsiella pneumoniae
tggagaacccgaataatggataatctcaacaaaatatattcttcgatacccgtactggaaagaaataaacgcctgaagttatcccggcaaaagagattcgatgtttattattgtctcgcttttatgtttggttttgccggattatttctgtggtggggaagccatgcttttttcaatgtgttcactgacctgttaaccccgccggaaaaactggagtcggcaaataacatcatcaatcagtggaatgtcctgatgtatttcgttccctttattcttttctcgctttccattggttgtctggcaacggctttgctgggggtactcattgccgaactagctttttggtttgaatatgcctttgaaaaaagcttccagagatatttaaaccgcaaccttcgacggaaaaataaaatgaaagaaggagagcctgatgttcatccgtaa

SEQ ID NO: 4078 - DNA, 2652 bp, Klebsiella pneumoniae
aggaacgaccgcatgagtaataacatcattgataccgtcacccaggctgtgaattcactcgtatcagcactgaagctgcccgacgaatccgctaaagccaatgacacgctgggcagcatgaatttcccccagttcagccgtattctgccctataaggattatgattccgcgaccggtctgtttattaataacaaaaccgtcggttttatgtttgaggcgcgtcctttacccggtgcggataaaagtatcgtcgccacactggagcatttactgcgcagcaaacttccccggggcgtcccggtcagttttcatctggtctccagcaaactggtcggcaatgatatcgactatggtctgcgtgaattccgctggagtggtaaacaggctaagaagtttaacgccattacccaggcctactacctccgggcagcggagacgaagttccccctgcctcctgatctggatttgcccctcacgctgcgtaactaccgcgtgtacatctcctgctgcgtacccaggaagaagaactccaccacgcaaattgtcgagatggagaaccagataaaaatcctgcgggcgtcactgggcggtgcctatattccgacgcgtatccttgatgcgtccgggctggtcgaactgatgcgtgagctgataaacccggacccgcacgaaatgtaccgcgtaccgtataagctggacccctatcaggatctgaactatcagtgtgtcgatgacagctttgatatgcaggtcaccgctggtcatctgaaaattggccgcctggggcgcgacgggaaagagtgcgtgacccgggtgacgagctaccatctggagagtgatccggaaatggccttcctctggaccgctgcggacaactacgccaacctgcttaacccggagctctccatttcctgcccctttgtcatcacgctgacgctgatggtggaggaccaggtgaagacccagaacgaagccaacctgaagttcatggacgtggagaagaaaagcaaaacctcctacgcgaagtactttccgaacgtgataaaggaaatgcaggagtggggcgatatccgccagcgactgtcgaccaaccagacctccctggtgtcctatttctttaatatcaccacgtacaccgcagacagcacagaggcctctctcgccgctgaacagcaggtgctcaacagctaccgtaaaggcggtttccagcttatcccggcccgctaccatcacctgcgtaactttctggccatgatgccgttcaagtgtggtgagggtctgtttaaagagctgcaggcggcaggcgtggttaagcgggcggagacgttccaggtggctaacctcctgccgatcgtcgctgacagcccgctggcgccggcgggactcctggcgcccacctaccgaaaccagctggcgttcatcgacctgttctacgagggaatgaacaataccaatttcaacatggcggtctgcgggacgtccggggcgggtaaaaccggtctgattcagcccctcattcgcagtgtgctcgactccggcgggtttgcctgggtgttcgatatgggcgatggctataagtccctgtgtgaaaacatggggggcgtatatctcgatggcgataccctcaagtttaacccattcgccaacgtgctggatgatgctcacttcgacatgtcagcagaacgtatacgcgatcagatgtcggtgatggccagtccgaacggcaacctcgatgaagtccatgaaggcctacttctgcaggcagttcaggcggcctggttaagcaaacgtaatcaggcacgcgttgatgacgtagtgcagtttttacaggacgcgaaggacagcgatgaatatgctgattccccgacaatccggggccgtctggacgagatgataatcctgctcgatcagtacacggtgaatgggatctacggggactatttcaactcagataaaccaacactccacgatgatgcccggatggtggtactggaactcggtggcctggagtcgaggccctctctgcttatcgctgtgatgttttcattgattatttacatcgagaacaggatgtatcagtcaccgcgtggcctgaaaaaactgaacgtcatcgatgaaggatggaagctccttgatttcaagaatgaaaaagtggggcagtttatcgagaaaggctaccgtaccgcgcgtcgacataccggcgcatacatcaccatcacgcagaacatcgtcgacttcgactccccgaccgcctccagcgccgcacgtgcagcgtgggggaactcatcgtacaaggccattctgaagcagtcagcgaaggaatttgccaagtataaccagctgtacccggatcagttcagcaagctggagaaagacatgattaacggcttcggttcggccaaagagcagtggttctcctcttttatgctgcaggtggaagcgaactgctcctggcaccgcctgttcgtcgacccgctcagccgggcgatgtactcctccaaaggcccggattttgagtacatgcaagcacgccggcaggagggggtcgatatccacgatgcggtatacggactggcgtgccgcaactttaaagacgaaatggctgagcttgaatcccgaataccggtgaatgacatggaggataaacagtga

SEQ ID NO: 4079 - DNA, 423 bp, Klebsiella pneumoniae
acaacgttacggactcagaggccttccccgggtcttatccggcagactcacagaaaaatcagggcagcatcggcagacggcgcttacgacacccggctctgtcacgatgaactgcggcgtaagaaaatcagcgcgcttatcccaccccgaaaaggtgcgggttactggcccggtgaatatgcagaccgtaaccgtgcagtggctaatcagcgaatgaccgggagtaatgcgcggtggaaatggacaacagattacaaccgtcgctcgatagcggaaacggcgatgtaccgggtaaaacagctgttcgggggttcactgacgctgcgtgactacgatggtcaggttgcggaggctatggccctggtacgagcgctgaacaaaatgacgaaagcaagtatgcctgaaagcgtgcgtattgcctga

SEQ ID NO: 4080 - DNA, 744 bp, Klebsiella pneumoniae
agacaagtacgtgtgatgaaagacatcaacatcatgtggaatgccttatcgaagaaccggatcttcgacggcaataaggagctgaaggaattcatcatgacgctcaccggtacgctgattttcggggagaacagtgaaatcacgcagttgccggcacgcaccactgaccaggatctgattagagccatgatggagggcggcacggctaaaatctaccactgcaatgattcggataagtgtcttaaggtcgttgctgatgcgaccgtgaccatcacttccaataaagcgctaaaaagccagatttccgctttgttaagcagtatccagaataaagcagtggctgatgaaaaactgacggatcaggagaaagggtttatctccagcaccaccattccggtattcaaatacctggtcgatccgcagatgctcggggtgtctaactcacttatttaccagctgacggactatatcggctacgacatcctgctgcagtacattcaggaacttatccagcaggcccgggcgatgatttcaaccggtaattatccccagtcgacaatggatatgatcatggaaaacctcaatcaggcgagtgtccagattgccgcttttcagtcccgtgttcaggttcagcaggacgccttgcttgtggttgacagacaaatgagttacatgcgccagcaggtctctgcccgcatgatgacccgctaccagaataactatcattttggggggaatctgtaa

SEQ ID NO: 4081 - DNA, 975 bp, Klebsiella pneumoniae
ataatgaagcgtgcccctgtcattccaaggcataccacacatactcaatcgactgaagatacttcatcaccggcgccggccgcgccgatggtggattcattaattgcgcgcgtgggtgctatggcccgcggtaatgctatctctcttccggtatgtggacgggaagtaaaatttacccttgaggtgctccggggagactctgttgagagcgcctcacgcgtatggtcaggaaatgagcgtgatcaggaactacttaccgaagatgctctggatgatctcataccttcatttttactgaccggtcagcagactccagctttcggccgccgggtttctgatgtcataaaaattgcagacggcagccgtcgccgtaaagccgcaatcctgacggaaagtgattatcgcgttctggttggtgaactggacgatgagcagatggctgcattgtcccggctgggtaacgattatcggccgacgagtgcttatgaacgtggcctgcgttatacaagccggctgcagaatgagtttgcaggaaatatttctgcgcttgccgatgcggaaaacatttctcgtaagatcattacccgctgtattaatacggccaaactgcctaaatccgttgttgccctgtttgcacatcctggagaactgtctgcccggtcaggtgaagcccttcagaaggcttttgcagataaagaagaattactgaagcagcaggctgagactctccacgatcagaagaaagcgggactaatctttgaagctgaagaggtcattagtcttttaacatccgtactgaaacaatctcccgcatcaagagttaatctgagctcacgtcatcagtttgctccaggggcaacagcattgtataagggcgataaaatggtgcttaacctggataagtcccgcattcctgcggagtgtatagagaaaatagaagccattcttaaggagcttgagaaaccaggagtctaa

SEQ ID NO: 4082 - DNA, 195 bp, Klebsiella pneumoniae
tcagaccggcgatacgagtgggaccgtggtcccagtctgattatcagaccgacgatacaagtggaacagtgggcccagagagaatattcaggccagttatgctttctggcctgtgagaaaggaaatgaagtaaagggagataaccgtagactaaagcgtgtccgcattagactcctggtttctcaagctccttaa

SEQ ID NO: 4083 - DNA, 711 bp, Klebsiella pneumoniae
aatgacattagcagccagccggggagcatgatgaaaatattaatcgttgaagacgaaattaaaacaggtgaatatctcagcaaggggctgacagaggcggggttcgtcgtggatcacgctgataatggtctgaccggatatcatcttgccatgacagccgagtatgatttagtcatcctggatatcatgctgcctgatgtaaacggctgggatatcatccgtatgctgcgcagtgccggaaaggggatgccggtattactgctgacggcccttggcacgattgaacacagggtcaaaggacttgagctgggtgcggacgattatctggtgaagccctttgcgtttgctgaactgctcgcccgggtaagaaccctcctcaggcggggaaacacgatgatcacggaaagccagcttaaagtggctgacctctcggttgatctcgtatccagaaaagtcagccgcgccgggaaccgcattgtgctcaccagtaaagagttcagcttgctggaattcttcattcgccatcagggagaagttcttccccgctccctgattgcctctcaggtctgggacatgaattttgacagcgacactaacgcgattgatgtcgcagtaaagcgactccgcgctaaaatagacaacgattacgggacaaaactgatccagacagtgcggggcgtgggctacatgctggagatcccggatgcatag

SEQ ID NO: 4084 - DNA, 273 bp, Klebsiella pneumoniae
gcgaagtatagtcattcgccctatctcttttgtcgcactttcaacaagggggtcgcttggaaagcggaacgaggtcagtctccgcccggactgctcagctctttaaacagcaaaagagaggcatcttatgagaagggattattcagtatgtcagggcagactgctttttcatccgcaggtactgagggtaaatgctcaattccggtacgattcttactctatagccagacagaattcagcattgtgctgaacccgaatctttttttactctga

SEQ ID NO: 4085 - DNA, 1179 bp, Klebsiella pneumoniae
aggatgttcagaatgaaactcatggaaacactcaaccagtgcataagtgctggtcatgaaatgacgaaggctatcgccattgcgcagtttaatgatgacagtccggaagcccggaaaataacccggcgctggagaataggtgaagcagcggatttagttggggtttcttctcaggctatcagagatgccgagaaagctggccggctgcctcacccggatatggaaacccgtggaagagttgagcaacgcgttggttataccatcgagcaaatcaatcacatgcgggatgtatttggtacacgactgcgccgtgctgaagatgcgtttccgccggtgattggtgttgctgctcacaaaggtggtgtttacaaaacctccgtttctgttcacctggctcaggacctggccctgaaaggattacgcgttctgcttgtcgagggtaatgatcctcagggcacagcctcgatgtatcacggatgggtgcccgatcttcatatacacgcggaagatactctcctgcccttttatcttggtgaaaaggatgatgccagttatgcgataaaaccaacctgctggcctggccttgatatcattccgtcctgcctggcactgcatcgcattgaaactgaactgatgggcaaatttgatgaaggaaaactgcccaccgacccgcatctgatgctccgccttgctattgaaacggtcgctcatgactatgatgtgattgttatcgacagggcaccgaacctcggtattggcacgatcaatgtcgtatgcgctgctgatgtgctgattgttcccaccccggcagagctgttcgattacacttctgcactgcagtttttcgatatgcttcgtgatctgctcaggaatgtggatcttaaaggctttgagccggatgtccgtattctccttaccaaatacagtaataacaatggttcgcagtcaccgtggatggaagaacaaattcgcgatgcatggggaagcatggttcttaaaaatgtggtacgtgaaaccgatgaagttggtaaaggccagatccgcatgagaaccgttttcgaacaggcgattgatcaacgttcttcgaccggcgcatggcgaaacgcactttcaatctgggaacctgtttgtaatgagatttttgatcgtctgattaaaccacgctgggagattagataa

SEQ ID NO: 4086 - DNA, 786 bp, Klebsiella pneumoniae
cgccggtggctactcgtttgccagcatcatcagcacgctgtcacaggaaggcgcacaatgatcccgtcatccagtgctcttgtatccctgaaaccagcccgttcggcagcgctgcatgccatcatgactgtggaatatgctccccaactccgcgcacgtctgccatcgatgccacacgtccggacattcctgcccctgctgacaggctgtagccggattaacagtgacgttgcccgccgtattcctggcattcaccgtgatccaaaagaccgcctttccagcctgaaacaggtagaagaggcgctggatatgcttatctccagccacggggaatactgtccgctgccgctgacaatggatgtgcaggctgaaaattttccggaaatccttcatacccgaacagtacgcaggctaaaacgtcaggactttgccttcacccgaaaaatgcgccgtgaagcccgtcaggtcgagcagtcctggttactgcgtcagaacctgctgggacaggctgtcacagaactgaattttcagtcaccggaaaccgtctgcacctggtacacccggtggagcgacgagtttgacgcggcagagcttgcagcaccgttctggcgctggcagtcgcgattcgcatcgctgaaggaacttgactggcttcgcatcagcggtgagccgctgtatgcagtgatgtacgaaattccgtttattgtccgggaaacacctgagcatattcgtgttgctgaacgctggcaggtgccaaataagctggctgatcggagtggtgtatga

SEQ ID NO: 4087 - DNA, 321 bp, Klebsiella pneumoniae
ccatctaacagcaatgaagaagtcaaagtaatcccttttaaccccggtgagcgggctttacggcgtttacgacgtaaagggcgtgatttccggggccttagcggcggcagcttgctgctgacgcttagggggatgttcatcaactatttcagcgacaccagggaacttaacacggtagctgcaaagccatacccgcttaaaacagctcagacgcctctgtacgcggtcggagtggtcccgacaaggcgacagccgcagtcggggcgtatctccgcgttagcgggccgcagggccgcttacgagcgtgtactaaacaactga

SEQ ID NO: 4088 - DNA, 378 bp, Klebsiella pneumoniae
tgctgccggctttatccccgtaatgcgttcgtcaaccagctgaaactctgcgttggctccctggcgatcgagcacaccggcatagaaaacgtggtcacctggcctgaacagcgtcacatctggtccggttgcttcaacaacaccggaagcgtcgtatcccataactaccggattgcctgcagagggactgatgtttcgccggcttttcaggtcccgtgggttaaccgcgaccgccctgactctgatcaaaagatcacgccccttgggcatggatgggtggggaagcgacaaatcttcaataacggatgtactttccccgggttgccagaaaccaacggctttcattctgtctccttaaaaaggtcagtcaccagataa

SEQ ID NO: 4089 - DNA, 921 bp, Klebsiella pneumoniae
gatcctgaaagaagccgtggagtacggccagtcgcgaaaatggatagcgcacgcgcccttgttgccaaaggacggggaatagccctggtcagccgcaccatgggcgtgtcgcgtgcgcagctgtcactgcggattaaccgttctgccgactggcaggacaagcgctgtaaccggcgtaatgacgaagcagacgaagaaatactgtcggctatcctcgacatcatcagcgatatgccgagttatggttatcgacgcgtgtggggcatcctgcgcaagcaacgtcgcacagagggacagccacctgtgaacgccaaacggctctacaggataatgagcgagcataacctgttgttgttgcatgacaaaccagagcgaccgaagcgtgaacataagggcaagatagcggtggcagaaagcgatatgcgctggtgttcagatggcttcgagttcggctgcgacaacggcgaaaaactgcgggtaacgttcgcgctggactgctgcgaccgtgaggccatagactgggcagcaagcacgggaggctatgacagttcaaccgtgcaggatgtgatgctgaggtcggtggaaaagcgcttcggcgacaggttgcccgatacagcggtgcagtggctgacggacaacggttcagcgtataccgcgtatgaaacgtggaggttcgcgagagagctgaatctggagccctgcacaacagcggtgagcagcccgcagagtaatggcatggccgaacggttcgtgaaaacgatgaaagaagactatatcgcgttcatgccaaaaccggatgtgagaacagcactgcgaaaccttgcagtagcgttcacgcattacaatgaaaaccacccgcacagcgcgctgggatatcactccccgagggaataccggcggcagcggacatcgttaacttaa

SEQ ID NO: 4090 - DNA, 1128 bp, Klebsiella pneumoniae
atgattatgagtgataatgatacaatcccgaagaagtctacaagccagattaacaaagcggtattctttacatctgctttgctaattttccttcttgtcgcctttgccgccgtattcccggatgtcgccgacaaaaattttaaactactacagcaacaaatcttcacgaatgccagctggttctacatccttgctgtggccctgattttactaagtgtcacgttccttggactctcacgctacggtgatatcaagctgggcccggaccatgcgcagcctgatttcagctaccattcctggtttgcgatgcttttttcggcagggatggggatcggcctgatgttctttggcgttgccgaacctgtaatgcattatctttcgcctcccgttggcacgccagaaaccgttgcggcagccaaggaagcaatgcgtctgaccttcttccactggggactgcacgcatgggcaatttatgccattgtggcgctgattctggcgttcttcagttaccgtcacggtctgcctttaactctgcgctccgcactctatcccattattggcgatcgcatatacgggcctgtaggccatgcggttgatattttcgctgttataggcacggtctttggcgtcgcgacatcgctgggttacggcgttttgcaggtgaatgccggtttgaaccatcttttcggggtgcccatcaatgaaacggtgcaggttattctgatcgtggtcatcacggggttagcgacgatttcagtggtgtccggcctggataagggaatacgtatcctgtctgagctcaatctgggtctggcgttgttgctcctggcgctggtcctgtgtctgggaccaaccgtgcttctgctgaagtcatttgtggaaaatacgggcggttatctttcggaactggtgagtaaaacgttcaacctttacgcgtatgagcctaagtcgagcaaatggctggggggctggacattactgtactggggatggtggctttcatggtcgccgtttgtggggatgttcatcgcacgggtcttcccgcgggcgaaccattcgcgagtttgtcaccggcgtgctgtttgttcccgcgggttttacgctaatgtggatgacagtgtttggtaa

SEQ ID NO: 4091 - DNA, 258 bp, Klebsiella pneumoniae
ctaataaagagaccgataatcatgaaaattaattttcacaaacagcatgccattgattttgttctgagattaacgctgacaataatcattatttcaccggtgatttatttctcctgggatgccgtcaaagcgacgtcggggagtgattatgtcgagagtgtggtttttattgttgcggttggttttttctggttcgtgagctatctcttttttagttcgcttgccgcgttgttacggaaaaagacggaggaagaatga

SEQ ID NO: 4092 - DNA, 657 bp, Klebsiella pneumoniae
  unsure (641): Identity of nucleotide at the above locations are unknown.
aagaaggagagcctgatgttcatccgtaaaccattatcggtgctttgtgggatgttgctaggggtgtcattgacggcggctgcagatgttaacggtgacatgaataacttcttcaataagctgggctttgcgtccaataccagccagccgcaggtctggcagggacaggctgcgggttacgcctccggcggttcgctgtatgccagaacgcaggtgaaaacgatccagctggtcagcatgacgctccctgatattaatgccggctgcggagggattgatgcctatctagggtcattcagctatatcaacagcgagcagctgcagaggttcgcaaaacaaatcatgagcaacgccgcggggtacttttttgatctcgctttgcaaaccacggtaccggagattaaaaccgcaaaggacttccttcaaaagatggccactgacatgaacagcatgaacctcagttcctgccaggctgctcagggaattgtgggtggcctgtttcctcgtacccaggtcgctcaacaaaaggtctgccaggacattgccggtgaaagcaatatcttttcggactgggccgcgtcgcgccagagttgtactgtgggcggcaagatggacagcgtccaggataaggccagcgatanagacaagtacgtgtga

SEQ ID NO: 4093 - DNA, 771 bp, Klebsiella pneumoniae
cgacgcgctggagaagagtctggcggagtatcagcagcagcatcatgtggtcattctggtttcacctgccgtggttcagggcgcgcccgatgtgacccgcaacatccagcacgacattgcccgccggatgaaaggagaacagtaatgatacgactgaaagactgtctgctcgccgcctgcctggtatcgccgctgactcaggcggctgatctcggtacctggggggatttatggcccgtccgggagcaggacatgctgcagctcatcacgcagcgtctgcagtcactgcaatcctctggccagtgggaccagacgatggatgcgtttaagcagcgggttatcgagaacagtcagcgcccggcaccggtggagggcattaagcgtgcggagaaatacgagcagcgctggtttgatcccagcatccgcctgaccgaagacctgaaggacaatgaggggcgggtgtttgcccgcaagggcgatgtggtgaacccgcttaaaaccgtaccgtttgtccagaccctgtacttcatcaatggagacgatgccgaccagctggcctggatgaagcgtcaggtgccggaaaccctgatgagcaaaattatcctggtgcgtggcagtatcccggacacctccgcagcgctggacagccggatctatttcgaccagaacggcgtactgagcaagcgatttggcctgacggcggtcccggcgcggatcacgccggcgccatccggtgaacgcctgaatattgagaccttccctgtaaaataa

SEQ ID NO: 4094 - DNA, 1158 bp, Klebsiella pneumoniae
tttgagaatggctgccctgaaaggttgaacatgcccggggcccagttcaacgtcacggatgcagatcgttatccccaactgaatgcctcatccgggatcacatacaacggtggtctgaaaggtgacaagccgaccacacaggagtacgacgcgggtctggagctcagctatgagctcgatttttttggcaaacttaagaacatgagtgaggctgatcgccagaactactttgccagcgaagaagcccgtcgtgccgtacacatcctgctggtctccaacgtttcacagagctatttcagccagcaactggcgtacgaacaactccgtattgcgcgggaaacgctgaaaaattatgaacagtcctatgctttcgttgagcaacagctcgtgaccgggagtacgaacgttctggcacttgaacaggcgagaggacaaatcgaaagtacccgcgccgaaatagccaaacgagaaggcgatctggctcaggcaaacaatgccctgcaactggtgctgggaacgtaccgcgcacttccgtcagaaaaagggatgaaaggcggggagatcgcaccagtaaaattgccaccaaatctatcttcacaaattttgctgcagcgaccggatattatggaagcggaatatcagctgaaagcggctgatgccaatattggcgcagcgcgagcggcctttttcccctccattaccctgaccagtggtctttccgcaagcagtacggagctgtcaagcctgtttacgtcaggaagtggaatgtggaattttatccctaaaattgaaattcctatttttaatgctggcaggaataaagccaatctgaagctggctgaaattcgccagcaacaatcggtggttaattacgaacaaaaaattcagtcagcctttaaggatgtttccgacacgcttgcgctgcgcgacagtcttagccagcaacttgagtcacagcagcgttatcttgattcacttcagataactctccagcgtgccagaggattatatgcaagtggtgctgtcagttacatcgaagtgctggatgcagaacgttccctcttcgctacgcagcaaaccattctcgatcttacctattcccgacaggttaacgaaattaatctgtttaccgcgctgggtggcggttgggtagagtaa

SEQ ID NO: 4095 - DNA, 882 bp, Klebsiella pneumoniae
actgacgtcggcattttgaatctcacttcggcgtgccccctccgaatggcgcaaaacatttcgtggtatggcatgatagcacccgaagagagtcaattcagggtggtaaatgtgaaaccagtaacgctatacgatgtcgcagagtatgccggtgtctcttatcagaccgtttcccgcgtggtgaaccaggccagccacgtctctgcgaaaacgcgggaaaaggtggaagcggcgatggcgcagctgaactacattcccaaccgcgtggcacaacaactggcgggcaaacagtcgttgctgattggcgttgctacctccagtctggccctgcacgcgccgtcgcaaattgtcgcggcgattaaatctcgcgccgatcaactgggtgccagcgtggtggtgtcgatggtagaacgaagcagcgtcgaagcctgtaaagcggcggtacataaccttctcgcgcaacgcgtcagtggtctgatcattaactatccgctggatgacgaggatgccattgctgtggaagctgcctgcgctaatgttccggccctatttcttgatgtctctgaccagactcccatcaacagtattattttttcccatgaagacggtacgcgactgggcgtggagcatctgatcgcattgggtcaccagcaaatcgcgttgttagccggtccattaagttctgtctcggcgcgtctgcgtctggcggactggcataaatatctcacacgcaatcaaattcatccgatagcggaacgggaaggcgactggagtgccatgtccggtttttcacaaactatgcaaatgctgaatgaaggcatcgttcccactgcgatgcttggttgccaacgatcagatgccgttgggcgcattgcgcgctaa

SEQ ID NO: 4096 - DNA, 519 bp, Klebsiella pneumoniae
ggttattccgggatttggcacggaggggaattcatgaagggagcagcgtttggtatcatcctgtctttaataccattgtcatcaatggcagcagactgctttgatatggctggcagggattacaaaattgatccggatctcctgcgtgctatatcatggcaagaatcacgatttaaaattgatgcgattggtcgtaatcctgttacgggttatggatcaggcttgatgcaaattgactcgcagcatttcaacgaactgtcgcgatatggaataaaaccggatcatcttcttagcgatgcttgtcttaacatctacaccggagcctattatctggctcaggcgtttaaaaagtggggcgtttcgtgggatgcagtcggggcatacaatgcaggcttcaaaaagaccccgcgccaggcagcaagacgttacgagtatgcgaagaagatccattactactacacggctatcaaagcaagcaaacgaacttcttctaaagatcagaaaatcgccatgaactaa

SEQ ID NO: 4097 - DNA, 240 bp, Klebsiella pneumoniae
gtttctggcggcagtatcggcataatctactttcttgctacctattgctatgcggtaatcaccttccctatagatagcgagcatttcctgacgaacggcatcatgaacagacatacctcccccactaaattgtggtggctgaccgcctttggttgcctctacatagataacttttttctctgtctcgatctctgtcactttccagcgccgcccaccgaagatgatgtgttggtctggtag

SEQ ID NO: 4098 - DNA, 420 bp, Klebsiella pneumoniae
atatcgccaggcatcagtttatgtgtttcaagagacatgacaggttcagatattgccataaataacctctattcaaataaagacgaaaagattccgccgaaggcggcaacgcctcacagatgcacaaataaattgcgcaactgttcaccgttcagatctggaattcatagattatttgacgaattaattctgacacaccagaaaggggatgccagtatggcccggggaccgggccgtggaatagaaagcttacagaatattagcgatcgattttgccagctggtcttcaagaacaggctgggcttcagggaacttgaggttaactttattagcgttagagacgacgcgagtctggtatttgtgctgattacccgtttcagtacttgtctgcacttttgcgccggatgttccctgacgtaa

SEQ ID NO: 4099 - DNA, 267 bp, Klebsiella pneumoniae
cgtcagccagggcgaacatcagtctgccctccgggttttatgaatgaaggctgtcaccacgccgaaaatttgcagcgtttccggatccgggtacagggaagggaagtccgggttcatcgcctgcagggctggccgcggcgtcagaagcaggcgttttaccgtaaattcaccctcaatttccgcgataacaatatccccgtgccgcggctgttctgctttatccacgaccaacagatcgccggaatagaggccaatatcagtcattga

SEQ ID NO: 4100 - DNA, 264 bp, Klebsiella pneumoniae
tcctttcagggccaggtcctgagccaggtgaacagaaacggaggttttgtaaacaccacctttgtgagcagcaacaccaatcaccggcggaaacgcatcttcagcacggcgcagtcgtgtaccaaatacatcccgcatgtgattgatttgctcgatggtataaccaacgcgttgctcaactcttccacgggtttccatatccgggtgaggcagccggccagctttctcggcatctctgatagcctgagaagaaaccccaactaa

SEQ ID NO: 4101 - DNA, 1290 bp, Klebsiella pneumoniae
aacccggagggcagactgatgttcgccctggctgacgtcaactccttctacgccagttgcgagaaggttttcaggccggatttgcgcggcaaacctgtcgtcgttctcagtaacaacgatggctgcgttattgcccggagtgctgaagccaaactgctgggtataaagatgggaaccccctggttccagctcaaagaggcgcagtttcctgaaaaattgtacgttttttccagcaactacgagctctacgcgagcctgagtaaccgtgtggtcgccctgctggaagagctgtcgccccgcgtcgaacaatactcaattgacgaatgtttcctggatgcccggggaattggccactgtatggatctggaggattttggcaggcagctgcgtgggcatgttctcagtggaaccggactgacgatcggtgtcggcttcggcgccacaaaaacactggccaaatcggcgcagtgggcgtcaaaggaatggccacaattcaggggggtactggcgctgtcgcccgaaaatccacgcagaacggcaaaattactcagcctgcagccggtggaagaaatctggggcgtggggaaccggatagcgaaaaagctgcacgttatggggatcaccaccgccctgcagctgtcgctgacgaaccccacatttatccggaaaaacttcaacgtagtgctggagcgcacggtacgtgagctgaacggcgagagttgcatttcactggaggaagcgccgccgccgaaacagcagattgtctgcagtcgtagcttcgggcagcggatcaccacctacgaagaaatgcgccaggccgtctgccagtatgccgagcgcgcgtcggaaaagttgcgcggtgagcgacagtactgccggcatatcagcaccttcatcaagacatccccttttgcggttaatgagccgtattacggtaacgtggccacggaaaaactgaacacccctacccgtgacacccgggacattatcgcggcagcggtcaggtctctggacaggatctggctcgatggccaccgctacgcaaaagcggggataatgctcaatgatttcagtccgaacggcgtcgcgcagctgaatctgttcgatgacgtgcagccacggccgcacagcgatgcgctgatgaaggtactcgacggcattaatcattccggactcgggaaagtctggtttgccggacggggtattgcgccggactggcagatgaaacgggagatgctgtcaccggcatataccacccgctggaaggagctgccggttgcccgtttctga

SEQ ID NO: 4102 - DNA, 297 bp, Klebsiella pneumoniae
aaattaattttcatgattatcggtctctttattagtcagcatggtttattgcgcggattgctgactcatgatttccttaattcgttccttggtcttattggtgagaacatcgttttccggtattttttgatttttcatcaggtcgtccataaaattggtgaaatcaagcatgttaaagtcgatcctctggagctcttcaaccgtaatcccccgacagtcaggactgctggcgccgccaaaaccgatatgcaactgaccatttcttccctgctgctgaacgatctgcgccagttttga

SEQ ID NO: 4103 - DNA, 369 bp, Klebsiella pneumoniae
aggctaattataagcgccgggcagctgtccggcgttttgatggtgggaatacttatgtttgaatttaaagctgtctgtatcagtatttcacatatggaagaaggtgatatcagagttcttcaggtgctttcatcaacaaccaattatctaacttgcgatagttacttagagtggatacatgatacaccttatggttgtgttataaggatgtatgatttcaaacgccatcttctggcgctaaaaagaggtggggtgtcaaaatttttacgcaaaaatctcatactaatgcaccgggagggcgggtatctgctttttcattttgatagtgatgccgattattatccaggtatagatgccgtagatttttaa

SEQ ID NO: 4104 - DNA, 2334 bp, Klebsiella pneumoniae
agaatgattttaaggttatatatcatggagttattgaattttttggcggcgatttttgtcatttacttgttgttttttagaaagaaaaaacgtaaatctccaaagtcttatgcttcagaccccgtgaaagcaccgccaaaagaatggctcgctgacatcaagaaaaaagaggcggttgtgcgaaacgatgatagtgaagacgataaccttgcaacttttacattgagcggtggccggggtgttgaacttcgggtgacaaccaatcattaccgcaacacctcaaagtcagcaggtgcactagctcgatgggtacttccgggtgagatgataactgtagctggtgtagcaattagcggtggccacatttacgtggggcaacgtatgaagccctccggtcaggaatcaggcggctattatgacgatggaagtgaggcatcattaattgatgacacatgtaagataaaacctacttcttatctttacgaggacagttcattaggatactggcccagtttttcctctctttccccagaagcacgcggtgcgtatgtcagttggcttgccagcgataggtctgatccatcgtgtcctatcggctatgtttttatctacctctacggcctggaaagaaaagcgctcgtagattccactgacccaaaattccctgatgctgagttccgtaatctgttcaatgaagtcgctcggttaagatcgatattcattgagaaccgctccttccgtggatattcgacccaattactcgaagccatgtctattctgcgcccgaacatgggcttagccactgagctcgatagcaattcaggtttcagcaacagcatgcaatttaagctggctcttgcaaaaactgtacatgaaggagttcctgtatcagctgaactggcgttgaactgggtaataaaccacaccgagtattcgctgcgtaccccggctcgccgctgtgctaaagagtttgctgcacttttcaaacggcgttacaccctcaaatatggtgaagggatggtcgttaaggcgaataaaacgcgcctgaggttagattacacaccagcaagtcctagtttgcgaggtgttcgacttcctgttcccgacctgcctgatccaagtgcgttgaagagccctgtccagaaaattatggctcttgccgatatatgtacagatgaacttgatgcttatagtcgctaccttggtaggaaaggtacgtcagtcaatgatacggctgcaattatgctgctcccttcagagatagttaatgaaagcgcagaaaaaatattaagctcattcaaacgctgggctgatgaggcgatcctcgtcaaggaggggttagtctcagttgctgacttttgggcacatatgaatgccagttgccccaataagatcaataaaaaagaggccgatttgatgcaggcctttgctctgaagatgggttacggtctggcacctgacccgtattatcaccatgtgaaggcggatgttgatgggacacttgttctattccctgccgccgaaggtggacgcttctcaccttctcctgaatttatctcagccgtaatgacgctcagattaggggcgatggtcgccttgattgacgattctcttgatcaagctgaacagaaagtgcttgagaatgccatcaacaacaatcctggcttcaccgatgatgaaaaacgctctctacatgcgtatttaacgtggcaacttcataccccagccaatatgacaggaatgaaaagtaggattgagttgatgggggccgcggaaaaagctgctgtgggtaaggttatcgttagtgttgcctgttcggatgggacaatagcgcctgccgaaatcaaacagcttgagaagatttattcaagtttggggctggatccctcatctgtctcgagcaatatccatcagcattccgcaactgaacatgatctcgtctcgtctgtaccaactgatcagccagcagcagggttcacactggatgctaatgtacttgcccgccacgaatctgccacggatgatgttcgtaaattgctgaacacaattttcaccgaagaagaaccggaagagccagaaagcgctccagcctcatcaacggaggcggggggacttgactccgcacatagccagctttatcgcagtttgctggagaaagaacagtggtcccgaaaagaggcgacagaattgtgcggaaatttgaatttgatgctcggcggtgcgcttgaggtgatcaatgactggtcctatgcggtggttgatgctccagtactggacgatgccgatgatgatatctgggttgacctggaaattgccaaagaattagagggatag

SEQ ID NO: 4105 - DNA, 300 bp, Klebsiella pneumoniae
gagcgtaatatctgcgtaccttttcttcttttgctgaatttgcgtatgtcgcagtggaatattgcctctttttcaaaggaggagcaggacaaagttgccgtcgataaggtggctgctgatgttgcctggcaggagcgcatgaacaagcccgtcatgccggaacttgttgaacgggaacagcctgaacacctgcgcgaatatttccatgaacggttccgcgtacatcgactgaacagtcagcagctgccgcgcgcaaatgcacccgaatataataaaccgggcgatgatcagcagaattga

SEQ ID NO: 4106 - DNA, 402 bp, Klebsiella pneumoniae
gggatggatatggcaaagatacaggcatatgttagcgatgaagttgctgaaaaaattaatgccattgtggaaaaacggaaagctgagggcgccagggagaaagatgttagtttttccagtgtgtctacgatgcttgtcgagttaggcttgagggtttatgaagcgcaaatggaaaggaaagaaagcggctttaatcagatggctttcaataaggttttgcttgaaacagttttgaagacacaatttgcaaccaacaaaattttgggaatttcttgtttgagtccacatatctctggcaaccaaaaatttgagtggagatttatgattgataccattctggaagacactaaagaagtggtcgatacattctttccagaatcagaagatggtgaagaagagtaa

SEQ ID NO: 4107 - DNA, 321 bp, Klebsiella pneumoniae
tctgtgcgtatgtctctgatgtttgctgccgtgacgcttttaacaggtattaacctgttttttattccgtttcagcctgttccggctctgtggggggctatcctggccgttgcttttgttctgattaatgtcgtggcggataagctgcgcctctggagtggtattgcgtggattatcgttgccggcatcatcataacgctgatgctgaaggggaaagagccgggtgacgaatttcgtgtcctgatcaccgttttcgctttcctggcttcaatctggtatagcgttgcgcagttcaggaaggaaaataagctccgttcctga

SEQ ID NO: 4108 - DNA, 354 bp, Klebsiella pneumoniae
aatagcctcatgaaacgacttcaagccttcaaattccagttaagaccgaatggtcagcaggagcgcgatatgcggcgcttcgctggggcttgtcgcttcgtctttaaccgtgcgctggcgcttcaaaacgaaaaccatgaagcggggaacaaatatgtttcctacaccaaaatggcttcatggctcattgagtggaaatcacaccctgatacccagtggctaaaagacacgccatcactgccgttgcagcagtcgctcaaagatctggagcgcggctacaagaatttcttccagaagcgtgcagcattccctcgtttcaagaaacgcggccaaaacgatgcccgcaaggcgtga

SEQ ID NO: 4109 - DNA, 216 bp, Klebsiella pneumoniae
gtaagtatcatcatacagtggtcagatgtgcatccgcagtacatttgctcgcatgttaacgtagcagtagtacaacatcatttagagacgaatcgcctaacaggttttaacaccttaaaatttcactgctggttaaacacattattaaatgatttttatcatttaaatcattgggttaattttaattgtgatttgcttttaaccctcgcaatttag

SEQ ID NO: 4110 - DNA, 558 bp, Klebsiella pneumoniae
gttggggtcattacccaggcacagttaagcaaagaagatcgcatttacgtcaaaaagtccattcgctggcttaccctgaagcgacccggcaacctgacgcccgcagagcaaaaggcgctggaggttgtaaagcaggcgatcccagcacttgccatggcctatgacttcaaggaagccttcttctgcatctacgacgaacccgacaagcagagtgctcagaacgcctttgaggcttggaagaacagcctgccgccttatggcatggagcctttcaaaaaactggtaaaaacggtacacaaccattacgacgacatctttgcctactgggatgcgccgttctcactcaccaatggctataccgaagggctcaacggtttgatcaagatgtccaaccggttaggtcggggttatagctatgagatcatccgtgcaaagacgttgtactccaaagaagcccgcaaggttggcagtggtattcgagcaggacgaggcaaggtcgagtatggaccgcacattccgacattgttgaagcaggcagaaggtggagagttggattaa

SEQ ID NO: 4111 - DNA, 270 bp, Klebsiella pneumoniae
gctgtgaccatgatactcaacgaaaaagtggtcactgccagcatactcgatgccagtatgttcagaatgttatcgactgcttccgcaccaaccttcacggaaaccgactcaggtatcattgatttaaaaagaattgataaaagggccgttattatcgcgacaatggcgaataacgttgccctgaaccatagctttttaactgtctgcttcagaatccatttccagcgtgaaatcattctgcattcctcatattgcggccgggataaataa

SEQ ID NO: 4112 - DNA, 255 bp, Klebsiella pneumoniae
gtccgtcacattgttcagcgacaggtcagcgcagatgatttcatgtgttttactgtcaacggcgagatgcagcttacgccagatacggcggcgttcctggccatgctttttgactttccactcgccttcaccgaagaccttcagcccggtggaatcaattaccaggtgtgcgatttcaccccgggtgggcgttttgaaactgacattaaccgactttgcctgcctgctgacacagctgtaatccgggcagcgtag

SEQ ID NO: 4113 - DNA, 2049 bp, Klebsiella pneumoniae
gaggtatcaattatgtctgcaacagagtctaaggtaaaaactgcaccgaaaaccagcaaaaaaacacttaagtctgccgaggctgaggcgcttaaagtggctctcgatgccgcacaggtcgagtatgtcccggtgtctgcactggtgaagtctcccctgaacgtcaggaccattccctatccggcggagaaagtctgttcaatggctgattccattgaagccattggcctgttgcagaatctggtcgtgcataacctcccggatggtcgctgtggtgtggctgccggtggtcgtcgcctgaaagcgctgcagctcctgcagagtgaaaaccgtatcgatgccggatatcaggtgatggtgaaaaaggtacctgatgaactggctgttgcggcatcaatggcagaaaacgaacagcagatggcaatgcatccgtctgaacagatcgccgggttccgcacactggcagagcaggggaaaacccccgcgcagattggcgatttgctggggttcggtacgcgtcatgttcagcgcatgttgaaactgaccgaactggctcccgaaattctggcggcgctggcgaaggatgaaatcaccaccgaacactgccaggcactggcgctcgaaagcgatcagaaacgccaggtggaagtgctggaatccgcccgcaaacggtcctggaataatgaagtatcagtttcctcgatccgtaacctcattacctcagaagaggtttccacaaacggcgacaaattccgctttgtgggagaggccgcattcagtccggatgaaatccgggttgatctcttcagcagcgaaaaccgcggctatgtcaaaagtgcatcgctcgataccgccctgctggaaaaactgcagaacatcgcggagcacctccgcgaagcggaaggctggtcatggtgtgatggtcgtcttgacccgatttcacactacgggaaggacactaaaatctggcgcctgcatgctgtcccgcctgtggaatataccgaagccgaatcagaacgtcttgcagagttggaagctctggaagctaagtatgaagacgagaaccccagcgtgaatgatgacgtcgtggccggggctctggaagccgtctgggaagaacagcagaccatcgcgcaccgggcaaaacaccgggcatggacggatgaaatgaagcaatctgccggagtggtggtttcctggactggccaggaggtgaaagtacagcgcggtgtggtgctgtgcgccgatgaaaaaatggaggagaaggatgcatccaccgatcaggcacctgaaaaagtcgatccgctggacgccgtcagtgtcccgttgctgacccgcctttcttctgaacgcacactggcggttcaggcggccctgttgcagcagccgcagaaagccgtcgcgctgatggtctggaaaatgtgtaactcggttttccataccacaacgtccgtcaaagagccgttctgcattagcgtgagtgtgtcgcattacgcgctgacccgtgaagcacctgacggtgaaaacagcgttgcgtttcaggccatccagtcagaaaaagaacgtcttgaagccctgctgccggaaaactggcgaaaggatatgaccaccttctttacgctcgatggcgcaaccctgatggcactgatggctttctgcaccgcctgttccatagatggtgtacagggcaaggatgaatttggtcgtaaacaccagaattcgctggatggggtggaaaacgccattcagtttgaccttcgtgactggtggaaaccgacggctgataaccttttctcgcacatgaagctgccacacattgtacaggcactctctcagaccggactggctggcgcagcacaggacgccgcgaagatgaagaaaaaggatgccgctgaacatgcagagcacttcctctcaaaaatccgttgggttccggaatggatgaccagtgctgacaaccagaaacagcttgccgcaaagtctgaactcagtctggcaacaagtcagaacgataccgacgttgatgccggcgaccgtcaccgaccataa

SEQ ID NO: 4114 - DNA, 243 bp, Klebsiella pneumoniae; identical to SEQ ID NO: 3601

SEQ ID NO: 4115 - DNA, 318 bp, Klebsiella pneumoniae
cacctaaaaatcatattgagacacataaaggaaaataaaatggctggtaataaaatttcagattttacggaagaagaatttactgcttttgttagtaaaataatcgctgctgattttccaactgacaaagagaacgatgatgctatttattcgttcgcccaactaacagagcatcctgctggttggaacctcatcttcaagcctaaggtaggcgaagattcttcggcgaaaggaattgttaaaaccgtaaaggaatggcgagctgctaacggtaagccaggttttaaaaatcgtgattggatgtgcgggttcaggtga

SEQ ID NO: 4116 - DNA, 540 bp, Klebsiella pneumoniae
aaggtaaaaatgatgattacgaacaaactacttattgaggaagtggaggagctgaaaaatctactttcacaagggaagactgaaattccatctttttggaagtgcctttggcctggcgtagtgttagttgcatggaatatgctttgcgctgtaattagtgtggatgctgtttatttgaccggaaagtatatatttcatgttttggtttttcctgtcggggtcagtatcattatgctcctaggtattgccagttcacgctctctctttttgtcagttcctaaaaactttagagaaaaatcgaatatatatcgctttttttctaagaaggttttgatttatgctgttgtgtacatggcagtgattatgttattagctatttgtaatagagtggtttatgacacgccattttcttttgcatttatggttattttaacgtctgttttttttggttttgtcatgaatctggattttggacgctatcagctatcattgctcacctctgcaataaactctttccgagcggaaaagttgggggggtaa

SEQ ID NO: 4117 - DNA, 231 bp, Klebsiella pneumoniae
ctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactga

SEQ ID NO: 4118 - DNA, 1020 bp, Klebsiella pneumoniae
ggagacagaatgaaagccgttggtttctggcaacccggggaaagtacatccgttattgaagatttgtcgcttccccacccatccatgcccaaggggcgtgatcttttgatcagagtcagggcggtcgcggttaacccacgggacctgaaaagccggcgaaacatcagtccctctgcaggcaatccggtagttatgggatacgacgcttccggtgttgttgaagcaaccggaccagatgtgacgctgttcaggccaggtgaccacgttttctatgccggtgtgctcgatcgccagggagccaacgcagagtttcagctggttgacgaacgcattacggggataaagccggcagcactaagttttgaagctgcagcgtcggttcctctgaccggtctgacagcctgggaaatgttatttgatcgtctgcagttgtcagtgaacggagatgctgatcagaccctgttgatgcttggcggtgcgggcggagtcccttgtatggctatacagcttgcccgcactctgagtcgggtgaacatcatcgggactgcctcccggcaggagagtgtcagagcggttcgcgggtttggtgcgcattatgtcctggatcattcatgtgcgcttgcgccacaggttgccagccttgctggactccctcccattacccggattttctcaacgtacaccacgccatctgcctgggaaaatatggccgaaattattgccccacaaggccgtatcggactcatcgacgaccctgaaccactggatctgcgtttgatcaaatttaagagcgtttctgttcactgggaggcaatgtttacccgccccatgcatgctactgcggacatgtctaaacagcatgatattcttaacaaactctcatgcatgctggattccggtaagctcaaacctccgttgctggcagagtatggcaggctgaatgctaaagcacttcgccgggctcatgaggacatggaaaataaaaatgtgaacgggaaaattgttttttcagggttctga

SEQ ID NO: 4119 - DNA, 567 bp, Klebsiella pneumoniae
cttttattgatatggccccttatgagtgaagaaaaacgccctgtactgagcctgaaacgaaaaccggcggagaacagtacggcccccgcagaggcaacccctgctcctggtgtggtgcgccgaaagaaggtcgtggtggtctcgtccccgccggcctggaaggcaaaaaaagagaaacttgagaaggttaaacaagcggccgaagccgccgcgcgcaacgctgcgccggtgccggttaaagcggtaaagacgccacctccggtgcgttatcttcgcctgctgccgccggaacaggccattatgacgctgaaggcattctggccacagctgttcgacggaaactcaccccgtctgctggcaacgggcatgcgcgaacagctgtttgccgacattgtgaaccgtgacctgccgctgtcgcataaacaggtgattaagtgcctgaagagtctgacccggtctgcgggctatctgtcccggatgaaagaggagccgcccgctatgatctgcaggggaacgccgtcgcgaccgtcactgcaggggaagcgcagtacgccagcgagcgcatga

SEQ ID NO: 4120 - DNA, 201 bp, Klebsiella pneumoniae
ctcagtgcgatttcagtctgcgtcaccaaattggtgatgggcgttctgatctcatgcgcgatatcagcagagaaattgggcctggcgggtaaagacttcctcaatctttccaatcatatgattgaacgagataaccagttgttccaggttcaatgggaacgcgtgtcggttccagtcgcgcatcaagattctcggaggtga

SEQ ID NO: 4121 - DNA, 981 bp, Klebsiella pneumoniae
ccactcaagatgaaaattatgacaaaccataaagaagagaacaggttattatcattatattctatggggatccttgatacaaaatatgaagaacgatttgacagattgacgaggattgccaccaaactctttgatgtaccaatagcacttgtttcattaattgatagagacaggcaatggtttaagtcatgttatgggctgaagataaaagagacagatagaagtgattcattttgtacaatagcagtagatcttagtgaaccattaatagtgcccgatgcaagccttgatccaagattcaaagaaaataaattagttaaaaatgatccttatatccggttttatgcagggcatcccgtaagactgccagatggtgagatagctggaacaatatgtattattgatacagaaccaagagtattaaccagagatgacttcttattgcttaaagatttagcagaaatcgtagaggatgagtttagaataataaacgaagcaactactgatcctttgacaggtatatgtaaccggcgttctttcgccctaatgacggatgaatcgttaagaaaagccaaaaaaaagaaaaaaacattctgtgttctgatcatagatctcgataattttaaaccaatcaatgataacttcggtcattcagaaggtaatgaagtactttgcaattttgcagatatgctggaagatcttagtagttcaaaaagcgttgttgcaagattaagaggtgatgaatttggtgttctattaccccactcaacctatgcagaaccctatgaattccttcctctcttgagggcctggattaccagctacaatcttaattctcaaaaaaaatacaacatagatttttctgcagggattattgaatatgatgagaaaattcatactgaatgctctgctatcatgcaggatgcacacgaaagaatgtatgaaattaaaaagggaaaacgatattatatgaaaaaatag

SEQ ID NO: 4122 - DNA, 1026 bp, Klebsiella pneumoniae
ccgttgaggatcaagatgacgagcgaaaataacagcttacttctgaaccttcaggaagttgataagacaaccggcgaagttgttaagctggatgtcaacagcaccagtaccgtgcagccagtagcgctcatgagactcggtctcttcgtcccaactctgaaatcaacagggaagagcaaggcgaaccggaaaaacgttacagacgcgactgaggagcttgtacagctgtctattgccaaaagcgaagggtacactgacgttaagatcaccggttcgcgtcttgatatggacacggattttaaagtctggctggggataattcgctccatgtcggagtatggggtaaaaagtgacaccctggaactgtcgttcgtcgaattcgttaagatgtgcggatttaactcccgtcgttcaaacaaaaaaatgcgcgatcgcatcagtaattccctgtttaaacttgcctcggttacgctgaagttccagagcgagaccaaaggatggaccacccatctggtgcagtcagcctattatgacatcaccgaggatatcgttgagataaaggctgaacctaagctgtttgagctttaccacatggacagaagggtactgctgcggctgaaagccattgacgccctgcagcgcaaggaatcagcccaggcgctttatacctacatcgaaagtcttccccagaatcctgcacctatttccatgaaacggatgcgtgaccggctgaatctcacctcaaatgtctatacgcagaaccacacggtgcgtaaggcgatggagcagctgcgggatattggttatctggattacaccgagtttaaacgtggccgagccacctatttcagcgtgcattatcgcaaccccaaactcatcagtggtcctgtgaaggttccgcgcaaagcggaagaagagaaggcgccagagcaaaattatgacgaagtcattaaggcgctgaaggctgctggcatcgatcctcttaaactggctgaagccctctcagcgatgaagccagaaaattga

SEQ ID NO: 4123 - DNA, 312 bp, Klebsiella pneumoniae
atcaggcacttcgcagactggaggaaatgcagaatgaaatataaaacccttagccaggttcataccgaagcaatgaacgatcatgagtacagcgcggcattcgaggcagaagaagcctcggagctacttcgggaaaccttagcaacatggagaaaagaagcgggtttgacgtcggcacaggttgcagaacgtatgggcatcaaagcgcctactatctcacgtatggagaagaacgcttcgcgaatgagtattcagacgctggttcggtacgccagagcctgcggtgttaactttaaaattcagcaggtttga

SEQ ID NO: 4124 - DNA, 243 bp, Klebsiella pneumoniae
ggagtcaactttatgatcgtttctattttttcaccttccgcaggcgctgtaaagccccgtcgtcattcgcgcattctgcgcgcagatatcaccgcacctgagattgatcccgctctaagagctttcgggcgtcatatcgccagaagtcaccgcaaagggcgcggtgtccacatccccgcgatgaaaaattccgccctcgggcaggtactccgcacgctggaactgaaacgcgcatttaactga

SEQ ID NO: 4125 - DNA, 570 bp, Klebsiella pneumoniae
ggaaatactgtgaaaaaaatgaaccgtacactccacaaatgttgtctgtcggggcttatcagcctggctttgtgtgcacctgttccggccgtgtatgccgccagcatcgagacgggatattctccggaaggaacggctctgcagttggtcctgaagactattgattctgcgcagcaggaaatccgactgatggggtattcctttacctcgcctgaagtcgccggtgcgcttgtcagggcaaagcggcgtggtgtcgatgtgaaagtggttctggactggaaagccaataccggcaagcaaaaccaggcgagcctggcggccatgaatcttctggtcaatgccggcatcccggttcgcacagtgtcgcagtacaaaatcatgcacgacaaagtcatcattgccgacggccgcaatattgaagtcgggtcttttaactacacccgcgccgctgatcgggtaaattcagagaacgtgcttgtcgtatgggatgatccagtcgttgctcaacgctatctgcagcactggttgactcgctggtcgcagggtacggactggaaacgggcttattaa

SEQ ID NO: 4126 - DNA, 273 bp, Klebsiella pneumoniae
cttacggacttcatttttcagcaattatcttttctcttctgttgtaaacttatgaaagcgttacgcgaaatcccgcaaggttacaggggtgtaccaggccggaaatcgcgtagcgctctcttctcttctgtttcctgcctaacatgtacatcctggcattactccaattctcccaaaaaccgtaaaacagccatcaacccgcgtcattactggcttcatggaggatctgagcagaaaaacgatcctttacgcatttggttttacccgcaataa

SEQ ID NO: 4127 - DNA, 1008 bp, Klebsiella pneumoniae
aataaggatgtttctgtgaaaaccctgacgcttttcctgagtgccctgatgttgtgggggtacagcctcagtgcggctgctgatccctcctgtgagggccggtttgttaacccgatcaccgatgtgtgctggcgctgcatcttccccctgtcgctcggcagcgtgcaggttggtaaaggcgatctgcctgataccagcaatccgggtagtcccctgcagctgtgtccggcgccgccaccgatttttgttcgacccggcctggccatcgggtactgggagccgatggccatgacggacgtcagccgttcgcctggctgtatggtcaatctggggggcttcagtatcaatctcggcaagaccggtatggggaccgcgagaaaggacgacaagcaggtgaacggcgctttttatcacgttcactggtacaagtacccgctgacctactggctgaacatcatcacctccgcaggctgtctggaaggcggagacatggatatagcctatctgtccgagattgacccgacctgggtggacagcagcctcaccaccattctgaatccggaagccatcctgtttgccaaccccatcgcacagggggcgtgcgcggctgacgctatggccagcgcgtttcatatgccactcgatattctgttctggtgtgccggctctcagggttcgatgtacccgtttagcggctgggtaagcaacgagtccagtccgctgcagtcctcgttacttgtcagcgagcgcatggcgtacaagcttcaccggcagggacaaattatggagagcatcgggaaggacaaggcggtctgctatgagtatccgtccccgatcatccccaaagagcgctggcgctatcagatggtgaacatgtacccggacagcggccaatgccatcccgtggggcgcagcgtgatgcgctgggaggccggtaaaaatccacccaacacccgtaagaactatggctatctgatgtggcgtaaacgcaattgtgtctttctctga

SEQ ID NO: 4128 - DNA, 258 bp, Klebsiella pneumoniae
atccgctgcttcacctattctccagcgccgggttattttccgggcttccggactgtcatcattaaactgcgcaatggcgatagccttcgtcatttcatgaccagcacttatgcactggttgagtgtttccatgagtttcattctgaacatcctttaatcattgctttgcgtttttttattaaatcttgcaatttattgcaaagcaacaacaaaatcgcaaagtgcacgaaaaagtgcaaagtgaaccgcattgggtga

SEQ ID NO: 4129 - DNA, 255 bp, Klebsiella pneumoniae
gtccgtaacgttgttcagcgacaggtcagcgcagatgatttcatgtgttttactgtcaacggcgagatgcagcttacgccagatacggcggcgttcctggccatgctttttgactttccactcgccttcaccgaagaccttcagcccggtggaatcaattaccaggtgtgcgatttcaccccgggtgggcgttttgaaactgacattaaccgactttgcccgcctgctgacacagctgtaatccgggcagcgtag

SEQ ID NO: 4130 - DNA, 285 bp, Klebsiella pneumoniae
ggtgcttgcgtggcttccatttccatcagatgtccttcctgctccgctactgaaggcgtggtgcgtaacggcaaaagcactgccggacatcagcgctatctctgctctcattgccgtaaaacatggcaactacagttcacttacaccgcctctcagcccggtacgcaccagaaaatcattgatatggccatgaatggcgtcggatgtcgcgccagtgcacgcattatgggcgttggcctcaacacggttttacgtcacttaaaaaactcaggccgcagtcggtaa

SEQ ID NO: 4131 - DNA, 204 bp, Klebsiella pneumoniae
tatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtga

SEQ ID NO: 4132 - DNA, 285 bp, Klebsiella pneumoniae; identical to SEQ ID NO: 2106

SEQ ID NO: 4133 - DNA, 273 bp, Klebsiella pneumoniae
aacaaggcggtgaagcgggctgaagctgacggcgtgcatttttcgatccccgtgacgccgcatactttccgtcacagctatattatgcacatgctttatcaccggcagcccaggaaggtcatccaggcactggccgggcataaggatccgcgctcgatggaagtctatacccgggtatttgcgctggacatggctgccaccctggccgttccctttaccggtgatggtcgagatgccgcggagatccttcgctccctgcccccggccggctga

SEQ ID NO: 4134 - DNA, 456 bp, Klebsiella pneumoniae
tatacagaggtgagtatgaaaaaagtggttctaatggcgctggctctcggcctttcactacccgcgatggcgagtgaaaaagtgattgatatgtacaaatctgaaaactgtggctgttgttccctgtggggcaaagcgatggaaaaagacgggtttgaagtacgaactcacgtcatgaatgatcaggcgctgtcagccctgaaagaaaagcatgctattcctgcaggactacgaagttgtcataccgcggttgccggtaatttgatcattgaaggccatgtgcctgcgacaacgatacataaggcaatgcagtctggttcgggtatatacggtctcgccacccccggtatgccagcaggaagtcctggaatggagatgggagcccgaaaagaggcttacgatgttatcgcattctcaccggatggaagtaaaaaagtcttccagcgaatcgaatag

SEQ ID NO: 4135 - DNA, 432 bp, Klebsiella pneumoniae
ggggttttatttgtgagactactcctattgaaaagtagagtggaggtgcaagtgaggcgaatgactactcgtccggcattaggtccatgcgtaagttttaaacttgatgaagatacgcatctgaaattggtaaacgccaaagagagaagcggacgtagtaaggctggggaggttgtgcttagggttaaggatcaccttttacgctatccagatttttatccaactgtaacttataagagtgtgagttttggtcctgttgttatggcccgctttgatgaggatacaaacaaaaaactgattgcagctaaaaataaaagtaacagaagcaagtcgcatgaagtttatcttcgtctcaaagcgcatctgttcgaatttcctgatttttatagctctgaagtcgaagtgataaggaggtctgtatctgaaacataa

SEQ ID NO: 4136 - DNA, 222 bp, Klebsiella pneumoniae
acagcattattcgtctgcaacataactctgctggttgctgcggataactactcagcgccttccagagatggcattgatgaaagtagtagaaaaaacctggaatctttgaagatgtgtccctacctcagggggctggagtgccatctggccctaattcagcacagtgctgcagatatgtgttatgtacaagtagacactgtcttgaaaatcagaagtcgttga

SEQ ID NO: 4137 - DNA, 489 bp, Klebsiella pneumoniae
acagcatcattcccttgcaaaattcaacaaaacgcgtctcttttcttgccaacggccccggccgttgattttgcgaccgcggtggcactccggcggatggccacctcaacaggtgccacgccggcttacctcctggcgccggaagtgagcgccctcctctggtatatgcctgaccagcgtcaccacatgttgttcgccaccatgtggaataccgggatccgtatcggtgaagcccggacgctcaccccggaatcgttcgacctggatggtctgcgcccttttgttcgggtgctgtcggaaaaagtgcgggcacgtcgtggccggccgccaaaagatgaagtgcgtctggtaccgctgacggatgccagttttgtgcgtcagatggagagctggatggtgaccacccgcccccgccggcgggagccgctatggccggtcacggatgagacaatgcgcaactggctgaaacaaggcggtgaagcgggctga

SEQ ID NO: 4138 - DNA, 192 bp, Klebsiella pneumoniae
cagtcaacattttacattccgcagtcgatccagacagacgttaaagccagttacagcgcatgctggagcgatccggggatctcttttggatctcactatgatctccttgggatcaattattggatcgagaccttgaataactcagatacaaggccggaagcgccacaccaggtatccagaaccctggcctga

SEQ ID NO: 4139 - DNA, 2232 bp, Klebsiella pneumoniae
gctggcgaatctggaatcaaagatgagaggagctgcttaatggacctttatatctgcgagaagccttctcaggccaaagatttggctggcgtaatgaaggcctcccaacgaggtgatggatttctccatgatggaggaaaccgcgttattacgtgggcgttcggccacctgctggaattgtatatgccagacgattatgacgaacgctacaagtcatggtcactggagaccctccctattgcaccagagtcatggcggtacaacgttcgcaagagtgcgttcaaacagtacaaaattgttgagggactggtcaaaaaggcgagcaccatctacatctcaacggactacgaccgcgaaggtgaggctatcgcccgttcgcttctggatcgattccgctactctggccctattcgccgggtttgtttgacggctctcgatgagtcaagcatcaagaaagcgctgaacaacgtaaaggatggcaaggatacggtctcactctactacgccgcattggcacggcaacgcgctgactggttggtaggcatgaacgtgagccgcctctacacagtgctggcccgagatgtcggcttcaaccacactcttcacgttggcagggttatcaccccaaccgtcgctcttgtttgtcaacgggaccgagagatcgccggtttcaccccctcaccatactggactctgggtgtgaacgtgtccgtacagaatggacagtttgccgcccaatggataccaccagaagagtgcagtgacgagcaaggccggtgcgtcaataaggcctatgccgagcaggtagcctcccaggtcaatggtgccaatgctgttatcagcaaagcagaaaccaaaccaggtaaagagtcagcccccctccccttcgatctaacgtcgctgcaacaatacgcaagcaaacgatggggatacaccgctcagcaggtactggatgcagctcaagctctgtacgagacgcacaaagcgaccacctaccctcgtactgacagtcgttatctacccgagagccaaaaggaagacattccggacattctccaggcgctcattttgtccgatcagaacgtctctgggctggtggctggcgcagatcctcatcgcaaggccagggtattcaatgacgccaaagtgaccgcgcaccacgcgatcattccaacaccggccagaacagacatcactgccatgtctgagatcgagttcaatctttacgacgccatccgtcgtttctacatcgcgcagttctacagcgagttcgagttcaccaaaacctccatcgaggtgcagtgtgggcgtcacctctttgcggcctctggtaagacacctaccaaacaaggctggaaggttttgtttgcttctgatagtgaaagcagtcccaaggacgagggggaagacaccgacgcgccggttgaacaagagaagctccccagggttagccagggcgaacccgctttgcttaatggtgccgagctggcaaacaaaatgacgcggccagcaccgcacttcaccgaagccacattgcttgccgcgatggagaacattgcccggttcgtgactgaggagaagttcaagcaaattctcaaagacacagccggtttaggcactccagcaacacgcgcaagcatcatccagggcgctgttgataaaggctacttcaaacgtcagaaaaaggtactgcttgcaactgataaggctcatgcgcttatcgcagtgcttccaccagccatcaaatcacccggcatgactgcggcttgggagcaggagcttgagaaagtcgcctccggctccgggaatatgtctgtcttcatgaagcagatttccacctggatctgccaaatggttgagcagctcaaagtggccgcaccggttctgaccaaagaaggtggcgcgatggctaaagccttcgagggcgcgaagcctccttcacacgaatgcttcaactgcggtggagagatgcaccggatcaaagggaagaacggttttttctggggctgccagaacgaggcttgcaagaagacgttcccagacaaccgagggaaacccgagaagcgtatcgcggctgaggattgtccagactgcccagattgcggtagcccgatgcgtctcaggaaaggaaaagcaccaggcaagaagcgagcgtctaagttctggggctgcactgcctatcccgattgcaaaggcactatgcctttcaaaaagtcggactttatggattga

SEQ ID NO: 4140 - DNA, 723 bp, Klebsiella pneumoniae
ggcgctagatcgcatcgctcagttctatatcgacatggccgaaggcatcttccccgttatcgaggtcgatgctggccgtcaggtagacatcatcgtgaccaaaggaaccaagctacaaattcgttccaccgggggaaccaagaaatgaaaaatttgaacattttgaccagaaagggcagttccagaggcgaggctcaaaaggaacaggcagtaagatccgcaaagatgttgggggtgggtgcagcgctacttattttgtcgggctgttcgacgttcaacatcggcaaggatgagtatagctgtccgggaatgccgaatggtgttcagtgtatgtcagcgcgagacgtttacgccgcaaccaatgacggaaatgtcccgcgcccaatgaaaccagaggaagtcgaggccaaagcggaagcggatggcgaaggttcctcaaacgtttcagcgaactcatctagctccggagacccggtgattgacaactatgtcgcaccgcgtcttccggatcgcccgattccaattcgtacaccagcacaggttatgcggatctgggtagctccctgggaggacaccaatggtgatctcatcgtgacagggtatgtctataccgaaatcgaaccgcgcaggtgggtgattggggatggcacaccgcaaagtgagccagttttgagaccgctgcaaacggtacaacacgaaccgaagtctgaaacaaccaaatag

SEQ ID NO: 4141 - DNA, 774 bp, Klebsiella pneumoniae
ccggacactttgcgtatgcccaaaggagcccgcaagtatgcgcaggacaaagccagtaaccgcgccgatggtggcgcgggtctatctgcgcgtcagcaccgacgcgcaggacttggacgccaagaggcgatcactacggccgcgaaggccgccggctactacgtcgccggcatctaccgtgagaaggcatccggcgcacgcgccgaccggcctgagctgctgcgcatgatcggcgacctacagcccggcgaggtggtcattgccgagaagatcgaccgcatcagccgcctacctttgcccgaggccgagcgcctggtggcctcgatacaggccaaaggcgcaagcctggccgtccctggcgtggtcgatctatccgacctggcggccgaggcccagggcgtcgccaagatcgtgctggaagccgtgcagatcatgctttttcgcctggccttgcagatggcccgcgacgactacgaggacaggcgcgaacgccagcgccaaggcattgagttggcccgccaggccgggcggtacaagggccgccgtgctgatccgaagcgccgcgcccaagttgtcgcgctgcgcaagtccggctacagcatcaacaagaccgccgagctggccgggtacagtgcggcccaggtgaaacggatatgggccgaggtcagccaggccgaagcgaagcagcacggcgcgttcgtggaggacgcattgacggaagccgatgccctggccgctgtcggccaggatgagcgccaggaggaaagggcatga

SEQ ID NO: 4142 - DNA, 450 bp, Klebsiella pneumoniae
acttatcatccccttttgctgatggagctgcacatgaacccattcaaaggccggcattttcagcgtgacatcattctgtgggccgtacgctggtactgcaaatacggcatcagttaccgtgagctgcaggagatgctggctgaacgcggagtgaatgtcgatcactccacgatttaccgctgggttcagcgttatgcgcctgaaatggaaaaacggctgcgctggtactggcgtaacccttccgatctttgcccgtggcacatggatgaaacctacgtgaaggtcaatggccgctgggcgtatctgtaccgggccgtcgacagccggggccgcactgtcgatttttatctctcctcccgtcgtaacagcaaagctgcataccggtttctgggtaaaatcctcaacaacgtgaaagaattggcagatcccgcgattcacccacacggataa

SEQ ID NO: 4143 - DNA, 1170 bp, Klebsiella pneumoniae
aaggcctgtccgaacttgctaaagccgccaaaggccaagaaaggcaaagaggttcttaccgtacctgttgacgacgttgtatccaaagtccaggttcgtaagcgcttccgtaacattgaagagctggcgggaaccttgctgaccgaagggcacaatctccgatcatcgggtttcccgaagaacgaaaaagggcaagttcgtcattccaaaaggggaaccggctttggaaaacgtggtaaacaccttggattcgagaacatggaccttggggggggaaggataaggtccaggaccaacttggacgagactgctggtgagctgatcgaaaacatccagcgggatgacttgactccggtagagattgccgaggcgttaaacctgtttattgaagaaggttggaagcaaaaggatattgctgatcggctcggtaagaatatcactttcgtatctacgcatctgtcgttgctcaagctacctgactgtgtgcgtgagttatacgataatgaagtatgttctgatacagagaccttgaataactttcgtctcttgttcgatctgaatgaagaaagatgtcgcgccgtctgcgcggtggctatgtctgacgggattactcgtaatcaaagccgtgagctgctgaatgatgccaaacgtatcaaagacgaaatggaaaaaggcccactgactggctcccaccagaatgatgagcttggcgctggcaacaccgacgagcaatccctcaactcgggtggggatggtacgtcggaacaaaccgggaatgacgacctgaaccttgcccaggaggaactggaagggggtaaaaattccaatggtcaggacgatgatgacgaagaccctttgcgtgatgaagagggtgagcacaaagatcctgtcaagcagccagataacagcggcaaggacaaagatgaagaaggcggtgatgctcttcctcctctgccgaaggacaaggaatggaagaacgtccgggctgacagtttgatttttgctgtcaacgttaacctggatggcgagaccaaacgtggagtcatcatgacagaccgtgttgctctggttccgtctactgtctgggttaaaacgctcgatggcgaaggcaaggaaaagcatgttcatgtgcctgtgtcagacattgaactcctgagtgtcgaaggctaa

SEQ ID NO: 4144 - DNA, 1431 bp, Klebsiella pneumoniae
ccaatgttaccgatcgtctccccctccgtagtaaccaaacaacttgcgttcaatcgagtaggcgataaacgcaaggttagggtttcgtccaactttttggatgttatggggttcaagccaggtatgggcatcgccgttgagccaggggaggggatgggcggtttttcggtgatcccggcgaccgatgaactacagacacaccaggtttatcagcgccggtatcaaccaaagagtcgctccaacaacccgctggaaaccgttattgagttttctggacaagggctcatagataagtgcttccctcgctatacagagcgtttccacgtcgaaatgcgaaaaggccgagtagtcttcactcctgtcgcaaacagagcctttgccattgctgatcggttcagaaaaaccagccctttccgtgcctttgtggcattgactggcggggtagacattcatgttatggaagcgcttggctggaaggctgagattgttttggagcatcgtccagttgaagccagagacagagcatccgggcggaacctgagtgaagtacatgcgctcaatacgctggtgaacagctccccgcgtatcctgcttaatgaagacattcatcacctggagctggatcgccttggagccttgctggcggagtgcccaccaattggtttggcccattactcgttggggtgtgatgaccactcaaacgccaaaagtccaagggacaaagagcgttctcttgaagatctctccaccatgctcgacatggtttacccggcactaaaacagatcgaggtcgtgaaccctgccgtcgtgctggtggaaaacgtcccgaacttcaaagcatccggagctggggcgatgatgggaacgacactgcggcggatggggtacttcctcactgagatggtcttgaacggtctggatttcggcgcttaccaggggcgagaacgctattacatggtggcgtcggtcttccctgggttcgttccaccgaaacctgagcagagagctggtggacgattgtggccggtgatcgagaagcacctcggggattgtgctgacgtcacagcgttgaagtcaattcaggccagagagtcaacttctcgcaggatgcctgcgttcttgacgagagaaagcaccagttgcccgaccatcctcaagtctcaggatcgtggggtaaaggatgcagtgtacatccaagacggtggccgcatttacaagccatcggtcgatctggttcaggagttgatgtcgatacctgatagctttgatgtttcgtggatggcaaaagaacaagcgacagaaacgcttgggcagagtgtggattacagattgcattcagcggtcatggccgcagttcgggatcacctgaatgtgaattgcggtcgccataccgtggtgcagcacggtatcagaagtaaggaaggtagataa

SEQ ID NO: 4145 - DNA, 1032 bp, Klebsiella pneumoniae
ggacaggctttcattcggagaaccatcatggaaaacattgcgcttattggtatcgatctgggtaagaactctttccatattcattgtcaggatcatcgtgggaaggccgtttaccgtaaaaaattcacccgaccaaagctaatcgaatttctggcgacatgcccggcaacaaccatcgcgatggaagcctgtggcggttctcactttatggcacgcaagctggcagagttagggcattttccaaagctgatatcaccgcaatttgtccgcccattcgttaaaagcaacaaaaatgacttcgttgatgctgaagctatctgtgaagcagcatcacgtccatctatgcgtttcgtgcagcccagaaccgaatctcagcaggcaatgcgagctctgcatcgtgtccgtgaatccctggttcaggataaggtgaaaacaactaatcagatgcatgcttttctgctggaatttggtatcagcgttccgcgaggtgctgccgttattagtcgactgagtacccttcttgaggacagtagtttgcctctttatctcagccagttactgctgaaattacaacagcattatcactatcttgttgagcagattaaagatctggaatctcagttgaaacgaaagttggacgaagatgaggttggacagcgcttgctgagtattccctgcgttggaacgctgactgccagtactatttcaactgagattggcgacgggaagcagtacgccagcagccgtgactttgcggcggcaacagggctggtaccccgacagtacagcacgggaggtcggacgacattgttagggattagcaagcggggcaacaaaaagatccgaactttgttggttcagtgtgccagggtattcatacaaaaactggaacaccagtctggcaagttggccgactgggtcagggagttgttgtgtcggaaaagcaactttgtcgtcacctgtgctctggcaaacaagctggccagaatagcctgggcactgacggcgcgacagcaaacttacgaagcataa

SEQ ID NO: 4146 - DNA, 2448 bp, Klebsiella pneumoniae
atgatcgtaaccatcaaaaagaaactcgaagaaacgttgatcccggagcacttgcgagctgccgggattattcctgtcctggcctatgacgaagacgatcatgtcttccttatggatgaccacagtgcaggctttggtttcatgtgtgagcccctgtgtggtgccgatgaaaaagttcaggagcgaatgaacggtttcctgaatcaggagttcccgtcgaagactacgctccagtttgttctgttccgctccccggacatcaatcaggagatgtaccggatgatggggttgcgtgatggcttccgtcacgagctgctgacatctgtcatcaaggaacggattaacttcctccagcaccacacgacagatcgcatatttgccaagaccaacaaaggtatctacgacaatggcttgatccaagacctcaagctgttcgttacgtgcaaagtccccatcaagaacaataacccgactgaaagcgaactccagcagctcgcacagcttcgcacgaaggtcgaatcatcgcttcaaaccgttggtctgcgtccccgcacaatgacggcggtgaactacatccggatcatgagcaccatcctgaattgggggccggatgcttcatggcgacatgactctgtggattgggagatggataagcccatctgcgagcaaatcttcgattacggcaccgacgtggaagtcagcaagaacggcatcaggctgggtgactaccacgcgaaagtcatgtcagcgaaaaagctgcctgacgttttctactttggtgatgcgttgacctatgccggggatctcagcggcggcaactccagcatcaaagaaaactacatggtcgtgaccaatgtgtttttccctgaggcagaaagcacgaaaaacactctggagcgcaaacgccagttcactgtaaaccaagcctacgggccgatgctcaaattcgtgccggtgctggcggacaaaaaggagagcttcgacactctctatgagtcgatgaaagagggggctaagccagtcaagatcacctattcggtggttttatttgctccaaccaaagaacgtgttgaagcggcggcgatggccgcacgaaacatctggcgtgaatctaggttcgagctgatggaggataagttcgttgctctgccgatgttcctcaactgcctgccattctgtaccgaccgagatgcagtgcgagacctattccgctacaagaccatgacaaccgagcaggctgctgtggtcctgccggtgttcggggaatggaaggggaccgggacctatcatgctgcgctgatttcccgcaacggccagctcatgagtctgtctcttcacgacagtaataccaacaagaacctggtgatcgcagccgaatccggctcgggtaaatcgttccttaccaacgaactgattttttcctacttgtccgagggtgctcaggtctgggttattgatgccggtaagtcataccagaagctgtcggaaatgctcaatggcgacttcgttcactttgaagaaggaacgcacgtctgcctcaacccgttcgagctcatacagaactacgaggacgaagaagacgcgattgtcagcctcgtttgtgcgatggcctcggccaaaggcttgctggatgaatggcaaatctctgcgctgaaacaggtcctttctcgcctgtgggaagagaaaggtaaagagatgaaggttgacgacatcgctgagcgctgtctggaagaagaaaacgaccagcgcctcaaggatattggtcagcagctctacgcctttacgtcgaaaggtagctacgggaaatacttctctcgcaagaacaacgtcagcttccagaaccagttcactgtactggagctcgatgaactgcaagggcgtaagcacttgcgtcaggttgtactgctccagcttatttaccagatccagcaagaagtattcctgggtgaacgtaaccgcaagaaagtcgtcatcgtggatgaggcctgggacctgctcaaagagggtgaggtctcggtcttcatggaacatgcctaccgcaaattccgtaagtacggtggctccgttgtcattgcaacgcagtccatcaacgacctctatgagaacgcagtgggccgcgccatcgcggagaactcggccagcatgtacttgctcggccagaccgaagaaaccgtggaatctgttaaacgtagcggtcgtctgaccctttcagagggcgggttccacaccctcaaaacggtacacaccatccagggcgtgtactcagaaatctttatcaaatcgaagagtggtatgggcgtcggacgcttgatagtgggcgacttccagaagctgctttattcgaccgatccggtggacgttaacgccatcgaccagtttgtgaaacaaggcatgagcatccctgaggcaatcaaggccgtgatgcgaagccgtcagcaggctgcataa

SEQ ID NO: 4147 - DNA, 186 bp, Klebsiella pneumoniae
gggggtgaaaccggcgatctctcggtcccgttgacaaacaagagcgacggttggggtgataaccctgccaacgtgaagagtgtggttgaagccgacatctcgggccagcactgtgtagaggcggctcacgttcatgcctaccaaccagtcagcgcgttgccgtgccaatgcggcgtagtagagtga

SEQ ID NO: 4148 - DNA, 297 bp, Klebsiella pneumoniae; identical to SEQ ID NO: 2022

SEQ ID NO: 4149 - DNA, 642 bp, Klebsiella pneumoniae
ggagaaccgactatgaagaagccgtggttgctggtcgcatggctgctggttattgagttgctggcgatattgctgctgatccctggcgactggacagacagagccatcaaaagagaatccgtgctggtggaacagagtcttggtgtcgaagcaagagactggatacagaacaaagcatctacctggttcaggtcgagcgttattgattcaggcttctacgagggcatgtaccaaacgctgatcccatcagaagaggaacgtcagaagtccaaagggatgcaggacatgggtaagggctggtttgtgtgggtcaaaggtcgcatggaggcctttgttaacgtcatttaccagttctacacacggttggcgctgttggccgcgtgggctccctacatgctgatcctgttcgtgcctgcggtatatgacgggatgatgacgtggcgaattaagcggaccaacttcgattatgcgagtccggttctccatcgttatagcgttcgcggaacgatgtacctgatggccggattgttcatcgcgttcttcatccccatagcgctcgatccggttgtcattccgatgacaatgatgacgtgctgcgttctggtcggactgacgttcggcaacctccagaaacgtgtatag

SEQ ID NO: 4150 - DNA, 600 bp, Klebsiella pneumoniae
cgtgtcaggacttttctctccagatgtgatcgggtgggccgctggtgtggccttcaccctcattatcttttctgttttcacacggccagcgatgtacggataccacaactttttcaagcagcatatttgctcaagagtaaagcaagtaacaccagaactcagaacagtcactgggccactgttcttctaccgaaacgaaattggacgatacagagaggaattatgaaagtaaccaagaaaattcaactgctggcgctgggcatgtttatggccgggacagccattgcggtccctgatgtgctcaatgacgacgcaaagctcaagaaccttgagaaggtgtgtcctgactgtgaaatggtggcaaaagacgtgctcaaccttcgggttgaaaactgccagctcaaagatacctccagtgcaatgatgataggaaccatgcaaagtgatcccatgttttcgtttatgctggcggtacacacggcggctggcggagaagcctataaaacagtggtaggggccgctgccacccatgttgactgtgaaaacccgttgaactggatcaagctgacccagcaagcaattaaaggaggcaaagcctaa

SEQ ID NO: 4151 - DNA, 192 bp, Klebsiella pneumoniae
acaggagggacagctgatagaaacagaagccactggagcacctcaaaaacaccatcatacactaaatcagtaagttggcagcatcaccccagaaatagatgggtttgcactattggcatcactccaaagagaccctttggcgttattaccaacactatccatgttgtcgccagaatcataaattccctgtag

SEQ ID NO: 4152 - DNA, 672 bp, Klebsiella pneumoniae
atgatttttgccccggctttccaaccaattaaagacgtcggcactggttcgtttgtcgctgctgaggtactggctcgttggtacgacgaatgccgggttcttacgccatcctctctttcatcacctcctcactgggggctggtggacatggaggtggcgcggttcattcacgacaatcttcacctttgccaggatcggtatccgactctcttcctgaacgtctccgaacaaactttgtactcaggcgtcattttcaaagcctgggcgcgagttatccaatccattgctgagaatcactcatcacggcttgtcatcgagattacagagggcattcaggacgcctcactcgcatcgagatgggccgctctgaccgaaataggggttgagctggcgctggatgactatggagacaaaaactcttctctggagcgcctgagccgttatgactggcactattgcaagtttgacgcgagaagactgcggtcgcttgaagactacccggccatcctccactgccgccgaaaaggcatacagctcattgctgagcaggtggagagcttcccattgggggagagtgccaaattacttggactgtcatggcaacaaggtttctatcacgggaagcctgctgtcatggagaaacatttgaattacgtaaaggccttaccatga

SEQ ID NO: 4153 - DNA, 1344 bp, Klebsiella pneumoniae
gcgtccatcgctgctgggaggtgcccaatgattaagcgattttggacacagttagaccccaacaagaagcgttgggtgtctatcgctggcggcgtcttcgttctttttgcggtcgtgacaatgttctctggtgaacccaagaaagaagagaagcgcggtcgccaagaaaccatcaagcacgttctcacagacaaaaacacccgtgagatcgggatagattcgttgtctgccgatgtgaagatggtgtctcgtgaaaactccgacctgaaaaaggagctggaacgagtcaagaaagagctggaggaaaccaaaaccactgccgggaaatccagtgatgttggccgtgagatgacccgccttcgtcaagatttggaccgcctgacccagaagaacatggaattggctaagaaagtcgaaaccggcgctgctggtggaaaaacatcctcttcatcagaggatgccagagccgatgttaatggtgcatctggtggtgatggtcagttcatggagaaaaagctcgactacaaagatccagcatccttttttcgggacgcaccgcttcctgactcgaagggtggggctcctgcaactggcaagggagacggtcgtgatgcaactaaaccaggcatccaaatagtgagctactcgcagaaagcgccagaagttgaagagaaggacaacaaggatgatgagtctatctacctaccttctggctccatcctgacaggggtgctcatcaacggtatggacgcaccaacatctcaaggtgctcgtcgagatccgttcccttcgaccctcaggattcagaaagaggctattttgcctaaccgcttccgtgcggatgttcgtgagtgcttcctgattgtttcaggctatggagatctcagttcagagcgagcgtacctgcgtggcgagaccttctcgtgcgttcgggatgatgggggggtcatagaagcgaagctggattcctatgcagtgggtgaagacggtaaggccggtgtccgtggtcgcgtcgtatcgaagcaggggcaaatcatcgccaagagcttgatggcaggcttccttggtggcgtttccgaagcctttgacgtcaatcctgtgccggtcgtcagcactaaccctggctcaaatacccagtaccagtctgtgttctccgaccagatgttgcagggagcagcagtgaagggggccagtaaggcgctagatcgcatcgctcagttctatatcgacatggccgaaggcatcttccccgttatcgaggtcgatgctggccgtcaggtagacatcatcgtgaccaaaggaaccaagctacaaattcgttccaccgggggaaccaagaaatga

SEQ ID NO: 4154 - DNA, 216 bp, Klebsiella pneumoniae
ataagggccgcatcgctcttcgaccttcgttgcagcccttacaacacaatcaagcaattaaggagctttgttatgctgcaaggcaatactaacacgaataagcgcatcccgctcgcggcgttcatgaaatggccgctggcgaaacgtcaggacttcatcgaccgggaaatgtccggttgccccgactttatcaagacgtctttgcttcggcattaa

SEQ ID NO: 4155 - DNA, 981 bp, Klebsiella pneumoniae
ggaagccacgcaccaaaactgttttggagcagctcaagcgcaaagaagagaaccggagaaagcatgaagaacaacgctaaactttcgctcctggcgctgtccttggcgcttggaacatcaatggcctatgcctcagatgacattcctgttgtcccggccagtgttatgaaaaaggacgttcctgcccctgtgacgtcgggacaaagctcccatgaggttgtgggtagcatgaatgaaaaccccgtactgacgatgaagcctggggtgaaccagatcatcccgatagccgttggtcatccgaaccgaatcgtcacgcctttcagcaatcctgagatcgtttcaacatctctgaccggggcgacggataacggccagtgtggtgaggtctgcatcaaagagaatgtggtctatgtcgccacggataagcagtatccggtgactatgttcattactgaaaaaggctcggaagcccaagctctcagcctgacgatggttccccgtcgtattccgcccagagaagtctttctcaagctcgatggtggtgtaggtatcactggtgcttttgccaataccaaggctgagacctgggaacagagccagccttatgtcgaaaccatccggtcagtattccgaaagattgctcttggtgaagtccctcaaggttacacgttgaaccgcatccctgctggtgctgcggtgccgagctgcgctcatcctggggtaaaggtggatttcagcaaggggcaatacatgatgggccaccaccttaacgtgttcatcggtgtcgcccagaacgtctctgatcagcctattgagttcaaagaggcgttgtgtgggagctgggatgtggctgcggtgactacgtggccgcttaacgtgattgagcccggccagaagacggagatctatgtggcgaagaagcagaagcgtggtctcgcaccaacgtctaagcgtccatcgctgctgggaggtgcccaatga

SEQ ID NO: 4156 - DNA, 3024 bp, Klebsiella pneumoniae
gagcatgtagcgacgagaaatacgataggaatatggtcaacctacatgctgaaagcccttaacaagttatttggtgggcgaagtggagtgatcgagaccgcgccgagcgccagagtgttgccgctcaaagacgtggaagatgaagaaatccctcgatacccaccttttgccaagggcctgccagtggccccactagacaagatactggcaacccaagctgaactgattgagaaagtgcggaactctctcggtttcactgtggacgacttcaaccggcttgttttgccggtgattcagcggtatgccgcgtttgttcacctgttgccagcttccgaatcacaccaccaccgtggcgctggtggtctgttccgacatgggcttgaagtggccttctgggcagctcaggcatctgagtcagttatcttttccatcgaggggacgcctcgggaacgccgtgacaatgagccgcgttggagactggcgagctgtttctctgggctgctgcatgatgtgggtaaaccgctctcggatgtgtccattacggacaaagacgggtcaatcacatggaacccgtattcggagtcacttcatgactgggcacaccgtcacgaaatcgaccgttactttatccggtggcgcgacaagcgacacaaaagacatgagcaattctcgctgctggcggtggatcgaattattccggctgagactcgggagtttctgtccaagtctggcccgtccatcatggaagcgatgctggaagctatctcaggaaccagcgtcaatcagcctgtgaccaagctgatgcttcgcgctgaccaagagagcgtctcacgggaccttcgccagagtcgtctcgatgtggacgagttctcctatggtgtgcccgtcgagcgttacgtgttcgatgccatccgccgcctggttaaaaccggaaaatggaaggtcaatgagccaggcgcgaaagtctggcacctcaaccaaggtgtattcattgcctggaaacagcttggggacctttatgacttgatcagccacgacaagatccccggtatcccacgagaccctgacacactggccgacattctcatcgaacgtggttttgctgtaccaaacacggtgcaggagaagggtgaacgtgcgtactaccgctactgggaagttttgcctgagatgctccaggaggcggcgggttcggtgaaaatcttgatgctccgactcgaatcaaacgacctggtgtttacgactgagcctcctgcggctgttgctgcggaagttgttggtgatgttgaggacgctgagattgagttcgttgatcctgaggaagccgatgacggtgacgaccaagaggaaggtgaagcagctctgaacgatgacatgttggccgcagagcaggaagcagagaaagctctagctggccttggctttggtgatgcgatggagatgctgaaaagcacctccgatgctgtcgaggagaagccagagcaaaaagatgcgggaccaacggaatcatctaagcctgacgctggcaagaagggtaagccgcagagcaaaccgggcaaagcaaaaccgaagagtgatacggagaaacaaccccataaaccagaggcaaaagaggatctgtcccctcaggacattgccaaaaacgcaccacctttggcaaacgacaatccgttacaagcactcaaggatgttgggggtggactgggggacatcgacttcccgtttgacgcattcaacgcatcggcagagacaaccagcactgacgcaacaaactcagaaatcccagatgtggcaatgcccggaaagcaagaggagcagccaaaacaggacttcgttccacaagaacaaaactccctgcagggcgatgactttccaatgttcggtggttctgatgagcctccatcgtgggcaattgagccgctcccgatgctaactgacgcaccagaacaaacaacacctgcgccagacatgtcacatacggacaaacccagtctggatgagaaagacgcaaagaccttgctcgttgagatgttgtctggatacggggaagcatcggcgttgcttgaacaagcgatcatgcctgttttggaaggtaaaacgacgctgggcgaggtcctttgcctgatgaaggggcaagcggtcatcttgtatccggaaggcgctcggtcgctgggtgcgccgtcagaggttctctcgaagctgtctcacgccaacgcgattgtccctgacccgattatgccaggccgcaaagttcgtgatttcagcggcgtgaaggcaattgtgctggcggagcagctttcagatgcggtcgtggcggcgattaaggatgttgaggcgtcaatgggtggataccaggatgcctttgagctcgtctctccccctggctcggatgcaagcaagaacaagtctgcaccgaaacaacagagccgaaaaaaggcgcagcagcagaagccagagattaatgctggtaaagccgcgcctgaacaaaaggcgaaagctaaggactcccagccacagccgaaggagaagagaggcgacgttgcttcttcggtcgaagagcagaagcgtaagccggtccaagaaaaacagaacgtggctcgccttcctaagcgggaggctcaaccagtggctcctgagcccaaagttgagcgtgagaaggagttgggacacgtcgaggtgcgagaaagggaagagccagaggttagggagtttgagccgcctaaggcgaaaacaaacccgaaagacatcaatgcggaagatttcttgccgtctggtgtcacccctcagaaagcgctccagatgctcaaggacatgatccaaaagcgctcgggccgatggctcgtgacacctgtcctggaagaggatggctgcttagtaaccagtgacaaagccttcgacatgattgccggtgaaaacatcggcatcagcaaacacatcctctgcgggatgctgagccgggcacagagacggcctttgctcaagaaacgtcagggaaaattgtatttagaggtaaatgaaacatga

SEQ ID NO: 4157 - DNA, 798 bp, Klebsiella pneumoniae
gggctttcagcatgtaggttgaccatattcctatcgtatttctcgtcgctacatgctctcaaaacacctttagatcgcacacacgcctatctgtccaatttgggcagtttgagaaaccagctttccatccccccccttttagaatgggctcatcgacaatttttgatgaggaacgacacgatgagacaactgatagcaattctgggagtggcaattctggccgggtgtgcctctaacgcccccgagcaaaagcctcagccccagactgcccctgccgaaaatgacaaacctgcccgagttagccgggaactgtcgatggcatgggacaacatggggcgcggtggtgctgcattgcgtcaacctggttatatccatgtgctgggcgacggtaatgtcagcgcaacgatgaacaagatcaaagatggctccgctggttcagataaaactccagcagggatcaagcagcacggggatgtgaacgaagccatcaataccttcaagtccatgaataaaggcaaaggctactcgctgtacgagttgtcacgctgggaacgctattgcgatggcggcaaaggtatggacgagcacgattggcgctttgtggaagccgaggggaccacaaacatccccaaggacgttgtaaccggctgcataccacctacccacacctatcaagattatctgaatgcctggacgcacttttgcaccagccaggctgtaactgacgcagatcgccgcattgtgcgcgagtccgtgcgtccctattcagtggtgaacccatgcaaagctctgaaataa

SEQ ID NO: 4158 - DNA, 297 bp, Klebsiella pneumoniae
tcgtcgcgggccatctgcaaggccaggcgaaaaagcatgatctgcacggcttccagcacgatcttggcgacgccctgggcctcggccgccaggtcggatagatcgaccacgccagggacggccaggcttgcgcctttggcctgtatcgaggccaccaggcgctcggcctcgggcaaaggtaggcggctgatgcggtcgatcttctcggcaatgaccacctcgccgggctgtaggtcgccgatcatgcgcagcagctcaggccggtcggcgcgtgcgccggatgccttctcacggtag

SEQ ID NO: 4159 - DNA, 420 bp, Klebsiella pneumoniae; identical to SEQ ID NO: 4000

SEQ ID NO: 4160 - DNA, 222 bp, Klebsiella pneumoniae
ccgatggatctggaccaaaagcaagaaccgtggatcagcgtcaacgacaagatgccggtcgtcggtgtgcctgttcactgccagcttaaaggatgttggtcgggcaaaattgttgagtacgacttgatccatgttcaggaagatgattgctcgtggcgaacggcggacgacaactcggaagtcagctatgactttgatgtcatcacctggagacctatttag

SEQ ID NO: 4161 - DNA, 318 bp, Klebsiella pneumoniae
ggtggaaatcacttcgtcagccctgatgtctttgtaagcacaccagtgaggtttaacggtgatcacaccatttaccaaaacgatgtcacacgccagtgtcgcttcaacattatcgttaacatcctgccgagcgtagatctccacgaaaccaacctgctctggaacaaccttgtcgatgaagctccaaaagctggggtacgacgttccatcgctgagcgtcaactgaccgtcatgctctttcagcatacggttcagttgtgcagtgaagaactctgccgacacttttcgcgccagaggctccaaatcactaagccgtag

SEQ ID NO: 4162 - DNA, 666 bp, Klebsiella pneumoniae
agccaaatccatagaagtataaaggaaggtgaaatctggggcggaattatgttttttgataacaaagtagaatctcactcgcttgtaattggagccagcgggaagggtaaatcggtcttttccgaacaagtacggaaaaatgcgaggctgcgcggtgatctgctggtggatactgagatgtaccgtgaaggtcgagggttgaaaccatacgagcatgagtacgctcgtcgcttagttctggggctaagtggaccgttgccgcgtgaactgcgtgggaagccggtgacggttatctctgatgtgtccaggccaaaaaaggtaaagcgtcagccaaagcaatttgttaagaccgtaaatggcgtaacccttgaacgccagttggtggccgatgcaagagaacagttggaaatgcaaacaggagtctggctcaaacaacctcagctcatcgagctgatggaggagtcgggcatagacgaaactctggccgagtttggtgaggctgaaacacagatccgagaaatgctggcggattcgttggcaatgaaactggtagggcactcatggcccaagtgtggagccctctataacgcggcagaaaagtccgacgtcaacttttcttccgagcttgatgctgcggccaaagaagcaggatacatggttcgctaa

SEQ ID NO: 4163 - DNA, 1248 bp, Klebsiella pneumoniae
actggctgtctccaaacacaccaccaccatcaccctgctgtcgccgtgcatcatattgatattgcctccttctggccaggttataccgtcatcgcccaagcgctttctgccaaccatcacaccctgtttacccttgagcctcgcgccgacctgttgccccgttgtcgccgatgcctgcaacccacgccattgatccacgaccaacgtatccgccgggtgcgtgagcgagacctatttgaccgacaagtctggttacaactgcctgttcgccgcgtcgactgtctgcgctgtggtcgcgtcagtgaacatatcgactggctcccctctggctcccgcctcacccggcgcatgcagtgctggattgaagcgctcgttcagtacctccccatccgccatgtcagccagctcaccggggtcggttggcacaccatcaaggagatcgacaagcgccgtttgcagaccagtgtgggcaccatcgaacttggggaggtgcggcggctggtgatggatgagtttgccctgcacaagggacaccgctatgccaccgtgatcatggatgccgagcgaacccgcgtcctgtgggtggggcacggcaacagccgggccgctatccgtcccttcttcgagcagctcggcgagcgatgccagcagattgaagcggtggcgatggacatgaacacggcgttcgacctggaggtgaagcaacactgcccgcaggcggaggtggtctacgacctgttccacgtggtggctcgctatggccgagaggtggtggaccgggtgcgagtggagcaggcgaatgcactgaaaagcgataaaccggcgcgaaaagtggtcaaaagtgcgcgttggttgctgctacgtaatcgggcgaagttgagtgaaaaacaggatgtgaagttgcaggagctgttggcggcgaatcaaccgctggcgatggtgtacgtgctgaaagaggggttgaagggcatctggtatgcgccgagcgtgtgggaaggatggcgacgatggcggagctggatgcggcaggtgaaggaaagcgggctagcgccgctgcaacgatttggtcgaaatttatcgaaatatatgcgggggatcctggcgagtgcaaactacccgatgcacacgagtgtgctggaaggggtgaacaacaagatcaaagtgataaagcgcatggcatatggatttagggactcagaatacttttttctgaaaatcaaggcggccttccccggaaagccgcgatga

SEQ ID NO: 4164 - DNA, 501 bp, Klebsiella pneumoniae
atgaaagcccaggcatacccaccatcagtcattcgtaaaggcgctgtgttgtacgcagccctttattacatctctgatgatgataaagcaaaggtcgaggttacagagtggatagttcgctctattcagaaacgacgcaactcaaccagcgatcaacgctatgtcaatcttgcccaaaagttagatgggattacgtgggggaaaaggtcacggaagaatggggactttggttggttgccatctataccgagctggtgcttgaagcagttccgggaaggtggcgaattgccttttggcgtttatacgacgcgactggccgctctcaagtttgcgaaagtcagcttgcaggaagaggtccaatattgcgaggccgagctgaaaaagcctcagacagaagatgatactcaggaactccaagaggagctggcggagaaccagagacttctgaaagctgctggagcaatggtgaagcgcgagcaaaacaagaagaaaagaggttga

SEQ ID NO: 4165 - DNA, 558 bp, Klebsiella pneumoniae
gtttatcaccaccgactatttgcaacagtgcccgaaatcctgcggctggccacctcgatcaagcagggcacggtgacggcctcgctgatgctcaggaaactcggcagctacccgcgccagaacggcttggccgtcgcgctgcgcgagttgggccgcatcgagcgcacgctgttcatcctcgactggctgcaaagcgtcgagctacgccgccgcgtgcatgccgggctgaacaagggcgaggcgcgcaatgcgctggcccgtgccgtgttcttcaaccgccttggtgaaatccgtgaccgcagtttcgagcagcagcgctaccgggccagcggcctcaacctggtgacggcggccatcgtgctgtggaacacggtctacctggagcgtgcggcgcatgcgttgcgcggcaatggtcatgccgtcgatgactcgctattgcagtacctgtcgccactcggctgggagcacatcaacctgaccggtgattacctatggcgcagcagcgccaagatcggcgcggggaagttcaggccgctacggcctctgcaaccggcttag

SEQ ID NO: 4166 - DNA, 393 bp, Klebsiella pneumoniae
gcaggccgacagtggctatgcgaattgcctttgcgtttggtgatgcaaaggtgtccgactgggacgaagctcaagagctggttatcgagcctttggtacaaggggaccgaaatgagtaagcgatatgcggtagtgccgcatccgaaactgaaacgagagtacaaaggtcggctggtcagaactactcgggtactaaaaaacggctgggggttgatccctctaggggctgtggcaacggtcacgcatcagtctcccaagggctcagcgctgacctttgaaccatgcgactgctgcggcctgaaagccattatcagtcatgtaagcatggactccattgaatttatcgaaccgattactgaggaagaagatggacgagaacaagctcaacattga

SEQ ID NO: 4167 - DNA, 189 bp, Klebsiella pneumoniae
cggtacgggcatgaattttcctcctttaacgactctaaacactcattctgcgatgtacttggtcaatggattgaaaacgcaggtgtttgccgcatcaatctgtctaacgagcaatatctcaggactgctcataacagcaaagctattccaaccaggaataacaaaagctatgattttcgtcggcagtaa

SEQ ID NO: 4168 - DNA, 312 bp, Klebsiella pneumoniae
atggacgctaaagaactgaaccacatgatagctgaggcctacagccgggatttgcaaaagcctgagctggtatcgttcaaagaggtgagtcgctgggggcgtaagtacggtttccccgtcgtatgcactctggccgatgaaagtgaagaaaagcagatccactgggctgccagtttgctcattcaagtagccggtacttggccgcgagaagatatgccggaattgctcacaccggaacggggctccgcgctgttcaacgatgcgatgcagttattggcgaatgggcttggagcagcaaatcaattgcgctga

SEQ ID NO: 4169 - DNA, 243 bp, Klebsiella pneumoniae
cgccagataaaaggcctgctggatacagagggtactcttacccactccgcctttctggttggcgaagctgattacttttgccatacccacctctattttggtttctcgcaggtgatcaagaccacccccaaactttcacatgtgaaagattgtagcgatcataaaatgatactgcaatatctaattatggttctgttaaaacaaactttaaacaaaaaaacggccatgaaggccgcttattga

SEQ ID NO: 4170 - DNA, 1305 bp, Klebsiella pneumoniae
tcgcaaaaaaaaaccgacacgcccgaagccatgactattatcaatgcaacccagtacctcaagcaacttcttagctcttctgaactcaaccggatcggtaaatttaccggtttttgtcagcgactccgggatatccagcctgcgagactactcccggctctgctctcagggcttggttgcgacaaggtggatggtattgctggtttgcatcgccatttcaatgcgttgcagctccatgatactgaccaaatagcgtataaaccctttcacaaccagttacgcaagcagggttttcccttgttcatgcgcgcactggttgaacgagccatcgccttacgcctcaaggagtgtctaccggacgcccacggactggcaggctttgagcaggtactgctgcaggacgggtcgtcattcgcgttacatccgcaattggcagaacatttcccgggccgattcaataagcacagccccgctgcggtagagtgtcatatgaccatgtccttgctggaccagtcgccgatatcgatgagtatcacggcggataccgaatcggagcgcaagcatcttccggccgcaaattcgttaaataacaaactgttattggcggatgccggttacatcagccgcgagtactttgctgatgtgaccaaagccaaaggaagctatctggtcagagggagtcaaaatctcaatcccaaagtacaggcagcttaccgacaggacggcagggaaatgcccaagttactcggaaaaaagctcaaggatatcgatcggagaagctgcagagccgaggttctggatctggatgtgagttcgggaaagtataaatatcgactcataagacgttggtttgcagaggaaaaacggttctgtatatggatgaccaatcttccgcgtgagcgatggccagccgagaaggtgatggcattgtatcgttgccgttggcagatcgaactgttgttcaaagagctgaaatcacataaccggttgaaggcgttcgcgacacgacaaaaagcgatagcggaaggcttgatctgggctagtttgctggccttgctggtcaaacgtcggctggcgctgacgctgattggcagcgcggagttatcgatgctgaagattgccaaaaacagcgcgctttggttaatgccgatattggcgagcatcatccatggtgcgtggcaggaaataacagagaagttggagtgggcaatggtgtatttatccaaaaacggcaaaaagagtaggcagagaaaatccaagcaaaacaacacgttagacggtattattaattcgcttgccgcttaa

SEQ ID NO: 4171 - DNA, 525 bp, Klebsiella pneumoniae; identical to SEQ ID NO: 2057

SEQ ID NO: 4172 - DNA, 1131 bp, Klebsiella pneumoniae
gcaggtggagagcttcccattgggggagagtgccaaattacttggactgtcatggcaacaaggtttctatcacgggaagcctgctgtcatggagaaacatttgaattacgtaaaggccttaccatgatacaaaaaatcctacggatcatggccgttagcgcggtcttttgggttagctctgtatcggctgaccctgggtgccagaatgcggaagtgatcggcggaaaactgattactgacatctgctggagctgtattttccctatcaaagtcgcaggggttccgataagtggaggtggcggttcttatccaagtgatgcagtcacttcaccgttatgtgcctgcgatgacaaccttggggtgcctcgacccggtgttactacttccatgtgggagccagcaaggttagtcgagtttcagagagtgccaggatgctcctctgtgttgaatgggactcgcttcccctttgatagaacgaatcaaggccatcatggaatgggagatatggatgggggtgatggctcattcatgcactatcactattacgcatttccattacttataatgcttgacctttttatcaaacaaacgtgcaacgctgatggatatatggatctcgacatcatgtacatgtcggagcttgatcccacttggaacaatgatgagctggcctttttcaccaacccagaagcggcggcagtggcaaacccgattgcggcggctgcatgtactgctgatgcggtctcttcgacagcaggaaagccactcaagcaacttttctggtgtgcaggttcttggggaactctatatccatttagcggcaaccaaaatggtgggaagggcgtgattcgtgatagcagcctcttgagcgccagagttctggctgcgctccatcgtcgaggtctcgcgtggaaaacaatggggtccgaagcgatgtgccgtggggttatcagcccgacactaccgaaaacgcagtacaaattcacactgctgcatcctgttccggaaaccaactcatcccatgtgatgggggaatccactttgacgtggggattggctcgcacaatacccgctattggtcaggacccaatctacacaatttggcgttggaatgattgctgtaacaactaa

SEQ ID NO: 4173 - DNA, 234 bp, Klebsiella pneumoniae; identical to SEQ ID NO: 2064

SEQ ID NO: 4174 - DNA, 186 bp, Klebsiella pneumoniae
agctttctctgcttcctgctctgcggccaacatgtcatcgttcagagctgcttcaccttcctcttggtcgtcaccgtcatcggcttcctcaggatcaacgaactcaatctcagcgtcctcaacatcaccaacaacttccgcagcaacagccgcaggaggctcagtcgtaaacaccaggtcgtttga

SEQ ID NO: 4175 - DNA, 192 bp, Klebsiella pneumoniae
ctctttacctggtttggtttctgctttgctgataacagcattggcaccattgacctgggaggctacctgctcggcataggccttattgacgcaccggccttgctcgtcactgcactcttctggtggtatccattgggcggcaaactgtccattctgtacggacacgttcacacccagagtccagtatggtga

SEQ ID NO: 4176 - DNA, 816 bp, Klebsiella pneumoniae
aatggccgctggcgaaacgtcaggacttcatcgaccgggaaatgtccggttgccccgactttatcaagacgtctttgcttcggcattaaggcgatcaggcaggaaagcaaagaacctcgcttcggcggggttcttcgtttctacctcttgaatgtttcgtcagaacaaactggagcgcttatgtcaccagaaacacagcaacttacatccaaggctttatctctcatcgagcagtcccgatacagaatgggcacatctcggtttgttgaggcctttattgaccagtgggcatacttgcagactggcctatacccagccaaggaggagatcccggaagaacttcagccggtcgccttcgagctctctcacgtcctgtctgccgccattaagcgcgaccccaccagtgatgttttgggttacgtcctaagcatgtctggcttccacaagaagggcaccaattacttccccactcctccagagattggccgcttgatgtcactcattgttggctcacagtcttcggcagacttttatgagccctgctgtggttctggcatcaacgccattcactggatggaaaacctgatcgagaaccacggtcccgaagcattgagagaagcctcaatctacctggaagacatcgatccgttgatggtaaagtgctgcatgatccagctattccattatttcgagtcccgcaataccactcccaaaacgctgagtatcgtcggcatagacacccttagcagacgaaccaagaacatcgcctactacgccgaaaaacctccagcaaccgccgctaccgtggcagcataa

SEQ ID NO: 4177 - DNA, 453 bp, Klebsiella pneumoniae
aaattcggatgttcaaaccatgttttaaagaaatgtactaaccgagggaaaactgtgaaaaaaatcataatggcgttagcaactattatgcttctttcggggtgtgataatcatcaagacggtatgataaccacccatgatgcgtatcgtatgagccaagagcttttccctacccctattcgtgagaagctaaagacaatactggaggattctaaaacctttggtatggccgaatatcaagagttagatttggctatacaaaaaaattgcgatggaactgattacacatggcgcgattacgcaagtttactgccgacgaaaatcatagcttttgttattcctggttggaatagctttgctgttatgagcagtcctgagatattgctcgttagacagattgatgcggcaaacacctgcgttttcaatccattgaccaagtacatcgcagaatga

SEQ ID NO: 4178 - DNA, 726 bp, Klebsiella pneumoniae
ccatccggatggatacctgctccacatgatctactgggccgggttcatcatgaccaaggccaaatctctcaagaatccgtttgtccggaggtatttgccttgaacctgaaaaagtatctcaagacctgggaagggacccaaacagaaaacaagtggggtcgaatcttccaaggtggtcttatcgctattgttttcctgctggtgatccaggtgttcagcaaggaaaccatcgtcactatccagcctttcacgctcacggaagaagcctgggtgacgaaaagtaacgcatctcagtcctataaggaggcttggggtttcgcttttgctcagctccttggcaacgtgacgcccggaacagtggactttgtgaaggaacggatcaccccgcttctctccccgagcatctatcaggacgtgattgatgccatcgaaattcaagctcaacagatcaagaacgaccgcgtaaccatgcggttcgagccgcgttttgttgagtacgagcccaagagcgacaaggtgtttgtctacggatactcctatgtcaaaggggcttcttctgacgaagagcgtagcgaacgctcttacgagtttgccatcaagatttctaactacgcgcccgtgctgaactacatcgacacctatgtagggaagccacgcaccaaaactgttttggagcagctcaagcgcaaagaagagaaccggagaaagcatgaagaacaacgctaa

SEQ ID NO: 4179 - DNA, 435 bp, Klebsiella pneumoniae
aaaacggctcgtcgtcttggttcggcttcttcatgccctttcctcctggcgctcatcctggccgacagcggccagggcatcggcttccgtcaatgcgtcctccacgaacgcgccgtgctgcttcgcttcggcctggctgacctcggcccatatccgtttcacctgggccgcactgtacccggccagctcggcggtcttgttgatgctgtagccggacttgcgcagcgcgacaacttgggcgcggcgcttcggatcagcacggcggcccttgtaccgcccggcctggcgggccaactcaatgccttggcgctggcgttcgcgcctgtcctcgtagtcgtcgcgggccatctgcaaggccaggcgaaaaagcatgatctgcacggcttccagcacgatcttggcgacgccctgggcctcggccgccaggtcggatag

SEQ ID NO: 4180 - DNA, 183 bp, Klebsiella pneumoniae
ttcatcggtcgccgggatcaccgaaaaaccgcccatcccctcccctggctcaacggcgatgcccatacctggcttgaaccccataacatccaaaaagttggacgaaaccctaaccttgcgtttatcgcctactcgattgaacgcaagttgtttggttactacggagggggagacgatcggtaa

SEQ ID NO: 4181 - DNA, 201 bp, Klebsiella pneumoniae
accagcaatagacataagcggctatttaacgaccctgccctgaaccgacgaccgggtcgaatttgctttcgaatttctgccattcatccgcttattatcacttattcaggcgtagcaaccggtaatgactccaacttattgatagtgttttatgttcagataatgcccgatgactttgtcatgcagctccaccgattttga

SEQ ID NO: 4182 - DNA, 1269 bp, Klebsiella pneumoniae
aaaatgatcagatcattggccgcgcatatcccctgttctaagagcgttctggtggcgttgatgttctctgtggctggcggggcatacgctcaagagtctccgctcacagagcaggataaggcgcttattgagcaaggaaagcaaattgcccaaaaggcccagaagatggaaatgccatctctgttgcaaaaccaacacatggacgaggctcaggccgaagccaaggcatttttcaagcagctccagtcaactaacccgacgctaaaggaaatgcaccgcaagcaggccgaaaagggtatttataccgaccatcggatactggttttcgcctcgctgtctcttggcgatcaggggttggatgatgtcctcacagcggtgtcaggccagcctgatgctgtaattgtgttccgtggaatcccggaaggaatgaacctggggcagggggttaaagctattcaggcgctcgcggccaaaaaagacccagtgccgaacatcatcatcaaccctacgttgttcaaaacgtacaacatcacagccgttcccacgattgtgatgctggaggatgagccgttgcctggcgaacaaccaaacgtcgtcgcccaggtctccgggttgtccgacccggtatggttggctcgggaagtggataacggagaaaaaggcgatctcggcgttaaggggccggtggagaaaatcagcgagccagaccttattgatgttgccaagaaacgccttgccaatatcgactgggaagagaagaagaaacaggctgtagagcgcttctggaccaagcaaaacttcaatgagctacccagagcgcccaaatctcgaacccgagagattgaccccagcgtcatgatcaccagtgacataagcactccggatggcactgtgttcgctcacgctggtgacgtgattaacccgttgtgcgatccgaaggaagtttgcaagcctggaacgcggccatttacccaagcagttgtggttttcgacccactggacaaaaagcaaatggagctgctcgccaagaagctgcctgaaatcaagcaggaacctggcgtacaacggatcacctatatcgctacagagttcgataaagacaaaggctgggattcctacaagagtgtcaccgacaactttgacgcgccggtatatctgctgacgccagatctgattacccggttcgagctggagcacactccgagcatcattacagccagaggcaagaagtttgtcgtccgcgaacttgctgaggagggcggtgaatga

SEQ ID NO: 4183 - DNA, 318 bp, Klebsiella pneumoniae
aggaggcccagccagagaggttgggtctgtcaagaacaggtgaatatgaagatctcacaggacatgaaaagaaaatttgctttggtgaatgccctgtctaaaacggagaagccaagtctccaagaccttcacaaggcaacaaatattcctgaatcaacgatcaagagacagttgtctgccctgcgtgatgagttcggaatgaatatcttgttcgtcagggagtctaccggcgaacgaggtgccaccggctactacatgctgacagactgggggatcttagacaggtcttcgttcttgaaccggtacggaaaactttaa

SEQ ID NO: 4184 - DNA, 318 bp, Klebsiella pneumoniae
ttaacggcaaggtgtcttttacacccccaggccattgctgagttgcacaacagtcgggatgaccttttctgcatgttccagagtggcagacatgatggattccactacggtcggggagttgtacaggcccataccgccaccgatacccatagcgaacgccatgaggctctggcgagcgataccgccaacaacgccgaccaggatcatcgcacccgcaacgattcgacccagtgtaccttgtgtccaatccttgagagtttcccatacatcgtcaaaggcaccaccgccagtacctgcgtgggcctgatccggcattag

SEQ ID NO: 4185 - DNA, 576 bp, Klebsiella pneumoniae
gttctggggctgcactgcctatcccgattgcaaaggcactatgcctttcaaaaagtcggactttatggattgatagaggaaataagtatgtttggaacaattattttaaccgccatgctcaccaccagctcagtctctgccgaagatgcaggaacgagcatagcctcagacttggcgacggcatccgccagccaaataggtcaggtcatcgtgccaactctagccatcggctcggctattgcaaaaagcgcaggtaaaggcatggtatcaggtttggctgcggcgactgccagctatattccccacgacgagctgagcgccactcgaagctatcaaaatcctgaggctgttgatatggcaaaaggcctggggaccttgaaagaggtccctgatttcctgtacgtcattacagacgtaaatgccaacatggcggtcaaatgcaagcgcgtctgggagcctcaatctctggctttaagtcaattgattgttgagctggtggagttgcgtaagacgaacaacaaaggcagctacgaacaagcactatcccacctcgattgttcaatattctcagactaa

SEQ ID NO: 4186 - DNA, 678 bp, Klebsiella pneumoniae
aggaggcaaagcctaatgagcaaaagcgatttcttttttggagaagtgtatgacggaagcggtggggccactctacggcttagtgatttggagcctctggcgcgaaaagtgtcggcagagttcttcactgcacaactgaaccgtatgctgaaagagcatgacggtcagttgacgctcagcgatggaacgtcgtaccccagcttttggagcttcatcgacaaggttgttccagagcaggttggtttcgtggagatctacgctcggcaggatgttaacgataatgttgaagcgacactggcgtgtgacatcgttttggtaaatggtgtgatcaccgttaaacctcactggtgtgcttacaaagacatcagggctgacgaagtgatttccaccttactggtgcctttgcatttgaaggctctccagggtaaggcttacattcgctgggatgatggtgaaaccgaacctctgttacaaaacgacgactatcaggctgaacttgaaaatgtgtttagtgtttccaagtacccatcagccatgagctggggcgatacagcagaccagaaggttaagcagtacaagatggaccttgagtgcgccacagatgttggttgtcgaggtgtctcatcagagcaagcatgggatgcttatcgagaactccgttacaatagaacagtgtga

SEQ ID NO: 4187 - DNA, 195 bp, Klebsiella pneumoniae
tcaattaagagacgattactccgtgatgacgacaagttatttggagggtctatgtccgcacaagctcacgtcagagaaagcgaaagctcatctggttcattcatctcctggcagttccttgtctggcaggtgatgttcgttataggtgttgttgcagggatgaacctggaacacgcattcaattttctaggttaa

SEQ ID NO: 4188 - DNA, 603 bp, Klebsiella pneumoniae
cccagtaagagcagagctatgtgtgacaagaagtatagagattacgaggtagccatcatggtcgatgtgaaccctttcgacagggttatgaatgaattgaaaagtcgtggccgcaagaacgctcacatcctgagcatcctccaattcgactggcctgcatcggaggccatcatcgagaagctgagctgctacatcacagacgggattaaggctaatcaggagcctgtgatttacccgatcattgaagaagctctgcatcgctacagccagctcgtgtttcatgagcagagagagaaatatgaagacccggccagaatcggggcatttctggaaaccctgatcaccgaaacctgccgagcgttggaagtgcaaattgtcgatagtggcggtgattcatggtctgtcgattcaggagagtcgttctcactgtggctttcttcccatccaggagaactatccattaacccgcaaccccatgaggatgagacctctttgcgtggcttgctgtatgagctcatcacctgtgagagcgtgaaaactgttttaaggagaaccgactatgaagaagccgtggttgctggtcgcatggctgctggttattga

SEQ ID NO: 4189 - DNA, 300 bp, Klebsiella pneumoniae
gaaaagaagagggttgctatgaagcctgtaaagataccgcgccgggtcgatgagcccccgcatctgctgttgtggagcgcagatgagttggccccgatgcttttggggctaacgataggggtcatcatcggtaaggccctgatctgctttctgggggggttacttgtaaccaacctttatcgccgattcagggataaccatccggatggatacctgctccacatgatctactgggccgggttcatcatgaccaaggccaaatctctcaagaatccgtttgtccggaggtatttgccttga

SEQ ID NO: 4190 - DNA, 207 bp, Klebsiella pneumoniae
atgggatttggtgtggacaagatagatcggcaaagttggctcgttaaattcaggcgagcgaagtgtcaggacactttagacacgatgcgggatgcggccattcgcaactatgaagggaatattcgtgttatcgcggatattgtattggcccatgaggcgagagagacagaaattgaaaaagggatgttttgtcgaatagttagatag

SEQ ID NO: 4191 - DNA, 336 bp, Klebsiella pneumoniae
agaatggatggtggagtaattgtcgtgacagaacaaaccaataagaaattgatgctggatgagtctccagatatgcccctgcaattcaagtggagaaagtttggtggtgcgatttttactgccacgcaaacaatggatcacgtcaaggaagggcgtaagctcgggccgactccagcagggatgctacctcaagaagtgtggctgaaccgcctgatcgctatggaagaaaccctgccacgagggaagttttttgacagattccgccgccgcgacaaaaacgagcagtatgacttggccgccgatcatctccgtcttgtcggacagaaaaagcgatag

SEQ ID NO: 4192 - DNA, 375 bp, Klebsiella pneumoniae
ggcaatcaaggccgtgatgcgaagccgtcagcaggctgcataaccagggagacagtaatggacattaaatcaatcgcaatcgccgccattctcggtgccgctggtggcttcggcggtagctactacgtgatgagcgaacaaacggcaagcatccatcagcgtttgaatcaaaccccgccagtggtcgtggttgacttcgctaaagtggcgtcggcgtatcccgctggtgcctctcaggcggaagtcgaaaggctgatggtcaagaccaatgacgcaattttgaagttgaaagacgcaggttatttggtccttgacgcaagtgctgtcgtcggggctccaagtgacgtgtacctccctgatgaggtgctgaaatga

SEQ ID NO: 4193 - DNA, 243 bp, Klebsiella pneumoniae
gcgccaggaggaaagggcatgaagaagccgaaccaagacgacgagccgtttttcatcaccgaggagattgcggccgaaatgatcgccggcggctatgagttcgagctgccgcccattccttgcaccatccgcctacgcgacgtgctggagcgcatgaccgatgctgagctagcattgcagccgggcgagatcgccgaccaggagcgtgaacgctgccggcgcaagccgtgttcaacctcatga

SEQ ID NO: 4194 - DNA, 303 bp, Klebsiella pneumoniae
gtaagctgggggctgagaagaatgaagaggacattgccaatggcaaagggaaaagcggccagaacagagtgcgttgcccagagtatcggtgggcgcaataacagcgccaccagcttttgggaccgtattttaacagttgaggagacggccacactcattggcgtcaggatctctgagctcaaagacgcggtgcgctatcagaaactcctgaaagggaaggcagctccagaagtacactcggtatcaggaactgggaaactgttttttgatgggcgatcaattaaagcgtttatagagggctaa

SEQ ID NO: 4195 - DNA, 819 bp, Klebsiella pneumoniae
ttcggtcggggttcaaacgttcagacgggccaccggctttcgcgttttgagcagaaccaagcgcgcgaccataaggcgggcgctttatccgtgtgggtgaatcgcgggatctgccaattctttcacgttgttgaggattttacccagaaaccggtatgcagctttgctgttacgacgggaggagagataaaaatcgacagtgcggccccggctgtcgacggcccggtacagatacgcccagcggccattgaccttcacgtaggtttcatccatgtgccacgggcaaagatcggaagggttacgccagtaccagcgcagccgtttttccatttcaggcgcataacgctgaacccagcggtaaatcgtggagtgatcgacattcactccgcgttcagccagcatctcctgcagctcacggtaactgatgccgtatttgcagtaccagcgtacggcccacagaatgatgtcacgctgaaaatgccggcctttgaatgggttcatgtgcagctccatcagcaaaaggggatgataagtttatcaccaccgactatttgcaacagtgcccgaaatcctgcggctggccacctcgatcaagcagggcacggtgacggcctcgctgatgctcaggaaactcggcagctacccgcgccagaacggcttggccgtcgcgctgcgcgagttgggccgcatcgagcgcacgctgttcatcctcgactggctgcaaagcgtcgagctacgccgccgcgtgcatgccgggctgaacaagggcgaggcgcgcaatgcgctggcccgtgccgtgttcttcaaccgccttggtga

SEQ ID NO: 4196 - DNA, 837 bp, Klebsiella pneumoniae
aagtttgggggtggtcttgatcacctgcgagaaaccaaaatagaggtgggtatggcaaaagtaatcagcttcgccaaccagaaaggcggagtgggtaagagtaccctctgtatccagcaggccttttatctggcgttacagaagataaagaaagtgctggtcttggatatggatggtcaggggaacacgtcctctcgactggcccccagacgagagcttgaggatggtgactacgagcccatcctcacaggaaccaaaaccgcagagctgttcgcttacgagctggacggcattgaggtcatgcactgcccttgcggtgcagacctcattcatacgccgaaaaacgacccggatctgtttgagatggaggctgtgcctcttgaccaggccatgaatccggctcgccatttggctgagctgtttgagaactacgactacgtgctgattgattgtccgcctagcctcggcagaaagctggtggcagcgttggtgatgtctacccatgtggcatgtccagtaaagctctctggcttcgctgtggacggcgtagaaggtctcctgaacacgattattggtgtgcgcgaggcgtacaaccaagatttggagatcctgggcatcgtgatcaacgacatggaccgctctgtcaatcacgacaaagccctcaagtcgctggagaacacagttccggatctgttgtttgagaacaaaattatgcaccggcctccgctcgatacggcgacgactgatggcatccctgtctgggagcttcgctatggacatgtcgcggccaaagaagttgaggcggtgttggaagaactattagagaaggtgggctaa

SEQ ID NO: 4197 - DNA, 543 bp, Klebsiella pneumoniae
cgacaagttatttggagggtctatgtccgcacaagctcacgtcagagaaagcgaaagctcatctggttcattcatctcctggcagttccttgtctggcaggtgatgttcgttataggtgttgttgcagggatgaacctggaacacgcattcaattttctaggttaatgggaggaagtgtgaaccttaataaacaatttttctggtttttgatgaacgcggtgctgatgtgcatcttcatcgttccagtggccgtcgcgttttggctgtctgcttttgcggcaggttttgactggagtcagtgggttaagttggctgctgatacggccaacagagctgcaagtgacccggccaaggctctgggcacggttcagacctactggggcattctcagcttcttcctgctggcggcgtacagtctgatgttcaagtttaaagccaatgctaacaaggaagtgaaaactctgggggtggcccgaccagccaatgaagttagcgttgcggcttcggaaaaacattcggaagcggttcctcaaaatcaataa

SEQ ID NO: 4198 - DNA, 396 bp, Klebsiella pneumoniae
gagatgttcttgatgaacgcaaatcagttggcgaatgcctcaagtaaaaacaacgcactcttcctcttcctggggttgatggtggtagtcttcctgctaatgccggatcaggcccacgcaggtactggcggtggtgcctttgacgatgtatgggaaactctcaaggattggacacaaggtacactgggtcgaatcgttgcgggtgcgatgatcctggtcggcgttgttggcggtatcgctcgccagagcctcatggcgttcgctatgggtatcggtggcggtatgggcctgtacaactccccgaccgtagtggaatccatcatgtctgccactctggaacatgcagaaaaggtcatcccgactgttgtgcaactcagcaatggcctgggggtgtaa

SEQ ID NO: 4199 - DNA, 717 bp, Klebsiella pneumoniae
gggatagacatgcggacaaaattacttggggcgctgatggcgttcgggatcattaccggcacggctcatgcgtcatcgaaattggaaattaccgatcccagagcggcgaagatagaggacatcgtaaagctacccatcaaaggggtgcgggccgttcagagtgatgggcaaatcatgttcctctccgaaaatgggcgctttgttatttcaggacaaatctacgacctgtggagcaagaagccactcaatacgatgtcccaaatgagggatgtagcggaacgtatccacttcaagagcatgggcatggatgtggacacgctgaacactgtgtcgatgggtcatggtgacaaagaggtggtggtctttgtcgatccccggtgcgcggtttgccatcacctcatggacgatgccaaatcgctggtggatgagtacaccttcaaatttatcgtgatcccagctctgggcgctgagtccaaccgcctggcaaaagacttgtactgcgcgaaagacaaaacccacgcgctcgatgcgctgatgaacaacaccctgggttcccttccttcaaaagaaacctgcgaccccggccaatacgaccaaacgctgctgacagctcatttcattgggattgagggcgttccgttcgtggttgctccggatggtcgtgtcagcaaaggacgtccgaagaacctgaaatcatggttggagagtgctgaatga

SEQ ID NO: 4200 - DNA, 1869 bp, Klebsiella pneumoniae
aacatgacaatgagttatgacccgctcgcctacgagatgccgtggcggcccaactatgaaaaaaatgctgtagcaggctggcttgccgcctccggcgcggctttggccgtagagcaagtcagcacgatgcctccggagcccttctattggatggcggggatctgtggcgtgatggcgatggctcgtttgcccaaggctatcaaacttcacctgctccaaaagcatttgaaggggcgtgatctggagtttatttccattgcggagctccaaaagtacatcaaggacacgccggacgatatgtggcttggtagtgggttcctgtgggaaaaccgccatgcccagcgcgtgtttgagatcctgaaacgcgactggacttccatcgtagggagagagtccacggtcaaaaaggttgtccggaagatacagggtaagaaaaaggagcttccaatcggccagccctggattcacggggtagagcccaaagaagagaagctgatgcagccactcaagcacaccgaggggcattcgctgatcgttgggaccaccggctcgggcaagacccgtatgttcgacatcctgatttcacaggccattctgcgtggggaagccgtgatcatcatagacccgaaaggggataaggagatgcgggacaatgcccgacgtgcttgtgaagctatggggcagccggaaagattcgtctcatttcatccagcattcccggaagagtcggtgcgtatcgaccctctgcgtaacttcacccgcgtgactgaaatcgcaagtcgtttggccgcactgatcccatccgaagcaggggcggacccattcaagtcatttggttggcaggcactgaacaacatcgctcagggcttggtcatcactcatgatcgtcccaacctgacaaagctccgccgattccttgaaggtggcgctgctggcttggtcatcaaggccgttcaggcttactccgagcgagttatgcccgactgggaggcagaagcagcagcctacttggaaaaagccaaaaacgggtcgcgtgagaagatcgctttcgcgttgatgaagttctactacgacatcatccaacctgagcacccgaactctgacctggaaggcttgctgtcgatgttccagcatgaccaaacccacttctccaagatggtggcgaacctcctgccgatcatgaatatgctgacgtccggggagctcggccccctgctgtctccagactcatctgatctgagcgatgaacgtcagatcaccgattccgcaaaaatcatcaacaacgctcaagttgcttatctggggctcgactccctgaccgacaacatggttggtagtgctatggggtccatcttcctgtcagacctgacagcggttgcaggtgacagatacaactacggcgtcaataaccggccagtaaacatctttgtggacgaggcggctgaggtgatcaatgacccattcatccagctcctgaacaaaggtcgcggtgcgaaacttcgtcttttcgttgcaactcagacttttgctgacttcgccgctcgactgggcagtaaagacaaagcgctccaggtgttggggaacatcaacaacacgtttgctctgcgtatcgtcgatggtgaaacccaggagtatatcgcggataacctgccgaagacccggctcaagtacgtcatgcggactcaaggccagaactcggatggcaaggaacccattatgcacggaggcaaccaaggcgagcgtttgatggaggaggaagctgatctgttctcagcccagttattgggaatgcttccgaacctggagtacatagccaaaatttcaggcggaacaatcgtaaaaggccgtctgcccatattgacccagtaa

SEQ ID NO: 4201 - DNA, 540 bp, Klebsiella pneumoniae
ggtgctgaaatgaaatttccactcaagaagtatttcgtcaaaaaggaatcctggaagcgcttcggggttaaagccggtgtgacactactggttctttgggctgctggtgcggcctttgccagccgctaccgtattggcattgatccacaacaggagaagtgcctgccgggttacaccttcttcctcattgatctgaacgaccagactctggagaggggagctgtttacgcctttcacgccaagaacatgcagcctttctacaaggacgggactcgcatggtcaaaatcctcaccggtatgccgggggataaagtcgagatcaacgataagtggaagatcaccgtcaatggtgatgtcgtcggagaggggctccagctcgcagggaaactacatctgccagagagccacttttacggcaaggccacgctgaaagagaacaactactggtttatgggcaaaagcccattcagcttcgactcacgttactgggggactgtgaaaaatgatcagatcattggccgcgcatatcccctgttctaa

SEQ ID NO: 4202 - DNA, 468 bp, Klebsiella pneumoniae
ggaggggtgatgagctactcggttttcagtcaagatggggtgcatcagtgtgacatcccattgaacgtctatcaggtgatacgtcgccaatctttgtctgtgttgtggctttactgggcgcagagcctgaatttagtgaaggtactcattgcctgcatcggaaaagtgttctttgtgatgccggtgatgtggttctgggtgctggtggtgtgccgcctggttgaaccagaacgtatatctgacgtgtcaggacttttctctccagatgtgatcgggtgggccgctggtgtggccttcaccctcattatcttttctgttttcacacggccagcgatgtacggataccacaactttttcaagcagcatatttgctcaagagtaaagcaagtaacaccagaactcagaacagtcactgggccactgttcttctaccgaaacgaaattggacgatacagagaggaattatga

SEQ ID NO: 4203 - DNA, 225 bp, Klebsiella pneumoniae
ctggctgagataaagaggcaaactactgtcctcaagaagggtactcagtcgactaataacggcagcacctcgcggaacgctgataccaaattccagcagaaaagcatgcatctgattagttgttttcaccttatcctgaaccagggattcacggacacgatgcagagctcgcattgcctgctgagattcggttctgggctgcacgaaacgcatagatggacgtga

SEQ ID NO: 4204 - DNA, 498 bp, Klebsiella pneumoniae
catggggagattgaagtggagaacacaatgcgaagtcataatcattttatgagagccgtggcctcgctgttgacagttaccatgtctgtgctgccgatacattcctatgcaaacggtagccaagacccggacatcacagcggtgggcaaagaggcccaggcattcgggcaaaacctctcaaactcattcaagtcgagctcaggaaccgtgcaaaatggcactatctcgatgccaacgttgaaggatgggcagttccagatgaatggagggagtcagatcaatgtcaatgatttattccctggtacgagtggaagcaataataagcctgatagctattatttccctgacgctaacaagcctgatgttggaggcctacagggaatttatgattctggcgacaacatggatagtgttggtaataacgccaaagggtctctttggagtgatgccaatagtgcaaacccatctatttctggggtgatgctgccaacttactga

SEQ ID NO: 4205 - DNA, 402 bp, Klebsiella pneumoniae
aatgatgctgtaaaagtgatatgtatgccaaagcaagcaaatcatctccgtttgaagaaaccttgcgccaactgtccattccggaaggagggcgctatcgagctggcccctgggcgattagaaggcatcatcaacgacatcgttgaaaacgacatgacgacgtttcattgccacaagaccgtgcattcaaagtcaggtggtgaatgggatgaagagggtaactatgcaccttcgggacaagagtcgatgtgtgccggtgctgcggcttacttgatgaaaataggcaggccgacagtggctatgcgaattgcctttgcgtttggtgatgcaaaggtgtccgactgggacgaagctcaagagctggttatcgagcctttggtacaaggggaccgaaatgagtaa

SEQ ID NO: 4206 - DNA, 285 bp, Klebsiella pneumoniae; identical to SEQ ID NO: 2106

SEQ ID NO: 4207 - DNA, 660 bp, Klebsiella pneumoniae
ataatggcagtcatttactacggcgagggaacccatgacgccggtttcgtcgggttccgtgtcgcacgaacagttggggtggcggatgattaccggcaagaatacttctccttgagagagtattcctacgcaacagctcaccggctggcctacagcttggaccgaaagtgggaagcagaggcagaagaggtgaagcgtcaaaataagacttgtaagcggcgacgcaactccgggccaaacatcattgctgaggggctgagggcttatatcagcatcgagaaccggagccggatgggggtgaagaaaacctacttcgcgccttgttttctcgtcacaaagccaggctacggcaatggggatattgctttcaggatttccactcatggctacgcagaagcctacgaaaaggcggtggaaaaatattgtgagatccatgatttgacggatgagcagtatgttgagttgcttgagcgtatgccgagtacagaggtgttcactggatacctgctgaatgctcttttaatgcgcggccatcgcgccacaaaagctgaaatactgagtaagctgggggctgagaagaatgaagaggacattgccaatggcaaagggaaaagcggccagaacagagtgcgttgcccagagtatcggtgggcgcaataa

SEQ ID NO: 4208 - DNA, 411 bp, Klebsiella pneumoniae
gtgtttagagtcgttaaaggaggaaaattcatgcccgtaccgttatgggaggcacagagaatgcttcataaagaaggcgagcaagcaattagattctctgtccacaaatacaacccttacaataatgagcgtaaaaccactctcgaagaggcggtccgatgccttgcgtttcagtcgcgctttgctggaacgcactcatttgtcgatagcgaaaccaaagagccgatgcacttacaaattgatatagcatcaaaaacagatgttcctatgcttggcatgttcctgtcagtctacatttcggatggaaaagaaaagtacctgtctcaatttattgtaagcgaatcaaggtcgcactactttttcctagattttagcttggcagcagctaaagccaaatccatagaagtataa

SEQ ID NO: 4209 - DNA, 5577 bp, Klebsiella pneumoniae
cctccagcattgggttcttgtaactcaaaacgaatggagaatgcgatgatcaatttcaagcctaaaattccagcgctgcttggggctctggcggttcttaccgctggtgctgctcatgcagagctgctggaatacacctttaaggctccagatggtacgcaacggtctctgactccgaatgccaactatgccaacccaacgggcaatatctcgtttgccttgagtgccggtatcgaccgaaaggtaaagatttcggtgattcggtcggatggaacagtggtttcgacagcgaccagccaccttcttggggctactgatcgcatcacagtgggtggaaaatcctactatggtgcggaacttcaactaccggctccttccgagggagtctacaaactaagggccgaaatactggcgtcagacggaagttccgttcagactgatgaatacccgcttcaagtcgatacgacagcgccaagtttggcaaacgtgacagtaaaaggggaatggaaccgggcgctttctgatggaacgctactgcgaggtcctaaccgattttcaggtatagatgtgtctgcatctgatgccggttcttcggtttcctctatacaggcgtatgctgtagatagcaaaggcaagaggagtcctgttgtctcggttaattacgccaacggccaaggccagttgttgaactggagcactgtgttccctaatggggaggatctatatacgcttcatttcgaggccctggataaagcagggaacaaagggtcaatagcctatcctattgcttgggattcagtaggtgcaaagtctggagagaatcctgagccagtagcagtgtatgaccctaagaacccgcaggcctcaacttttaaggttaatggtcaggccctatcaggttttgcgccttatcagaacggaatgaccatttattccgatacctacagggtgctctaccggatacccaaaacaaactcctatccttcttcaccttacggtgctcaaagcggtaactggtgtgattataaaaactgtattgaaggcaatatcattgccgaagacggtacatatgattatcggcagacgcaagctgatgtattccagcaacatgggacaaaaactaagtcgtttattatttacgactgggttatgaactctcttggtaatacatccgtcagtgtgaaagctgatccatcggttagcttggctcccatcggtaagtatgttgaatatcttagggatgatggtcagtgggtccgcggtgaaaccattaatatgagctcagttaaccattataaaaaactgagatttcatgttgagccgagaccttacgctcaggagttatggggatcttggttgcctactactaaaattccggcaaatgcttcttatgcagaagtggatacggatatatcgttcagtgggcgctcatgttcatggcctggatattggtctcgaccggaagggaagcctgaacttccgtctgatcggattggggcaacgttctgctatgaccttaaccctcctgaaattgctgggttagaacgaaatgggcggatttttaaagctcatttccgtgagcctgattcatttgacggttggggtgttaaccagtgggttatttctaacaactcaagtgcgtctgcgataacctcgactggcgaagaacgtccgttgtctcgtactgaagttcttcgtagtagcacaaatgattggtttttcacattttctgctgagaatctgtcagagggcacatataccggcatatctctcgtagctaaagatgctttcggtaatgaggttaagcaggtattcactggctcccaatatgctatgagcatagataattcagcgccgacactaaccgtatcgatcagtgatggagcaccaatccagtctttggatgatgttgtaatcaccttgactgatactgccgacccgagtcctaagctgacctctattgccctcgtcggaggcccagccgatgacaaggtgcagttgtcttggcgtgaggagtcgaaaggtcgattccgccttgagtacccggtaatgttcccgtctttgaaggaaggggaatcttacacgctgactgtttccggtgaggacgcacaaggcaacgcggttcaaaaggcggttggcttcgagtacaaaccgcgtcaggtgatgctggcggatgggatggatggcaaggttatggtccccgctgtcactcatgaatttgttcatgcagatggcaagcggatcatcgagaccaagccgctgacgctcagtgatggtgctgtcgtgacaggttcatacgacgtgtttgcgaccctccgttctgatgcgaaagtgccgctggtggtgaatggggtgcgtatcgagccgggccagacaatggggatcatgagccaacatgatttcggtgcgtcaggtggtcgtttgagcattccggttaaaccggctgttcctgatgtggtcggctcttccagtcttcttgtcatgacctccgcgccgaactcacccatcttggttgtggacatcaatacctggaaagggacggccaagctctcggctgaatcatggacaattcgccaggttattgacccggtgaaaatctatgccctgccagagtcgggtgtgccttgccggttcaccacgaaagaggatgtggctatggccgcagacccaattcgtgacccggtgtgtttgctccaatgggacagaactccggatgaggctgaacaaactacgcaggacaacaacgggatgaaagttgccgggctggtggggcaggctgtgagcattggtgaacaacctgtcgaatacagcctgtacctgttcagtggtgacggttccaaggtaaaagttgggtctggctctcagaacctgacggtaactactgcctatggctctgttggttacaccccgattgatgacattgctcaggtgaatcgcgtcattgaagactttgatgtgaacttcaagcagagcaaaggtcctgactgttcaatcaccctcagtgctgaccgtgcgaaaaacgaggccgcgaacaaagctgttggcagcgcaagccgcacctgtctgttcgagtggcagcagatccccgatggactggtccaagacccgttatcggaatctccttcgttgtcaggttccctggccgagaacggtgatcaccctctggggtggcgggtaagtattttcacccgcaatggcactcgggtgacgttgaacgacgagactttcaatgttgaagccgttgatccaccagctccgaccgttgaactggcctccgactacaacttcaaggacaacatctacatggtgccgatgacaggtaactacctgggtgatgccattatcaactctgaacgagctgatctggatattgccatatcgcgcaactcggatgttcttgagtctgagaccttcactccgggatggggtgccaccaataaggtgtatcgccgcatcaataccgatgagcgagcgttgtgggaggagaccacctataaggtgaacgcggcatatagcaaggttcctgatgtgaaaacagaggttgtttaccgagctatatccgcaccttctaagagtatccgtcctatcgttgaagttgaaggtgataccgcgattgacaccaaggcattgccggttcgggttatcatccgcgatcagtacaagcctgatggtgattatgacgtcaacacaatgggggtgtggaaagtacgcctgatccaacaaaaggtctacaacgagacggttgcgctcactgattatgcggaagcatcgaacggtgaagctcagttctcagtagacctgtctggtgtggatactgcctctgtccgtatcgccgctgaggctgttttggacagccctattgagggttacaaccgcacagagttgtctatcagacctgctttcttgaccgtacttcgtggtggtgccatcggtgctggagtggaggctcgcaagctgtctggcgaagccccgttcacgactgtgttcaagctgtctctggatgaccgccaggatcttcgcgctacgggccaggtggtgtgggaaacaagtaaggacgatggtaaaacatgggaacagttcatcccagaagatcgatacaagtatcagcttgtgaagaccttcgacaagggtgagtaccaggttcgagccaaggtggtaaacgtcaactcaggtgcggaaaagtacaccgaagcggtcagtgttgtcgcttacgacaaacctgatattactattgtcggcccgaccacgttgtttgtgggaagtgagggcaagtacaccgcgaacctgacgttgaatgatgagccaatctccggtggcaatgccgttgttgaatggtccactgacggtggcaaaacctattcgcaggaagggaacagcattacgctttcaagtgatgaagaaaaccgataccgactttgggctcgcgtacgttcgacctctgcaccggctgatgacgggtatgcctatgaagttgataaaacgtctgttgatttcgttgttgtgaaagcacctcgtccttatgtgactgggccaaaggtaattgagactggcaagaagtatgtgtttaaagcagaagccagcctgccttaccgtgggatggatgtgaagctgaacgggttcttcacgctgcctgatggctcaattgttcaaggtgatactgctgaatacgtgccttcggacactgacctcaaccaggctactgtagaaacgaagtacaccacctggatcgaaggataccgagatcaaggtgcagaagcatctcacagcctgcgctccagagtttggcagtatgtttggccgaaattcggaatgcagattcggatgaatgcggatgtagctcccgcgacgatcacggcgtcagtgcgaccaattgctttcaacggcaagctggaagagccgacatatgagtgggtattgccaaatggtgcagtgattcaggaacagaggcaggatattgtccggtcctttgtgatcaatgagccgggcgattacaacatcaaggtgactgtccgtgatgctcgcggccatgaaaccgtgatcgagcaaccgctcaagatcggccaggcagagccctatgctatcgacctgcaatactctggctcgaacaaatacgagcgtgagcctctggatgtgctgttgcgaccgtacatttctggcggccacccacgcgaccgtatttcgactcgcgtctactcggtagatggtacgccgttggaaagcagcggttactacggcagagcaactctgggcgctggtgagcacagcatcaagctgaaaataacctcagagatggggcatgaagctgagggtgaggtgaacatcaatgtggcagagaacaagttgcctgcatgtagcctgagctcacgagagaccgttgggtcgtggatcgtctatgcgaactgcgaagataccgatggccgcatgaagtcctacgaatggaccattgccggtgagttgcagagcatcagctctgatcgagtaactatcagcaagggcacctatgaaacgatgccgaccatttctctggttggggtcgatgactctggtggtaaatccgaagctgtcacgatgaactaa

SEQ ID NO: 4210 - DNA, 624 bp, Klebsiella pneumoniae
gttttcgttccactgagcgtcagaccccttaatctgtcggtgttcaacgtcagacgggcaccggccttcgcgtttgagcagagcaagcgcgcgaccataggcgggcgctttatccgtgttgatgaatcgcgggatctgccacttcttcacgttgttgaggattttacccagaaaccggtatgcagctttgctgttacgacgggaggagagataaaaatcgacagtgcggccccggctgtcgacggcccggtacagatacgcccagcggccattgaccttcacgtaggtttcatccatgtgccacgggcaaagatcggaagggttacgccagtaccagcgcagccgtttttccatttcaggcgcataacgctgaacccagcggtaaatcgtggagtgatcgacattcactccgcgttcagccagcatctcctgcagctcacggtaactgatgccgtatttgcagtaccagcgtacggcccacagaatgatgtcacgctgaaaatgccggcctttgaatgggttcatgtgcagctccatcagcaaaaggggatgataagtttatcaccaccgactatttgcaacagtgccgctggttctggctctccagttcggccagttccctga

SEQ ID NO: 4211 - DNA, 567 bp, Klebsiella pneumoniae
acttatcatccccttttgctgatggagctgcacatgaacccattcaaaggccggcattttcagcgtgacatcattctgtgggccgtacgctggtactgcaaatacggcatcagttaccgtgagctgcaggagatgctggctgaacgcggagtgaatgtcgatcactccacgatttaccgctgggttcagcgttatgcgcctgaaatggaaaaacggctgcgctggtactggcgtaacccttccgatctttgcccgtggcacatggatgaaacctacgtgaaggtcaatggccgctgggcgtatctgtaccgggccgtcgacagccggggccgcactgtcgatttttatctctcctcccgtcgtaacagcaaagctgcataccggtttctgggtaaaatcctcaacaacgtgaagaagtggcagatcccgcgattcatcaacacggataaagcgcccgcctatggtcgcgcgcttgctctgctcaaacgcgaaggccggtgcccgtctgacgttgaacaccgacagattaaggggtctgacgctcagtggaacgaaaactcacgttaa

SEQ ID NO: 4212 - DNA, 738 bp, Klebsiella pneumoniae
acttatcatccccttttgctgatggagctgcacatgaacccattcaaaggccggcattttcagcgtgacatcattctgtgggccgtacgctggtactgcaaatacggcatcagttaccgtgagctgcaggagatgctggctgaacgcggagtgaatgtcgatcactccacgatttaccgctgggttcagcgttatgcgcctgaaatggaaaaacggctgcgctggtactggcgtaacccttccgatctttgcccgtggcacatggatgaaacctacgtgaaggtcaatggccgctgggcgtatctgtaccgggccgtcgacagccggggccgcactgtcgatttttatctctcctcccgtcgtaacagcaaagctgcataccggtttctgggtaaaatcctcaacaacgtgaagaagtggcagatcccgcgattcatcaacacggataaagcgcccgcctatggtcgcgcgcttgctctgctcaaacgcgaaggccggtgcccgtctgacgttgaacaccgacagattaagtaccggaacaacgtgattgaatgcgatcatggcaaactgaaacggataatcggcgccacgctgggatttaaatccatgaagacggcttacgccaccatcaaaggtattgaggtgatgcgtgcactacgcaaaggccaggcctcagcattttattatggtgatcccctgggcgaaatgcgcctggtaagcagagtttttgaaatgtaa

SEQ ID NO: 4213 - DNA, 1563 bp, Klebsiella pneumoniae
cactgtttcccgtctggatatggcgggagaaatcaaggagtgataaacgtggcgatattgagcgcaattcgacgctggcattttcgcgatggtgcgtcgattcgggaaatagcccgacgaagcggcctgtccaggaacaccgttcgcaagtatttgcaaagcaaggtggttgaaccgcagtacccagcgcgagacagcgttggcaagttaagtccttttgagcccaagttaaggcagtggctctccaccgagcacaaaaagacaaagaagctgcgcagaaacctgcgcagcatgtaccgggatttggtcgctttgggctttaccgggtcttatgaccgagtgtgtgcctttgcccgacagtggaaagattccgaacagttcaaggcgcaaacctcgggcaagggttgtttcatccccttgcgctttgcttgtggcgaagccttccaattcgattggagtgaggactttgcccgcatagcgggcaaacaggtcaaacttcagattgcccagtttaagttggcccacagccgggcctttgtgcttcgggcttactaccagcaaaaacatgaaatgctgtttgatgcccactggcatgcctttcaaatcttcggtggcattcccaagcgcggcatctacgacaacatgaagaccgctgtggattcggtggggcgtggcaaagagcgcagggtcaatcagcggttcactgccatggtcagccactacctgtttgatgcgcagttctgtaatccagcatcgggttgggagaaaggccagattgagaagaacgtgcaggattcccgccaacgcctgtggcaaggggcaccagactttcaaagccttgctgatttgaatgtgtggcttgagcatcgctgcaaagcgctgtggtctgagctgcgccaccccgaattggaccaaaccgtgcaagaggcctttgccgatgaacaaggcgagttgatggcgctacccaatgcctttgatgcattcgtggagcaaaccaagcgagtcacttcaacctgccttgttcaccacgagggcaatcgctacagcgttcctgccagttacgccaacagggccatcagccttcggatttatgcagacaagctggtgatggctgccgaaggccaacacattgccgagcatccaagattgtttggcagtggccacgctcggcgtggccacacacaatacgactggcaccattacttgtctgtgcttcagaagaaacctggggcgttgcgcaatggtgcgccatttgctgaattgccacccgcgttcaagaagcttcaatccatcttgctgcaacgccccggcggtgaccgtgacatggtggaaattctggcccttgtattgcaccacgatgaaggtgcggtactcagtgctgtggaattggcattggagtgtggcaagccatcgaaggagcatgtgcttaatctgttgggacgtttgaccgaagaacctccacccaaaccgattccaattcccaaggggttaaggctgacattggaaccacaggccaacgtgaaccgctatgacagtttaaggagagcccatgatgcagcatga

SEQ ID NO: 4214 - DNA, 963 bp, Klebsiella pneumoniae
aatgtaaggcctttgaataagacaaaaggctgcctcatcgctaactttgcaacagtgcctctcgataggtatagtgttttgcagtttagaggagatatcgcgatgcatacgcggaaggcaataacggaggcaattcgaaaactcggagtccaaaccggtgacctgttgatggtgcatgcctcacttaaagcgattggtccggtcgaaggaggagcggagacggtcgttgccgcgttacgctccgcggttgggccgactggcactgtgatgggatacgcgtcgtgggaccgatcaccctacgaggagactctgaatggcgctcggttggatgacaaagcccgccgtacctggccgccgttcgatcccgcaacggccgggacttaccgtgggttcggcctgctgaatcaatttctggttcaagcccccggcgcgcggcgcagcgcgcaccccgatgcatcgatggtcgcggttggtccgctagctgaaacgctgacggagcctcacgaactcggtcacgccttgggggaagggtcgcccgtcgagcggttcgtccgccttggcgggaaggccctgctgttgggtgcgccgctaaactccgttaccgcattgcactacgccgaggcggttgcggatatccccaacaaacgatgggtgacgtatgagatgccgatgcttggaagaaacggtgaagtcgcctggaaaacggcatcagaatacgattcaaacggcattctcgattgctttgctatcgaaggaaagccggatgcggtcgaaactatagcaaatgcttacgtgaagctcggtcgccatcgagaaggtgtcgtgggctttgctcagtgctacctgttcgacgcgcaggacatcgtgacgttcggcgtcacctatcttgagaagcacttcggagccactccgatcgtgccagcacacgaagccgcccagcgctcttgcgagccttccggttag

SEQ ID NO: 4215 - DNA, 333 bp, Klebsiella pneumoniae
atgccgggaacaggagataccatgacaagacgaccgcgccggaaccacagcccggctttcaaggcaaaagtggcgctcgccgcgatccgaggtgagcagacgctggtggaattgtcccagcagttcgacgtgcatgccaaccagatcaaacagtggaaagaccagctccttgatggggcgacaggcgttttcggcgatgaagcgaaggcggaaccggcaggtccaaccgtcgatgtcaaaacgctgcacgccaaaataggcgaactgacattggagaatgattttttagccggagcgctcggcaaagcgggattgctgggcggaaagaaatga

SEQ ID NO: 4216 - DNA, 306 bp, Klebsiella pneumoniae
aggccgtcgacaatgataatctggatcaacggacctttcggcgccggaaagacgactctcgctgagcggctgcgcgatcggcgtccgaaatcgctgatctttgaccctgaggaaatcgggttcgtggtgaaagaaacggtccccataccagcgagcggagactatcaggatctccccttgtggaggggacttacgatcgctgcggtcagcgagattcgcaggaattactcgcaggacatcatcatcccaatgacgctcgtgcacccggactatcagaggtggctcgggaaatctgcacagcggtga

SEQ ID NO: 4217 - DNA, 324 bp, Klebsiella pneumoniae
cttgccaacgctgtctcgcgctgggtactgcggttcaaccaccttgctttgcaaatacttgcgaacggtgttcctggacaggccgcttcgtcgggctatttcccgaatcgacgcaccatcgcgaaaatgccagcgtcgaattgcgctcaatatcgccacgtttatcactccttgatttctcccgccatatccagacgggaaacagtgtcatacgtgggtcaaatttcgacgcaaatctttaccctaagttggggtgcggacaaaatcttggactactttaggagtagttcatgtattcgtatgaagatcgccttcgagccgtga

SEQ ID NO: 4218 - DNA, 510 bp, Klebsiella pneumoniae
agccgcagagcacaagaccatcatgatcgatgcgacctatctcaaggcccaccgcacggcttccagcttgcgggtaaaaaagggggcgcgggccgcctgattggacgcacgaaaggcggcatgaacaccaagcttcatgccgtaacggatgcgagtggtcgcccgatcagcttcttcataacggcaggccaggtcagcgattacaccggtgctgccgccttgcttgatgaacttcccaaggccaaatggttgctggccgaccgtggctatgatgccgactggtatcgtgacgctttacaggcgaaggggatcactccctgcattccaggtcgaaaatcccgcaagaagaccatcaaatacgacaaacgccgctacaaacggcgcaaccggatcgagatcatgttcgggcgtctcaaagactggcggcgtgtcgctacgcgttacgaccggtgcccaatggcctttctctccgccatcgctctcgctgcgaccgttatcttctggctatga

SEQ ID NO: 4219 - DNA, 693 bp, Klebsiella pneumoniae
tgcacgcatcacctcaatacctttgatggtggcgtaagccgtcttcatggatttaaatcccagcgtggcgccgattatccgtttcagtttgccatgatcgcattcaatcacgttgttccggtacttaatctgtcggtgttcaacgtcagacgggcaccggccttcgcgtttgagcagagcaagcgcgcgaccataggcgggcgctttatccgtgttgatgaatcgcgggatctgccacttcttcacgttgttgaggattttacccagaaaccggtatgcagctttgctgttacgacgggaggagagataaaaatcgacagtgcggccccggctgtcgacggcccggtacagatacgcccagcggccattgaccttcacgtaggtttcatccatgtgccacgggcaaagatcggaagggttacgccagtaccagcgcagccgtttttccatttcaggcgcataacgctgaacccagcggtaaatcgtggagtgatcgacattcactccgcgttcagccagcatctcctgcagctcacggtaactgatgccgtatttgcagtaccagcgtacggcccacagaatgatgtcacgctgaaaatgccggcctttgaatgggttcatgtgcagctccatcagcaaaaggggatgataagtttatcaccaccgactatttgcaacagtgccaatttttga

SEQ ID NO: 4220 - DNA, 444 bp, Klebsiella pneumoniae
tcgggcgaccactcgcatccgttacggcatgaagcttggtgttcatgccgcctttcgtgcgtccaatcaggcggcccgcgcccccttttttacccgcaagctggaagccgtgcggtgggccttgagataggtcgcatcgatcatgatggtcttgtgctctgcggcttcaggcacggccagaccttccatcatctggataaatacgcccttgtcgccccagcgtttccagcggttataaagcgtcttcgccgggccatattccttcggcgcatcacgccaacgcagcccgttgcggttgacgaagatgatgccgctcagaacgcgtcgatcatcaacgcgctggcggccatggctcttggggaaatagggctgaagacgagccatttgctcgtccgtcagccaaaacaaattactcatcagtcgggctcctatacgcccatctga

SEQ ID NO: 4221 - DNA, 207 bp, Klebsiella pneumoniae
aaatcgagacataattctgacaacaaggggtgggtcaaaattcaatgcaaatcccgggtcaaatttgggtgcaaatcaacagatatcgacaacctctcgcgcaaccaagacatcgcggtcggactgcaagtgatcttgaagccacgggcccgtcccaccccgacatggacctcgatgcccgaacggacgttagatttcgagttctag

SEQ ID NO: 4222 - DNA, 660 bp, Klebsiella pneumoniae
attatcggacatcgtaaaactgttacattaatatgtctattaaatcgtaaatttgtaataatagacatgagttgtccgatattcgatttaaggtacatttttatgcgactttttggttacgctcgggtctcaaccagtcagcagtctcttgatcttcaggtcagagcactcaaagacgcaggtgtgaaagcaaaccgtatatttaccgataaggcatccggcagttcaacagaccgggaagggctggatttgctgaggatgaaggtggaggaaggtgatgtcattctggttaagaagctcgaccgtcttggccgcgacactgccgatatgatccaactgataaaggaatttgacgctcagggcgtggcagtccggttcattgatgacgggatcagtaccgacggtgatatggggcaaatggtggtcaccatcctgtcggctgtggcacaggctgaacgccggaggatcctagaacgcacgaatgagggccgacaggaagcaaagctgaaaggaatcaaatttggccgcaggcgtaccgtggacaggaacgtcgtgctgacgcttcatcagaagggcactggtgcaacggaaattgctcatcagctcagtattgcccgctccacggtttataaaattcttgaagacgaaagggcctcgtga

SEQ ID NO: 4223 - DNA, 300 bp, Klebsiella pneumoniae
gaggtgattaaaatgactttaacgatgcaagatacattcatttatatggctctgtgtttcggtatgtatgtttatctaaaactattccgaatgtaccattccataactgaagataactgtacttttaaggatgcttttacagcctctttttcagatgaaagatattttggcattagaaataacattctagcatttgctgccttagcatttgcttctttcggtctgtttgtttgctataaatttgtaacccaagaaatcacatattcaaaaattggcactgttgcaaatagtcggtggtga

SEQ ID NO: 4224 - DNA, 510 bp, Klebsiella pneumoniae
ttggactgtttggcgcgcattctgtccagccccgtggtgaagacgggcaaacaggcgcatggaggcgatttcgtacagggcatcttccatggcaccgtcgctcaggttgtaccaatgctgcatgcagtgaatacgcagcatggtctccagcggatagggccgtcggccattgcccgccttgggataaaacggctcgatgacttccaccatgttttgccatggcagaatctgctccatgcgggagaggaaaatctcttttcgggtctgacggcgcttagtgctgaattcactatcggcgaaggtgagttgatggctcatgatgtccctctgggatgcgctccggatgaatatgatgatctcatatcaggaacttgttcgcaccttcctttattatttttaagcgtgcataataagccctacacaaattgggagatatatcatgaaaggctggctttttcttgttatcgcaatagttggcgaagtaatcgcaacatccgcattaaaatctag

SEQ ID NO: 4225 - DNA, 1365 bp, Klebsiella pneumoniae
ttatcagccaatcaggattacagaccaaacagagatttggggcgtaatcgccggatcagtccgccgctattcggtggattgattgcaatggtaagacccatagccctgattgatgggaataatttctatgtttcgtgtgagagggtgtttcagccgcacttgctaggcaagccggttatcatcctgtcaaacaatgatggttgtgccgtagcacgatcagaggaagcaaaagccctcggtattaagatgggtgcgccgctgtttaaaatccgtgagctggtcaaagaacacggcgttaaagtgctatcctcaaactatacgctttacggagatatgagccgccgtgtcgtggatgctgtgagccagttttcacctcattacgaaatctattcgatagatgaaaactttgttgatttgtcgggctttggtgatcgttatgaagccattgccgttgatatgcgagccaccgttagacaagtgaccggaatccctaattgtgtcggcattgccgagacaaagacacttgcaaaacttgccaattttgccgccaagaaaaacccgatttttggcggtgtttgcgacttcacgcaaccggcagtattggcatggtgtttagaccggattccggttgctgaagtgtggggaatagggcggcaaacacaaatcaagctggcatcacaaggaatagcaacggcggcacagttgcgcgacatgccgcgcacacttgcacgtcaactcggtacagttgtcttagaaagaacagttgcggagcttcagggcatccgctgccttgagatcgaggacattgcaccacaacgcaagggcatggctgttacgcgctctgctggtgcgcctatgcgcgatttagaggctgttatgcaggcactcaccgcccacgcttcccgtgccgctgaaaagcttcggttgcatggattagttgctggtcagatcacagcgttttttcacacaaacagtttttcaaaaaacgccgcgcagcactcggtatcaagaaccgtaaagctgaagcccatgacgaataatacattcgatcttgtgcaggctgttaaccggtgcgcccgtgctggttggcatcctaaagcgcatgagcatggctatagctatacaaaggcgggtgtgatgctcgatgatcttctgaaggcagaggacgcgcccaaaatgctttttgatatagtgcagccccgtgatgctcgcctaatggaagcaatggacgcaattaatgaccgatacggcaaacgcaaggttgttatcggtgcgcaaggctttcagaataaacatgaagcgaaagcggatatgcgttcaccacgcttcacaacaagactttcagacttgccagtaatttgttga

SEQ ID NO: 4226 - DNA, 612 bp, Klebsiella pneumoniae
gtcctgaccctagcgcatatcaagccagaggagcctgaggtacttggtcttttagccctcatggaactccagtgctctcggctgcttgcccgacaagatcgtcaaggcttgccagtgccgctcgatcgtcaggatcgtggcttgtgggatcgattgctcatacgtcgaggtctggagatagttgagcgagcatgccgcatgtcgtctcccactggatggtatcttctgcaagcgttgatttctgcttgtcacgcgcgggctgcgagctttcgagacaccaattggcgagagatactggcgagatatgacgcgctcttcctgttgagccctacatacgtagttgccctcaatcgagcagtcgctgtgtcgtgggccatgaaccccgctgcagggatggcggtccttaaggggattgaggacgagtgggacgtggagacctacccgctttttcacgcgacgcgggcggatttcctttcgcgtcttggtttccaagaccaagctgcggcagcctatcaggctgcggccgtactcagcaccaacctacctcaaaagttgttcttggtcacgcgcgctgaggaatgcctggcagggtctcggacagatgttggataa

SEQ ID NO: 4227 - DNA, 528 bp, Klebsiella pneumoniae
tataccaagaacacagagcagcaacgcgatccggagatgcatcagaccaagaaaggcaatcagtggcactttggcatgaaggcccacattggtgtcgatgccaagagtggcctgacccacagcctagtcaccaccgcggccaacgagcatgacctcaatcagctgggtaatctgcttcatggagaggagcaatttgtctcagccgatgccggctaccaaggagcgccacagcgcgaggagctggccgaggtggatgtggactggctgatcgccgagcgtcccggcaaggtaaaaaccttgaagcagcatccgcgcaagaacaaaacggccatcaacatcgaatacatgaaagccagcatccgtgccagggtggagcacccgtttcgcatcatcaagcggcagttcggcttcgtgaaagccagatacaaagggctgctgaaaaacgataaccaactggcgatgttattcaccctggccaacctgtttcgggtggaccaaatgatacgtcagtgggagagatctcagtaa

SEQ ID NO: 4228 - DNA, 240 bp, Klebsiella pneumoniae
cgatcataccttattcagatcatgcgatcggcgccctgccatcaggaggatgaaatgcgtaaagatcagatcccggatttcgttgatgagatcttcgccaccggctgcccaatcaccgcagtaggacaagattgctatgttttgcagagagcgatctgctggcagaagacttcgaccgtgttggtgaggtggtcgataaaatctgccagcgataaggaaagcgtgaccatctgttgctga

SEQ ID NO: 4229 - DNA, 840 bp, Klebsiella pneumoniae
ccaactggcgatgttattcaccctggccaacctgtttcgggtggaccaaatgatacgtcagtgggagagatctcagtaaaaaccggaaataacgccagaaatggtggaaaaaatagcctaaataggctgattcgatgtgtttgcgggaaaaaaatcggcccagatccgcgaaattttaatcagcgagtcagcttgggaagaaatgacctgcttattcgcaccttccctaaagaacaggatgcacagcgagcgcggggcagtattgatgcctttgcgcaagagcgcggcttatcaatttgcaactattatgcagaaaatgaatctggcgctcgtttagatcggcctgagttattccggctcctgagcgattgccagtctcaagatattttacttattgaagatgttgaccggttgtctaggctgcgtgaagctgattggcaaaatctaaaagctatcttgcgggatcggcaaattaaaatcgtggccgtgaatgtcccgacgacttggcaaagtctaaaagctgaccagaccgaatttgatgcccgaatgtttggcgcaatcaatgacatgcttctagacatgctggccgctatagcacggcgagattatgagcagcgccgtgcgcggcaaagacaaggtattgataaggcaaaatccaacgggaaatttaagggtcgcacacctgacctgaagcgatatgaagctattaataagatgcttgcaagcggcaactcatggacaacgatacaacagacattgaattgcagccgctccacgattgccaaggcggttaattataaattaaccaaggaaagcactaataagataagaggtgattaa

SEQ ID NO: 4230 - DNA, 222 bp, Klebsiella pneumoniae
tgccgctcagaacgcgtcgatcatcaacgcgctggcggccatggctcttggggaaatagggctgaagacgagccatttgctcgtccgtcagccaaaacaaattactcatcagtcgggctcctatacgcccatctgaatcacagccgtcagttcaaatcaatgggtcctgaccctagggcttatgaaatgatgtgttgtttatcgcttgtgttgagctggtaa

SEQ ID NO: 4231 - DNA, 393 bp, Klebsiella pneumoniae
actgacggctgtgattcagatgggcgtataggagcccgactgatgagtaatttgttttggctgacggacgagcaaatggctcgtcttcagccctatttccccaagagccatggccgccagcgcgttgatgatcgacgcgttctgagcggcatcatcttcgtcaaccgcaacgggctgcgttggcgtgatgcgccgaaggaatatggcccggcgaagacgctttataaccgctggaaacgctggggcgacaagggcgtatttatccagatgatggaaggtctggccgtgcctgaagccgcagagcacaagaccatcatgatcgatgcgacctatctcaaggcccaccgcacggcttccagcttgcgggtaaaaaagggggcgcgggccgcctga

SEQ ID NO: 4232 - DNA, 3183 bp, Klebsiella pneumoniae
ccaaaaagtcgcataaaaatgtaccttaaatcgaatatcggacaactcatgtctattattacaaatttacgatttaatagacatattaatgtaacagttttacgatgtccgataatttataacatttcgtacggttggaaaaatgttactaaatgcccgtcaggcagggaggccgatatgcccgttgactttctgaccactgagcagactgaaagctatggcagattcaccggtgaaccggatgagcttcagctggcacgatattttcaccttgatgaagcagacaaggaatttatcggaaaaagcagaggtgatcacaaccgtctgggcattgccctgcaaattggatgtgtccgttttctgggcaccttcctcaccgatatgaatcatattccttccggcgtccggcattttaccgccagacagctcgggattcgtgatatcaccgttcttgcagaatacggtcagagggaaaatacccgccgtgagcatgcagcgctgatacgtcagcactatcagtatcgtgaatttgcctggccctggacatttcgccttacccgtcttttatatacccggagctggataagcaacgaacgtcctggcctgcttttcgatctggcgacagggtggcttatgcaacatcgtattattctccccggagccactacgctgacccggttgatttcagaggtaagggaaaaggcgacgttgcgcctgtggaacaaactggcactgataccgtcagccgaacagcgttcacagctggagatgctgctggggccaactgattgcagccgcctgtctttactggaatcactgaaaaagggccctgtgaccatcagtggtccggcgtttaatgaagcaattgaacgctggaaaactctgaacgattttggcctgcatgctgaaaacctgagtacactcccggctgtgcgcctgaaaaatctcgcacgttatgctggtatgacttcggtgttcaatattgccaggatgtcaccgcagaaaaggatggcggttctggttgcctttgtccttgcatgggaaacgctggcgctggatgatgcattggacgttctggacgccatgctggccgttatcatccgtgacgccagaaagattgggcagaaaaaacggctccgctcgctgaaggatctggataaatctgcattggcgctcgccagcgcatgttcgtacctgctgaaagaagaaacaccggacgaatcgattcgtgctgaggtgttcagctacatcccaaggcaaaagctggctgaaatcatcacgcttgtccgtgaaatttcccggccctcagacgataattttcatgaagaaatggtggagcagtacgggcgcgttcgtcgtttcctgccccatctgctgaataccgttaaattttcatccgcacctgccggggttaccactctgaatgcctgtgactacctcagccgggagttcagctcacggcggcagttttttgacgacgcaccaacggaaattatcagtcggtcatggaaacggctggtgattaacaaggaaaaacatatcacccgcaggggatacacgctctgctttctcagtaaactgcaggatagtctgaggcggagggatgtctacgttaccggcagtaaccggtggggagatcctcgtgcaagattactacagggtgctgactggcaggcaaaccggattaaggtttatcgttctttggggcacccgacagacccgcaggaagcaataaaatctctgggtcatcagcttgatagtcgttacagacaggttgctgcacgtctttgcgaaaatgaggctgtcgaactcgatgtttctggcccgaagccccggttgacaatttctcccctcgccagtcttgatgagccggacagtctgaaacgactgagcaaaatgatcagtgatctactccctccggtggatttaacggagttgctgctcgaaattaacgcccataccggatttgctgatgagtttttccatgctagtgaagccagtgccagagttgatgatctgcccgtcagcatcagcgccgtgctgatggctgaagcctgcaatatcggtctggaaccactgatcagatcaaatgttcctgcactgacccgacaccggctgaactggacaaaagcgaactatctgcgggctgaaactatcaccagcgctaatgccagactggttgattttcaggcaacgctgccactggcacagatatggggtggaggagaagtggcatctgcagatggaatgcgctttgttacgccagtcagaacaatcaatgccggaccgaaccgcaaatactttggtaataacagagggatcacctggtacaactttgtgtccgatcagtattccggctttcatggcatcgttataccggggacgctgagggactctatctttgtgctggaaggtcttctggaacaggagaccgggctgaatccaaccgaaattatgaccgatacagcaggtgccagcgaacttgtctttggccttttctggctgctgggataccagttttctccacgcctggctgatgccggtgcttcggttttctggcgaatggaccatgatgccgactatggcgtgctgaatgatattgccagagggcaatcagatccccgaaaaatagtccttcagtgggacgaaatgatccggaccgctggctccctgaagctgggcaaagtacaggtttcagtgctggtccgttcattgctgaaaagtgaacgtccttccggactgactcaggcaatcattgaagtggggcgcatcaacaaaacgctgtatctgcttaattatattgatgatgaagattaccgccggcgcattctgacccagcttaatcggggagaaagtcgccatgccgttgccagagccatctgtcacggtcaaaaaggtgagataagaaaacgatataccgacggtcaggaagatcaactgggcacactggggctggtcactaacgccgtcgtgttatggaacactatttatatgcaggcagccctggatcatctccgggcgcagggtgaaacactgaatgatgaagatatcgcacgcctctccccgctttgccacggacatatcaatatgctcggccattattccttcacgctggcagaactggtgaccaaaggacatctgagaccattaaaagaggcgtcagaggcagaaaacgttgcttaa

SEQ ID NO: 4233 - DNA, 879 bp, Klebsiella pneumoniae
ttttttagccggagcgctcggcaaagcgggattgctgggcggaaagaaatgatcgaccgaacacacaaactgtcggtcgcacgtcaggccaggcttctcggcttcagccgtggcagtgtctactattctccacgtcaagtgtccgacggcgatctggacctgatgcggcggatcgacgaactgcacctcgactatccgttcgccggaagtcggatgttgcaagggcttttgaggggtgaagggaccgacgtcgggcggttgcacgtcgccacgctgatgaagaagatgggcatcgaggcaatctaccgtcgcccgaacacctccaaaccagcgccaggtcacaaaatctatccttatctcctgcgcaagctggcggtcacccggcccaaccaggtctgggccatggacataacgtatgtgccgatggcgcggggattcgtctatctctgccccgtcgtggactggtttaacccgcgggttctgttctggcgggtgtcgattcccatggaagcggactcctgctccaaagcggtcgaggacgcgatggcccgatatggaaagccggaaatattcaacaccaatcagggttcgcagttcacctccatcgacttcacagccgtgctgaagaaggcggagatcgccatctcgatggatggcaagggcgcgtggcgcgacaacgtcttcgtcgagcggctctggcggtcgatcaaatacgaagaggtctatctccacgcctacaagaccgtatccgaggctcgcgctggcatcggccgctatctcgccttctacaatagccgacgtccacattcatcccttgaccggcagacgccggatcaggcctacttcaacgcgctggcaccaatgatggtggcggcataa

SEQ ID NO: 4234 - DNA, 336 bp, Klebsiella pneumoniae
cggcaggccaggtcagcgattacaccggtgctgccgccttgcttgatgaacttcccaaggccaaatggttgctggccgaccgtggctatgatgccgactggtatcgtgacgctttacaggcgaaggggatcactccctgcattccaggtcgaaaatcccgcaagaagaccatcaaatacgacaaacgccgctacaaacggcgcaaccggatcgagatcatgttcgggcgtctcaaagactggcggcgtgtcgctacgcgttacgaccggtgcccaatggcctttctctccgccatcgctctcgctgcgaccgttatcttctggctatgagcaatga

SEQ ID NO: 4235 - DNA, 930 bp, Klebsiella pneumoniae
tgcgtggggctttgtaggtatggggctcataattgctgcctttttgctcgcccgatccccatcgtggaagtcgctgcggaggccgacgccatggtgacggtgttcggcattctgaatctcaccgaggactccttcttcgatgagagccggcggctagaccccgccggcgctgtcaccgcggcgatcgaaatgctgcgagtcggatcagacgtcgtggatgtcggaccggccgccagccatccggacgcgaggcctgtatcgccggccgatgagatcagacgtattgcgccgctcttagacgccctgtccgatcagatgcaccgtgtttcaatcgacagcttccaaccggaaacccagcgctatgcgctcaagcgcggcgtgggctacctgaacgatatccaaggatttcctgaccctgcgctctatcccgatattgctgaggcggactgcaggctggtggttatgcactcagcgcagcgggatggcatcgccacccgcaccggtcaccttcgacccgaagacgcgctcgacgagattgtgcggttcttcgaggcgcgggtttccgccttgcgacggagcggggtcgctgccgaccggctcatcctcgatccggggatgggatttttcttgagccccgcaccggaaacatcgctgcacgtgctgtcgaaccttcaaaagctgaagtcggcgttggggcttccgctattggtctcggtgtcgcggaaatccttcttgggcgccaccgttggccttcctgtaaaggatctgggtccagcgagccttgcggcggaacttcacgcgatcggcaatggcgctgactacgtccgcacccacgcgcctggagatctgcgaagcgcaatcaccttctcggaaaccctcgcgaaatttcgcagtcgcgacgccagagaccgagggttagatcatgcctag

SEQ ID NO: 4236 - DNA, 873 bp, Klebsiella pneumoniae
aaaaggaagagtatgagtattcaacattttcgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggtgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgctgccaacttacttctgacaacgatcggaggaccgaaggagctaaccgcttttttgcacaacatgggggatcatgtaactcgccttgatcattgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 4237 - DNA, 204 bp, Klebsiella pneumoniae
acgtccgctggctgtgccggcgccatcatatccggctgcacttctacggtgaggacatgtttcctatgtgcaggccgcatcacgtatgaacggcggctctccggttatgcctcaacgccgctgaaagcgtcgcgcggtcagtcagccatgacgatcataccttattcagatcatgcgatcggcgccctgccatcaggaggatga

SEQ ID NO: 4238 - DNA, 474 bp, Klebsiella pneumoniae
cctttgttcattatatgttcttgtagtgtagcaaatggtaattcaatgattttaagccctgtttcagttgcctatgaaggccaaaccgttattttatcctcaattgtcgttcctgctggtttcccatcaccggccagtgatgatttagaggatgaaattgaccctattgcttggatcgtaccgcatccgagcgccacattttggtggcgtgtttccggtgatagccttgtcgatgaaggtattcacgatggagatttaattgccgtggatcgttccggtaaagcgcgggtaggccgcattgttttagctgtggttgacggttcaatcacactgaagaaattagccaagcgagacggtcaatattggctcgatcctaaatctaagggcaataattatcagccaatcaggattacagaccaaacagagatttggggcgtaatcgccggatcagtccgccgctattcggtggattga

SEQ ID NO: 4239 - DNA, 363 bp, Klebsiella pneumoniae
tatgagatcatcatattcatccggagcgcatcccagagggacatcatgagccatcaactcaccttcgccgatagtgaattcagcactaagcgccgtcagacccgaaaagagattttcctctcccgcatggagcagattctgccatggcaaaacatggtggaagtcatcgagccgttttatcccaaggcgggcaatggccgacggccctatccgctggagaccatgctgcgtattcactgcatgcagcattggtacaacctgagcgacggtgccatggaagatgccctgtacgaaatcgcctccatgcgcctgtttgcccgtcttcaccacggggctggacagaatgcgcgccaaacagtccaa

SEQ ID NO: 4240 - DNA, 795 bp, Klebsiella pneumoniae
ggagagcccatgatgcagcatgaaggccatgtgagaatcctcaaatccttgaaactctttggcatggcacacgccattgaggagttgggcaatcagaattcaccagcatttaatcaagccttgcccatgctggacagcttgattaaagctgaagtggcagagcgtgaagtacgttcggtgaactatcaattgcgggtggccaagttccccgtgtatcgggacttggtgggctttgacttcagtcaaagcctggttaatgaggccacggtcaaacaattgcaccggtgcgacttcatggaacaagcccagaacgtggtgctgattggtgggccaggcacaggcaagactcacctggccacagccattggtacacaagcagtgatgcacttgaaccgacgggtgcgtttcttctccaccgtggatttggtcaatgcactggagcaagagaaatcatctgggcgtcagggacaaatcgcaaaccgtctgttgtatgccgatttggtgattctggatgagctgggatatttgccttttagccaaaccggtggggcactgctgtttcacctgctctcaaagctgtacgaaaaaaccagcgtgatactgaccaccaacttgagcttctcggaatggagccgagtgtttggcgatgaaaagatgacaacagcgttgttggaccgactaacccaccactgccacatcctggaaaccggcaatgaaagttaccgcttcaaacacagttcaactcagaataagcaggaggaaaaacagacccgcaaactgaaaatcgagacataa

SEQ ID NO: 4241 - DNA, 387 bp, Klebsiella pneumoniae
gcgtgcataataagccctacacaaattgggagatatatcatgaaaggctggctttttcttgttatcgcaatagttggcgaagtaatcgcaacatccgcattaaaatctagcgagggctttactaagcttgccccttccgccgttgtcataatcggttatggcatcgcattttattttctttctctggttctgaaatccatccctgtcggtgttgcttatgcagtctggtcgggactcggcgtcgtcataattacagccattgcctggttgcttcatgggcaaaagcttgatgcgtggggctttgtaggtatggggctcataattgctgcctttttgctcgcccgatccccatcgtggaagtcgctgcggaggccgacgccatggtga

SEQ ID NO: 4242 - DNA, 258 bp, Klebsiella pneumoniae
agcgtcacgataccagtcggcatcatagccacggtcggccagcaaccatttggccttgggaagttcatcaagcaaggcggcagcaccggtgtaatcgctgacctggcctgccgttatgaagaagctgatcgggcgaccactcgcatccgttacggcatgaagcttggtgttcatgccgcctttcgtgcgtccaatcaggcggcccgcgcccccttttttacccgcaagctggaagccgtgcggtgggccttgagatag

SEQ ID NO: 4243 - DNA, 264 bp, Klebsiella pneumoniae
cacgacggcgttagtgaccagccccagtgtgcccagttgatcttcctgaccgtcggtatatcgttttcttatctcacctttttgaccgtgacagatggctctggcaacggcatggcgactttctccccgattaagctgggtcagaatgcgccggcggtaatcttcatcatcaatataattaagcagatacagcgttttgttgatgcgccccacttcaatgattgcctgagtcagtccggaaggacgttcacttttcagcaatga

SEQ ID NO: 4244 - DNA, 603 bp, Klebsiella pneumoniae
cggaccctggtcaggttccgcgaaggtgggcgcagacatgctgggctcgtcaggatcaaactgcactatgaggcggcggttcataccgcgccaggggagcgaatggacagcgaggagcctccgaacgttcgggtcgcctgctcgggtgatatcgacgaggttgtgcggctgatgcacgacgctgcggcgtggatgtccgccaagggaacgcccgcctgggacgtcgcgcggatcgaccggacattcgcggagaccttcgtcctgagatccgagctcctagtcgcgagttgcagcgacggcatcgtcggctgttgcaccttgtcggccgaggatcccgagttctggcccgacgccctcaagggggaggccgcatatctgcacaagctcgcggtgcgacggacacatgcgggccggggtgtcagctccgcgctgatcgaggcttgccgccatgccgcgcgaacgcaggggtgcgccaagctgcggctcgactgccacccgaacctgcgtggcctatacgagcggctcggattcacccacgtcgacactttcaatcccggctgggatccaaccttcatcgcagaacgcctagaactcgaaatctaa

SEQ ID NO: 4245 - DNA, 234 bp, Klebsiella pneumoniae
gccacgcaggttcgggtggcagtcgagccgcagcttggcgcacccctgcgttcgcgcggcatggcggcaagcctcgatcagcgcggagctgacaccccggcccgcatgtgtccgtcgcaccgcgagcttgtgcagatatgcggcctcccccttgagggcgtcgggccagaactcgggatcctcggccgacaaggtgcaacagccgacgatgccgtcgctgcaactcgcgactag

SEQ ID NO: 4246 - DNA, 609 bp, Klebsiella pneumoniae
ttcatgtattcgtatgaagatcgccttcgagccgtgaggttgtacctgaagcttgggcgccggatgagcgccacactacggcagctgggataccccaccaagaactcgctgaaggcctggttggcagaattcgaacggaatcaggatcttcgccgaggctatcaacggataaaacggcagtacaccgatgagcaaaagcaacgggcagtagatcactatatcgaacaaggctactgcctgagtcacacaatccgaagcctgggctacccaagccgcgaggccttgcgtgcctggatccgtgatttacgccctgaattcgctaggacggtcgtcggcagcagcgctcccacagtcgcccgctctcgcctcgagaagcagcaagccgtcattgcactgaacctgcgcgtaggttcggcaaaggatgtggccgacactgtcggtgtatcgcgaccaacgttgtataactggcagcatcgattacttggcaaagtgcccctaaaacccatgacaaagaagaaaggtgacacctcgctcgagcagcggcatgaggcactactcagggaactggccgaactggagagccagaaccagcggcactgttgcaaatag

SEQ ID NO: 4247 - DNA, 234 bp, Klebsiella pneumoniae
cgtatgcgctcacgcaactggtccagaaccttgaccgaacgcagcggtggtaacggcgcagtggcggttttcatggcttgttatgactgtttttttgtacagtctatgcctcgggcatccaagcagcaagcgcgttacgccgtgggtcgatgtttgatgttatggagcagcaacgatgttacgcagcagggcagtcgccctaaaacaaagttaacccctaaggaagtatcgtga

SEQ ID NO: 4248 - DNA, 321 bp, Klebsiella pneumoniae
tttttaccgtcgagccaagaccaatgtcgctccctatgcggtagactttgccggccacggcgtccagcaccggcgcgaggcgggcaaaggcggcatcgctcccggaggccatcaccgtcatgtcgccggcggccgctttcacggcgccgcccgataccggcgcgtcgagcatcaatagctggtactccgccagcgcctcggcaatggcctgagcatcggcggaagcgatggtggacgacaccatcacgacggtgcccggcttcagatgggcggcgaggccgctctcgccgaacaggatcccccgcacctgggcggcattga

SEQ ID NO: 4249 - DNA, 738 bp, Klebsiella pneumoniae; identical to SEQ ID NO: 4212

SEQ ID NO: 4250 - DNA, 447 bp, Klebsiella pneumoniae
catcaaggcccgatccttggagcccttgccctcccgcacgatgatcgtgccgtgatcgaaatccagatccttgacccgcagttgcaaaccctcactgatccgcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaa

SEQ ID NO: 4251 - DNA, 1152 bp, Klebsiella pneumoniae
gagggtatgccgggcgccgctgtgctactgtggcagccttctatttccagggccggacgcataatgattcagtacattcgtattcaaaattttcgctcagtaaaggatatcgcgctggagctcgggccgctgaacattgtcttcggccctaacggctgcggtaaatccaatatttataacgccatccacctgctgaccgctgccgctgagggcaggctttcggggtttatcagcgaagagggcggtctggagaatatgatgtggtccggggagcgttcgcccctcgatcgtcacccccgccggctgcaaatcgcctgccggaccgacagcttcgattatgaactgcagataggcttccctgaaaaattgccctatccgacgcaattcatgctcgatcctatcgttaaagaagagaatatctggctggccggctactcccgccggccttcctcccgcgtactgcagcgcaagaatcaggcggcgtttctcgtcgatgtcaccggggagaaaagtactttcaccgagagtatttatgaaaatgagtcggtgttcggtcagcttggcgagccgcaccgttttcccgaagtatcgcgagtgcgggagacgctgcgccgttggcggttttatcatgaattcgcgattggccgtcattcgccactgcgtcagccggccgtgggttaccgttcgccagtcctcgacagcgatggccagaatctcgccgccgcctttcagaccattgtcgagatcggcgcggaggagattttgcatgaaatccttgccgacgcctttcccggctgccagttttattgtgaaaacgagcactcgcgtttcgctctgaaaatgcgtcgcgaagggatccgccgcccgctgctggcggcggagatgtccgacggtacgctgcgctttttgtgcctcgccgtcgcgctgctcagtccgcgcccgccggcgtttctggcgatcaatgaaccggagaacagcctgcatcgcgacatgttgcccgcgctggcccggctgattatcgaggcctcgcgctacagccagatctggctgaccagccactcggcggagctggcggagcttatcgccgccggggcgccttgtcagcgctatgcgctggagaatcgcggcggtgagacgcggattgtcgagtga

SEQ ID NO: 4252 - DNA, 810 bp, Klebsiella pneumoniae
gctcaggcgttagacatcatgagggtagcggtgaccatcgaaatttcgaaccaactatcagaggtgctaagcgtcattgagcgccatctggaatcaacgttgctggccgtgcatttgtacggctccgcagtggatggcggcctgaagccatacagcgatattgatttgttggttactgtggccgtaaagcttgatgaaacgacgcggcgagcattgctcaatgaccttatggaggcttcggctttccctggcgagagcgagacgctccgcgctatagaagtcacccttgtcgtgcatgacgacatcatcccgtggcgttatccggctaagcgcgagctgcaatttggagaatggcagcgcaatgacattcttgcgggtatcttcgagccagccatgatcgacattgatctagctatcctgcttacaaaagcaagagaacatagcgttgccttggtaggtccggcagcggaggaattctttgacccggttcctgaacaggatctattcgaggcgctgagggaaaccttgaagctatggaactcgcagcccgactgggccggcgatgagcgaaatgtagtgcttacgttgtcccgcatttggtacagcgcaataaccggcaaaatcgcgccgaaggatgtcgctgccgactgggcaataaaacgcctacctgcccagtatcagcccgtcttacttgaagctaagcaagcttatctgggacaaaaagaagatcacttggcctcacgcgcagatcacttggaagaatttattcgctttgtgaaaggcgagatcatcaagtcagttggtaaatga

SEQ ID NO: 4253 - DNA, 678 bp, Klebsiella pneumoniae
agtcaggtaacttcggcgatatccagttctttgcccgtgcccagcaggagtttcgtcatgactgagcaacaactgcgagaggaaatggtgcagattggcgcctcgttatttagccgcggctatgccaccggctccgctggcaatctgtcgctgctgctgccggacggcaacctgctggcgacgccgaccggcgcctgcctcggcgaactgcaggctcagcggttgtcggtggtgacgctgcaaggggaatggatctccggcgacaaaccgtcgaaagaggtcacttttcaccgggcagtctatttgcacaacccggcctgcaaggcgatcgtccacttgcacagccactatctgaccgcgctctcctgcctgcaggggctcgatccgcacaactgtatccgcccctttaccccctatgtggtgatgcgcgtcggcgacgtcccggtggttccctactaccggccgggcgatgaccgtattgcccaggcgctggccgggctggcgccccgctataacgcctttttactggccaaccacggaccggtggttactggctcatcgctgcgcgaagccaccaacaataccgaggaactggaagagaccgcacggctgatatttaccctcggcaaccgcgagatccgctacctgaccgctgacgaagtaaaagaactgagataa

SEQ ID NO: 4254 - DNA, 942 bp, Klebsiella pneumoniae
atcagcaaaacgccgggttattcttatttgtcgcttctttactcgcctttatcggccctcactcaaggatgtattgtggttatgcgttatattcgcctgtgtattatctccctgttagccaccctgccgctggcggtacacgccagcccgcagccgcttgagcaaattaaactaagcgaaagccagctgtcgggccgcgtaggcatgatagaaatggatctggccagcggccgcacgctgaccgcctggcgcgccgatgaacgctttcccatgatgagcacctttaaagtagtgctctgcggcgcagtgctggcgcgggtggatgccggtgacgaacagctggagcgaaagatccactatcgccagcaggatctggtggactactcgccggtcagcgaaaaacaccttgccgacggcatgacggtcggcgaactctgcgccgccgccattaccatgagcgataacagcgccgccaatctgctgctggccaccgtcggcggccccgcaggattgactgcctttttgcgccagatcggcgacaacgtcacccgccttgaccgctgggaaacggaactgaatgaggcgcttcccggcgacgcccgcgacaccactaccccggccagcatggccgcgaccctgcgcaagctgctgaccagccagcgtctgagcgcccgttcgcaacggcagctgctgcagtggatggtggacgatcgggtcgccggaccgttgatccgctccgtgctgccggcgggctggtttatcgccgataagaccggagctggcgagcggggtgcgcgcgggattgtcgccctgcttggcccgaataacaaagcagagcgcattgtggtgatttatctgcgggataccccggcgagcatggccgagcgaaatcagcaaatcgccgggatcggcgcggcgctgatcgagcactggcaacgctaa

SEQ ID NO: 4255 - DNA, 216 bp, Klebsiella pneumoniae
ttcatcgacgcccaggatgacgccgggaaagcgcaggtaacagagctgcaccgcgaagcccagccgattggctggcccgcgccgctgtcggatgatcgagaggtcggtatcgttgaatgtgtaatgtcggatcaggtcgtccttggagtccggcaacgccagcaggctttcccgctcggcggcggacaggatggaacgacgtggcatatttactga

SEQ ID NO: 4256 - DNA, 1563 bp, Klebsiella pneumoniae
tgcacgcatcacctcaatacctttgatggtggcgtaagccgtcttcatggatttaaatcccagcgtggcgccgattatccgtttcagtttgccatgatcgcattcaatcacgttgttccggtacttaatctgtcggtgttcaacgtcagacgggcaccggccttcgcgtttgagcagagcaagcgcgcgaccataggcgggcgctttatccgtgttgatgaatcgcgggatctgccacttcttcacgttgttgaggattttacccagaaaccggtatgcagctttgctgttacgacgggaggagagataaaaatcgacagtgcggccccggctgtcgacggcccggtacagatacgcccagcggccattgaccttcacgtaggtttcatccatgtgccacgggcaaagatcggaagggttacgccagtaccagcgcagccgtttttccatttcaggcgcataacgctgaacccagcggtaaatcgtggagtgatcgacattcactccgcgttcagccagcatctcctgcagctcacggtaactgatgccgtatttgcagtaccagcgtacggcccacagaatgatgtcacgctgaaaatgccggcctttgaatgggttcatgtgcagctccatcagcaaaaggggatgataagtttatcaccaccgactatttgcaacagtgccgtggaagcttatatcgaacgcgtcagccgggccaaccgctttgaatatggcaaagtgcgggtcgcaggctgcgtcggctgggcgctatgcgcctcgataaccggcgtgctgttcggcatcgatcccaatatcaccttctggatcgcctccggctttgcgctggtgctcggtctgctgctctggctgtcgcggccggaaagcagcaacagcgcccaggttatcgaggcgctgggcgccaatcgccaggccttttcgctgcgtacggcggcagagctgctgcgtatgccgcgcttctggggctttatcgtctatgtggtgggtgtcgccagcgtctacgacgtgtttgaccagcagttcgccaactttttcaaaagctttttcgccagtccgcagcgcggtaccgaagtgtttggcttcgtcaccaccggcggcgagttgctcaacgcgctgatcatgttctgcgcgccggccatcgttaaccgcatcggcgccaaaaacgccctgctgaccgcggggatgatcatgtcggtgcgtattctcgggtcgtccttcgcctcatcggcagtcgaggtggtgatcctcaagatgctgcatatgtttgagatccccttcctgctggtgggaacttttaaatatatctcttccgcctttaacccgcgcctctcggccaccctgttcctgatcggttttaatctgtcaaaacagctgtccggggtggtgctttccgcctgggtgggccggatgtacgacaccgtcggcttccatcaggcctatctgatcctcggctgcataaccctgagcttcaccctgctctcgttcgtcaccctacgcggcggcaaccgtctgctgccgaccgcagagacgcagagccccgcctga

SEQ ID NO: 4257 - DNA, 297 bp, Klebsiella pneumoniae
tgcacgcatcacctcaatacctttgatggtggcgtaagccgtcttcatggatttaaatcccagcgtggcgccgattatccgtttcagtttgccatgatcgcattcaatcacgttgttccggtacttaatctgtcggtgttcaacgtcagacgggcaccggccttcgcgtttgagcagagcaagcgcgcgaccataggcgggcgctttatccgtgttgatgaatcgcgggatctgccacttcttcacgttgttgaggattttacccagaaaccggtatgcagctttgctgttacgacg

SEQ ID NO: 4258 - DNA, 2610 bp, Klebsiella pneumoniae
attcggaatcagtcgcgaaaccctgtatcaatacttgagaacggatcagtaaatatgccacgtcgttccatcctgtccgccgccgagcgggaaagcctgctggcgttgccggactccaaggacgacctgatccgacattacacattcaacgataccgacctctcgatcatccgacagcggcgcgggccagccaatcggctgggcttcgcggtgcagctctgttacctgcgctttcccggcgtcatcctgggcgtcgatgaactaccgttcccgcccttgttgaagctggtcgccgaccagctcaaggtcggcgtcgaaagctggaacgagtacggccagcgggagcagacccggcgcgagcacctgagcgagctgcaaaccgtgttcggtttccggcccttcaccatgagccattaccggcaggccgtccagatgctgaccgagctggcgatgcaaaccgacaaaggcatcgtgctggccagcgccttgatcgggcacctgcggcggcagtcggtcattctgcccgccctcaacgccgtcgagcgggcgagtgccgaggcgatcacccgtgctaaccggcgcatctacgacgccttggccgaaccactggcggacgcgcatcgccgccgcctcgacgatctgctcaagcgccgggacaacggcaagacgacctggttggcttggttgcgccagtctccggccaagccaaattcgcggcatatgctggaacacatcgaacgcctcaaggcatggcaggcactcgatctgcctaccggcatcgagcggctggttcaccagaaccgcctgctcaagattgcccgcgagggcggccagatgacacccgccgacctggccaaattcgagccgcaacggcgctacgccactctcgtggcgctggccaccgagggcatggccaccgtcaccgacgaaatcatcgacctgcacgaccgcatcctgggtaagctgtttaacgctgccaagaataagcatcagcagcagttccaggcgtcaggcaaggccatcaacgccaaggtacgtctgtacgggcgcatcggtcaggcgctgatcgacgccaagcaatcaggccgcgatgcgtttgccgccatcgaggccgtcatgtcctgggattcctttgccgagagcgtcaccgaggcgcagaagctcgcgcaacccgatgacttcgatttcctgcatcgcatcggcgagagctacgccaccctgcgccgctatgcaccggaattccttgccgtgctcaagctgcgggccgcgcccgccgccaaaaacgtgcttgatgccattgaggtgctgcgcggcatgaacaccgacaacgcccgcaagctgccagccgatgcaccgaccggcttcatcaagccgcgctggcagaaactggtgatgaccgacgccggcatcgaccggcgctactacgaactgtgcgcgctgtccgagttgaagaactccctgcgctcgggcgacatctgggtgcagggttcacgccagttcaaggacttcgaggactacctggtaccgcccgagaagttcaccagcctcaagcagtccagcgaattgccgctggccgtggccaccgactgcgaacaatatctgcatgagcggctgacgctgctggaagcacaacttgccaccgtcaaccgcatggcggcagccaacgacctgccggatgccatcatcaccgagtcgggcttgaagatcacgccgctggatgcggcggtgcccgacaccgcgcaggcgctgatagaccagacagccatggtcctgccgcacgtcaagatcaccgaactgctgctcgaagtcgatgagtggacgggcttcacccggcacttcacgcacttgaaatcgggcgatctggccaaggacaagaacctgttgttgaccacgatcctggccgacgcgatcaacctgggcctgaccaagatggccgagtcctgccccggcacgacctacgcgaagctcgcttggctgcaagcctggcatacccgcgacgaaacgtactcgacagcgttggctgaactggtcaacgctcagtttcggcatccctttgccgggcactggggcgatggcaccacatcatcatcggacggacagaatttccgaaccgctagcaaggcaaagagcacggggcacatcaacccaaaatatggcagcagcccaggacggactttctacacccacatctccgaccaatacgcgccattccacaccaaggtggtcaatgtcggcctgcgcgactcaacctacgtgctcgacggcctgctgtaccacgaatccgacctgcggatcgaggagcactacaccgacacggcgggcttcaccgatcacgtcttcgccctgatgcacctcttgggcttccgcttcgcgccgcgcatccgcgacctgggcgacaccaagctctacatcccgaagggcgatgccgcctatgacgcgctcaagccgatgatcggcggcacgctcaacatcaagcacgtccgcgcccattgggacgaaatccggcactgttgcaaagttagcgatgaggcagccttttgtcttattcaaaggccttacatttcaaaaactctgcttaccaggcgcatttcgcccaggggatcaccataa

SEQ ID NO: 4259 - DNA, 300 bp, Klebsiella pneumoniae; identical to SEQ ID NO: 2144

SEQ ID NO: 4260 - DNA, 528 bp, Klebsiella pneumoniae
cttcttcgtctttttctccattgcgcccggactaataatgggcaggcaaggtgtgtctcagcttggcttcagcctgctgtttgccacagtggcaattgccatggtgtttacggctcgttttatggggcgtgtgatacccaagtggggcagcccaagtgtcttgcgaatgggaatgggatgcctgatagctggagcagtattgcttgccatcaccgaaatatgggcttcgcagtccgtgttaggctttattgctccgatgtggctagtgggtattggtgtcgccacagcggtatctgtggcacccaatggcgctcttcaaggattcgaccatgttgctggaacggtcacggcagtttacttctgcttgggcggtgtactgctaggaagcatcggaacgttgatcatttcgctgttgccgcgcaacacggcttggccggttgtcgtgtactgtttgacccttgcaacagtcgtgctcggtctgtcttgtgtttcccgagcgaagggctctcgcggccagggggagcatga

SEQ ID NO: 4261 - DNA, 276 bp, Klebsiella pneumoniae
cccttgcaacagtcgtgctcggtctgtcttgtgtttcccgagcgaagggctctcgcggccagggggagcatgatgtggtcgcgctacaaagtgcggaaagtacgtcaaatcccaatcgttgagagaatgtggcaagctatcgcccaacaaatcgctgcagccgacccaaaaccgctacgcggtttcggtcggctgagctcaggcgttagacatcatgagggtagcggtgaccatcgaaatttcgaaccaactatcagaggtgctaagcgtcattga

SEQ ID NO: 4262 - DNA, 348 bp, Klebsiella pneumoniae; identical to SEQ ID NO: 2147

SEQ ID NO: 4263 - DNA, 366 bp, Klebsiella pneumoniae
gaaagtactaaataccgcactctgtcgggcgtcgctgtttgccgatcaccacgcccgccggtccctgcggttcgccaacgctatatgccatcccgggaggaactggtgcacccgataattaaggtcatgctggtgggcggtaaggcggacgggctgttggtcagcgtcgccgatgacgcgaccgaagtctcggtgacgcctgcgcagtacggtgcgctatccgggcaatcgttgagctaccgaattgttagccaaaccattgacgatgaacgctatttttttggcgttttcagcgacgcccatcaggatagcgataagctgacgcgggtcgccctgacccgtggaatgaaaaaaatgttctgttaa

SEQ ID NO: 4264 - DNA, 783 bp, Klebsiella pneumoniae
aaaaatggtaaggggagagcggtgattccaatagaacgacatcagcgtattttagccctggtggagcagcgtggggcggtaagcattaacgagctgacggagatcctcggcgtgtcccatatgaccatccgtcgggacgtcagtaaactggaggagcaggggctgctggtcagcgtctcgggcggcgtgcgcgccgtcagccggctggctgcggaacccagtcatctggtgaaaagcacgctgcagagtgaggagaaacaggcgatcggcgcgctggcggcgagtcatatcgctaaaaacagttgcatctatctggatgccgggactaccaccctggcgctggcgcgggcgatcctcgaccggaacgatctccaggtggtcaccaatgattttgagataacccagctgctgatcgatgccagccagtgcggcgtgatccacaccggcggcactctgtgccgggagaaccgctcctgcgtgggcgaatcggcggcgcgtacgttacgccacctggctatcgatacggcctttatctccgccagcggctgggacagtcgcgggatattcacccctgatgagaacaaggttaccgtcaaggagaccgtcagccaggtcagcgcgagaagcatcctgctgtgcgacagttcgaaatacaatcaggtggccacgtttatggcgttacctttgacccggttcaccaccatcattaccgaccggcatctttccgatgccgccgccagtcatatcgcccggcacgcctgcgaggtgctgcgggccggataa

SEQ ID NO: 4265 - DNA, 1020 bp, Klebsiella pneumoniae
caagccatgaaaaccgccactgcgccgttaccaccgctgcgttcggtcaaggttctggaccagttgcgtgagcgcatacgctacttgcattacagcttacgaaccgaacaggcttatgtccactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccagcttctgtatggaacgggcatgcggatcagtgagggtttgcaactgcgggtcaaggatctggatttcgatcacggcacgatcatcgtgcgggagggcaagggctccaaggatcgggccttgatgttacccgagagcttggcacccagcctgcgcgagcagctgtcgcgtgcacgggcatggtggctgaaggaccaggccgagggccgcagcggcgttgcgcttcccgacgcccttgagcggaagtatccgcgcgccgggcattcctggccgtggttctgggtttttgcgcagcacacgcattcgaccgatccacggagcggtgtcgtgcgtcgccatcacatgtatgaccagacctttcagcgcgccttcaaacgtgccgtagaacaagcaggcatcacgaagcccgccacaccgcacaccctccgccactcgttcgcgacggccttgctccgcagcggttacgacattcgaaccgtgcaggatctgctcggccattccgacgtctctacgacgatgatttacacgcatgtgctgaaagttggcggtgccggagtgcgctcaccgcttgatgcgctgccgcccctcactagtgagaggtag

SEQ ID NO: 4266 - DNA, 192 bp, Klebsiella pneumoniae
aaaatgatgaaggaaaaaagaggaattgtgaatcagcaaaacgccgggttattcttatttgtcgcttctttactcgcctttatcggccctcactcaaggatgtattgtggttatgcgttatattcgcctgtgtattatctccctgttagccaccctgccgctggcggtacacgccagcccgcagccgcttga

SEQ ID NO: 4267 - DNA, 348 bp, Klebsiella pneumoniae
aaaccgccactgcgccgttaccaccgctgcgttcggtcaaggttctggaccagttgcgtgagcgcatacgctacttgcattacagcttacgaaccgaacaggcttatgtccactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctga

SEQ ID NO: 4268 - DNA, 1314 bp, Klebsiella pneumoniae
atccttttgctctacgagagcgccgccaaatccttcgttcaaggagatggtttcgtgcgctcaaaaaactttagttggcggtactcccttgccgccacggtgttgttgttatcaccgttcgatttgctggcatcactcggcatggacatgtacttgccggcagtgccttttatgccaaacgcgcttggcacgacagcgagcacagttcagcttacgctggcaacgtacttggtcatgatcggtgccggtcagctcttgtttggaccgctatcggaccgactggggcgccgccccgttctactgggaggtggcctcgcctacgttgtggcgtcaatgggcctcgcttttacgtcattggctgaagtctttctggggcttcggattcttcaggcttgtggtgcctcggcgtgccttgtttccacgtttgcaacagtacgtgacatttacgcaggtcgcgaggaaagtaacgtcatttacggcatactcggatccatgctggccatggtcccggcggtaggcccattgctcggagcgctcgtcgacatgtggcttgggtggcgggctatctttgcgtttctaggtttgggcatgatcgctgcatctgcagcagcgtggcgattctggccagaaacccgggtgcaacgagttacgggcttgcaatggtcgcagctgctactccccgttaagtgcctgaacttctggttgtacacgttgtgttacgccgctggaatgggtagcttcttcgtctttttctccattgcgcccggactaataatgggcaggcaaggtgtgtctcagcttggcttcagcctgctgtttgccacagtggcaattgccatggtgtttacggctcgttttatggggcgtgtgatacccaagtggggcagcccaagtgtcttgcgaatgggaatgggatgcctgatagctggagcagtattgcttgccatcaccgaaatatgggcttcgcagtccgtgttaggctttattgctccgatgtggctagtgggtattggtgtcgccacagcggtatctgtggcacccaatggcgctcttcaaggattcgaccatgttgctggaacggtcacggcagtttacttctgcttgggcggtgtactgctaggaagcatcggaacgttgatcatttcgctgttgccgcgcaacacggcttggccggttgtcgtgtactgtttgacccttgcaacagtcgtgctcggtctgtcttgtgtttcccgagcgaagggctctcgcggccagggggagcatgatgtggtcgcgctacaaagtgcggaaagtacgtcaaatcccaatcgttga

SEQ ID NO: 4269 - DNA, 219 bp, Klebsiella pneumoniae
cgtcatttacggcatactcggatccatgctggccatggtcccggcggtaggcccattgctcggagcgctcgtcgacatgtggcttgggtggcgggctatctttgcgtttctaggtttgggcatgatcgctgcatctgcagcagcgtggcgattctggccagaaacccgggtgcaacgagttacgggcttgcaatggtcgcagctgctactccccgttaa

SEQ ID NO: 4270 - DNA, 381 bp, Klebsiella pneumoniae
cgtcgtaacagcaaagctgcataccggtttctgggtaaaatcctcaacaacgtgaagaagtggcagatcccgcgattcatcaacacggataaagcgcccgcctatggtcgcgcgcttgctctgctcaaacgcgaaggccggtgcccgtctgacgttgaacaccgacagattaagtaccggaacaacgtgattgaatgcgatcatggcaaactgaaacggataatcggcgccacgctgggatttaaatccatgaagacggcttacgccaccatcaaaggtattgaggtgatgcgtgcactacgcaaaggccaggcctcagcattttattatggtgatcccctgggcgaaatgcgcctggtaagcagagtttttgaaatgtaa

SEQ ID NO: 4271 - DNA, 1284 bp, Klebsiella pneumoniae
acagtgaggagagacaacatgcagcttggtgtcattgccgatgacttcaccggcgccacggatattgccagcttcctcgtgcgcaacggcatgccgacggtgcaactgaatggcgtgccgacccgcgatcttccgctgaccagcgaggcggtggtcatcagcctgaaaactcgctcctgcccggcggaaatggccgtcagccagtcgctggcggccctgcgctggctgcaggcccagggctgtcagcagttttatttcaagtactgttccactttcgacagcaccgcgcagggcaacattggcccggtgctggatgccctgctggccgagctgggtgagacgcggacggtgatttccccggcgctgccggttaacggccgcacggtctatcagggatatctgttcgtcggcgagcaactgctgaatgagtccgggatgcgccaccatccggtgacgccgatggaggatgcgcacctgggccgcttaattgagcgccaggggcgcggaaaagccgcgctgattgcctggccgattgtcgcccgggggccggaggcggtcgccgccgcgctggcggcagtcaacgatccggcggtgcgctatgtggtgctcgacgccctcagcgaacaggatctgctcacccagggcgtggcgctgcgggagatgaagctggtctccggcggttccggcctcgccatcggcctcgcccgcgacttggcgcagcgccatggcgcccggggtgaaagcgctcaggccggcatgccgctggtcggcccggcggtggtgctctcgggctcctgctcggtgatgaccaacagccaggtggcggcctatcgtcaacaggcccccgcccgcgccgtcgacttaagcgcctgctttaccgatctggagagctacgtcaggacgctgactgactgggtggacgcgcagcgcgatgcgccgctggcgccgatgatctatgccaccaccgagccgcaaacgctgcagcggatccaggcgcagtatggcgacaaggccagcagcgaacgggtggaacagctgtttgccgctcttgccgccgccctgaaggcgaaaggatttacccgctttattgtggccggaggggaaacgtcgagcattgtggcgcagaccctgggggttgaggcgttccatattgggccgaccatctcccctggcgtgccctgggtgcgtgacacccgccagccgctctccctggcgctgaagtcaggtaacttcggcgatatccagttctttgcccgtgcccagcaggagtttcgtcatgactga

SEQ ID NO: 4272 - DNA, 435 bp, Klebsiella pneumoniae
gcgcactccggcaccgccaactttcagcacatgcgtgtaaatcatcgtcgtagagacgtcggaatggccgagcagatcctgcacggttcgaatgtcgtaaccgctgcggagcaaggccgtcgcgaacgagtggcggagggtgtgcggtgtggcgggcttcgtgatgcctgcttgttctacggcacgtttgaaggcgcgctgaaaggtctggtcatacatgtgatggcgacgcacgacaccgctccgtggatcggtcgaatgcgtgtgctgcgcaaaaacccagaaccacggccaggaatgcccggcgcgcggatacttccgctcaagggcgtcgggaagcgcaacgccgctgcggccctcggcctggtccttcagccaccatgcccgtgcacgcgacagctgctcgcgcaggctgggtgccaagctctcgggtaa

SEQ ID NO: 4273 - DNA, 579 bp, Klebsiella pneumoniae
cattttgcagggaattccatgactggacagcgcattgggtatatcagggtcagcaccttcgaccagaacccggaacggcaactggaaggcgtcaaggttgatcgcgcttttagcgacaaggcatccggcaaggatgtcaagcgtccgcaactggaagcgctgataagcttcgcccgcaccggcgacaccgtggtggtgcatagcatggatcgcctggcgcgcaatctcgatgatttgcgccggatcgtgcaaacgctgacacaacgcggcgtgcatatcgaattcgtcaaggaacacctcagttttactggcgaagactctccgatggcgaacctgatgctctcggtgatgggcgcgttcgccgagttcgagcgcgccctgatccgcgagcgtcagcgcgagggtattgcgctcgccaagcaacgcggggcttaccgtggcaggaagaaatccctgtcgtctgagcgtattgccgaactgcgccaacgtgtcgaggctggcgagcaaaagaccaagcttgctcgtgaattcggaatcagtcgcgaaaccctgtatcaatacttgagaacggatcagtaa

SEQ ID NO: 4274 - DNA, 243 bp, Klebsiella pneumoniae
tgtcgttctattggaatcaccgctctccccttaccattttttcacaccaggcgtcaccacccaggctacggccctggcgacacccggtgttgttatcgcgctttgccgctgtttttaggctattttagggcaagaatcgccgttgtgcagcctctttccgcctgtgaattttttatattcatgtgggttattcgtgataactctcacataaattcacatgataacgctttattctatcattaa

SEQ ID NO: 4275 - DNA, 1026 bp, Klebsiella pneumoniae; identical to SEQ ID NO: 2203

SEQ ID NO: 4276 - DNA, 771 bp, Klebsiella pneumoniae
gataaaaccatgccaaaattcgctgcaaatttatccatgctgtttaccgaactgccgttcctggaacgctttgccgccgctgcccgggcgggatttgaagccgttgagtttctgtttccctatgagtatgccgccggggaaatcagacagcgcctgcaggagaaccagctgcagctggtgctgttcaataccccacccggcgacgtcaacgccggagaatgggggctcgccgccatccccgggagaagcgcggaggcccgacgcgatattgagctggcgctggagtatgcctgccagctcggttgcccgcaggtgcatatcatggccggcgtggtgccgccgggagcggatcgcgcagcctgcgaggccgtgcttatcgataatctgcgctacgcggcggagtgctttgcccgccacgacaagcggatactcatcgaagcgctgaatccgcagaccaaaccgggctatctctaccacagtcaatatcagacgctggcgatggtgaaacgggtcgacaggccgaacctggcggtgcagttagatctgtttcacgcgcagaaggtggacggcaatttaagccatcttattaccgaatatgccggccagtatcgccatattcagattgcctccctgcccgaccgtcatgaaccggatgagggcgaaaggcactgttgcaaagttagcgatgaggcagccttttgtcttattcaaaggccttacatttcaaaaactctgcttaccaggcgcatttcgcccaggggatcaccataa

SEQ ID NO: 4277 - DNA, 930 bp, Klebsiella pneumoniae
ttaactaatgttcacaaggagaccagcatggctgcacacactaacgtctgcgtgattggactgggttcaatgggcatgggcgccgcccgcgcctgcctgcaggcgggcctgaacacctggggcgttgacatcaatcccgacaactgtcgcgcactgctggcggcgggcgccaatggcgcgggccccagcgcggtgccgttcgccgcggaactggatgcagttgtgctgctggtggtcaatgccgcccaggtgcgggggatcctgttcggcgagagcggcctcgccgcccatctgaagccgggcaccgtcgtgatggtgtcgtccaccatcgcttccgccgatgctcaggccattgccgaggcgctggcggagtaccagctattgatgctcgacgcgccggtatcgggcggcgccgtgaaagcggccgccggcgacatgacggtgatggcctccgggagcgatgccgcctttgcccgcctcgcgccggtgctggacgccgtggccggcaaagtctaccgcatagggagcgacattggtcttggctcgacggtaaaaattatccatcagctgctggccggggtgcacatcgccgttgccgccgaagcgatggcgcttgccgcccgcgccgggatcccactcgaaacgatgtatgacgtggtcacccacgcggcgggtaattcatggatgtttgagaatcgcatgcagcacgtcctggatggcgattactcgccaaaatccgctgtcgatatttttgtcaaagatctcgggctggtgaatgacactgcccgggcgctgaccttcccgctgccgctcgctaccaccgcgctgaatatgttcacctccgccagtaatgccggattcggtcgggaagatgacagcgcggtgatcaagattttcaacggcatcaccctgccgggccataaacagtga

SEQ ID NO: 4278 - DNA, 483 bp, Klebsiella pneumoniae
ggaagtatcgtgaaactatcactaatggcagcaatttcgaagaatggagttatcggaaatggcccagatattccatggagtgccaaaggggaacaattactcttcaaagcgattacctataatcagtggcttttggtaggccgaaagactttcgagtcaatgggggctttacccaaccgaaaatatgccgttgtaactcgttcaagcttcacttccagtgatgagaatgtattggtatttccatctatcgatgaagcgctaaatcatctgaagacgataacggatcatgtgattgtgtctggtggtggtgaaatatacaaaagcctgatcgataaagctgatactttacatatttcaacaatcgacattgagccagaaggtgatgtctattttccagaaatccccggtagttttaggccagtttttagccaagacttcgtgtctaacataaattatagttaccaaatctggcaaaagggttaa

SEQ ID NO: 4279 - DNA, 618 bp, Klebsiella pneumoniae
aagttggcggtgccggagtgcgctcaccgcttgatgcgctgccgcccctcactagtgagaggtagggcagcgcaagtcaatcctggcggattcactacccctgcgcgaaggccatcggtgccgcatcgaacggccggttgcggaaagtcctccctgcgtccgctgatggccggcagcagcccgtcgttgcctgatggatccaacccctccgctgctatagtgcagtcggcttctgacgttcagtgcagccgtcttctgaaaacgacaatggaggtggtagccgagggtgtggaaacacccgactgccttgcgtggttgcggcaggcgggttgcgacacggtgcagggtttcctgttcgccaggccgatgccggcggcggccttcgtcggcttcgtcaaccaatggaggaacaccaccatgaacgccaatgaaccgagcaccagttgctgcgtgtgctgcaaggaaatcccgctcgatgccgccttcacgccggaaggggccgagtacgtggagcatttctgcgggctggagtgctatcagcgcttccaggcgcgggccagcactgcgaccgaaaccagcgtcaaaccggacgcttgtgattcgccgccgtcaggttga

SEQ ID NO: 4280 - DNA, 339 bp, Klebsiella pneumoniae
tgcacgcatcacctcaatacctttgatggtggcgtaagccgtcttcatggatttaaatcccagcgtggcgccgattatccgtttcagtttgccatgatcgcattcaatcacgttgttccggtacttaatctgtcggtgttcaacgtcagacgggcaccggccttcgcgtttgagcagagcaagcgcgcgaccataggcgggcgctttatccgtgttgatgaatcgcgggatctgccacttcttcacgttgttgaggattttacccagaaaccggtatgcagctttgctgttacgacgggaggagaggataaaaatagacaggcgtccaagggttttcca

SEQ ID NO: 4281 - DNA, 423 bp, Klebsiella pneumoniae
tggaaaacccttggacgcctgtctatttttatcctctcctcccgtcgtaacagcaaagctgcataccggtttctgggtaaaatcctcaacaacgtgaagaagtggcagatcccgcgattcatcaacacggataaagcgcccgcctatggtcgcgcgcttgctctgctcaaacgcgaaggccggtgcccgtctgacgttgaacaccgacagattaagtaccggaacaacgtgattgaatgcgatcatggcaaactgaaacggataatcggcgccacgctgggatttaaatccatgaagacggcttacgccaccatcaaaggtattgaggtgatgcgtgcactacgcaaaggccaggcctcagcattttattatggtgatcccctgggcgaaatgcgcctggtaagcagagtttttgaaatgtaa

SEQ ID NO: 4282 - DNA, 411 bp, Klebsiella pneumoniae
ttgttgtggaagagcagactctccactaagggcagcagcatgggcaaaaaagtacacatcatttgtggaaagtgcggcagtgacgagatgaactttgtcatcaatgaacactgtccagacgatccccagaatgttgccagtatgtcctgctcaaattgttgcgaactgacaggcatagccgagtggtcggaatttaatggacgtgagctgaaaggtgaagccgtcgccctatcaacaccggcaaacgtgaatgctcttctaggattgcttcgccaggcgatggacagcgttgagtatcgcctctatggcggggacatgtcattgagcggtaatgatgctgccgaactcatagacctccaggagcgagctgagaaggtcttgtctgttcttcggagtgatcagcatgagtga

SEQ ID NO: 4283 - DNA, 651 bp, Klebsiella pneumoniae
gtctttgcatgttcatttggacaggcttttagagcagctcgttgcatctgggaagccggtattggcatttggcgtgactggttcgggggacccgaagcacccactaatgcttggatattcgacaaaacttgtgccctggggaggaaaataattatgtcgatgcttgaagcacgttacttcgtggcaaagataagcgatgcacaggccgtgctctgcgatgaggagctggcgacactggaaaggctgatccggaaggttgatgatggccgcagagcaaatggcaagagctcgcttacttgcgttgttgtcgaagaagattggccgaactggcagcaaacggttgactctgtactttcacttgctgacgggaaagacaacgattggaccaatgccacaccagaacaaatcaaggccttttgggtcgatgactcagtttggaaaactctggatggccgggataaatggattgaagatctcgacctgctggtggacggttccccggtggcttctgagtgggaaccttttggcttggaatcagggcagtctgtcgtcatacgaggcggatggatagaagggaatgccttgagtgatgatggcgtaccgctagtgcaggcattcgtcgcttggaaacagggccaagacaaccactaa

SEQ ID NO: 4284 - DNA, 522 bp, Klebsiella pneumoniae
acctccaggagcgagctgagaaggtcttgtctgttcttcggagtgatcagcatgagtgatttatacgaaccgcttgagtttgtgttctgcggctttaggaaaggggacgctgggctatttatctcggtagccactttgcgcgatggtgttttaggccgtgagatgtatttctcaaagggaaaaagcaaaaggcgctgggttgtcggtggcatttactcaggggcctcgttttcggacaacggagcaaaaggtctggatgatgctcattacgttaaagcatgggaagtgcaaggcgacaagatagagtggcaagcaaaaagcgagcaagccgaagccttggcgcgaagcgagaaacttgaagccgacgataggaagcgcaatgaactcgaagagctgatgctacccatcaggaagcaatatggggcattaacaaagcgacgtgatagggcaggggccgcagctcttgaagaagctgtcctgagagcgctgagagcgcccatcaggaaggctgaggagaaataa

SEQ ID NO: 4285 - DNA, 204 bp, Klebsiella pneumoniae
ggagaactgatggacgaaaaaattacctacgaagaaatgcttgaacaactcgaccagaaaggcatccgcgtcaccaacggggcgagacggctttatgtcgcgttgaacaacggagtcaaagctgaggtgctgggtaactgcggtcccgccacaatcagcttggttgacgggatgattgttgtggaagagcagactctccactaa

SEQ ID NO: 4286 - DNA, 351 bp, Klebsiella pneumoniae
aaaggagagatgaccatgaaacatgtactgaatatcgcgctgatggctgttgttattcttggcctggctatgcttgaggccaccaactggggttacgcagtgctggctatcccggcagtgatttgggccaagtcggtgctcaaccttctgcacaaactgccggttctggctgctgctttttggattctggttgctgttttcgcgtggcaagcggcacttgttggtatcctgttctatggcgtacttgcgacccctaaagcgccagcaaacaccaatggcaagaaaagccgaaaagccaatctgatgggcacttacagctacgactttaaaaccggcgaatgctttagctaa

SEQ ID NO: 4287 - DNA, 1035 bp, Klebsiella pneumoniae
gtgcgacactcatggatgaatggcgagaggtggccaactgctgattggtggtacccttctgctcgccaaagtaaaagcagtatcaccatgagctatcagcagttgaccgaggggcaacgataccagttatcggtgcttcgcgcacaggggatgtccatccttgccaccgcacgcgccattggcgttcatcgctccaccctctaccgggagctgcgtcgtaacgccgggccgcagggctaccagccagacaatgcgcatcagcacgccacccaccgacgggccagtgcggccaaatctcggctatctgccgatgtcatccagtttgtcgagctgacactcgcctggtggtggagcccggagcagataagcgcggtgggcaagcagataggcctcatggtgagtcacgagtggatataccgccatgtggccgccgacaaagcccggggtggccagttgtaccgccatctgcgccagggccacaagcgctaccgcaagggggcgagcagcctgcgttctcccatcaaggaagcccgctctattgatgaacggccggctatcgtcgatagccgggagcggctcggtgattgggaggcggacacggtgctgggcaagcaaggcacaggtgcactggtcaccctggtggagcgcaagagccggctctatctggtcaagcgggtcgcgagcaaacaggctggggtggtgcgggatgcgataatcgagatgttaacgccctacatcgagcaggtgcataccatcacctttgacaacggcggcgagtttgccgaacacaaggcgatagaggaagcgctgggtgccgagacttactttgcgcacccttactcttcgtgggagcgcggtctgaacgagaacagcaatgggctgttgaggcagtttatcccaaagggaacagacctgagagaggtcacggacgaggatgtcaggagagcggagcagtggctcaacctacgacctcggaaatgtctcggattcaggcagcctgtcaaggtattcgaagagtactgtcaggcggcatag

SEQ ID NO: 4288 - DNA, 336 bp, Klebsiella pneumoniae
aagcgttcatcgaataacgcactttttgtatggctaacaacgcagtttaaagggtggcaaacaatggataaatgccaattgatagacatcccaagcgacccagagaagaaacgtgagtggatcaagtacaaactcaagatccaggggctttctctggccgcattgggcagaaaacacaaaacatctcggcaggtggtgtctacggcactctataagcccagtccatgctgggaacatgagatagctacagctttgggtgtgaagccgtctgagatttggccggagcggtacgacgaagaacacgaaatacccctcagacataaggaggcaagctga

SEQ ID NO: 4289 - DNA, 360 bp, Klebsiella pneumoniae
ttttctggatcgtggccgtgctggtcctggtcgcgcttggatttccctatgtcgttccatttttctattaaccaggagttcatcatgaagaaactgtttgcctcccttgccctcgccgccgctgttgccccggtgtgggccgctacccagaccgtcacgctagcggttcccggcatgacttgcgccgcctgcccgatcacagtcaagaaagcgctctccaaggtcgaaggcgtgagcaaggtcgatgtgggcttcgagaagcgcgaggccgtcgtcacttttgacgacaccaaggccagcgtacagaagctgaccaaggccaccgcagacgccggctatccgtccagcgtcaagcagtga

SEQ ID NO: 4290 - DNA, 1608 bp, Klebsiella pneumoniae
agtatccctcccccgagaagaaaagcggatcagcacgttcctctcgacacaaaagaagcgcatcactctccagatgtgtttgtcgtagggggcatcatgaaacaacttcctcctgacacaccagaacaatcactgatcactcagtacaaagggcctcgccttgtcgttaaggcctacgctggaacgggtaaaaccacgacactggtgaagtacgcccacaacaacctcgattcacgtatcctctacttggcatacaaccgggctatccgcgatgaggcaagagaaaagtttcctgcaaacgtagactgcaaaacgtcccaccagcttgcctacgcaactataggacggggctaccagcacaaactctccggcaacctaaggctcaccgatattgcccaagcggtgaataccaagaactggacgtttgccaaagatattctcgatacgctcaacgcctttatgtgcagtgcagacatgcggattctttatacgcattttgctcgcgccgatacgggtaaagtgcttacgtccaaacaggagagataccaaatccaggtggtcgaaggtgctgagctcatatggaaacggatgacaaacgttcaagatccgttcccgaccgtacacgactgctacctcaaacagtatcagctcgggatgccgaatctgtctcgccggtacaccaccattctttttgatgaggcacaagacgctaaccccgtaacaagtagcatcgtcctacagcagaactgcaaggtaatcctggttggagatcgccaccagcagatctataggttcagaggcgcaaacaacgcccttgatagcaaagagctcatgaacgccgaccaactctatctcactcatagcttccgctttggccctaacgtttccctggtggcaaacgcccttcttgaactcaaaggtgaaacacgacctgttgttggccggggaccagcagatcaggtagtcatgtttttaccaggtgatgtgggccatcgcgcaatacttcaccgaactgtcatgggggttatagagacggcgctctctgcgaccgaatccggagcgcaggttttctgggtcggtggaatcgacgcttaccagatcaatgagctccaggatttgtactggttttcgatggcagagccagaccgggtaaagaataagaaactgcttgatgagtatgaagactacttcgagtatcaagaagtagcgaaggcgaccaaagaccctgagatgatgagggctgtcaagatcatcaacagctacgatgaaatccctgaacgactcaccactctacgacgcaatacagtcaaagaagagtttggggctgacattacggtctcaacagctcatcggtgcaaagggttggagtgggactttgttcagctctatgacgactttccggatgtcctggacccagagctcgacccaatggcccgtgacgatgaaataaacctgctctacgtcgcatccaccagagcgatgcgaatccttgcattgaacagcgctgtcgagatggttatccgctacatcacccaaaaacgcatggtcgagaagcagatgaagatggccgcagaagcgacagaagttgaagaggacacgaccaaatag

SEQ ID NO: 4291 - DNA, 738 bp, Klebsiella pneumoniae; identical to SEQ ID NO: 4212

SEQ ID NO: 4292 - DNA, 477 bp, Klebsiella pneumoniae
ccccggccgccttggcaaaaacgccaatggtcaggttttccaaattattttccatatcgcttgactccgtacatgagtacggaagtaaggttacgctatccaatccaaattcaaaagggccaacgtatgtctgaaccacaaaacgggcgcggtgcgctcttcgccggcgggctggccgccattcttgcatcgacctgctgcctggggccgctagtactggtcgccctgggcttctccggtgcttggatcggcaacctgacggtgctggaaccctatcgaccgttgttcatcggcgcggcgctagtggcgctgttcttcgcctggaagcggatttaccggcccgtgcaggcatgcaagccaggtgaggtctgcgcgattccgcaggtgcgcgccacctacaagctgattttctggatcgtggccgtgctggtcctggtcgcgcttggatttccctatgtcgttccatttttctattaa

SEQ ID NO: 4293 - DNA, 1023 bp, Klebsiella pneumoniae
aatgtaaggcctttgaataagacaaaaggctgcctcatcgctaactttgcaacagtgccgaaccagcggcttcgcatggagaatgcaattctggagaaggcgagtgaattgataaaaaaagacatgggcatcaaccccctcgaactgacaagccgagaaaaaacgaaggtggttgatgccctcagagtcacgtttccattagccaatctgttgtgcggcctgaagctggcgcgcagcacatacttctatcaacgcctgcggcagacgcggcccgacaagtacacgcaggtgcgtgaggtcattcggactatcttcgaggacaactaccgctgctatggctatcgacgcattgatagtgccttgcgccttggtggcatgcgtgtgtccgagaaggtcgtgcgtcgcttgatggcgcaagagcgtctggtcgtgagaacaccgcgccgccggcgcttctcggcgtatgctggcgacccgacaccagcggtcccgaatctgctgaatcgcgactttcacgcgtcggcgccgaatacgaaatggttgaccgatctgacggaaatacacattccggcagggaaggtctacgtctcgccgatcgtcgattgcttcgatgggctggtggtggcctggaatatcggcaccagcccggatgcgaacctggtcaataccatgctggatcacgcggtacggacactgcgacccggtgagcatccggttatccattcggacaggggctcgcattatcgctggcctgcgtggatccgccgcactgaaaatgcccaattaacgcggtcgatgtccaaaaagggctgctcgccagacaatgctgcatgcgagggctttttcggacgattgaagaccgaactaatctacccgaggaattggcagcacgtgacgctgaaagacctcatgacgcgaatcgatgcctatatccactggtacaacgagcgccgcatcaaagtgtcgcttggcgggcgtagtcccatcgagtatcgtcatgcggtcggattgatgtccgtataa

SEQ ID NO: 4294 - DNA, 1113 bp, Klebsiella pneumoniae
accgctgatacaaagctacgaaacgcaacatatagaggagctgcctcttcatctcaaaatatgggatttgcttctcgttgcggtcggacttcggaggtgactttgcacgacacgaacaatgacaaggaagagctagtttcacatgcgaaagtgaatgttccggcagaacaaaccattcgcggtgaactgttgccgtcatcgagctcgctccggaacatccaggacaaccccgccgtcgcctatctggtgagcctcgggtcaaagcgaagcaggcagaccatgagctcattcctcaatattgtcgccaagatgatcgggtttcagaaccttcgtgactgtgcatggagctcaatgaggcggcaccacatattggcggtgctggaaatgctgggggatgcagggaaggctccggcaacgatcaacacctacctgtcagcgctcaaaggggtggctcttgaagcctggacgatgaagcaaattgatacggacagcttccagcacattaagcaagtccgttcagtacgtggatctcgactcccaaaagggcgagcacttgaacgccatgagattcgcagcctctttttcacatgtgaaagtgattcaagcgccaaagggcttcgggatgcggccattctcggggtgctcctcgggtgtggcttgcgccgctcggaaatcgttgcgctggacatggaaagcatgatctacaaggaccgcgctctcaaggtccttggcaagggcaacaaagagagaatggcgtatgtgcctggtggcgcatggaaaagactggataagtgggttgaagaggttcgaggaacgcatgaagggcctttattcccgaggatcaggcggtttgatgatgtgactggagagcggatgtcggatcaggccatctaccacatcttggagaccagaagagtagaagccggtctggagaagtttgcgccccatgacctgcgacgcacctttgcctcctcgatgctggataacggtgaggatattgtgaccgtgaaggacgcaatgggccactcaagcattgcaactacccagaaatatgacaggcgcggcgatgagcgcttgaagagagcaagccaacgcctcgatatagcggattaa

SEQ ID NO: 4295 - DNA, 207 bp, Klebsiella pneumoniae
ttctgtcacacaagtacaaggcacccgttgcccagtaacggtatgtccgaaccggttgttgagacagcggacggggatagagtccgttacatcaagacaaaccttctcagcgaaaaagaagtggtcaagctgtggcaccgctatcaatccatccgttctggtcaggtaaaaacctcctgttcctgtggcggaaagtttcacatgtga

SEQ ID NO: 4296 - DNA, 909 bp, Klebsiella pneumoniae
tctgttagaacaaacccacacataggcggcaacatggctaaaaacttcatatcagaacaattctcggccatgtgccgcgacttaacgaacctgtcctcccttatcaaacgactaccgccacggtacgcaaaagttgcggccatccctcctaccagaaaaggaatggagaacgagcccgtcaacaagattgtcgtaactgaacaaactggccgtgaagctcttgaactggcagcgcacagctacagagatcttcacatcaacccagactattcgcagaagtctgccaggcgcaccgtgggggtactctggttctccccttccaggattggtgtagctgacgaaattgcggcgacggttgaacgcatcaacgcggccaaagctggtatcgaggagttcattatctcgacgtaccccaccaggcaagaaaggtttgaagcacttcgagcggactgccctggcgtcatgactctccacctttacagacaaattcggtgctataccaatggcgacatcgactctatccgcttcacctggcaacggaaggactccttgaagaagcccgtaaaagaggagcttttgcaacgcatcagagaggagctggagcgatctgggccagactatcaacttcccctggagcagcttatccagaagatcgccagcaccccggagccttatctccgggaacgaagggaagtaaaggttcagccggtggcaaacgtcatggccgcaggggtactcaaaaccgttaccgcgccaatgcctctgatcgtgctccaggacaaggaggttcagctcaaattgcttcgtagctttgacgcctcagaacaacgcaaaacccgatctgataaagcggcatcggaaatccttggcaccttcggtggagtcaccatcgaatccttccctggatga

SEQ ID NO: 4297 - DNA, 498 bp, Klebsiella pneumoniae
tttggaatgacagaacaatcctacggcgatagcatcaaatttttctcagactggcagaaggaccccgcgaaacgcaccggcctgaatgtgcaacacacgctaaccagaggtgagtatcctacggtcagcatcgagattgcgccgatcagggcttcggggtccagcccagactggaaaagcaagatcacggtgcagctcactcgtggcgaactgacggcgttttgcagcgttctctttggcttgcgtagcaaggctgagggttcctatcacggggactcgaagaataagagctttgcggtttacaacaacggcaaggccggtgttgcgatcatcctgagcgagcgaggaaaccagctccagaatttcatcaatgatgacgaccgtatggagctcgcagtcttcgcagttcgccagctctccaacgcatggaaagttaccccttctgatgccatcgcgctgctgcgtcaatcagcgtggatggaccgcaatctgtcctaa

SEQ ID NO: 4298 - DNA, 297 bp, Klebsiella pneumoniae; identical to SEQ ID NO: 2022

SEQ ID NO: 4299 - DNA, 303 bp, Klebsiella pneumoniae
ttaaggcatgcgatgacaagatctgcccttttgattccactcaccacggcggctatcgcgctaaacgcaatatcgccggtttatgcgagcgacacccattctattgatgataccgtaaaacaggttgaaaccacgctgggagcaaaagtgggtatagccgtcctggacaccgggtctcaacgtgcctggttccaccgtgctgatgaccgtttcccgatggcgagcacatccaaagctctgacctgtgcagcgctgttggataaaggtcagagctttatgaataaagagcgggaattcagataa

SEQ ID NO: 4300 - DNA, 456 bp, Klebsiella pneumoniae
ttgatttgtgcagaggtggcaatgttggattttgtttttttggtgtttttggggttgggcatatctacggtgctggtgcgtcggtcttcccgtaaggggatggatcttgagctgacatggctccagtcgttgaaggtcgtgctggttcgtggagctgttgcattgggcctgggttttggcattggcaggcttgtattgatggggatgcagtatggtttcctgagtgagtctgtcctgagggaacatgcacttgtctccgtagcggtggttctgatctgtgggcttggttcgttcgttgcgtttcagtggatcatcgggaggatctctggaagatcgatcagcgtcgtttctgtgatcaaagctgtgatgtacgagtctggttactttgtgctgtcgatgcttatcttgttggtgatactcgtcctgttcggccttgcatacgagacttttttctaa

SEQ ID NO: 4301 - DNA, 624 bp, Klebsiella pneumoniae
tgtgcaggtgcgagaaataatatgtataagagccttgaagatctgatggcgggtatttacgagatggccgcgccagatggcatcatctgtaacgaggtttccaaattccttgcggccaaccaggtcaagccggaagatataagctctgggatctggtttttcctgtggctgaaatcagctcccaaggatgcgaagccaatccaaaaagaaatccccggatttggagtcgttctcaacatgccgacttatggcggaacgctcaacgaagcaatcacagggttgatcgagaacgagtgccgtcaaatacaactcgctgagggacatcctagccttgaggcttgggttgaatcggtattagctggtcgagatgacggagaggaaaacgaagctgcggccaatatcgtggacttgcttaatggatgtcacgacctactggatacagcaataatcaattacctttttaaggtgggaaaaatcaacgagcaagagattttgtcgcttatctattatggagagctgtgtgaccactctcttgtcggtacgcctttttcaacgttacatatcccgagtgaaaataacgtccacgaacgcaacatcatccccattaaaaaaggagccagttag

SEQ ID NO: 4302 - DNA, 927 bp, Klebsiella pneumoniae
caaactgccgcccgagacgcgccaacccgtttccggctacctgtggggtgcgctggccgtgttgacctgcccctgccatctgccgattctcgccgccgtgctggccgggacgaccgccggtgccttccttggcgagcattggggtgttgccgcgctcgcgctgaccggcttgttcgttctggccgtaacgcggctgctgcgcgccttccggggcggatcatgacgagttcgcagcccgccggatggacggcggccgagttggcgcaggcggcggcgcgcggacagcttgacctgcattaccagccgctggtcgatctgcgcgatcaccggatcgctggcgcggaagcgttgatgcgctggcggcatccgaggcttggcctgttgccgcccggccagttcctgccgctggccgagtcgttcggcctgatgccggaaataggcgcgtgggtgctgggcgaggcctgtcgccagatgcacaagtggcaaggaccggcatggcaaccgttccgtcttgccatcaatgtgtccgccagccaggttgggccaacgttcgacgacgaggtaaagcgggtgctggccgatatggccctgcccgccgagcttctggagatcgaactgaccgaatcggtcgcattcggcaatccagccctgttcgccagtttcgacgccttgcgcgccatcggcgtgcgcttcgccgccgacgacttcggcaccggctattcctgcctgcaacatctgaaatgctgccccatcaccacattgaaaatcgaccaatcctttgtcgccaggctcccggatgatgcccgtgaccaaactatcgtgcgggcggtgatccagctcgcgcacgggctgggcatggatgtcattttcagaagacgactgcaccagttgattgggcgtaatggctgttgtgcagccagctcctga

SEQ ID NO: 4303 - DNA, 873 bp, Klebsiella pneumoniae
ggagtggtagccgtggacgaatatcccatcatcgacctgtcccacctgctgccggcggcccagggcttggcccgtcttccggcggacgagcgcatccagcgccttcgcgccgaccgctggatcggctatccgcgcgcagtcgaggcgctgaaccggctggaagccctttatgcgtggccaaacaagcaacgcatgcccaacctgctgctggttggcccgaccaacaatggcaagtcgatgatcgtcgagaagttccgccgcacccacccggccagctccgacgccgaccaggagcacatcccggtgttggtcgtgcagatgccgtccgagccgtccgtgatccgcttctacgtcgcgctgctcgccgcgatgggcgcgccgctgcgcccacgcccacggttgccggaaatggagcaactggctctggcactgctgcgcaaggtcggcgtgcgcatgctggtgatcgacgagctgcacaacgtgctggccggcaacagcgtcaaccgccgggaattcctcaacctgctgcgcttcctcggcaacgaactgcgcatcccgttggttggggtaggcacgcgcgacgcctacctagccatccgctccgatgaccagttggaaaatcgcttcgagccgatgatgctgccggtatgggaggccaacgacgattgctgctcactgctggccagcttcgccgcttcgctcccgctgcgccggccttccccaattgccacgctggacatggctcgctacctgctcacacgcagcgagggcaccataggggaactggcgcacttgctgatggcggcggccatcgtcgccgtggagagcggcgaggaagcgatcaaccatcgcacactcagcatggcctgttga

SEQ ID NO: 4304 - DNA, 1206 bp, Klebsiella pneumoniae
ttagtcgttctgaaaactttacttttcacagtatcattttataatactgtaaatcataaaaacaacccagtaaagaaaaaagagcgacttatgttgagacgagaaaaccaaggagatttgttcgatgaccaggtggtgttgccatcactggagtcggttcttaccggcatatcttccagtcagcgttgtgacgatagaacaacgtacttctccgctccggatgtggacctgagtttgtacgatcacatcattgtttgcctgtctggaggcaaagactcgattgctgcgtacttgcggctggtggacatgggtgttgataagtcaaaggtggagttctggcaccatgatgttgatggtcaggaaggcagttcgttgatggattgggccttcatgcgtgattactgtcgtcagctcggggaagaactgggtatcccaatgtacttctcgtggcttgagggcggctttgagggcgaaatgctcaaagacaatgcctatagccacccccatcgtgtagagacgcctgaggggcttctggtgctgcctacagaccataagcgctctaagcctggtacgcgccttcgtttccctcagcaatcgccatcactccaaacaaggtggtgctcatcagccttgaagatcgatgttggccgcagagctcttaataaccaggagcgcttcaaggggaagaagatccttttcatcactggtgagcgccgggaggaaagtgcaaacagatccaagtacaaccagcttgaggctcatgcctgtgacagaagatatgggaagactgcacggttagttgatgcctggaggcccgttcttcattggactgaggaggaggtatgggaagtaatcgagcgtcaccgcatcctggccccagtcccttatcgccttggctggagccggtcgtcgtgtatgacctgcatctacaactcacagcgtatctggtccacgatccgtcactactggcctgaacgagctgggaaaattgctcagtatgaacaaacctttggtgtgacggtatcaagaaaaaaaatcgacgtaatagatttaggttctgctgttgcgccgatacagattagtgatgttgaggcattggagcaggtatccagagaagattacacgctcccgatttttgtgccggaggggcagaagtgggttctccctggtggcgcatttggccgagaggcctgtggttctgattga

SEQ ID NO: 4305 - DNA, 219 bp, Klebsiella pneumoniae
catcgagttctccacacaaagttactggccgagcatcccagccagggcggtctgctggccttcgctacaaggtgcaaatccggcaaaagtaccggcattaaccttgagctcatcaaagcgtccatcggtgtcccggtagtacaccttacgttttccaattccaccttcgaggtttgcggccaaccaggcgatcactgcatcagcatcgttcgtaactga

SEQ ID NO: 4306 - DNA, 435 bp, Klebsiella pneumoniae
tgggctccgtatgacatgaaagaccacgaggagttctctacgctatcagcggctgaacgtagagagttaataatcgcagagttaaagcgtaaaagccgcattcgcaccctgttgcgaggactcccgttagatgaagttcgggagatcattgacagaatgaagggcgttctcaatgaactggaggaagagtacaaaaagcgagaagaagaagaaaaagaaaagcgagctcaggctgagcgaataatgagcgacatggaatcctgcggtgtggacatcggcttgctcaacgaaatgttcacgagcagatcagaacctgataatgctaaatattcaaaagacggagtttcgtggagtgggcaaggacgtcgcccggatgctttcaaggggttgggagctgtcgagctggagcgctaccgtatcccacagaagaagtaa

SEQ ID NO: 4307 - DNA, 1167 bp, Klebsiella pneumoniae
gcgtcgcatctaccagctagtgttttcagcgacggtagcagcgggagcattgacaatgctggcggcatggaccaccagctagaaagtatcgacggaacaatcatgagcaagagaaccaaagacaaagacctggagaaactcgacgtaatcaaagactcaccgcaaatgagcctgtttgagatcattgaatctccggccaagaaagacgactactccaacaccatcgagatctacgatgcgctgccgaagtacatttgggaccaaaagcgtgagcatgaagatttatccaacgctgtagtgacacgacaatgcaccatcagaggccagcatttcacggtgaaggtgaagccagccatcatcgagaaggatgacggaagaaccgtgctgatctacgcgggacagcgagaggaaatccttgaggatgctctacgcaagctcgcagtgaacgggaaaggccatatcatcgagggcaaggctggagtcatgttcactctgtacgaactccagaaagagctctcgaagatgggtcacgggtacaacctgaacgaaatcaaggaagcaatccaggtttgtcgtggcgcaacactcgaatgtatcagtgatgacggtgaagccttcatcagctccagcttcttcccgatggtgggactgaccaccagaggtgagtttcgcaagaaaggcgggaacgccaggtgctatgtgcagttcaacccgctggtaaacgaatcgatcatgaatctgtcgtttcgtcagtacaactacaaaatcggaatgcaaatccgctcccctcttgcacggtacatctacaagcgaatgagccactactggactcaagcatcaccagattcgccgtacacgccatcgcttatcagcttcctgacccagagccctcgtgaattgagcccacggatgccggagaacgtcagagccatgaagctcgctctggaggccctcatcaaacaagaggtcataagcgactacgacgcgaaccagatcaaggatggccgcagagtcatcgacgtgcggtacgtcataaggcctcatgagaacttcgtgaagcaggtgatggcgtccaacaagcgtaagcagcagacagagctacgggccatcaagcacggcatgatcgaccacgacatcattgatgaaccccaacgtaaggggagatag

SEQ ID NO: 4308 - DNA, 186 bp, Klebsiella pneumoniae
gatctagttcacggagtctttcaaccccttaccagctttgaacccaggaatgttggccgccgcgatctggatgttctctccagtctggggattccgcccggttcgcgctgcgcgttccttaacgtggaaagtaccaaacccagtgagcgttattgtcccacccgctttaagctcctctgtcactga

SEQ ID NO: 4309 - DNA, 705 bp, Klebsiella pneumoniae
tgcacgcatcacctcaatacctttgatggtggcgtaagccgtcttcatggatttaaatcccagcgtggcgccgattatccgtttcagtttgccatgatcgcattcaatcacgttgttccggtacttaatctgtcggtgttcaacgtcagacgggcaccggccttcgcgtttgagcagagcaagcgcgcgaccataggcgggcgctttatccgtgttgatgaatcgcgggatctgccacttcttcacgttgttgaggattttacccagaaaccggtatgcagctttgctgttacgacgggaggagagataaaaatcgacagtgcggccccggctgtcgacggcccggtacagatacgcccagcggccattgaccttcacgtaggtttcatccatgtgccacgggcaaagatcggaagggttacgccagtaccagcgcagccgtttttccatttcaggcgcataacgctgaacccagcggtaaatcgtggagtgatcgacattcactccgcgttcagccagcatctcctgcagctcacggtaactgatgccgtatttgcagtaccagcgtacggcccacagaatgatgtcacgctgaaaatgccggcctttgaatgggttcatgtgcagctccatcagcaaaaggggatgataagtttatcaccaccgactatttgcaacagtgcccgcttccggtactcggaatga

SEQ ID NO: 4310 - DNA, 468 bp, Klebsiella pneumoniae
atagtggcccagcttaaacataaccgcttcgtcatgttggggtccttggtagcgacggtcgtagctgccgccaatggcttgagttttctcacccttatggctggtggaatgacccttctccagttcatggcttggaagcaacaagatgctgtccggagccggtttaaagctgcgaaggatgcgtttgaagcgttgaacgtcattgcgttcgacaagcactgggtaggttcaaccgcgacggtcgccaaagtgtcgaacatgatcactccgcccgaacgactggataagccctgggcggtgcaagttctggccgtgaccaaaggtgggacgtggttcgcggtggatctgcaagtgaccggcactgacaaggttcagatgcttagcctccaccagcttagtgaaaaggcggcaaagaccatgctggccttcgacctcgaagtgtatgagaaatttttcggaaaaacctga

SEQ ID NO: 4311 - DNA, 537 bp, Klebsiella pneumoniae
gtttatcaccaccgactatttgcaacagtgcccgcttccggtactcggaatgatcggccgggcctggcggcctgcttgaagtccttgcgcgaaggtgatgttttggtggtctggaagcttgatcgtctcgggcgatcgcttgctcatctggtcaatactgtgaaagacctgtctgatcgcaatatcggtttgcgggtactgaccggaaaaggcgcccagatcgacactacgaccgcatccggtcgcatggtgtttggtatatttgccactttagcagagttcgagcgagaccttattcgtgagcgaacagtagcaggtcttgccgccgcaagagcgcgcggccggaaaggagggcgaagattcgctcttacaaaagcgcaggttcgtcttgctcaagccgccatgacacagcgcgacacctctgtttccgacttatgcgcagagctgggaataaaacgcgttaccttatatcgatatgtgggaccgagtggggagctccgggactacgggaaacgcgttcttggcctggttccgtag

SEQ ID NO: 4312 - DNA, 348 bp, Klebsiella pneumoniae; identical to SEQ ID NO: 2147

SEQ ID NO: 4313 - DNA, 297 bp, Klebsiella pneumoniae
ccaagaaaacaaacaggaataacgatgaacaaaagtgaactgattatgaaagtggccgaagacgctgacattagcaaagcaaaggccgaagctgcggtaaatgcgctgatcaactcagtgacagaggagcttaaagcgggtgggacaataacgctcactgggtttggtactttccacgttaaggaacgcgcagcgcgaaccgggcggaatccccagactggagagaacatccagatcgcggcggccaacattcctgggttcaaagctggtaaggggttgaaagactccgtgaactag

SEQ ID NO: 4314 - DNA, 621 bp, Klebsiella pneumoniae
agggggccgcacatgaaaacgataaagcggttcatcgtatgggtgaattacggtcttgagggttggagcattttcggatcgagcgatgactgggatgaagcggtatccatccgttcggaagcgatagacgaatgcaatattgacgaggaagacatcatcttggcagaaaacaaaaacgagctggtggtaaaacctgcggccaagcaaatgacggagtggcaccgggaactggaagccgtccttatgaccttggatgactgccagatggaatgtgacggtatgacatgggcagtaagccacctactcaatgaagcgggtgtacctcatgactgcatgtatggctttgtgcgaaacgaacagaccaaggacatcgtgacaccgcatttctgggttgtcctggatgatgggtggctggtggatctgaggctacgcatgtggctgggcgatcacgacaacattcctcacggggtattccatcccgataacgagccaggacttttctacaagggagacccggttcaaaaccataaagggatgagactgggcaaagccgtcctggacatcatgaccgacggaaaactttcacatgtgaaagttcctgaacgacaagacggagagtaa

SEQ ID NO: 4315 - DNA, 369 bp, Klebsiella pneumoniae
ttgacgcagcagcgcgatggcatcagaaggggtaactttccatgcgttggagagctggcgaactgcgaagactgcgagctccatacggtcgtcatcattgatgaaattctggagctggtttcctcgctcgctcaggatgatcgcaacaccggccttgccgttgttgtaaaccgcaaagctcttattcttcgagtccccgtgataggaaccctcagccttgctacgcaagccaaagagaacgctgcaaaacgccgtcagttcgccacgagtgagctgcaccgtgatcttgcttttccagtctgggctggaccccgaagccctgatcggcgcaatctcgatgctgaccgtaggatactcacctctggttag

SEQ ID NO: 4316 - DNA, 402 bp, Klebsiella pneumoniae
tgccgtggtaaactggaggtaaagagtaagggggttgatatgaaacatgtggtcaatattcttctgctgggaatggtgcttctgggaatagccatgatggctgacacaccttggggacttggtgtggcgctggctcccttcggcgtttggggtgctcgtttcctatttctggttcacaaaagcctttgggctgctgttatcttttggggagggatcgcttacttccagtggcaagttgctttggttgtcggggctctgtttggactaacgtgctttatccgcgttgcgcggtcagcatataaagaggcaccacctacccggcgcagaaaaaaacaaactggtgggtttcaagattcctatgattttgaccagcgcttccatattggagctggagacgaataa

SEQ ID NO: 4317 - DNA, 1224 bp, Klebsiella pneumoniae
ttttatctaaatcggattggttctatgcattttacaaaattaaagaccgtggtaatcgctgctctcctgagcgcaactgtcagctcatttaccctgccagcttattctgccgatctcatcggtttttgggacacacagcgaaaaggcgggaacagctttaacaaaacgcctcctgatgaggcttatttcaaaacgctggccgcgacgggcgctacctgggttcgtctgacttttagcaaatggcgtggggaagatcgggatttcctgatcggcaatgctgatcactatcgaagcctgagagaaaaagatttacaaattctgcggaagacattggatgccgctcaggcagccggacttaaagtcgttcttacatcggtaagccttccaggtgcccgatggactcaacaaaatggtggtaaatttgatgatcggctatgggaaagccctgaatatgtcgagcaagccgtcaagttctggaccgatctggccggagaactgaaggatcacccagcgatagccgcctataatttaattaatgaaccagcacctgagaaaaccaccgggcttaaagaaaatgcatcgatggaagttttagaagagtggcagaaggaacatcagaacggcacaagggatttacgagcgttttaccaacagctcattgaaggcatttggaaagtcgatccggcaacacctataatggtcgacagtgggtattacgcgaatgctcgatcactagcagcatggcctgcaccgcttgctgacaccaaagttctttatgcatttcatatgtatgaaccctatgatgccacaagcgcgccaaatatgaagcgcaaggtgcctttacgctaccctggtgtaaagacgcgatactctggttcagaagttatttgggaccgcaaaacagttgctgctcatatcaccctcccttttgaatgggccaggaaaaacggcttaagcaccaatcgaatagtgatggccgaattcggttgtatgcgcctctggccagactgcagcgcctatttgaccgatgtaatggatgcagccgagaagtttcaggctcaccgtgcattttatgcatttcgggaagacgagtgggacggcatggattacgaactgcctgcaagtctgcgtcccggccagttttactggctgacagaacagggtaagcaaaacaaaattccgcgaaatggcgaactcatgaaactgctcaagaagcggatgtaa

SEQ ID NO: 4318 - DNA, 306 bp, Klebsiella pneumoniae
gggagggaaaaagaaagaggaaaactgatggcgcgaaaggctaaatattcagaagagtggcgacacagagctgcggctcttcaaaccaagattgaggaggctatgacactagccgcctcatctattggcgactatcgctggttacaccgtctccatagttgggttacggaggtggctcaaggtaaagccccagactggtggacagatctggattgtgaagtatccctcccccgagaagaaaagcggatcagcacgttcctctcgacacaaaagaagcgcatcactctccagatgtgtttgtcgtag

SEQ ID NO: 4319 - DNA, 276 bp, Klebsiella pneumoniae
ccagttggaaaatcgcttcgagccgatgatgctgccggtatgggaggccaacgacgattgctgctcactgctggccagcttcgccgcttcgctcccgctgcgccggccttccccaattgccacgctggacatggctcgctacctgctcacacgcagcgagggcaccataggggaactggcgcacttgctgatggcggcggccatcgtcgccgtggagagcggcgaggaagcgatcaaccatcgcacactcagcatggcctgttgagttgcatctaa

SEQ ID NO: 4320 - DNA, 555 bp, Klebsiella pneumoniae
aagttcctgaacgacaagacggagagtaatagcgtggaatttgattacgacaagtcagtatcaaacgcacatcttgaggccgcaggctggggtatggatgcctttaaccactccaacccatttgagagtcatgtcatctatgtgcgtgactaccgcaacgatcacatccgcctgttcaccatcaagcaggctgacttcgacacgataaagctgccgcttcaccttacctccgacatgctggcttcggtgatcgctgagttcgtatcgaaggcagcaaaagggaagttgaatacgaaggagtccgacacgctggctcctgccttggttggctatgccaaatcaacagaaacctaccggagctggcggagagtttctggagcaacagagcgattgcatatggtcatcaatatctatgcgggttctgaattgctgagacctttcatcgctcgggctcctgagaccgtcctgacgacccaagagctactggtcttctcatcacaggttaagagcatggatgtatccaatcatccagagtggtttaggggccggaggtag

SEQ ID NO: 4321 - DNA, 321 bp, Klebsiella pneumoniae
gtggtgctgaatgcccactttttacaaggagcgcgaccagtgatttttgatgtaagagcgacctttgaagtggcactccagacggacacccacctggtacttatcgatctggatcagggagcatcagttacgaacgatgctgatgcagtgatcgcctggttggccgcaaacctcgaaggtggaattggaaaacgtaaggtgtactaccgggacaccgatggacgctttgatgagctcaaggttaatgccggtacttttgccggatttgcaccttgtagcgaaggccagcagaccgccctggctgggatgctcggccagtaa

SEQ ID NO: 4322 - DNA, 549 bp, Klebsiella pneumoniae
atgaacaacctacccctactgctcgatgcaagagaagccattgactactaccaccagcatccaggcatgactgatgcagaaaaggcctatgtggtcgcgttcctaagcggagaggggcgttcaaacagtcagatcagagaggatctgggtattgagaaggtctatacggttacacacctgaaacgcgccggtacgctatcggaggaagagctaacactctggctcagaaatccacgcaagatcaccctggggcatgtgagggccgtggctaagttacctttcagcaagagagaaaagctcctgagggatctcctgcataccaggacaccggttcataaatttgaggcgatagcgaagggcaaagaagtggacagggatgcagacattaagcgcctggagaccctgatgagcgatgctacgggtaggcctatcaaagttcgctataaccccgcgaagcgctccggggaactgacgctgggattcttcacgctcgatgacctggatgacgtgtgcaaggctttggggtttgatccaagcgagcagatgtaa

SEQ ID NO: 4323 - DNA, 873 bp, Klebsiella pneumoniae
gagcagtttgatatgacagaacaaagtaccaaatcactacgtctcggggttgttgccgccattcttttggggctcgtaggaaccgggttcgggatctaccagttcgtgaaagagaaggatctggcgcaagagatcgccaacgtgaagtctacggtcaaccaggtgaaggatgccgaaggcgtcaccttcaaaagcaaggcagagtttgaagctgctgtggccgaaagcatcaacaagtttgtcgcgcagaaacaacaagccgacatcgatcagaagtatgcccagttcgaggcagcacctgagaaggtcgaagaaggcaaacacatctacggggaccttggtgctcggttcacgctggtggagttctccgatatggagtgcccattctgcaagcgattccacgacacacccaaacaaattgtggatgccagcaaaggcaatgtgaattggcagtggaagcacatgcctctcgatttccataacccggcagctcacaaggaagctctggccgctgaatgtattgctgagcagaagggcaaccgtggcttctgggtcttcgttaacgacattttccaccatacccaggggaatggtggcggtgttgctgacctggcctctgttgtcactggtgttggtgctgatctggatgcgttccgggagtgcctcggctcaggaaagtacgaagacaaggttgaagctgacatccagaaagccaagagctatggcgtcaacgggacaccagccacttttgtagtggacaaccataccggcaagagccagcttctcggcggcgctcaaccggcgcaagccatcatggccgtgatgcgaaaaatgatgattgagtcgcaacaagacgactccgcgaaccaataa

SEQ ID NO: 4324 - DNA, 297 bp, Klebsiella pneumoniae
ggcatagctgaccttgccaggcctgcttcgccctgtagtgacgcgatcaacgggcaggaaacattcccctttcgtgcatggcaggcgcacacgagttcagacagcacggtttccatgcgcgccaagtcggccatcttctcgcgcacgtccttgagcttgtgttcggccaggctgctggcctcctcgcagtgggtgccatcgtcgagccgcaacagctcggcaatctcgtccagactgaaccccagccgctgtgccgatttcacgaatttcacccgaaccacgtccgcctccccatag

SEQ ID NO: 4325 - DNA, 1746 bp, Klebsiella pneumoniae
aagacggctgaccgtgcgacacggcggcccacacgaataaggaacgatggtatgagcactctcaaaatcaccggcatgacttgcgactcgtgcgcagtgcatgtcaaggacgccctggagaaagtgcccggcgtgcaatcagcggatgtctcctacgccaagggcagcgccaagctcgccattgaggtcggcacgtcacccgacgcgctgacggccgctgtagctggactcggttatcgggccacgctggccgatgccccctcagtttcgacgccgggcggattgctcgacaagatgcgcgatctgctgggcagaaacgacaagacgggtagcagcggcgcattgcatatcgccgtcatcggcagcggcggggccgcgatggcagcggcgctgaaggccgtcgagcaaggcgcacgtgtcacgctgatcgagcgcggcaccatcggcggcacctgcgtcaatgtcggttgtgtgccgtccaagatcatgatccgcgccgcccatatcgcccatctgcgccgggaaagcccgttcgatggcggcatcgccgctaccacgccgaccatccagcgcacggcgctgctggcccagcagcaggcccgcgtcgatgaactgcgccacgccaagtacgaaggcatcttggagggcaatccggcgatcactgtgctgcacggctccgcccgctttaaggacaatcgcaacctgatcgtgcaactcaacgacggcggcgagcgcgtggtggcattcgaccgctgcctgatcgccaccggcgcgagcccggccgtgccgccgattcccggcctgaaagacactccgtactggacttccactgaagcgctggtcagcgagacgattcctaagcgcctggccgtgattggctcatcagtggtggcgctggagctggcgcaggcgttcgcccgactcggagcgaaggtgacgatcctggctcgcagcacgctgttcttccgcgaagacccagctataggcgaagccgtcacggccgcattccgcatggagggcatcgaggtgagggaacacacccaggccagccaggtcgcgtatatcaatggtgaaggggacggcgaattcgtgctcaccacggcgcacggcgaactgcgcgccgacaagctgctggtcgccaccggccgcgcgcccaacacacgcaagctggcactggatgcgacgggcgtcacgctcaccccgcaaggcgctatcgtcatcgaccccggcatgcgtacaagcgtggaacacatctacgccgcaggcgactgcaccgaccagccgcagttcgtctatgtggcggcagcggccggcactcgcgccgcgatcaacatgaccggcggtgacgcggccctgaacctgaccgcgatgccggccgtggtgttcaccgacccgcaagtggcgaccgtaggctacagcgaggcggaagcgcaccatgacggcatcaaaactgatagtcgcacgctaacgctggacaacgtgccgcgcgcgctcgccaacttcgacacgcgcggcttcatcaaactggtggttgaagaaggcagcggacgactgatcggcgtgcaggcagtggccccggaagcgggcgaactgatccagacggccgcactggcgattcgcaaccggatgacggtgcaggaactggccgaccagttgttcccctacctgacgatggtcgaagggttgaagctcgcggcgcagaccttcaacaaggatgtgaagcagctttcctgctgcgccgggtga

SEQ ID NO: 4326 - DNA, 525 bp, Klebsiella pneumoniae; identical to SEQ ID NO: 2057

SEQ ID NO: 4327 - DNA, 318 bp, Klebsiella pneumoniae
agaaggagtgacgttatggcaagaactcttgaccaaatgctggcaacagaaaagcctgaggttgttgccaaagcacagaaagcggccactgagatgttactgaacatccacttggcagagcttcgtgatcgcatgaaccttacccagggggaaattgctgcatctctgggtgtgagacagccgacagtctccgagatggaaaaacctggacgagatctcaagctgtcgtccattaagcggtacgttgaggcctccggtggcaagctacgcctcgatgttgaacttccggacggcacccactacggctttgccgtttaa

SEQ ID NO: 4328 - DNA, 315 bp, Klebsiella pneumoniae
ttaaagggtgaggatgtgggggacctgcacgttatgagatttgatatgtgggtacgttgcacgaaagcaggtcctgaacctctcgatatatgggaactctgcacgattgacgaagcagaacaaagattgacagatcaggacaaacctaaaaaagcagtcaaaatgactctaatagtccataaagtgatcacgcgcacacaaaaagaggccaaaagttatccacatttcctgtgcataaacggggttttggtatatgggaacgctgcacgatcatatgtgggtacgctgcacggtgcaaaaaacgaccaaaattga

SEQ ID NO: 4329 - DNA, 561 bp, Klebsiella pneumoniae
cgctggggtgagcgtacatatcgtgcgcgactacctggtgcgcggcttgttacggccggtggcctgcaccacgggcggctacggcgtgttcgacgatgcggccttgcaacggctgtgcttcgtgcgcgcggccttcgaggcgggtatcggcctggatgccctggcgcggctgtgccgtgcgctcgacgcagcggacggcgcacaagccgcagcgcagcttgccgtgctgcgccagttggtcgagcggcggcgcgcggcgttggcccatctggacgcgcaactggcctccatgccagccgagcgggcgcacgaggaggcattgccgtgaacgcccctgacaaactgccgcccgagacgcgccaacccgtttccggctacctgtggggtgcgctggccgtgttgacctgcccctgccatctgccgattctcgccgccgtgctggccgggacgaccgccggtgccttccttggcgagcattggggtgttgccgcgctcgcgctgaccggcttgttcgttctggccgtaacgcggctgctgcgcgccttccggggcggatcatga

SEQ ID NO: 4330 - DNA, 666 bp, Klebsiella pneumoniae
acaacggtcgatagggttccagcaccgtcaggttgccgatccaagcaccggagaagcccagggcgaccagtactagcggccccaggcagcaggtcgatgcaagaatggcggccagcccgccggcgaagagcgcaccgcgcccgttttgtggttcagacatacgttggcccttttgaatttggattggatagcgtaaccttacttccgtactcatgtacggagtcaagcgatatggaaaataatttggaaaacctgaccattggcgtttttgccaaggcggccggggtcaacgtggagacaatccgcttctatcagcgcaagggcctgttgcgggaaccggacaagccttacggcagcatccgccgctatggggaggcggacgtggttcgggtgaaattcgtgaaatcggcacagcggctggggttcagtctggacgagattgccgagctgttgcggctcgacgatggcacccactgcgaggaggccagcagcctggccgaacacaagctcaaggacgtgcgcgagaagatggccgacttggcgcgcatggaaaccgtgctgtctgaactcgtgtgcgcctgccatgcacgaaaggggaatgtttcctgcccgttgatcgcgtcactacagggcgaagcaggcctggcaaggtcagctatgccttag

SEQ ID NO: 4331 - DNA, 246 bp, Klebsiella pneumoniae
gtcgttcacgaaaccttgagcgagctggcaggagttgcccagatgttggttgagcgcttgcactttcttctggaagttctctatccacttcgctccgtccgggaaaacgttatcgagcgcaagctggaaggcatagcccttggcgttggctgctacagcccgaaggagttggacaatttgatccgcgttaatgaaggaaagcgaaccgccgaacagatctacaccaccgcaaccagctttccatga

SEQ ID NO: 4332 - DNA, 234 bp, Klebsiella pneumoniae; identical to SEQ ID NO: 2064

SEQ ID NO: 4333 - DNA, 411 bp, Klebsiella pneumoniae
atgatcaaatggacggcttcattcaataaaaaattgaaccgcattttgaaatttgccgtgcaagtatgttccgccgttgactggaacgaggcggaacactcccgctcattcaacctgagcgcaatttttgtcctctcattacatccgcttcttgagcagtttcatgagttcgccatttcgcggaattttgttttgcttaccctgttctgtcagccagtaaaactggccgggacgcagacttgcaggcagttcgtaatccatgccgtcccactcgtcttcccgaaatgcataaaatgcacggtgagcctgaaacttctcggctgcatccattacatcggtcaaataggcgctgcagtctggccagaggcgcatacaaccgaattcggccatcactattcgattggtgcttaa

SEQ ID NO: 4334 - DNA, 609 bp, Klebsiella pneumoniae
acagcaaggtggatgaaacaaggctctgttgggccaaggctctaccggctgggaaaaaaaagtaatttggatggagtgattatgaggttaggttttgtgaaaaatacgggggtttcagcgttcctggtagccatgctggtggtggcccctcaggtatgggcagaaacctttactgcgaaggttgtgggggtgtctgacggtgatacggtcaaggtcctgactgaacaaagctgtgactccgggaaagattgccggagcggcaaaatccagtaccgggtaaggctggcggaaatcgacaccccagagaagaaacaaccctacggctcaaaggcgaaacaggcgttgtccgatctggtgtttggtcgaatgattaaagtcgagcaaatcgacaaagaccgttatggccgtctggtcgccaacctttatgtcgatggcaaatgggtcaatgccgaaatggtccgttctgggagtgcgtgggtgtaccggcagtacgccaaaacaccggagctgttcaagctggaggccgaagccaaagccgataagcgaggtctctgggcattaccggaatcggagagaactcccccttgggagtggcgaagaaagcactaa

SEQ ID NO: 4335 - DNA, 336 bp, Klebsiella pneumoniae
gaaatttttcggaaaaacctgatgttgcatgaggacaatgtgatggaaaaagtcaaaagcgtagatgccgtggagttcacggcagcagataagaaggcgatgacccatgcggcatacgcccagtgtttcttcattctggcccaagtgatggcattcccttccctgggggtggctggcgctatggttgctgctctgtgcggcatgatgccgtggttgaccaagttcgccaaagaggctccatcgaaagcctttggcatggtgatggcttcactctgccttgctcctgtgtacgggaaactctgtgagctggtggtccacgcgattcagggagcttga

SEQ ID NO: 4336 - DNA, 1026 bp, Klebsiella pneumoniae; identical to SEQ ID NO: 2067

SEQ ID NO: 4337 - DNA, 471 bp, Klebsiella pneumoniae
cgctgttgccggccagcacgttgtgcagctcgtcgatcaccagcatgcgcacgccgaccttgcgcagcagtgccagagccagttgctccatttccggcaaccgtgggcgtgggcgcagcggcgcgcccatcgcggcgagcagcgcgacgtagaagcggatcacggacggctcggacggcatctgcacgaccaacaccgggatgtgctcctggtcggcgtcggagctggccgggtgggtgcggcggaacttctcgacgatcatcgacttgccattgttggtcgggccaaccagcagcaggttgggcatgcgttgcttgtttggccacgcataaagggcttccagccggttcagcgcctcgactgcgcgcggatagccgatccagcggtcggcgcgaaggcgctggatgcgctcgtccgccggaagacgggccaagccctgggccgccggcagcaggtgggacaggtcgatga

SEQ ID NO: 4338 - DNA, 744 bp, Klebsiella pneumoniae
gagaggtcacggacgaggatgtcaggagagcggagcagtggctcaacctacgacctcggaaatgtctcggattcaggcagcctgtcaaggtattcgaagagtactgtcaggcggcataggcgagtgtcgcacttcgaagttgaattcgcggaggccttgatcaaaaaggcggacctggatgaatatgcaccagtgacatccggcatagtcggcaaaaaagtaagtgcggctgacctttgcagcattaccatgcgtacaagtgacaataccgccgtcaacaaagttcttgaaatcctgggaggaccgcaagctgtaaccgcttatttgcgcaagacaggtgataacattactcgacttgacagaaatgaaccggacctcaacgaaggaacgcctggagacgtgcgcgacacgacaacgcctcgcgctattctcgaaacacttaataaactggtactgggccccactcttggctctgacgagcgaaaacaactcacaacctggcttgaaagtaatgaggttggtgaccctttgctgcgcgctggagttccttctgattggcgcgtcgccgatcgaactggcgctggaggtaacgggacgcgtggggtgattgccgtcatgtggccgccaaaacacgcgccaatcattgctgcgatttacattacacagacgaaagccactatggaggaaaggaacgctgccatcgcctctattggcaaagcgattgctgccgaagttctggaataa

SEQ ID NO: 4339 - DNA, 399 bp, Klebsiella pneumoniae
cgcgatcaacgggcaggaaacattcccctttcgtgcatggcaggcgcacacgagttcagacagcacggtttccatgcgcgccaagtcggccatcttctcgcgcacgtccttgagcttgtgttcggccaggctgctggcctcctcgcagtgggtgccatcgtcgagccgcaacagctcggcaatctcgtccagactgaaccccagccgctgtgccgatttcacgaatttcacccgaaccacgtccgcctccccatagcggcggatgctgccgtaaggcttgtccggttcccgcaacaggcccttgcgctgatagaagcggattgtctccacgttgaccccggccgccttggcaaaaacgccaatggtcaggttttccaaattattttccatatcgcttga

SEQ ID NO: 4340 - DNA, 591 bp, Klebsiella pneumoniae
agaaggcagcggacgactgatcggcgtgcaggcagtggccccggaagcgggcgaactgatccagacggccgcactggcgattcgcaaccggatgacggtgcaggaactggccgaccagttgttcccctacctgacgatggtcgaagggttgaagctcgcggcgcagaccttcaacaaggatgtgaagcagctttcctgctgcgccgggtgaggacaaggaggtgtgcgatgagcgcctacacggtatcgcaactggcccataacgctggggtgagcgtacatatcgtgcgcgactacctggtgcgcggcttgttacggccggtggcctgcaccacgggcggctacggcgtgttcgacgatgcggccttgcaacggctgtgcttcgtgcgcgcggccttcgaggcgggtatcggcctggatgccctggcgcggctgtgccgtgcgctcgacgcagcggacggcgcacaagccgcagcgcagcttgccgtgctgcgccagttggtcgagcggcggcgcgcggcgttggcccatctggacgcgcaactggcctccatgccagccgagcgggcgcacgaggaggcattgccgtga

SEQ ID NO: 4341 - DNA, 546 bp, Klebsiella pneumoniae
ggaggcaagctgatgaagaacaaagccaaggcgctagttctgtctgcggctctcctttcatcaacagcgaatgctattgacctgagcggaaccatcttcgacaaagcagcgaaagcatataacctcgaccctcttctagtgtattcggtcgcattggccgaatctgcatcagggagaggtaatggctctataagtccttggccttggacgcttcgcgttcctgggcttcctttctatgctaagtcggaagatcaggcaaaggctaagctcgctgagtttcagcagcagtacggtcgtgccattgatgtcgggtttatgcaagtgagcatccggtggaatggtcatagagtttcttctccagcagatcttctcgacccagagaccaacgtcatggttggggcagaggtgctatcagaagccattcagtcatctccaaatgacttggagcttggcgttggccgctatcacgcctgggaagacgaaatccgagccagaaactatggtagccgagtcttggctatctatcgcaaccttcgtgatttgtga

SEQ ID NO: 4342 - DNA, 570 bp, Klebsiella pneumoniae
gaattggataggaattgggagggtattgaggtgagtctaccaacagagcgatggctagatctgctagatccgaagctcgaagaagaacgatccgagataacagaggatctgctagaggcagagggacgagagtttgttgcagaggtacggagcaaactggatcacgccttagcggttcttgctgtcgaggcgcagcaggaagcggacatgtactggaacgcgcacaaatcagcgcgtgaagaagcgtcagaggacgaacaagggcgtgtcggtacacgggttcgcattctaggcgtatcactcgttgcagagtggtatcgcaacagatttgtcgaacaagttcccggacaaaagaaaagggttctatcgacacatatcaagaagggtcgcggtcatgcctacagcatgtcgcacttcaagaaagagcctgtctgggcacaagagttgatccagcaagttgaaaccaggtatgccgtgttaagacaacgcgccactgccttagcaaaaattcgccgggcgctaaacgagtacgagcgccagctaaacaagacacatagcgacgaggtgtga

SEQ ID NO: 4343 - DNA, 882 bp, Klebsiella pneumoniae
cggattaacagcatgaatgatgaagaactcgaacttgccagagccgaagccatgaaagccgataggtgcttttcaaaaggacggctcagggacgaatttcggatgaagcctaagccaggagtagagccagtttcgttctacaaaaacgggtatggcggccaatttggagtgtaccggatagcagattgccaaccaatgcggagaaggggctgttcaccggcatcacaaaagcaaatacgggcgcaatccatcctttcggtcaaggcaagaatgcgtagcaatctagcaaaggcctctgtcttggcacaaaggtgggtcgctctggaacctctggtactcgataccgagacgaccggacttggtgaaagagaccaggtgatcgagctggctgttacagacatcagaggcgctgttctcctctgcaccagattgcggccaaccgtggaaattgaccctcaggcaatgggtgttcatggtatcaacgaggcagagctgtcgaatgagcctacgtggaatcaagttgcgccagctctcgcccggcttttgtcgggccgtcatctggtgatatttaactccagtttcgacagcaggatgttgaggcaaacagccagtgcatttggagaccaactctcttggtggcaagagcagaactgtctatgcgcgatgaagttggcggctgatgcctttggctcaaccaaccggcacggcacaatctcacttgctgatgccacctgcgaggctggtgtgagctggaaaggtcgagcccattcagcagcgaccgacgctattgccaccgccgacctggtgacagagatagccaaagtccaacgtgacctcgtggtccagctccaggagcttcaaagcaaaggtaatttggaatga

SEQ ID NO: 4344 - DNA, 1113 bp, Klebsiella pneumoniae
aacgctctaagcgccctaaatgggcgcttacacctgcctaatttcacgcctcccacctctaccatatcgagcatgggaaaatacgtgcgtgagactatgaaaaaatcacctttgaatttactgctccttgcagcgctcacgctgggggcatcacaccaggcttgggctcaagatggcacacggcctggtttttatgagcgaaaggaagagggttggttctggtacaaggaagagcccaaagaaccagagaaaaaacccgaaaagcccaaaccaaagcctgtggcagaagcgaagcctacacagccgaagcctgctgctccgctaccgagcggcccagaaatgttctcagcggaatggttccgggaaaacttacccaagtacaaagaccttgcttggaacaatcctaccgtcgaaaacgtcaggacatttctctatttgcagcgatttgcgatagatcgctctgaacagttttcagatgctacagagttggcggtcgtaggtgatcctttcttggatgaaattactcgacgtcctgctgccacgtttgcctcacaacaggttgatcgtgacgctggtaacgccaaaaacatgctactcaaaagcgtagccgaccgcgtagggatattcttcttctacaagtccgacgatgactacagtgacttgcaagcaccgctcatcaagatgttggaacaaggagaaggattctcgatcattcctgtatctatggacggcaaaccactccccagtgggcttttcccccattacaaaaccgatgaaggccatgccaaacaacttggtatcgtaactttccctgctgtttacctcgcatctccagatggtcagttcgctcctataggacaagggccaatgtctcttcctgagctgaatcacaggattttggtcgcagcaaaacgcaatggttgggtcacagacgaagagtttaaccgtacacgtccggtactcaacctggaaaacaacatagccgaacgcttggcctcaccagagctgggctctgacctcaaacagctatctcaagcgagcggtgataaagacaactttgtgccaccggaacaactcatgaagtacatccgggacaaattacaggagaactaa

SEQ ID NO: 4345 - DNA, 624 bp, Klebsiella pneumoniae
cagccgggaagagttaacacacccggtattgaaaaaactgcaacagtctctacagggacgtgggaggtggagatgaacattggcaactctggtacattgggtcgctgggttacagctcgacacatggcccttgctgggtacatcacaaaaatcatcatgatcgagactggtctgacctacaaacaggtcagacggctttaccaggatctggagagggacggatatactctggaacgaaaatccagaactttccggggtggtgcgacactgattcatagtcacacatccaagatacaggcctctcttctaatgcagctctacttcaacattggtggagaagccgtgttgcggtctgtgaacatcaaagccttgaacaaggcatttagaatgtatcacgcaatccgcaaagaagtgcccggaatgaaaggtgctcggtgggctccgtttgatattactgatgcctggtgtcttgcttcggagctgagaagtggggacgcaatgctggaggtgtgcgacaactgcaagtgtacgtacttcacctctgttaatcaaagaacctgcgttgaatgtccgttctgcaaagaacaaggaaggcatggtggtggggagaaagagtgtgcttga

SEQ ID NO: 4346 - DNA, 234 bp, Klebsiella pneumoniae
cccatctttggaatttgtcaaatttccctctatctatctggaatcttgatgctcttattctttcacagcctctttacatatgaatctatatttaaagattccagatatattggatatggcatcaaagattccaaatgcctctttaccaccgtctctcgatgctggagggcaagcggttctcgatgcgagggtaaggtctgtttatctgagcctatccgtgcagcgttcccatag

SEQ ID NO: 4347 - DNA, 3624 bp, Klebsiella pneumoniae
ggggccattggaatgggagctttttcaatccactctatcggtgactctgcttttctggagcaaatcctgattgcagtatcaatgatcaccggcaccggagacttcgagaagatggtcagtattggcctgcttcttggggtcttgatgatctgtattcagtccgtctttcagggcgcaaagcaaatcaacctccagcaagtgctggtaggttggattctatatgcctgcttcttcggtccaaccacaacggtgactatcgaggatgcgtacacagggcaggttcgagtcgtcgccaatgtccctattggggtgggctttgctggaggtgtcatatccaacgtgggatacaccatcaccaatttgtttgaaaccggatatggagtaatcgtacccaatgtcacggaaagccacttttccgaaacactgaaactgttgaatgacgtcagacggcgagcctatgacaccggggttttcactgcgcttaattcagcaaatgggggcggctatgttgatgtgaggcgttcttggaacaactacattcgggaatgcacgttgacgaaagttgatctcaacctaatgtcccttgatgagttgatgaaccgttcaaccgactcagctttgcggttcaactctcagctctacggaacccggttgtatttgtccacatcaaaccctgatggcgctgactacacatgtactgacggatgggtggctattagcactgcaaccgccaacctaagcagcccggttgttgttgatgctcttaacagcctactgggtattgacacatcaactggcgataacgctataacgaagctaactgactccctgcaagcaatgggggccacaactacgtcatcaatcgactacctgaaagccgccgttctggagcccctttattatgaagccgcagcaggacgctatcaggacctccaggactatggctctgcattgatgataaaccaagccattcagcaacgtaatactcagtgggccgcagagcagtcgatgttcatgaccgttgtccgaccaatgctgacgttctttgagggcttcatttacgctatcaccccgatcattgcttttattatcgtgatgggcagctttggcctccagttagccggtaaatatgtgcaaaccatcctctggattcagctatggatgccagtcctctcaattatcaacctgtttgttcataccgccgcgtcaaatgagatgtctagtctcagtgctggtggtctcaactccatgtacgcactttcctcaactggagatgtgctgcaacactggattgcaaccggcggcatgttggctgcggccactccggtgatttccctgtttatcgtcacaggtagcacctacgccttcaccagcttggcatcgagaataagtggttctgaccacgttgacgaaaaaatgcaaacgccagatctactcaagcaaggtccggttatgcaaagtcaaccagcgtacaaccacaaccaattcagtggtgcgattgcaaacggcgcagaaagcatgatcagcaccttctcgcttggctccaccttggcatcgggcgtgagctccgcacaggcattacaaagtcagaaatcggaggctttccaaagcaccctcggtcgaggtttttctgatggagtaagtcaggatcaagcctattcaagactctccaatattggccgtaacgtttcttcgcaaaacactgctcagagtcaactgatcaatcagcaagccaagaactttatggacaagttccaggtggatgattctcactcagacgctgtaaaaggtgcttttgccatgcaagcaaccggcacacttgatgttgaccaagccgcctccatgcttatgcctatggtcggcaaggccagagctgccatgaaggctgcggctggtgttacgtcaaagagcacagctctggtgccgagtggcgaaggaaaatctggaaatgatgatgatgtccttgacataaaagcacgagctattgggtcaagcgagtcatccaccaacgactcgtctagctggtcagctagtgatgtgtctcagttcatgaagggagtgagctattcgcaaaccgacagccaagcgctgacaaatcaattggcgcaaggtttcagccgttcaggtagcgagtcgtttaagcagacctggggggataacttatcccagaacctatccaagtcagcctctgagctggtgtcagcatcagacaccttcacgacaatgagccagctccagaaccagatgggctccatgactaataccgactttaaaactctcggtggtgcagtcgctcaaacacctgcggccatgaatcaattgaatgactatttccgaaatgccgcgccgcagtcagttaaagacgaggcggcttcactacagcaaagataccaagcctacgggatgtcgcctcaggtagctcaggcagcagcccgaatgacggcaatgaccaactccaaaaattacgaacccggtaaggagcttggcgggtatcaagccgccctacaggcgatcaataccgcgtccggacgcaatggtgcctttagtggtgatgcctacggaaataacggtattaaaggcccgaatgttcagggactacctggacaggttcaaggtgctgttggcagcggccccaatatcccaacaggattccgggagaatgtggctgggatagctggaactaatccggcatcagaagctggtcagttaccaacaaatagtcctcttgttcaaaatgaacatgcagccggtacatcagcactaaacaaccaagcgcagcaaacagaaagaaatgtatctgctccagaactgaaaaaagcgcaggacaaccttatgaactcacttccagaaatgtcctggagcgcttcggcgtggggagcgtgggacaactccagtgattggatgggccgcagagctgaacaagcaggtggagctctcattgctggtggtcaagctggcgctgatgcgttctcaagagcgatggatcaaatgagaacgatgacacctgaacaacgcgaccaattcatcgcggccactcaacgcggcgaccaggccgtgcaagaggagtttggctgggccggtgatgcgatggtcggtatggctaaacttggccgcaacgtcatgggagctgctgcaagcggctatgatgcagcgaaggagtggttaactggtaaatctgatctatcggaagccgctaaagggatgagcattgaggaacgcggcgcgttctatgcagcagcgctatcctctgccgcagaagctggtggtggagccgcgcagcagtttatgaaccagtacggtgatgagttcaaagaaacgatgcagtctatcgctcaaagccgttatgggctgactgaatcccaagccgctgtttatgccgaatcgtttgacacaaacgaaggtcgcatgaaccaggctgttcagaatctgaaaatggagtatgcagaacgtaacccggatggctcaccgatgatgcaaggaggtcagcctgttctttctcagcaaaacgaagagtttacggacaagctggtaaacgtattgcagaactcgacggaagctggagaccgttcaggtagctatttgactgccgtcagggggtacaacatagcaaatcaaaggttctaa

SEQ ID NO: 4348 - DNA, 192 bp, Klebsiella pneumoniae
ggattttgtggaaaaaagaggggttccgtgtggataacagtggataagatccaagggtatgtggggacgttgcacggcaacctatgggaacgctgcacggcaacctatgggtttgttgcacggaataaatatgaaaacaccagtaatatcaatgtgttgagtggtgatttagaacgcctaacctgtctttaa

SEQ ID NO: 4349 - DNA, 840 bp, Klebsiella pneumoniae
gcatccggtggaatggtcatagagtttcttctccagcagatcttctcgacccagagaccaacgtcatggttggggcagaggtgctatcagaagccattcagtcatctccaaatgacttggagcttggcgttggccgctatcacgcctgggaagacgaaatccgagccagaaactatggtagccgagtcttggctatctatcgcaaccttcgtgatttgtgaggggggcggaatgttggaactggatattattggtgcgtgggatgcaagagccgtcaacctcgatcaagaagaagctgatagaaacgtctacgagttcgatctgacattgtggaacctgctatccactctggcaaaagaacgtccagatgatgcggcctcacaattttctttgggcatggacaccgttcaaaagctgtcactggcaacaccttcccaattggaagctctggcctctggcgtgttgatctctttcaaactcgaaacagcagagcagaacatcatcacgcgactctctggcgactacgaccctgtagtttttatcaaccatagtgttgatgaatttgatgctgcctactggttgctatttaaccgcgtcgcatcgagagacccggagatggcaaaggaagttttcggggtttcgagagagcttgcggagctggtggctaaggcaacagacagccagttgcgccacatgtctggaacaacggttacgcattttacgcttcgttttgctccgagcatcattgaagaaattctcgatgacagccgggaagagttaacacacccggtattgaaaaaactgcaacagtctctacagggacgtgggaggtggagatga

SEQ ID NO: 4350 - DNA, 1467 bp, Klebsiella pneumoniae
agtacatccgggacaaattacaggagaactaagatggtcacgcacaagatattaaaaaggagcctgcttgccctgagtgtggcggccagtctcgtcatggcaccgacaggggcgatagccgctaacggcctccaatcacaaatggacaaactcttcaatgaaatgagcaacacaacaccacctggggtttatgagagccaacgacgtggcgttttagctggtggccggttcactgcaaagacacgaatcttcgacgagaacctggtgagctttgcccctccatcatggaaagctggttgcggtggtgtagatctgttcggcggttcgctttccttcattaacgcggatcaaattgtccaactccttcgggctgtagcagccaacgccaagggctatgccttccagcttgcgctcgataacgttttcccggacggagcgaagtggatagagaacttccagaagaaagtgcaagcgctcaaccaacatctgggcaactcctgccagctcgctcaaggtttcgtgaacgacctaaccagtggcatggaccttaaacacaaaactgatgcttctataaccgcgacaacttccggcctgtatgaagacttcttcgggtccaagcaggaaaccagcggcaagagtcccctggaagaactgaaagccaataagcctgacgaatacaacaagatgattggcaacatcgtctggaagcaactcaagagcaacaacgccaacacctggttccagtacggggataacacccttcttgaagcgatcatgtctttaaccggcacagtcatcattggtgatctggtaaacgacccgaactcaaccggcactggtgcgaaaacaacccctctgacgaccctaccaggtaacaagatcaccttgtcagacctgatttcaggcggttctgttgagatctattcctgtgattctgatacgaccaactgcctgagtgctggctccagcaataaaactgtcgtgctcaaaggtatcaagaaccagatcaccgacatgctattgggaaccagttctacgcctggcgtcatctacaaatacgcaacgaactctggaaccttaaccgacccagaaaaggcctttgtttctaacctccctggagggattggcaccatcgttcgtaatttgtctgtcctttcacaggacggcgctaacctgttcgcaacagagtcatcaggagcgatagccctgaccatgatgtatagcttctcggaagagttcttccgtgcagctcgcattgcgatggctaatagcaaatcgccctacaagaaagaggcactggagcttctcgcgcaatcgcaacagcaaatccgcgctgaatacacaattctgtcctctcaatacggcgacctggcaagccagattgagaaatacaacaacctactggacaacatccgcaagcaaaaatacatgctggcaactttgtccaatcctcctagcacgaactaa

SEQ ID NO: 4351 - DNA, 534 bp, Klebsiella pneumoniae
cgacaccaaggccagcgtacagaagctgaccaaggccaccgcagacgccggctatccgtccagcgtcaagcagtgagccagcaagccaacgacaacagcgagagccgcttcatgggactgatgacacgcattgccgataaaaccggcgcgctcggcagcgtcgtttccgcgatgggctgcgccgcctgctttccagccctcgccagcttcggcgcggccatcgggctgggcttcttgagccagtacgagggactgttcatcagccgcctgctgccgctgtttgccgcgctggccttcctggcgaacgcgctgggttggttcagtcatcggcaatggctgcgcagtctgctcggcatgatcggcccggccatcgtgtttgcggccacggtctggctgctcggcaactggtggacggcgaacctgatgtacgtcggcctggccttgatgattggggtgtcgatctgggacttcgtgtcgccggcgcatcgccgttgcggaccggacggctgcgaactccccgccaagcgcttgtga

SEQ ID NO: 4352 - DNA, 1005 bp, Klebsiella pneumoniae
agagttctggggactgataatcgaaacatgcaaaaggaaaaactaatggcagaaaacaaagagatcccctgggagaaagaactcattgagaagtacatgttcaccctgcataaagagcaggtgaaagaccggcgctggcggaccatgttgcgtgtgcttcgcgcatctggtttcgtgcttctcatgatcggcttcatcattttggcatctaatccgggtgggatgccgtggcaaagcgccaaggcaggagcccctcacaccgcgtatatcaacatccgtggtgaaattgctgctggcactctggccgatgctgatcaccttatcccgtccatccaagctgcattcgacaacccgaactcacaagctatcgtgcttcgcataaacagccctggcggtagcccggttcaagcaggacggatttatgacgaagtgaaggcgcagcgagcccttcatccggagaaaaaggtctacgccatcattgatgacatcggtgcctctggcggttactacatcgcctctgctgcggatgaaatctatgctgaccgcgccagccttgtcggttctatcggcgtcatcagctcggggtttggattcaccggcttgatggacaagctcggcatcgagcgccgggctatcacttccggagagcacaaagcgcttctcgacccattctcccctcttacctctgacatgaagaaattctgggagggcgttctatcgaaaacccaccagcagttcatcgaacgagtgaaggctgggcggggtgatcgactgaaagacgacccagaggtgttttctggattgctctggaacggggagcaggccaaagacattgggctgattgatggcctgggtagtttgaactccgtggcgcgagacgtcatccaccagagcaacttggtggactacacaccaaccgaagacatcatccggcgactgacccaacgagcgaagctcgaagccagttccttcgtgcaagaactcagcgctgtgaaagtttactga

SEQ ID NO: 4353 - DNA, 369 bp, Klebsiella pneumoniae
ggtgaatctatggagttacaagaagcaaaagaggctctcgatagccttcatccacacaaggcctcagcgcctttgaggcttgtcatccaccagccaggtgggattggtggaacccctacagtgggggtgaaagctattcacgcaggctttgactgggacagcaacaccatcctgatctatccggaagagcagctcacccggttgacgccggatgaggtcgccgccatcacgaagtcagtatcgaaaggacagtcctggcattcatatcagcagttcaagaagtatcgggagcagttggccgaagccacggaagaaattaataggctcagggctgagctgggcaggtatcagaataacgggagggggtaa

SEQ ID NO: 4354 - DNA, 348 bp, Klebsiella pneumoniae
tatgagatcatcatattcatccggagcgcatcccagagggacatcatgagccatcaactcaccttcgccgatagtgaattcagcactaagcgccgtcagacccgaaaagagattttcctctcccgcatggagcagattctgccatggcaaaacatggtggaagtcatcgagccgttttatcccaaggcgggcaatggccgacggccctatccgctggagaccatgctgcgtattcactgcatgcagcattggtacaacctgagcgacggtgccatggaagatgccctgtacgaaatcgcctccatgcgcctgtttgcccgattatccctggatagcgccctgccggat

SEQ ID NO: 4355 - DNA, 318 bp, Klebsiella pneumoniae
acaagacacatagcgacgaggtgtgacaacatgacagcatctgtagcggccactgaattggcgaaactggggaaatgtgaagcgatgatcaagaaagtcgccagccatcctcgccctgccctgtcaaagcgcccacaatcgccacaggggacagatagcacccttcggggtgagttcgctcatttccgatatgaagcggcagccctgcgttttatgagcggcactgcgggggctaagcgtcgcatctaccagctagtgttttcagcgacggtagcagcgggagcattgacaatgctggcggcatggaccaccagctag

SEQ ID NO: 4356 - DNA, 465 bp, Klebsiella pneumoniae
gttggcagcatcaccaagaatgagaagttaataactttgatagtagccgcggccgcatcatgctcatcagtctacgccgtgacattaccgaccagcgaggtggacgcatacatacttgcgatgaacaccatgtcaccgatcactgcaaagtacaccatccagtacaagcaagcggttgagcagaaatgcaatacagccctgagcgttgagcagctcaactcaaaggcattcaccaatgttgtccaggcaatggtgagtagtgagaccgtcgatagaatggggcttgatgctgctggtggatcactccaggataccctgtctgtgatcggcaagaacgtcacatgcagtgacctgaacgcgccatttaaagcactcttggatgataaagacttcaccagaaagcatcagcacctatcaaaggttttgcatacgtgggacgaggtggtttcgcagagcaagccttga

SEQ ID NO: 4357 - DNA, 1734 bp, Klebsiella pneumoniae
tctgcaccaatctcgactatgctcaatactcgtgtgcaccaaagcgaggtgagcatggcgacggacaccccacggattccagaacaaggcgtggccactctgcctgatgaggcttgggagcgtgcgcgccgtcgtgcggagatcatcagtccgttggcgcagtcggagacggtcgggcacgaagcggccgatatggcggctcaggcgctgggcttgtctcggcgccaggtatacgttctgatccggcgtgcccggcaaggcagcggcctcgtgacggatctggtgcccggccagtccggtggaggtaaaggtaaggggcgcttgccggaaccggtcgagcgcgtcatccacgagctactgcaaaagcggttcctgaccaagcagaagcgcagcctagcggcctttcaccgcgaagtcactcaggtgtgcaaggctcaaaaactgcgagtgccggcgcgcaataccgtggccttacggatcgctagccttgacccgcgcaaggtcatccgccggcgggaaggccaggatgccgctcgtgacctacaaggtgtgggcggcgagcctcctgccgtgaccgcgccgctggagcaggtgcagatagaccatacggtcatcgacctgatcgtggtcgatgaccgcgaccggcaacctattggccgcccgtacctgaccctcgccatcgacgtgttcacccgctgcgtgctcggcatggtcgtcacgctggaagcgccgtctgccgtttcggttggcctgtgcctcgtgcatgtcgcctgcgacaagcgcccttggctggaaggactgaacgtggaaatggattggcagatgagcggcaagcccttgctgctctacctagacaacgcggccgagttcaagagcgaggccctgcgccggggttgcgagcagcatggcatccggctggactatcgcccgctgggacagccgcactatggcggcatcgtggaacggatcatcggcacggcgatgcagatgattcacgacgaactgccgggaacgaccttctccaaccctgaccagcgcggcgactacgattccgaaaacaaggccgccctgacgctgcgcgagctagagcgctggctcacattggcggtcggcacctaccacggttcggtgcacaacggcctgctccaaccgccggccgcgcgctgggccgaggccgtggcgcgtgtcggcgtaccggccgtcgtcacacgcgctacttcgttcctggtcgattttctgccgatcctccggcgcacgctgacccgcaccggctttgtcatcgaccacatccactactacgccgatgcgctcaagccgtggattgcgcggcgtgaacgctggccgtcctttctgatccggcgcgatccgcgcgacatcagccgtatctgggtcctggaaccggagggacagcattacctggaaattccctaccgtaccttgtcgcatccggctgtcaccctctgggaacaacggcaggcgctggcgaaactgcggcagcaagggcgcgaacaggtggatgagtcggcgctgttccgcatgatcggccagatgcgtgagattgtgaccagcgcgcagaaggccacacgcaaggcgcggcgtgacgcggatcgccgccagcacctcaagacatcagctcggccggacaagcccgttccgccggatacggatattgccgacccgcaggcagacaacttgccacccgccaaaccgttcgaccagattgaggagtggtag

SEQ ID NO: 4358 - DNA, 1068 bp, Klebsiella pneumoniae
acattacaaattaaaaggaacgttctcatggcaagaaaattggttgagtttgacgatgtagcggctgcggcccagaagctcaaggacgccggtaaacgcccaacggtcatcgctatcagagacatcattggcaaggggagctttaccaccatttcaacgtatctcaaacagtggtcagaggaacactccctcgatgaggagccggtagaggtagtccttccagaatcggttatgagtgatgctgagctcttcctacagaagatctatacggtagccaaagcaagcgccgatgagcagcttgagcgcgagcgtgaactgctacgacagaaagagcttgagtaccaggaagatatgcagcaagccgtggacatggcaaatgatgccaccgaacgggctgaactactggaagaacaacttgaagctctcaccaacaaaaaaacagagctcgatgcggcccttggtaaggcagaaaactcgctatccctcaagtctgcggagctagaacgctcactggctgacattgataagttggaaaagcggatcgttgagttggaaggcaagctggaggcgaaagccgcagatctgacccgagcacaggatcacctggagcaagctgaaagcgaaaatcgctctttgagccaaaaattggcaactacagagggtgagttggaagtgcaaaaaggcaagagtatagagcagacagaaaagctccgagccgctcaggaacaaaatacatcgttgaaagagcagctcgaaaatgtacaggccaaactggcccaatcacaggactcccttgccacagccaaagctcatggcgaatccgctgaacgagagtgccagcgcctatctggagaggtagaaaagctggacgccaaattatccagcgccgaagcagaagctcgcgctcttgttcaagacaaaggcatgatggctggtcagttgcaggaaaaagaccagcaggccaagagcctcgaacaaagactcaatgatgcactgaccaaaatttctgggttggagcaagagctcgttaaagctggtaagggagggaaaaagaaagaggaaaactga

SEQ ID NO: 4359 - DNA, 435 bp, Klebsiella pneumoniae
gaactgatgatcaagattacaactaaattgggatgccttctggcggggctgcttgtcctgtcggcttgctcaagcgtccctcagccaaacaacgaatacgcgaaggccttggatgataccaaacaggtatgcgctgcctgtgccctggttggtaatgacctgctggttgccctcaacaagtcatgcgacaccccaatgacccccgagactcttacaagcgtcatgaacagtaacccgatgtttgccgccatgatggcaattaactccataggtggaaccgacttctatcaggtttaccgtgatgcggccatagacaccctgcggtgcaatgaaatggacagttggcctgatcggaccaaggtgcgtttccagcagcccgacatgcaaaaggcgctggccttgagggtttctgccagacagcagaaggcaaattaa

SEQ ID NO: 4360 - DNA, 537 bp, Klebsiella pneumoniae
gaggggccgatgaaaaaagttacctttatcagccagtctgaggccgaaaggctggagccagttgccggtgcggccatgatctccataactgacccagacaagtcccctgccgctctcggacagtgggagcagttgtaccgcgatagcttctatgacggcggctattctgagaacaccatccacacgatgaaggcagcgttccggatgaattacgcctcttacattgactcatcccaggctgaaaagctgtccaccttcctggatggattggttggtaccggtatcgatcagatcttcgttcattgctattacggagaatccagaagtggcgcggtagcgctgtacctccagaacaaacatggattcactccgaataagccgatcaccaagcccaaccgaacagtttacgaattgctgtgcaatccaaccaagtttgaaccgctgatacaaagctacgaaacgcaacatatagaggagctgcctcttcatctcaaaatatgggatttgcttctcgttgcggtcggacttcggaggtga

SEQ ID NO: 4361 - DNA, 963 bp, Klebsiella pneumoniae
ataagcaggataacaataaacgcgctttcacgcatatgggagacgcccttcgctgggccggtgatcctgagcttgcaaagcaattcgatgccgagggggaagaacatgcaaattcgtgactacatgacaaagttgtttgacgcatttggtgatgtggaggaagtcacccgagaaatgcttctggagcaggcggagctcattcatacgatcagcgataagtgtcagagcacaggcctgtttctggatagtcaggttcgtttcaaccagttcgttcaagagattgaggctgacgacaaggtagaggatcggttgcttcatgcttggtgctgggtaatggaccgaatagtgaaggctccaacatcctttcacatggatggggctgtgattttgacaatgcctctggtcgccagatacctgccaccggttgaacaggagccggaaaccatcgtggtgaatctcgatgaggactacaaggctcctgtaggcaaccaaacgctctgcgagctcgttatggaacggaggcattggccgcaaggtgcaacctgtgcgacccaagaagcggacgggggagtcctctactgggacgccccggttgatgtggtagaggaaggcagaaaggtcgccggtaagcacggcatgatggccgagatcggattgaaacatcaggttgatgcctggtatgcagatatggacgaaacacggctcgcaaccgattggaacaccgccgtcattacgcctcactgcttgctgctttcctatctggatgtgcttcaaaagaacaaagttccctttgatgaaggtgtgcagctcgctgccgaatgggtgaagcaacttggcggggaatttcgtgaagacactgaggaagcgccggaagctgaggcttcagtgctttccctggggagagccacggctcattgctttaaaccctatccggacacaaaaaatttctattacgaggcctaa

SEQ ID NO: 4362 - DNA, 303 bp, Klebsiella pneumoniae
ggggaagggatgagattgtcgtcaactcaaaaagacgttttgttcattctatacgcaattgaggccggtggaaaagccgagcctgtaccaggtgtaaaaatactggagatgatcaattcagctcgccagagcggtattcatggaacgaacttccgaacgtcatgccacacgctggtggagaacggcctgttgaacaagtaccggaatgcttctctaaagctggcctttaggctgaccgacgatggcagggaacgtgcaggagagatataccgaaaacggctggaagaagagcaagagaagtaa

SEQ ID NO: 4363 - DNA, 303 bp, Klebsiella pneumoniae
gaggtcgttgtggctggtagcaaatgggatggaaaaatatctaatctgaacatatcggagcaagcctttccggagctctatcgtgaactgtcccagatgcagcataaggcgcgtagtgatcggctccgcgcccttgctctattgggtctttattctcttcgattttctggcaacattgggtcttttgagcaacagagttcagagagtcaacctgcacagcatcaaaattcgccagtgcagactgacgcaaaactgaactctcaacgtgattcacttaaaggaaaactgatgggctccgtatga

SEQ ID NO: 4364 - DNA, 285 bp, Klebsiella pneumoniae; identical to SEQ ID NO: 2106

SEQ ID NO: 4365 - DNA, 306 bp, Klebsiella pneumoniae
acctacccagtgcttgtcgaacgcaatgacgttcaacgcttcaaacgcatccttcgcagctttaaaccggctccggacagcatcttgttgcttccaagccatgaactggagaagggtcattccaccagccataagggtgagaaaactcaagccattggcggcagctacgaccgtcgctaccaaggaccccaacatgacgaagcggttatgtttaagctgggccactattcacctcctataccaaccagcgtacaggacttttcaaaaatgcaaccccgcctagctgcccaattcgggcaaccctga

SEQ ID NO: 4366 - DNA, 297 bp, Klebsiella pneumoniae
gggccggaggtagtcatgaagccagttctctggatattcgtcctgatcatcgcccctttcgtcattgcgaaagtggaccaatggcgcaaacgcggcattggagacacctgggcgtggtggaaatcagagaacatgccttatgagctgcgctcggccactctgtttttgtccgaacaggacatatcaaccacacagccggtgcccatgcacggcagggttgatcaggtgtaccaaacccaagaatggggttctcattcccttggacaccaagctgcgccaggtaaaccacatctatga

SEQ ID NO: 4367 - DNA, 459 bp, Klebsiella pneumoniae
cgggagggggtaatgctaaaacgcggaattatcaatctcgctgctagttacatcattgttgatgccctactccggaatgcagcaatttggatctttggcttgtccttctccgttggtggcacttacgtcactggcgaggccagtacatgggtcgtttacctagccacttctggtgccatgacactctgttctgtcgtaacagcctacctgctcgtgacctatcaccgctgggggctgatgacggccagggtctggttgctattgagtgcctgcctaaacggctatgccgtctatttgagtagccacaacatccagttggtggtggcactgctttccagcctgtttattgctttgtggatgctcaagacccttgagcaaccagcagtgaaggggacgtacaaggtaatcgctgatcttcaccgtcagctatggggaatgttgaaggggcaaacacaatga

SEQ ID NO: 4368 - DNA, 1005 bp, Klebsiella pneumoniae
aagcaatctttggaggatttcatgagtcaatttgttctgggtttggatattggttactccaacctgaaaatggcaatggggtataaaggtgaggaagctcgcacagtcgtcatgccggtgggggcaggtccattggaactgatgccacaacagttaactggcggtgcagggacctgcattcaggttgtgattgatggagagaaatgggttgcaggcgtcgagcctgaccgattgcaaggatgggagcgtgagcttcacggcgactatccttcgaccaatccatacaaggctcttttctacgctgcactcctgatgtccgagcagaaggagatcgatgtgctggtgactggcctgcctgttagtcagtacatggacgtagagcgcagagaggcgttgaaatctcggcttgagggtgaacaccagatcacgccaaaacgatcggtagcggttaagtctgtcgtggttgtacctcaacctgccggtgcttacatggatgttgtaagttcaaccaaagatgaagacctcctggagattatccagggaggaaaaaccgttgtaattgaccctgggttcttttctgtagactgggtagctcttgaagagggagaggtccgctatcactcatctggcaccagcctcaaggcgatgtcggtgttgctacaggaaacggaccggctaattcaggaagaccacggcggtgcccctggcatcgaaaagatcgagaaagctattcgtgccggtaaggccgaaatcttcctctacggtgaaaaggtatcgatcaaagactacttcaagaaagcctcaaccaaagtcgctcaaaacgccttgatccctatgcggaagtcaatgcgtgaggacgggatggatgctgacgtagttctgctggctggcggcggtgccgaggcttaccaagatgcggccaaggagcttttccctaagagcaggatcgtactgcccaacgaatccgtggcatccaatgccaggggcttctggttctgcggctga

SEQ ID NO: 4369 - DNA, 1683 bp, Klebsiella pneumoniae
tgctgtttatcaataaatgtgacgaccatcgcgaataagttgccaactggcgcattattaagcagaatgccgcacattcgacgacaaccttgcgttttttccggacatcgcctgctgaggaacctgaagctgcagaagattaactctctgaaaaaattaaagattaattatctgctgatcggcattgtcacccttttgctggcggcggccctgtggccgtcgatcccctggtctggtaaacccgagaaccgggtggcgggcattatcgctcgcggcgagctgcgcatcagcaccatcaactcgccaatgaccttcgccaccatgaacaataaagcgttcggtctggattatgaactggcgaagcagtttgccgactaccttggcgtaacgcttaagataaccgtccggcaaaacatcagccagctgtttgacgacctcgacgacggtcaggccgatatgctggccgccggactggtctataaccaggagcgagtgaaaaactatcaggccggccccacctactattctgtttcacaacagctggtctaccgcgtcggcaatacccggccgcgcaccctcgcggcgctgaccgccgagcagctcactatcgctccgggccacgtggcgatcaacgacctgcagaccttaaaagccgagaaatacccggatcttgcctggcgcgtggacgaaaaacgcggtaccacggcgctgatgcaggcggtgattgacggtaaacttgattacaccatcgctgactcggtggccgtcagcctgtttcagcgcgtccatccggagctggcggtggccctcgatatcaccgacgaacagccggtcacctggtttagcgcccgggacgacgataattcgctgtcggcggcaatgcttgatttcttcaacaacatcaatgaagacgggacgctggcgcgcctcgaggagaagtacctcggccacggcaacgatttcgattatgtcgatacccgcaccttcctgcgcgcggtggaaaatattcttccggaggtgcagccgctgtttgaaaaatacgcccgcgagattgactggcgcctgctggccgccatcgcctggcaggaatcccactgggatccgcaggccacctccccgaccggcgtgcgcggtatgatgatgctcacacgcaatacggcgcaaagcctgggtctaaccgaccgcaccgatgcggcgcagagtatcgacggcggcatgcgctacctgcaggatatgatggataaagtgccggattcgatcccgaaagatgaacgcatctggtttgcgctggccgcttataatatgggctatgcccatatgctggacgccatggcgctcacccgcaaacagaaaggcaatcctaacagctgggcggacgttaagctgcgtttaccgttgctgagccagaaaccctattacagcaaactaaaatacggctatgcccgcggccatgaggcctacgcctatgtggaaaacatccgcaaatatcagataagccttgtcggctatttgtcagagaaggagcgccagcagcagcaaacgctggccctggcggaggattacccggccgtgctccccaatgagctcgaacagccgcaggagaccaccctgccctttttcaagtttcgcgccgataagcagatggataatgcccggatgaaactccccggccacctgtattaa

SEQ ID NO: 4370 - DNA, 1137 bp, Klebsiella pneumoniae
cgcgggagatttttcatgcataaccaggctccgattcaacgtagaaaatctaaacgtatttacgttggtaatgtgccaattggcgatggggctcccatcgccgttcagtcaatgaccaatacgcgcaccaccgatgtggcggcgaccgtaaatcaaatcaaagcgttagagcgcgtaggcgcggacattgtccgtgtctctgttccgacgatggacgctgctgaggcgttcaaacttatcaaacagcaggttaacatcccgctggtcgccgatatccactttgactaccgtattgcgctgaaagtggcggaatatggcgtcgactgcctgcgtatcaacccgggcaacatcggcaacgaagagcgcatccgcatggttgtagattgcgctcgcgataaaaacatcccgatccgcatcggcgtcaacgccggctcgctggaaaaagatctgcaggaaaaatatggcgagccgacgccgcaggcgctgctcgaatccgccatgcgtcatgtcgatcatctcgatcgtctgaacttcgatcagtttaaagtcagcgttaaagcttccgatgtcttccttgcggtggaatcctatcgtctgctggcgaaacagatcgatcagccgctgcatctcgggatcaccgaagcgggcggcgcgcgcagcggcgcggtaaaatcggcgatcggtctgggactactgctgtccgaggggatcggcgatacgctgcgcgtctcgctggcggcggatccggtggaagagatcaaggtcggcttcgatatcctcaaatctctgcgtattcgttcccgcggcattaactttatcgcctgcccgacctgttcacgccaggagtttgacgttatcggtacggtgaatgctctggagcagcgtctggaagatatcatcaccccgatggatgtttcgatcatcggttgcgtggtgaacggcccgggcgaagcgctggtctccacccttggcgtcacaggcggcaacaagaaaagcggcctgtatgaagacggcgtgcgtaaagatcgcctggataacaacgacatgatcgaccagctggaagcgcggatccgcgccaaagcctcgatgctcgatgaagcccgtcggattgacgttcaacaggttgaagcaaaataa

SEQ ID NO: 4371 - DNA, 1713 bp, Klebsiella pneumoniae
aagaggaaatcgcgttcggtgggaggccatcacatgagtatcttcgaggcgcattttcgcagactacacgcccgctacggcgcaggtcagacgcacgaattacagatgcacgagatcgccgccatcttcggctgttcggtgcgtaactgccgaattgcgctgaaaaagatgcaccaggaaaaatggctcgactggcagccgcagcgcggacgcggcaagcgctcacgactccatctattaacctcgccggaaaagctgttcagccagaacgtcaataagctgctggagaagcaggattacggcgacgtgctgcggtttatcggcaacgacaagtatctgctggatcgcctgagcctgtggcgctttggggtacaggataaaagcagtgaaacacgggtgcgcatcccctactatcgcaatctggatccgcttaatccgctcgttcccctgcggcggaccgaacgtcatctcctgcgccagtgcctgagcggtctgacgcgctatgacgccgtgcagggcagggtcgtccccgatatcgcccactactggatccacaacgaggactttacccgctgggagttctggctgaaatccaccgcccgctttgccgatggcagcgaactggatgccagcaccgttcagcgctgcctgctcgccgccagccagagcccgcaattcgccccgcttttcagcccaatcaaaaccatcaccgctgacgccccctggcatctggtgattgaaacgcatcatccggtcagacgtctcgactgcctgctcgccactcagccgacgatgctgttcgattaccagcacggacacatccgctgtaccggcgctttccacctgcaggaacacagcgacaactttatggttctgcggcgcaatcaacactggcaccaggcgcggcccggactggatgagatcaccattttcacctgggctccggagcatatcagcatgagctttattcccctgctgcggggcgaagaggcgcaggatgaccgcccgctcaacgagcgcagtctggagcaggggtgctgctttgtgctgctcgacagtgacggggcctttgcagatgaggccggaagacggtttatcaattacctgctacaacctgtcgaactcctcagccagacgcagcttcccgacgaatatgcgcgcatcctctccgtggctcagggtatgctaccgcagtggaaccaccgcccggtggattatggcgggatcaccgcgccgtttaacctgcgtcagcgggttatcatcagcacctttcagcagccggaactggtggaacttgccggggcgattcgcatcttgcttgagcgttggcatattcgcgccgaaatacggatcgacccatttgaccacttcaacagccagccgcgcctgcctgcggacatctggctcagcaactttatgctcgataccctttcggttccggcgtttctggaatggctggcttccaccacgctgtttacgcgactgcctgaagcccagcgacaaaacctgaacaccctgttgccgaccattctgaacagcgataatgaacaggcgttcgcaaccattgccgcctttttccatgagatgacccatcagcgatatgtcattcctttgctgcatcactggatggaatttgcgaccgagaagtcatttacctggcgggatttaaatacgctgggatggccggattttagccaactttggctcgaataa

SEQ ID NO: 4372 - DNA, 1341 bp, Klebsiella pneumoniae
gagatcgtgtctatggctacaactccttcggttccttcacttcctgaacttcccagtgttccaacaacaattctacctgcaattgccgaacttaccgctgcactgggaatcccaagaaatgtattagctagtgatgaagaaataagctttgcttggcaggatttaccaagggaactaagactaattccttcggatcttcgaggtgaactcgtcgcccgtatgtgtgttgcagtaagcgctggcttatttgatggcgcaatgaattacatatggaatgccgcaattttacaaatcagacaaaaggtaaggaattttggtttgcccatcgtaagtcagatgcttcaatccgactttgaagagaagcacttgatcgacttacaagatagtaaacttttagaacttgcattaaaattaaatttagtaaatgaagatggttatttcttcttagatcattgcagagaaatgaggaataatttctctgccgctcacccaactatcggaaatattaatgatagagaattcacaacattcctaaatcgatgtgttagatatgccttggctgatgcttcttctccaagaggagtaaatgttgcagatttcatagcatcaataaaaagtgctcgttttacagggcaacaatgtgctatttggattcagcgaattaatgatacacatgcagcacagaggcaaattcttattggaatggttcatggcatatattgcgatcccaatacatcagaaccagccagattaaatgcaattgatttatgctccgctatcagtgaacagttcactgcggcaattcgctctgacttgatcaacaaacatgctgaatatgctgctaaaggagatgaacaacgccacacagcatctactcaattttttgaaaaactcggtcagataagatacctaagtgaagccgatcagcacatcatattctatcgagcaatagaaagactttggaatgctcataatggaatgaataacttttataatgaaccccccttcgctgaaaggctttgtgagctagcaactcacggagcagtacctgaaacagtacaggaatattttgttcaggttgtagtggcatgtgcgattgggaatggatatggtgtatcgcatggtgcattatcatattacactgaaatgattagaacattttcccctagagaaatagcgactatgattagactctattccgatagaacaaatattgtaggatatcgtatagctacatactccaggggaagagaacgatttaaagagtatttaagaacactcgatccagccagtatttctagcggtgttcgttctgattatgatagaatattacgagaatag

SEQ ID NO: 4373 - DNA, 3939 bp, Klebsiella pneumoniae
cgcccgtttccccccctggctcaccctgaaagcttcgaagacgagagacttatgatggaaattttgcgtggttcacctgcactgtcggcattccgtattaataaactgctggcacgatttcaggcggccaaccttccggtaagcgccatatatgccgaatatattcattttgccgatctgaacgccccgctgagcgctgacgatcgcgagcgcctggcgcgactgcttcagtatggcccgagcttaagcagccataccccgaccggtaaattactgctcgtgacccctcgccctggcaccatctctccctggtcttctaaagctaccgatatcgctcacaactgcggtctggcgcaggttgtgcgtcttgagcgcggcgtggcgtattacgttgaagcctcaaccctgaccgaagcgcagtgggccgcggtggcggcggagctgcacgaccgcatgatggagagcgtcttcgacgcgctggaagcgggcgaaaagctgttcgctcaccatcacccgacgccggtgaccagcgttgacctgctgggcgaagggcgtcaggcgctgattgacgccaacctccgtctgggtctggcgctggccgacgacgaaattgactacctgcaggacgcgtttacccgcctgggacgcaacccgaacgatatcgagctgtatatgttcgcccaggcgaactcagagcactgtcgccacaagattttcaacgccgactggatcatcgacggcgaacagcagccgaagtcgctgttcaaaatgatcaaaaacacctttgaaaaaacgccggactacgtgctgtcggcctataaagataatgctgcggtgatggaagggtctgaagtcgggcgctatttcgccgaccatcagaccgggcgctacgacttccatcaggagccggcgcacattctgatgaaggtggaaacccataaccacccgacggccatctctccatggccgggcgcggcaactggctccggcggcgaaatccgcgatgaaggcgccaccggccgcggcgcgaagccgaaagcgggcctggtgggcttctcggtttccaacctgcgtatcccgggcttcgaacagccgtgggaagaagatttcggtaaaccggatcgtattgtcaccgctctggacatcatgaccgaaggcccgctgggcggcgcggcgtttaacaacgaatttggtcgtccggcgctgaacggctacttccgcacctatgaagagaaagtcaccagccacaatggcgaagagctgcgtggctaccacaaaccgatcatgctggccggtggtatcggcaacatccgcggtgagcacgtgcagaagggcgagattaccgtcggcgcgaagctgatcgtgctgggcggcccggcgatgaacatcggcctcggcggcggcgcagcgtcttctatggcctccggccagtccgatgccgatctcgatttcgcctccgtacagcgtgacaacccggaaatggagcgccgctgtcaggaagtgatcgaccgctgctggcagttgggcgacgccaacccgatcctctttatccacgacgttggcgccggcggtctctccaacgctatgccggagctggtgagcgacggcggccgcggcggtaaattccagctgcgcgatattctcagcgatgagccagggatgagtccgctggagatctggtgtaacgaatcgcaggaacgttatgttctggcggtcgccccggagcagctgccgctgttcgacgaactgtgccgccgcgagcgcgcgccttatgccgttatcggcgaagctaccgctgagcagcatctgagcctgagcgacagccactttaacgatcagccgatcgacctgccgctggacgtcctgctcggcaaaacgccgaaaatgacccgcgacgtgcagactctgaaagctcagggtagcgcgctggatcgccaaccgattatccttgccgatgcggttaaccgcgttctgcatctgccgacggtggccgagaaaaccttcctcgtcaccatcggcgaccgcaccgtgaccggtatggtcgcccgcgaccagatggttggcccgtggcagatcccggtggccaactgtgcggtgaccaccgccagcctcgacagctactatggcgaagcgatggcgatgggcgagcgcgccccggtcgccctgctggacttcgcggcctctggccgtctggcggtcggtgaagcgctgaccaacatcgccgccacgcagattggcgagctgaaccgcgtgaagctgtcggctaactggatggccgccgccggccacccgggtgaagacgctggcctgtatgaggcggtgaaagcggtaggcgaagagctgtgcccggcgctgggcctgaccattccggtcggtaaagactctatgtcgatgaaaacccgctggcaggaaggcagcgagcagcgcgagatgacctccccgctgtcgctggtcatctctgccttcgcccgtgtcgaagatgtccgtcataccgtcacgccgcagctttcgacggaagataacgccctgctgctgatcgacctcggtaaagggcacaacgcgctgggcgcgacggcgctggcgcaagtctatcgccagctcggcgacaagccggctgacgtgcgcgatgtcgcgcaactgaaaggcttctggaatgcgatgcaggccctggtggcgcagcgtaaactgctggcctaccacgaccgctccgacggcggtctgctggtgaccctggcggaaatggcctttaccggccactgcggcgtggaagcggatatcgccgcgctgggcgacgaccatctggccgcgctgttcaacgaagagctgggggcggtgattcaggtccgcgccgcaaaccgtgaggcggtggaagccattctggcggttaacggcctggcggactgcgtgcattacctcggtaaagcggttgagggcgatcgcttcgtgctgaccgccggcggtcagacggtgttcagcgaaagccgcaccacgctgcgcatgtggtgggcggaaaccacctggcagatgcagcgtctgcgcgacaacccggcctgcgccgatcaggagcatgaggcgaaagccaatgatgccgacccgggcctcaatgtgaagctctcgtttgatattaacgacgacgtcgccgccccgtacattgccaccggcgcgcggccgaaagtggccgtcctgcgcgagcagggggtgaactcccacgttgaaatggcggccgccttccatcgtgccggctttgacgccatcgacgtgcatatgagcgacctgctggccggccggaccggtctgggcgatttccatgccctggtagcctgcggcggcttctcctacggcgacgtgttgggcgcgggcgagggctgggcgaagtcgattctgttcaacgagcgcgtgcgcgatgagttcgcgaccttcttccatcgtccgcagacgctggcgctcggcgtgtgcaacggctgtcagatgatgtccaacctgcgcgagctgatcccgggcagcgacctgtggccgcgctttgtgcgcaaccagtctgaccgctttgaagcgcgctttagcctggtggaagtgacgcaaagcccatccctgctgctggaaggcatggttggctcacggatgccgattgcggtctcccacggcgaaggtcaggtggaagtgcgcgacagcgcgcatctggctcagctggagagcaaaggtctggtggcgctgcgcttcgtggataacttcggcaaagtgaccgaaacctatccggcgaacccgaacggttccccgaacggtatcaccgcggtgaccagcgaaagcgggcgcgcgaccatcatgatgcctcacccggaacgcgtcttccgcaccgtaagcaactcctggcacccggagaactggggcgaggatagcccgtggatgcgtatcttccgtaacgcgcgtaaacagctgggttaa

SEQ ID NO: 4374 - DNA, 363 bp, Klebsiella pneumoniae
aaggccaatccgtggacgaggtttaaaatgccaaaaattgtatttctgccccaccaggacctgtgtccggatggcatcgttgtggaagctgagaccggtgaaaccattctcgatgccgcgctgcgtagcggtatcgaaattgaacacgcctgcgaaaaatcctgtgcctgcaccacctgccactgcatcgtgcgtgaaggttttgactcgctggcggaaagtagcgaagatgaagacgacatgctggataaagcctgggggctggaacctgacagccgtctgagctgccaggcgcgcgtcaccgacgaagatctggtcgttgagatcccgcgttacaccatcaaccacgcacgcgagcactaa

SEQ ID NO: 4375 - DNA, 1206 bp, Klebsiella pneumoniae
ataatttgtccatctgagagggactcgatgcaattgcgtaaattactgttgccagggctgctttccgttaccttgctgagcgggtgttcgctgtttaatagcgaagaagatgtggtgaaaatgtcaccgctgccgacggtagaaaaccagtttacgccgtccacgtcctggagcacctcggttggcgatggtatcggcgaattttactctaaccttcatccggcctttgccgacggcgtagtgtatgctgctgaccgtaaaggcaccgtcaaagcgctgaacgccgacgacggcaaagaggtgtggtcggtgaatctggcggagaaagatggttggttctcgcgcacgccagcgctgctttccggcggggtgaccgtctctggcggccatgtttatatcggcagcgagaaagcgcagctgtatgcgctgaataccagcgatggtaccgtggcctggcaaacccgtgtcgccggcgaggcgctgtcgcgtccggtggtgagcgatggcatggtgctggtgcataccagcaacggccagctgcaggcgctaaacgagaccgatggggccgtgaagtggaccgttaacctcgatatgccggcgctctccctgcgcggcgagtctgcgcctgcgaccgcctacggcgcggcgatcgtcggcggcgacaacggccgcgtcagtgcagtattgatgcagcaggggcagatgatttggcagcagcgtatttctacggccaccggcccgacggaaattgaccgcctgaacgacgtcgacacgacgccgatcatcgttaacggtgtggtttatgcgctggcttataacggcaacctgaccgcgctggacctgcgtagcggccagattatgtggaaacgcgagctgggttcggtgaatgatttcatcgtcgatggtaaccgtatctacctggttgaccagaacgatcgcctgctggcactgaccaccgacggcggtgtaaccctgtggacgcaaagcgatctgctgcaccgtttgctgaccgcgccggtgttgtataatggcaatctggtcgtcggcgatagcgaaggctacatgcactgggttaatccggaagatggccattttgtggcgcagcagaaagtggacagctccggcttcctgaccgacccggtggttgccgatggtcgactgctgatccaggcgaaagacggtacgctgtacgcgattacgcgttaa

SEQ ID NO: 4376 - DNA, 2427 bp, Klebsiella pneumoniae
aaacgaatcccgcgcctactctgtggctgcttcctgcttcctgaggaatccgtgatgaaacaagcctgtattgatgccgtagccaacacgctggggcgccagccgaaagcggacgaaattaaaaatatcgaagaccgtattaaagacgccgtgcgcgtcatcgcgcgccgcaacgccagggaagggaagaccggcatccctgacgcggaaacttaccgtcaggcggcagagcttgccgctgcgcaggctgtgcatgcggtattcaaaaaacgtcagcgagtggcgcagaatgccatcgctatcgccaaagttcgcgacacgctgaataaagccatacccgagaatgagcaaaccccgatcgctctacagcagtttattttttccgggcgccgcgggcgagacaagcagccggatattaacgtggtctcagcagaggagatggcgacaggggcataccaggactggacgcgccagctatcagccgaacttacggcagcaggcgatgatgttcagaaattcttctatcagagtcaggcgttaggtgagcagcgcctgcgcaaccttttgccgtttgaccgtgaagcgtccagatctggccagttgcagatcctgaaggaaatttacggcgaagacaccgggaacccggcagcaaagaaaattgcgaaagtatggggggatgtcaccagtcgggcccggcaggaaatgaacgattcagggtttgatataggtctgcgtgatgactggcatctgccatatgttgatgatgccgagctcatccgcgccgctggccgcgatgagtggctttcctctcttccgctgaatgagcgcgctgccgcaattgctactggcctccagccgccgcaggatttcgctcggcaggcctgggttgatgacgtatggaacactcaggaccgatcgcagtatgtgaatcttgacggcagcccgatgaacgatatcgagtaccgccaggcgctggaagccatctacgaaaccaaagtgacggaaggggccaacaagattgaccccggcgcctttatgggaagcggtggaataaagaaccgcggatcacagagcagggtgatgtcgttcaaggatgcacagtcgcattttgcgtatatggagcgatacacccagcagccggtagtcggagtgatgatgtcacacctgcagtcctcatcgcgggacctcggcgttgttaaggcgtttgggcctgatgcagccagtaacttcaaacttcttatggaccagatttatcagagagcgacgtcaaccactggtggcggccatgatattgggacgatgaatgatcagcgtcaactggtagagaggatgtttaactctatggctggtctgaacggcgttgcatcgtcaagtgtgttttcctctgctgtcggtggtctacgaaacctgatgacctcggcaatgcttggcaccagtgtgttcaccgcagccagcgatcaggccatcatgcgcgctaatgctcaggctcttggcttcgatcgcaatggcatgcgtctgtcggccaatactctgcgcaatctctttaacggcgacgcaaagcgtgcgaatgccgagcttggtctgctggttgatacgcatgcggcggtggtatcgaaaatgggagggtttgacctttctcgcgggataacaggttggttcgctgagaagacgctgaagtggtccgggttaatcgctatggaccgggcaaataaggcttcttttggcctgctgatgtttaagaatatcggcgagctttcccgcaaatataagtcactggatgcgctgaccgacagcgatcggactgtgctggctaacaagggttggacgccagaggactgggctattatgagtgctgcggagttgcgcccgctgacgcctgacgggcataaggggatgacgccagacgcgatctatgacgtgcccgatgagactatccgtaatatcctggctgacaggatagagaaggtgcgggctggcagtgatcaggcgctggcggcgctgggcgatatgaccgacgcgaagcgcaagacactgaaacaggcctttgacgcagaggttgagcaaaccataagccggatggtgcgcaatgcacgtgcagaggccgcacagcatctcctggggataacccacggtgagatgaccagcgccgtaacgacggctaccggactggatactttcgcccgcgatacttccggggatctcctgaaaagctttatgctcttcaaaacaacgccgatggccggcatgcggcaactggtcaccagagcgcaggatctggaaacgctgccggctgtaaaatatctggcatcctatattgccggtaccactctggcagggatgttcgctaaccagatgaatgcgctgctatcaggaaatgacccattggatatgactaaacctcagacatggctgcaggcccttgtctaa

SEQ ID NO: 4377 - DNA, 672 bp, Klebsiella pneumoniae
aagcttcccccccggttaaggccgggggggggggtgggaagggaaaagccccccgggaacttaagccttttttggcttccccgccgtaaaacatggaaagtccaagttcctttacaggttttccaaccgggttggcacaaaaatttccttattaggcatgaaaggcggttgatgcgggccaccgccgcacataatggccgtggcctcaaacagatttttcagcattttaaaacccaggccgccagtcggtaccttggcgcatcaaccaggcaagtaaggtcatcgtctgcgcggaatggacgaccagtgggaatacgtcggggtaatcgccgcaagcgctggctgttttacgcgtatgacaggctccgaaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataa

SEQ ID NO: 4378 - DNA, 684 bp, Klebsiella pneumoniae
cgcatgaaccccatcgtaattaatcggcttcaacgaaagctgggctacacttttcatcatcaggagctgttgcaacaggcattaactcaccgcagtgccagcagcaaacataatgagcgcctggaatttttaggtgactccattttaagtttcgtgatcgcgaatgcgctgtatcatcgctttcctcgtgtcgatgaaggcgatatgagccgtatgcgcgcgacgctggtgcgcggcaacacgctggcggagatcgcccgcgagtttgagctgggcgagtgtctgcgcctcgggccgggagagctgaaaagcggcggtttccgtcgcgaatcgattctcgcggataccgttgaagcgttaattggcggggttttcctcgacagtgatattcagaacgttgaacgcttaatcctctcctggtaccagacccgtctggacgaaatcagtccgggcgataagcaaaaggatccgaagacgcgtctgcaggagtatctgcagggacgtcatctgccgctgccgtcttacctggtggtccaggttcgcggcgaagcgcacgatcaggaatttactatccactgccaggtcagtggcctgagtgaaccggtggttggcacaggttccagccgtcgtaaggcggagcaggctgccgccgaacaggcgctgaaaaagctggagctggaatga

SEQ ID NO: 4379 - DNA, 351 bp, Klebsiella pneumoniae
gacaggaaccccatgaaaaagattgatgcgattattaaacctttcaaactggatgacgtgcgtgaagcgctggccgaagtcggcatcaccgggatgacggtaacggaagtgaaaggctttggccgccagaaagggcacaccgaactgtaccgtggtgccgagtatatggtcgattttctgccgaaagtaaaaattgaaattgtggtgaccgacgatatcgtcgatacctgtgtggataccatcatccgtaccgcacagaccggtaaaatcggcgacggtaaaatctttgtcttcgacgtggcgcgggtcattcgtattcgtaccggcgaagaagacgacgcggcgatttaa

SEQ ID NO: 4380 - DNA, 537 bp, Klebsiella pneumoniae
atgcatgaccctgaggttactatggactatttcaccctcttcgggttaccagccagctataccctctcgcttgaacaactggctgtccggtatcaggatctgcagcgccagtaccatccggataaatttgccagcgcgcctgcggcggaacagcttgcggcggttcagcattccgccactataaaccaggcctggcagacgctgcgccatccgctgactcgcgcagaatatctcctttcgctgcatggcttcgatctggccagcgagcagcataccgttcgcgataccgcgttcctgatggaacagctggaattgcgcgaagagctggatgagatcggccaggcgaaagacgacgcgcggctggaaggttttatcaaacgggtgaaagcgctgtttgatacccgtcagcagctgatggttgaccaattgcataatgagagctgggaggcggcggcggacacggttcgtaagctccgtttcctcgataaactgcgcagcagtgctgaagaactcgaagaaaaactgctcgatttttaa

SEQ ID NO: 4381 - DNA, 912 bp, Klebsiella pneumoniae
agccagcgaccgctggctttttttatagggatgacaacgatggctgaaccacaaccgctgtttgactacaccggatacctgccggaatgcccgacctggagcgaggcagaaaaggccctctactgggctgatatcatggaatgtgaaattcaccgctacgatatccgcagcggagaacaccaggtgctgcagtttccagaggaggtcggctgttttgccctgcgcgagaagggcgggtttatcgtggcattgcgcagcggcatctggctgaccgacgcccacggcctgctgcggcggaaagtctgcgataacccgagcaacccggagctggcgcggtttaacgacggcgggaccgatcgcgatgggcgcttttatgccggtaccttctgggggcctggggattacaacggcgcgctgctgatgcgagtggataacgacctgcagccgaaagtgatccagtgtgacatccatggcgccaatggcctggcctttagcgccgaccggcgctggatgtatacctctgatacgccgaacgccgtgatctaccgtacgccgctggatgagcagggtgagcctggccgacgcgaagtctttcgccgttttcagcctggcgaagggatccctgacggggcggcgatcgacgtggagggatgttactggagcgcaatgtttgacggctggcggatcgcccgtttctcgccgcagggcgaggagctggaatcctacccgatgccggttcgttgcccgacgatggtctgcttcggcggggcggatatgaaaacgctctatatcaccaccacccgggaaaacatggaggacgatgagctggcgcagtatccgctgtcaggcgccatcttcaccctgccggtagcggtggcagggatgaagaaattaccgttccgcgaatgttaa

SEQ ID NO: 4382 - DNA, 1350 bp, Klebsiella pneumoniae
cgtggtacgcccgacaagacagattgcagtctttgctggagcaatataacaatgacagaaagtagcattaccgaacggggcgcgccggaactggccgatacccgtcgtcgtatttgggcaattgttggcgcttcctcggggaatctggttgaatggtttgatttttacgtttactcattctgctcgctctatttcgcgcacatcttctttccatccggaaataccaccacccaactgctgcaaacggcaggcgtatttgccgccggatttctgatgcgtcctatcggtggatggctgtttggtcggatcgctgaccgccggggacgtaaaacgtccatgcttatctcggtctgcatgatgtgctttggctcactggtgattgcctgtctgccgggttatgcggtgatcggcacctgggccccggcgcttctgctgctggcgcgtctgttccaggggctgtctgttggcggagaatacggcaccagtgcgacctatatgagtgaagtcgcggtggagggtaagaaaggcttctatgcctccttccagtacgttacgctgattggtggtcaactgctggctgtattagtggttgtggcgctccagcaggtgcttagcgatgaagatctccatgcctggggatggcgtattccttttgccctcggggcggtactggctatcgtcgcgctgtggctgcgtcgccagctggacgaaacctcgaagcaagagacccgggcgctgaaagaggctggctcatttaaagggttgtggcgcaatcgccgggcctttgcgatggtgttaggctttaccgccgccggatcgctgaccttctacaccttcaccacctatatgcaaaagtatctggtcaacacggcgggcatgacggccagcaccgccagcgtgatcatgaccgcggcgctgttcgtttatatgctggttcagccgctattcggcgccttctcggataaagttggccgccggacctccatgctgtgctttggcgtgctggcgacgttatttaccgtgcctattctcagcgccttgcaaaaagtgagctcaccctatgccgccttcggcctggtgatctgcgccttactgattgtcagtttctatacctcgatcagcggcatcctgaaagcagagatgttcccggctcaggttcgcgcgcttggggtcgggttgtcctatgccgtcgcgaacgcattgttcggcggctctgcggagtacgtcgcgctgtcgcttaagtcggcagggatagagcacgcgttctactggtatgtgacggtgatggccgccattgccttccttgtctccctgatgttgcatcgcaaagggaaggggttgcgtctgtaa

SEQ ID NO: 4383 - DNA, 501 bp, Klebsiella pneumoniae
ggcgctcggcctgcccgtcacctcgctggcgctgcgctatatcgccgccgccatgctgattggcctgatacgcgggattatcaccgagtacctgttcctgcggctcagcaaacgggggaatgcgccatgatgatttactgcgcacgtattactgctatcgggctgtttgtcgccgacggtctgaccgacaagatgctcatcaccttcgacagcaacgggccgaaagactgcctcgattactcccagtcgctggagccgtcgttccgggaagagagcctgatgatactccctggcgaccgcctgttgctggcagggcatgattatctggtgactgccgtcggcaagggggcacagcaggcgctttttgaactcggccacctgacgctggtgttcaacggcgatctgaatccctgtcacgtcggcgcggttcatctctccggcccggtgccgaaactccatgacctgcacggcaatctggtgatagaggaggggcggccatga

SEQ ID NO: 4384 - DNA, 1254 bp, Klebsiella pneumoniae
aatgtgcttaccgatacaaaactcaaaaacctgaaaccgcagggcaaaatgtacaaggtctccgatcgcgacgggctgtatgtagccgtgctgatctcaggcaccatctcgtttcgttacgattaccgcatcaacggccgccgggagacgctggttatcggtcagtatggtcgtgacggtatcacgctggctgaagccagggatgaactgatagccgctaaaaagctgctgaacgcaggccagtcgccggctgcggcgaagcgtgacggtatcaaacggatccgcggcgcagaaacatttacggtacataccgacgcctacatgaaacatgtggtcctggctgacagcacgcgggctatgaagcaatcagtaatcgacagggatattttgcctgttctcggaaacaaaatgatgtccgagataacgacccctatggtgctggatctttgcgatcggatagtcgagcgcggcggacgtgcgacggcggtgcaggcgcgtgaaatcatcagcagcgtttaccggtacgccaatgaccgcgggcacgggttattcaacccggccgcagatatcaagccttcagcgatcgccatgtttaaaccgcgtgaccgttgcctgcagccggaagaaatcggcgtgctgttcaggtcgctcgataccgtcagcactttgccaaccttaaaactggctgtgaagctcatcctgatcacgatggtgcgcaaaaccgagttcatcatggcgacgtggaaagaggtggatttcagcaaaggaacctggacgatcccaccagacaggatgaagggtagccggtcgcacgtcatctacctgccgcctcaggcgcaggatctgatggtaggcctgcagatgtgcgccggcgggagtgattatctgttgccaggtcgttacagcaccagtaagccgctatccaatgctgctctgaactcagtcatcgatcgcgcggtggcggctgccgtagatgcaggggaaagtttacagcctctcacggtgcacgacctgcggcgcacagcgagcacgcttttgcatgaagcgggattcccgtcagactggatagagaaggcgcttgcgcatgaacagaagggcgtgagggcggtttacaacaaggccgagtattccaggcagcgggcctacatgctgcagcagtgggcaaatatggttgatgcatggataaacggggagcattacgacctggtgccgttctccccgtctgcatttgaaaagtggatgaatgaacaatag

SEQ ID NO: 4385 - DNA, 318 bp, Klebsiella pneumoniae
aatgtgcttaccgatacaaaactcaaaaacctgaaaccgcagggcaaaatgtacaaggtctccgatcgcgacgggctgtatgtagccgtgctgatctcaggcaccatctcgtttcgttacgattaccgcatcaacggccgccgggagacgctggttatcggtcagcatggtcgtgacggtatcacgccccccgaagccagggatgaactgatagccgctaaaaagctgctgaacgcaggccagtcgcgggctgcggcgaagcgtcccggtatcaaacggatatgttggtccggccggtcgcgacaggtccgtcatacg

SEQ ID NO: 4386 - DNA, 771 bp, Klebsiella pneumoniae
gttcaggagtttttgtcggcaaggttattgaggatgtctcagtcgaagtttgcgctgccgcgcaatggttttaccttcaaacggttctttgtcgctcacgatcgctgcgccatgaaggtgggtaccgacggcattttgctgggtgcctgggcgccgattgccggagtgaagcatgtgctggatattggcgcgggcagcggcctgctggcgctgatgctcgcgcagcgtaccggagatgatgtgcatgtcgaggcggtcgaactggacgaagaggccgccgctcaggcgcgggaaaacgccctcgcgtcgccgtgggcttcgcggattgaggtctggcaggccgatattcatcagtggcagccgtcgcaaactcgacgctatgaactgataataagtaatccgcccttttttgccgaaggcgtgccatgcgcgacctcgcagcgagagcaggcgcggtacaccactacgctcgatcacgcctccctgctgacctgtgccgcagagcatattaccgaagaaggttttttttgcgtggtgttgccagtggatattggtaatgcgttcatcgaacgggcaagggcgatgggctggcatctgcgactgcgtactgacgtggcggagaccgagctgcgaccgccgcatcgggtgctgctggctttctccccgacggcaggggagtgtttcagcgacaggctggcgatccgcgggccagagcagcaatattcggaaggctttaccgctctgaccgaggacttttatctctttatgtga

SEQ ID NO: 4387 - DNA, 999 bp, Klebsiella pneumoniae
cgaatgaatactgaagccactcaagatcatcaagaagcaaacaccacgggcgcgcgtctgcgtcacgcccgcgaacaactcggacttagccagcaagcggtggccgaacgcttatgcctgaaggtgtccacggttcgtgatattgaagacgataaggcccccgccgacctcgcctccaccttcctgcgcgggtacatccgctcctacgctcgcctcgtacatattccagaagacgagctgctgccgatgatggccaagcaggcgcccatccgcgcggcgaaagtcgcgccaatgcagagtttctctttaggcaagcgccgcaaaaagcgcgacggctggctgatgagcttcacctggctggtgctgtttgtggttatcggtctgagcggcgcctggtggtggcaagaccataaggcgcagcaggaagagatttcgaccatggccgatcagtcttccgcagagctgaacggcggcgacgccaacagccagaacgtgccgctggataccagcgcccctgcagccccgaccgccgatagcgccgcgaacagcgcgccaaccgataccgccagcgcaccgaccaccagcgcgccggcccagacgccagcggataataacgctgtcgtggcgccttcccaggccaatgtcgataccgcggggacgacgccggcagctccggctaccactccagcctcgccgttgccgaccgatcaggcgaacgtcacgactccggcggcgtcggcgcaggatctggtgatgaacttttccgccgactgctggctggaagtgagcgatgccaccggtaaaaaactgttcagcggcctgcagcgtaaaggcggtaacctgaacctgagcggtcaggcgccgtataagctgaaaattggcgccccggccgcggtacagatccagtatctgggcaagcctgtcgatttaagtcgttttatcagaactaaccaggttgcgcgtctgaccctcaatgccgaatcatcaccggcgcagtaa

SEQ ID NO: 4388 - DNA, 1239 bp, Klebsiella pneumoniae
tcagagaatacggctgatcagccggtcaatgcggatccgccgcagacggcggatcagttttcgcactttcaccggatagtcggcgatactttgcagatcccgataatgtttcactaccgtggtgtgggtgcggatgagcttcagctctttctcccgcatggcccccagctgccgctttggatcgtggatcagaatggcgttttccagatcgagccgccaggcgcgcgggttcaggttgttgccagtgagcagcatccactcatcgtcaacccacatgcctttcaggtggtagctgttatcgtcatccttccacaggcggacgatcagctgatcggtattgacataatactgcagccggctgaggaaacgccgcaggttgatctcatacagatagggaagggcgccgatgattttaaacggctgatcttcaggaatgtagaaatcgttagccgttttatcgccgacaataatctccacctgttttccgtcgcgcagcagctggatgatatttcttaccagtacggcagggaggttgaagtagggggtgcagatcgtcagcttgtgttcggcacagggcatcaggtgaaagatggttttattcagcaggctcgatttacccaggcctaccagcggggtgacggagagttcttcgtcaccagcggtgccgacaaaatggtagctgcggtcgcggagctcctgacggtactggcgaatgtcgtttttgatttccgggcttcttggccgatccggtctgtcgagacggttaacgccgcgcccctgaaccagattgttgtcgacccagtcgaacatgatgtccgccattttgccgttacggatgcactgatagcgatcatagcgatacttatcatgctgatgcagataaacatcattcaggctggcgccgctgtagaggacgcagtcatcaataataaagcctttgaaatggagaacgccgagcgcctcccgggtgttaatcggcacgccgtaaacggggatatctacccctggattttcattggccatccgacaataccagtcggcattggtattagaggcggcggcgccgatacggccacgctgagcgcggtgccagtccaccagaacgcggacatccagttccggacgctggcgtttggcgtcataaagggcctgcaaaattccttttccgccatcatcttgctccagatagagcgcaataatgcatatacgctgagtggcgtgggcaatccgggtcagtaa

SEQ ID NO: 4389 - DNA, 1128 bp, Klebsiella pneumoniae
tcccgcgatacttcgccgggaacagagcggctcaaaggtggacttactatgcagattggttttatcggcctcggcgcggtggtggaaaccgcctatttaccggcgctgcgtcgcctgggggacgtcatcgaccgctgccagggctatgacctggactgcagcagagcgctgccggggatccagcgctgtagttcgctgtcggcgctgctggccgaacccctggatacgctcttcattaccacctcatcacttcagcatctgcccgtactggagagggcgttagccagcggcatttcccgcatcgtggtggaaaagccgatcgtggccaaccttgagcaggccgcccggctgcgggcgctgctggcgccgcctgagcaggccgcgcgggtgctggctcttgaccactggatggcgcgaggcgttgcgctgaacgctcctggcccgctgtggcgggcggaaggggaggccagcggcttgcctccgccgcacctgtcagcgcaggatatcgtctggctcgaaggctctttgcaggagccaagcggctttaacagcgctggtgagccggtcgcactcaattttgccaccggggagctggatacccggcagctgcgtcaccctgatggggtgatcctcgatatcggcacccatgtcctggcgatgctccgcgaaaccctgcacgccagcggaagcgatacggcgctgagcctttcccttcgggtggcgaaagaccgcctcggccatgacattgctccaggggataccagcactgccgagggcgtggcgcatctgcagggaaccctgggcactatcccgctcaatatctggctcaacaaatacgcgggtcccgcgggcgggcaaaagggaatgcgaataggactgcgggacgggcaaataatcaccctcgatcgcgcccctgagggcgaagtggtgacgctacaggacggcgagcgggtgcagcgctggacccggcccggggcgatctatacgcactgtcttgatgagcagatcctcggcgcggataatttgtttatccgggcgccggacagcgtggccgggctaacgcagcgtaggcttgaggaagtggaatggctgctcaggttgcagcagcaattacgcggcccgcattaa

SEQ ID NO: 4390 - DNA, 537 bp, Klebsiella pneumoniae
gttatctgtacgttgaggagcaattgcagacgctggtttagtcataaacgaacgtggcggagcgcaaatttgtgtattacgtttaaatcacacgtctctcataacgagctgattatgaacacactccgctattttgattttggcgcttcccgctctctgttgctgcttatcgcccgcatcgccgtggtgattctgtttattctttttggctaccccaaactgctgggctttgacggtacggtgcagtacatggccgcctccggcgcgccgatgccgaccctggcggcgattatcgccgtcattatggaagtgcctgccgcgattctgattgtgctcggctttttcacccgcccgctggcggtcatctttattttctacaccctgggcacggcggtgattggccatcactactgggatatgactggcgatgcggtattgccgaacatgattaacttctggaaaaacgtcagcatcgccggcgctttcctgctgctggcaataaccggccccggggcgatctccctcgaccgccgctaa

SEQ ID NO: 4391 - DNA, 231 bp, Klebsiella pneumoniae
tgcgcctccactgacacggaacaacggcaaacaagccgccgggccaggaggattcagcgacggaaatcgacgttgaaagccgacagagaaaagcaaaataagcgcttgactctgaatgaggaaaacgtattatacgggacctcgcgacagagcgctaaagcgcgtcgcaactgctctttaacaatttatcagacaatctgtgtgggcactcaaagtgacatggattcttaa

SEQ ID NO: 4392 - DNA, 795 bp, Klebsiella pneumoniae
atacgatccaccttctttctctcctgtagcgagcagcttaccgacagacggcatgattattcgtggattatgaataatgaaaacaatttacgcacctttttacgcttaatcgcctggcgtatcgttgcacggtggattacgaaagggggcccgaaaatgaacatgccctcaataaatatccagataatcattacgttaaatagcatgcacaaaggaaaaaccatgtccgttcagcctgtcgaaataagtaaggcctatcgtttattgcaggtcgggtccaccaccatgatttccgcaaaatatgatggcgtcgaaaatgtcatgtcagccgcctgggttgggctggcaggcgagcgaaaagtggtggcctatattggcacccaggctttcactcgtcagctggtggaaaagagcggctatttcgtggtgcagatccccgtagtcagccagatggcaaccgtcttctacgctggcgggcgcagctatgccgacgcgccggataaaaatgacaccatccccttcttttatcagccggaatttgatcttcctcttgtggcaggctgtgcgggctggctggtgtgcaaagtgatgccctacccggacattcagcagcaacacaatctgtttatgggcgatatcgtcgccgcctggagcgatgaccgggtattccgcaacggacactggatctttgatgatgcgccggacgagctacggaccgttcactatgtcgcaggcgggcagttctatgccatcggcaaaggcagcaaattcgatcatgggccgggtcaggactga

SEQ ID NO: 4393 - DNA, 864 bp, Klebsiella pneumoniae
cgcgtatacacaggaggcaaaatgaaacagctacaccacagcggcctgccgctgtatctcgatgacgatggcgtgatggcgctgaaaccgccgctgaactatctcggctttggccgtaaaagcgccgggcagatggcggtggttttaccggagttcaccgaagcgcagcgtgatgaactggcttacgatgtctatcgcgggctcagctttgcggaggatcaggaacggcttgctgctgaccagtatcagtacgacatcaccatcatcatgccgggaacaattggcaaggagcgcaagaaaaccagcggtcactatcacggctataacgacacgcggcgcaacacccatccggaagtgtatgaagtgattaagggcacggcggcatatatcctgcaaaagtcgccggattttgccgtcgcgccaaaagatctgctggtggacgatcttatcgtggcggtggtgaaggaggggcagagcattatcgtgccgccgaattacggccactgctccattaatatcggcgacgggccgctggtgttcagcaacctggcctataaaccctgcgcggttcactacgacacggtgcagttttaccacggtatggcctgctacatcgtggaagagaacgggcagctctgcgtgcgcaagaatcactactacccgcgtattccgcgcatcaaattcgccaccgtcaaagagaacccgcatcttggcatcaccttcgatacgccgctttacctgcgctaccgcgccgcaccggaacgttttcattttctggggcatgtcgataactatgtccgggaaatcacggggatgctccagtatgaggatgatttattcccgctctttcaggaggacgcatga

SEQ ID NO: 4394 - DNA, 306 bp, Klebsiella pneumoniae
agagcacacactgttcttcatcctgccggagggctggcgggaaatgtgccggggattcagtcccgccagagcagccagattatgtctggaagcggaatgccttctgcccggcagcgacgggaaataccagtcgcaggttcgcctgccggagatcggcaaaaccagggtctatcggctcacctcccgcatcctcagtatctgagtgcggtctcgcgtgtttcaaaaaaaggtggtacagggtgggacaagtggtacacgcagggctggtgcgggttacagcgtcccaccttagagaatctagtttaa

SEQ ID NO: 4395 - DNA, 309 bp, Klebsiella pneumoniae
atttgcataacaccaccaccgcggcgcctggcgcgccgcactgaaaaaagagaggtaacgatgaaaggtgcattaggcaaaaaggaactgctggcggccgtgcctgtatcgatgagcactatcgaccgcatggagaaaaacggggagttccctaagcgtttctggatcacagacaagcgctgcgcctggaacagcgaagagatcgagcgctggctggatgaacgtcagcagaacggcacaacggagtttgctggaaaaaagcctccggttgagcagcgagtatttcgcccggttggtaacgcggcgtga

SEQ ID NO: 4396 - DNA, 1194 bp, Klebsiella pneumoniae
cgtgtaataacgaggccggaaaatattatgtctgaacaaattgtcacgcctgataccgccgctctgacggtgccgaacaaagatgccaaaatcaacctgctggatttaaaccgtcagcagatgcgcgagtttttcaaaaacatgggcgagaagcctttccgcgccgatcaggtgatgaaatggatgtatcactactgctgcgacgactttgatgagatgaccgacatcaacaaagtcctgcgcagtaaactgaaagaagtggcggagatccgcgccccggaagtggttgaagagcaacgctcaaccgacgggaccattaaatgggcgattgccgttggcgatcagcgcgtcgagaccgtctatatcccggaagaagaccgcgccaccctgtgcgtctcctcccaggtaggctgcgcgctggagtgcaaattctgctccaccgcccagcagggctttaaccgcaacctgcgggtatccgaaattatcggccaggtctggcgcgcggcgaagatcgtcggcgcggtgaagaccaccggcgtgcgtcccattaccaacgtagtaatgatgggcatgggcgagccgctgctgaacctcaacaacgtcgttccggcgatggaaatcatgctcgacgatttcggctttggcctttccaagcgtcgtgtgaccttgtctacctccggcgtggtgccggcgctggataaactcggcgatatgatcgatgttgcgctggcgatctccttgcacgcgccgaacgacaccattcgcgacgaaatcgtcccgatcaacaaaaagtacaacatcgagacgttcctcaactcggtgcgcggctatatttcgaagtccaacgccaaccagggccgggtgaccatcgagtacgtgatgctggatcacgtcaacgacggcaccgagcacgcccatgagctggcggcgctgctgaaagatacgccgtgcaagatcaacctgatcccatggaacccgttcccgggcgcgccgtatggccgcagctccaacagccgcatcgaccgtttctccaaagtcctgatggagtacggctttacgaccatcgtgcgtaaaacgcgcggcgacgatatcgatgccgcctgcggccagctggcgggcgacgtcattgaccgtaccaagcgtacgctgcgtaagcggatgcagggcgaagcgattgacgtaaaagcggtctga

SEQ ID NO: 4397 - DNA, 483 bp, Klebsiella pneumoniae
ttcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtag

SEQ ID NO: 4398 - DNA, 789 bp, Klebsiella pneumoniae
agtagccaaactatgtcagatacaaaaaatgaattagaaaccctgctggaaaaagcggcgactgagcccgcccatcgtccggcatttttcagcgcgctgctggaggccaccgtctgggtgccgggcagggcagccgatggcgagcagattgtcgaagatagcgcgctggatctgcagcattgggaaaaagacgacggtacctcggtgatcccattctttacctcgctggaggcgctgcagcaggcggtggcggatgaacaggctttcgtgatgatgccggcccgcacgctgatggcgatgacgctgggcgaatcgttattcctcaacccgaagctgccgagcggcaaagagttcaccccacgggaaatcagccatctgttaggcgaagagggcagcccactgagcacccagacggtactggaaggcggcgaagcgctgctgctgtctgaagtcgccgaaccgccggcgcagatggtcgattcgctaaccacgttgttcaaaacgctgaagaccgtcaagcgggcgtttctgtgctcgattaaagagcgcgccgacgcgccggcaaacttattgatcgggattgaagcggaaggagatattgaagccattatccagaccaccggcagcgtggccaccgataccttgccaggcgacgaaccgatcgatatttgccaggtggtggaaggcgagaagggcatcagccactttatgattgcccatatcacgccgttctatgaaaagcgctggggcagcttcctgcgcgattttaagcagaaccgcatcatctga

SEQ ID NO: 4399 - DNA, 2529 bp, Klebsiella pneumoniae
aaggagctgactatgccaaccgttccgcaatatcaacgccagagccagacgcaaaccgcgccggtgatgacgagtaatcttcgtgtgccggaaaatccgctggtgcagggcatccagcaggctgctgatacgtcgatcaatatgatggctgatgcaaagcgcaaggctgatgtcgcgcttagtcaggatgctctgctgcagtttaatcagttcggtgatgaccagttcaacaatcctgacaatggtctgataacgaagcagggaaaggctgcgctcgggcaaagcgatgtcgtcatgcagaacatgcagcagaaagctcaggacttgctgggtacagtgccggatggcgaggcccgtcagcagttatcttttcaattgcagcagtcgatgcagtcatttcacaaccaggcccgccggtatgaggtgagccagttccagcagtttcaggatcagcagttctccgctatcaagcaaaacgtggtaacccagtctcaggggctctatggtgatgatacagcgtttgttaatacggtaaaaatggggtttgatgcgatagagcagtacgccgctgcccatggatggagccaggaacaggttatagcggaaaaagaaaagctgaaagagcaggcggcagatagcgcgctgagtactgcagcatcgcaacagtatattcagttcatgcagcagaatggtgagcctggagacaatgagggcgcgccacgtgttacagcgcatggtaattcatcagccgccagagggctgcggaataataatccagggaatatcgaagccggttccaattcgtgggatggccaggcgggtagtgatgggcgttttgcgaaattcgtgacccctgagcatggtattcgtgcgctgggtaaaaacctgctttcgtaccagcggcagggttacgacacagttagcgagatcgttaatcgttgggcgccggccagcgatggcaataacacagaagcgtacattgccgcattatgcaaaaagctgaatgtcacgccaaatgaccagcttaatatgagcgacattaataccctgcgtcagctctgcgctggcatcatccagcacgagaacgggaaacagccatatagcgaggatcaactgaacactggcgtttctgccgcgcttggtcttactactctggaatcgcctaagcgatattcagggaatcaagctttcgacgccgcaagcccgcagcagcaggcggcatatttacgccagtctatggagctgcggaaccaggctcgtacgcagttcaaggcccaacttgttgatcaggtgcaggatgcaaccgctgcttatctgaaggggatccagttcgataatccgccttcacagggcgacttcattaacgctttcggttaccgggaggggacacagcgttttaacgatttcgaaaacctgcgcgttgccgggcagtatatcggatctttccgcacaatgccgacggcatccattcagcaatatgtcagtgatcttaagaatcaggttggtaatggagaaggtctggcagggcgcgcagcagcattcgaccatgttcaggctgctgctcagaggataattagccagcgtcagtctgacccgtttcagtctgctgtcgatattggagcctataagccaatcagcaacagtactcctgatgccattgcgtcagaggtgaaaaatcgctatgcggcgcaagaccagctgaaggctataggtatcactccaccactgctgtcgaaacaggaatcgcaggttttgactgatgcagtccgaaattctacggatgtaaatcaggcgatcagtctgttgcaaggattagggagaaccttaccgccgaaggcattgcgcagtgttgcatcatcgatcgcgccaggcagtccaggaaccgcatacgcagcgctgctgctgggacagcaggataaccagtacgacaaccgcagcggcatcatcccttacagccagttcgtatcctacaagcctacgctggataaatacgatgtcgctaaaacggtgctggctggcgatcaaatgctgaatcccaccaaggcgatgaaggacgcggggatcagcgcggtcagcattccttctgatgaaaaactaaaaacctacttcgacaaagaagtcggtaacgcctttgcctacagcgcgcaggcgcggcaggtggcgtggggtaatttccggtcagcatacgcggcacttgcctatcaatctggcgatgcatctaaaactaatacggtctctcccgacagtgatattgcagagaaagccgcgcaatatgctacgggtggcgtgtacaaaggcctgaacggcagtgacgtagtcatgcctttcggtatggataagaccaccttccgggaccggtacacggccgcagggcgagaggctatgactcaggcgggattaaacccttcatcgttggaaaactttaaggcggtcaatgtcggcaataaccagtaccgcctcgtaaacggtagcggtcgttgggcgacagatccgcggactaaccagccggtaactgtgagggttgaataa

SEQ ID NO: 4400 - DNA, 738 bp, Klebsiella pneumoniae
ctggttatgacgaaactgattgtaccgcagtggccaatgcccggcagcgtggcggcctgtagttctacccgcatcggcggcgtgagtctgccgccctatgactcgctcaacctgggcgcccattgcggcgacaatctgcaggatgtcgaagaaaaccggcggcggatgtttgccgccggcggcttgccgtcttacccggtttggctggagcaggtccatggcaccgaggttctgacgctggacggcggaccctatccgtcgaaacgcgcggatgcctcttatagtcgtacgccagggaccgtctgcgcggtgatgaccgctgactgcctgccggttctgttctgtaaccgcgacggcaccgaagtcgccgcggcgcacgcgggatggcgcggcttatgcgaaggggttctggaagcgacggttgctcgtttcgccgataaagccgaaaatattatggcgtggctggggcccgccatcggtccgcaggcgtttgaggtgggaccggaagtccgggatgcctttatggcgaaggacgagaatgcgcaccgggcctttcgtccggcaggcgaaaaatattttgctgatatctaccaactggcgcggcagcgtctggcaaacgtcggcgttgagcagattttcggcggcgatcgctgcacgctaagcgaaaaggatgattttttctcttaccggcgcgacaagaccaccggtcgtatggcaagtttcatttggctgatataa

SEQ ID NO: 4401 - DNA, 297 bp, Klebsiella pneumoniae
tgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtctttcggagcctgtcatacgcgtaa

SEQ ID NO: 4402 - DNA, 936 bp, Klebsiella pneumoniae
agcatgaagaccatttatacaagccaatcgaccagggaaaacctagatttgctttatgcgcaggcctgcatttacgacaatgtgaaaaactggaataagttaaatttcaccttcagtattatcataccactgctactttcggtcttgacggtttacaaccgaagcctgaaatttgtcgatatagagctgctatcttccctgttgggactgtacgggttgctcgtgctcactttgaacattgccgtcagtagtcacattgcgtcactacgcagaaaggccgcgtcggttcaggagatgtacgactgtcgggtgcttggcatacggcgtaatgaactgaaagtggaggagatcccccgggacgagatctgcagggcagctgaacgtttcaaaaataatcaggcaaaagcaaataagcgatttggcgatgagggatggtacgtcagtaaggtgtatgacgcgccgcatagtgtgatggcactcctgtgtcacgggaaaaatctcggctgggacaggtcgcttagggaagtaatgcatgtgttttatctgtcagctttcattatcgctccagtggccatgattatttacggcatagtaatgaaatcaggaatgaatgaaatccttttctatatagtgtttacgatgccggttatccgctattttttgcttcagtttctggataaccgcagcagcatgaagagaagtgaaaaactgaaaaagtatgttgagaaggaaatatccagtatcagagtgtctggccgcattgaagaggagaagcttggatatacactcaggaatattcaggatgaaattttttcctatcgagtttcatgtccacccgttccgaactgtatccagaggctgatgaagggcaaaaatgagcggatttatgatgattatttcgagtcaaatctgaaaatgatgcacctgtcagactga

SEQ ID NO: 4403 - DNA, 309 bp, Klebsiella pneumoniae
acgcgtcctgcaggtagtcaatttcgtcgtcggccagcgccagacccagacggaggttggcgtcaatcagcgcctgacgcccttcgcccagcaggtcaacgctggtcaccggcgtcgggtgatggtgagcgaacagcttttcgcccgcttccagcgcgtcgaagacgctctccatcatgcggtcgtgcagctccgccgccaccgcggcccactgcgcttcggtcagggttgaggcttcaacgtaatacgccacgccgcgctcaagacgcacaacctgcgccagaccgcagttgtgagcgatatcggtag

SEQ ID NO: 4404 - DNA, 2922 bp, Klebsiella pneumoniae
gccaaccatgccttccagcagcagggatgggctttgcgtcacttccaccaggctaaagcgcgcttcaaagcggtcagactggttgcgcacaaagcgcggccacaggtcgctgcccgggatcagctcgcgcaggttggacatcatctgacagccgttgcacacgccgagcgccagcgtctgcggacgatggaagaaggtcgcgaactcatcgcgcacgcgctcgttgaacagaatcgacttcgcccagccctcgcccgcgcccaacacgtcgccgtaggagaagccgccgcaggctaccagggcatggaaatcgcccagaccggtccggccggccagcaggtcgctcatatgcacgtcgatggcgtcaaagccggcacgatggaaggcggccgccatttcaacgtgggagttcaccccctgctcgcgcaggacggccactttcggccgcgcgccggtggcaatgtacggggcggcgacgtcgtcgttaatatcaaacgagagcttcacattgaggcccgggtcggcatcattggctttcgcctcatgctcctgatcggcgcaggccgggttgtcgcgcagacgctgcatctgccaggtggtttccgcccaccacatgcgcagcgtggtgcggctttcgctgaacaccgtctgaccgccggcggtcagcacgaagcgatcgccctcaaccgctttaccgaggtaatgcacgcagtccgccaggccgttaaccgccagaatggcttccaccgcctcacggtttgcggcgcggacctgaatcaccgcccccagctcttcgttgaacagcgcggccagatggtcgtcgcccagcgcggcgatatccgcttccacgccgcagtggccggtaaaggccatttccgccagggtcaccagcagaccgccgtcggagcggtcgtggtaggccagcagtttacgctgcgccaccagggcctgcatcgcattccagaagcctttcagttgcgcgacatcgcgcacgtcagccggcttgtcgccgagctggcgatagacttgcgccagcgccgtcgcgcccagcgcgttgtgccctttaccgaggtcgatcagcagcagggcgttatcttccgtcgaaagctgcggcgtgacggtatgacggacatcttcgacacgggcgaaggcagagatgaccagcgacagcggggaggtcatctcgcgctgctcgctgccttcctgccagcgggttttcatcgacatagagtctttaccgaccggaatggtcaggcccagcgccgggcacagctcttcgcctaccgctttcaccgcctcatacaggccagcgtcttcacccgggtggccggcggcggccatccagttagccgacagcttcacgcggttcagctcgccaatctgcgtggcggcgatgttggtcagcgcttcaccgaccgccagacggccagaggccgcgaagtccagcagggcgaccggggcgcgctcgcccatcgccatcgcttcgccatagtagctgtcgaggctggcggtggtcaccgcacagttggccaccgggatctgccacgggccaaccatctggtcgcgggcgaccataccggtcacggtgcggtcgccgatggtgacgaggaaggttttctcggccaccgtcggcagatgcagaacgcggttaaccgcatcggcaaggataatcggttggcgatccagcgcgctaccctgagctttcagagtctgcacgtcgcgggtcattttcggcgttttgccgagcaggacgtccagcggcaggtcgatcggctgatcgttaaagtggctgtcgctcaggctcagatgctgctcagcggtagcttcgccgataacggcataaggcgcgcgctcgcggcggcacagttcgtcgaacagcggcagctgctccggggcgaccgccagaacataacgttcctgcgattcgttacaccagatctccagcggactcatccctggctcatcgctgagaatatcgcgcagctggaatttaccgccgcggccgccgtcgctcaccagctccggcatagcgttggagagaccgccggcgccaacgtcgtggataaagaggatcgggttggcgtcgcccaactgccagcagcggtcgatcacttcctgacagcggcgctccatttccgggttgtcacgctgtacggaggcgaaatcgagatcggcatcggactggccggaggccatagaagacgctgcgccgccgccgaggccgatgttcatcgccgggccgcccagcacgatcagcttcgcgccgacggtaatctcgcccttctgcacgtgctcaccgcggatgttgccgataccaccggccagcatgatcggtttgtggtagccacgcagctcttcgccattgtggctggtgactttctcttcataggtgcggaagtagccgttcagcgccggacgaccaaattcgttgttaaacgccgcgccgcccagcgggccttcggtcatgatgtccagagcggtgacaatacgatccggtttaccgaaatcttcttcccacggctgttcgaagcccgggatacgcaggttggaaaccgagaagcccaccaggcccgctttcggcttcgcgccgcggccggtggcgccttcatcgcggatttcgccgccggagccagttgccgcgcccggccatggagagatggccgtcgggtggttatgggtttccaccttcatcagaatgtgcgccggctcctgatggaagtcgtagcgcccggtctgatggtcggcgaaatagcgcccgacttcagacccttccatcaccgcagcattatctttataggccgacagcacgtagtccggcgttttttcaaaggtgtttttgatcattttgaacagcgacttcggctgctgttcgccgtcgatgatccagtcggcgttgaaaatcttgtggcgacagtgctctga

SEQ ID NO: 4405 - DNA, 849 bp, Klebsiella pneumoniae
caaggagtcgctatggccgcaaatatcgtttctcccgcgcagagcgggcggttctattatggctgcgccggcgccgccgggctgctggcgggcctggcgatcgtattctggtttccagccctggccagctggtggccgtcagatctggtgcgtgtctaccacgccatgccgtatgttatgcgattcggggtggcgagtgtcgcggatattccgctggtggcctacgccaccctaacgctgtcgggcttcgtgctggccttttgtcatcccggtcacagtaaactgcccattgttgcctgggctgtgcataaccagccctcgccgcgggagatggtcgactggatcctgcgcagctgggtgttgcagttcggttttctggtgatcattttctggcgtttcgcgtttatgggtaagctaagcagcgacaggctaatgcagatcgtgggcatctttaacgacgtatgctatctggccacgctggtgctggctggaatactgctgcgcgacggctggcgcgactttcagggcgttgccgcaccggcaggcaatattcgcattccgctgatctttgccctgagcttttatctgccgtttcagctggtatggattttactcagtgcgcagcagtatgagctgccgctgtggggatggctgctgctggttccggcgatggtcggcgtgctgttagcccgcctggcgacggtagggatagcgctgtgtttccggcgctggctggggacgcagggctgtctgcgctggcgcggaccgctggccttatttagcggcctaacggtgctctgtattggcggcaatgcggtgattcgccagatcctcaacatgataaaatga

SEQ ID NO: 4406 - DNA, 594 bp, Klebsiella pneumoniae
tttattcccgctctttcaggaggacgcatgatggaaacgcaatctgttgcaggcgttgcctgtagcgacctgaatcaggcgatgtcgcggattgatggcgctgcgctggcgcgtctggagcaggccatcgctgaagcgaacgcgatatttgtttttggtgcagggcgttcgctgttgatgctgaaagcttttgcgatgcgcctgatgcatatcggcctgaaggtgcatgtggtcggcgatgtggtgacgcctgcgctgcaagaaggcgacctgctgctgctggccagcgcatcgggtgaaacggcttcgctggtgaatgtggctacaaaagcgaagaagctgggcggcacagtggccctgctgaccattttccccgagtccacgctggggaaactggcggaggtggtggtcaggatcccggcctatacagacaaactcccggatgggcccgataacgtgaaaggcattctgcccggcggcagcctatttgaagaggccgtcatggtgctgggcgacgccatgatagtgaatctggcgcagtcgacgggatatcgtttaaccaaaggttttgcgctacacgccaacctcgaatag

SEQ ID NO: 4407 - DNA, 708 bp, Klebsiella pneumoniae
agttcaaccgcttatcaggcgttgacgatagcggaatactggaaaagggtatcaggcatgcagaaagaaaaactttcggctttaatggatggtgaaacgctggataacgaactgctcaacgagctgagtcgttcttctgagatgcaaaaaacctgggagagttatcaccttatccgcgatacgctgcgtggcgataccgctgaggtgctgcaatttgatatctccgcccgggtgatggccgccattgaaaatgagcccgttcgtcagacggctccgcttattcctgaatctcagcccgcaccgcatcagtggcggcagatgccgttctggaacaaggtgcgtccgtgggccagctccctgactcaaatgggcgttgccgcctgtgtatcgcttgcggttatcgtcggcgtccagcactataatggtcagtctgattccgctcagcagccagaagcgccggtgttcaatacgctgcccatgatgggtaaagcaagcccggtaagtcttggcgtgccggctgacgcgtcagcgggaagcggccagcaggcgcaggtccaggaacagcgccgccgaattaacgccatgctgcaggactacgaactgcagcgccgcctgcacgctgagcagcttcagtttggccaggcccagactcagcaggccgcagtccaggtaccgggctatcaaactttaggaacacaatcgcagtaa

SEQ ID NO: 4408 - DNA, 1044 bp, Klebsiella pneumoniae
agcggatgcgccgccggaggatatggcgctgggcagctattttgcccagaaggtgaccctgacatgtcagtaatttttactccgcgcgcgcgatcttcgcgctggaaagcgctgtggccgctggcgctgttgctggctgtgagcatcatcggcggcatttggctgtggcgggcgtggccgcaggtgctgatgcagagcgcagtctggcagcgttcgctcaatctggaactcagccggctgctgcaggcggtggcggagaacccggcggcggcagggctgtcgctgctggggtttagcttcgtttacggggtgctccatgccttagggcccggacacggtaaaattgtcattacgacctggcttgccacccatcccgcgaagctgaaatcaagcattggcctgacgctggccgcctctttattacaggggctggtggccatcgcgctggtggtcgtggtgctggcgctgctgcagctgccggcgcgccagctgcacctcagcagtttctggctggagaaggggagctatttgctggtgggtgcgttagggctgctgctgtgctggcgggcgttaaaaaagctgcgtctgctgctgcgccggccaacgtttaccgcttttaccccgcatcatgttcataacgaacactgcggctgcgggcatcagcatctcccggccccggagcagctgcaggccggcgacgactggcgggctcgcgccgcgattgtcctgtcgatgggcatgcgtccctgctcgggggcgatcatggttctgctgttcagcaaggtaatcggcgtttttggctgggggatggcggcggcgctggcgatggcggcgggaacctcgttgactatcacggcgctggcgctgttggtgcatgggttccgccaactggcgatccgcctcagtcgccatcaggcgccagcgttatggaagcaggttagttgggcgacgctggcgctggccggcggcgtcatattgctggcggcggcaggggtgatgtggctcagcgccgtccctgccggcggtgggatccgtccgttttag

SEQ ID NO: 4409 - DNA, 312 bp, Klebsiella pneumoniae
ccgttcagcgccggacgaccaaattcgttgttaaacgccgcgccgcccagcgggccttcggtcatgatgtccagagcggtgacaatacgatccggtttaccgaaatcttcttcccacggctgttcgaagcccgggatacgcaggttggaaaccgagaagcccaccaggcccgctttcggcttcgcgccgcggccggtggcgccttcatcgcggatttcgccgccggagccagttgccgcgcccggccatggagagatggccgtcgggtggttatgggtttccaccttcatcagaatgtgcgccggctcctga

SEQ ID NO: 4410 - DNA, 372 bp, Klebsiella pneumoniae
cgacccagcgccgacagtggcgttatactgcctgagctgctcacggatggcaacgagctgctgctgcagccggccagcgcgagcggcagcatcaagagcatcattgcgcgcctggtcgatcctctgctgcgcttctcgctcattggtttctttctcctgttcgtcatgttgacgggctttatcatcttctgctttgcggtctgccttcgcctgcgcatacccggcgtcgtactgtctgtcaccgtgaatattccatgctacaacgcctccggccaccagagcagcaagcatcgacacgataagcaactgtttccagtacgctttcacgaattccgtgatcatgatgccagtaccttcttggccgacaggtaa

SEQ ID NO: 4411 - DNA, 333 bp, Klebsiella pneumoniae
tgctgctcagcagccagcggtgacgcaatgacttattgcctgagcgaagaagagcgtgaagaacgtgcagcagatgagctcaaaaggcagcagttacggcgcgagaacgaacttaatgacctgcgcctcatctgcgggacagaacacggccgccgtttcatctggcgcctgattgagcaggctggcgtgtggcgtacgacttataccggtgaggcgctctcggcagccttcgccgaaggaaaacgtaacacgggactgaaagtcttttccgacgtgatggaagcgtgtcccgatcagtatctggcaatggccaaagaggccagcgaggaatag

SEQ ID NO: 4412 - DNA, 1866 bp, Klebsiella pneumoniae
ttttcggaagcaattatggccttattacaaattagtgagcccggcctgagcgccgcgccgcaccagcgtcgtctggcggccggtatcgacctgggcaccaccaattctctggtggctaccgtgcgtagcggccaggccgagactctgcccgatcatcaaggccgctatctgctgccgtcggtggtgaactaccacgcttcggggctgaccgtcggctatgacgcccggcttaacgccgctcaggatcctgccaataccatcagctccgtgaagcggatgatggggcgctctctcgccgatattcaaaaccgttacccgcatctgccgtatcagctgcaggccagtgaaaacggcctgccgatgatccagaccgccggcggcctgctgaacccgattcgcgtctccgccgatatcctcaaagcgctggccgcccgggcgaccgaagcgctggccggcgaactcgacggcgtggtcattaccgttcccgcttacttcgatgacgctcagcgccagggaaccaaagacgcggcgcgtctggcgggcctgcacgtgctgcgcctgctcaatgagccgaccgcggcggctattgcctacggcctcgactccggccaggaaggggtgattgcggtctacgatctcggcggcggcacctttgatatctccattctgcgtttaagccgcggggtgtttgaagtgctggccaccggcggcgactcggctctcggcggcgatgatttcgatcacctgctggctgactacctgcgcgagcaggcgggcttcagcgaccgcagcgataaccgtctgcagcgtgagctgctggatgccgccatcgcggcgaaaatcgccttgagcgatgccgaggcagcgcacgtcgaggtcggcggctggcagggcgatatcacccgcagccagtttaacgatctgattgccccgttggtaaaacgtaccctgatggcctgccgtcgggcgctaaaagacgctggcgttgaagcgcaagaagtgctggaagtggtgatggtcggcggttctacccgcgtgccgctggtgcgtgagcgcgttggcgagttcttcggtcgcactccgctgacctccattgacccggacaaagttgtcgccatcggcgcggcgatccaggccgatatcctggtgggcaacaagccggacagcgaactgctgctgctcgacgttatcccgctgtcgttaggcctggaaaccatgggcggcctggtggagaaagtgatcccgcgtaacaccaccattccggtggcccgtgcgcaggagtttaccaccttcaaagatggccagacggcgatgtccattcacgtgatgcagggcgagcgtgagctggtccaggattgccgttcgctggcgcgctttgcgctgcgcggtatcccggcgctgccggcgggcggggcgcatattcgcgttaccttccaggtggatgccgatggcctgctgagcgttacggcgatggaaaaatcgaccggcgtggaagcctccatccaggtgaaaccgtcttacggtctgaccgatggcgaaatcgccaccatgattaaagattcgatgagctacgccgaacaggatattcaggcgcgcatgctggctgaacagaaagtggaagccgcgcgcgtactggagagcctgacaagcgcgctggccgccgacgccgcgctgttaagcgccgcggagcgtcaggccatcgatgccgctgcggagcaggtacgcgccgccgcggcaggcgacgacgctgacgcgattaaagaagcgattaaaaatatcgacacacaaacccaggaattcgccgctcgccgtatggatcagtcggtccgtatcgcgctgaaaggccaatccgtggacgaggtttaa

SEQ ID NO: 4413 - DNA, 699 bp, Klebsiella pneumoniae
cgcaggagagcgttgccgcgcatttgcgcacacttctgggttaatctcccgggaattattagtcaggagaaggactacgtggaaacttttaacaacgagaacgatcaggtcgatgcgctgaagcgcttctttgccgaaaacggcaaagcgctggcggtcggggtgattttagggattggcgcgctggttggctggcgctactggacctcccatcagcaggatacggccagagacgcgtcgctggcttacgagaaggcgacttccgcgctgaaatcgaatacgccagaagtgctgtcaggggcggagaaattcgcggctgacaataaaaatacctacggcgccttcgcctctctcgagctggcacagcattttgttgaacagaacgatctgccgaacgctgaaaagcagctgcagcaggggctggcggccgcatctgatgataatctgaaatcggttatcagtatgcgtctggcccgcgttcagctgcaaatgaaacaggctgatgcggcgctgaaaaccctcgacagcatcaaaggtgagggctggaccgccattgtggccgatttgcgcggcgaaattctgttgagcaaaggcgataagcaaggggcccgtgcggcgtgggaagctggcgtgaaaagcgatgcttctcctgcgctcagcgaaatgatgcgtatgaaaatgaataatttgtccatctga

SEQ ID NO: 4414 - DNA, 678 bp, Klebsiella pneumoniae
agacgcgcggcaacgtcgtgcaaatattcaagatatcgaggtcgcaacatggacattaacgagtttcagaaagctgccggcgttagtctggcgctggccacacgctggcatccgcacatcgtggcggccatgaaagagtttggcattatcaagccgctggatcaggcgatgtttattgcccaggccgggcatgaaagcactggatttacccagctcgttgagaacttcaattacagcgtggcggggctggctggtttcgtccgtgccgggagactgacgcagggccaggctaattccctcgggcggcggcagggtgaaccatcgttgccactggagaggcagcgggccattgccaatctggtgtacagcaaacgcatggggaataacgggccgaccgacggctggttttaccgcgggcgcggtctcatccagaccaccggactgaacaactaccgcgattgcggggctgccctgaaggtggatctggttaagcagccggagctgctggagcaggacgagtatgcggcgcggagcgcggcgtggtacttcgtgaaatatggatgcctgaagtacaccgacgacctgatgcgcgtcacgcagatcatcaatggcggccagaatggtatcgacgatcgccgtgtgcgttacctgtcggccaagaaggtactggcatcatga

SEQ ID NO: 4415 - DNA, 606 bp, Klebsiella pneumoniae
caatttcaggctaaaaaaatagaaatgaaaagcatctacgacataagacgcgacaacctcaatgagataatccggaaggatttcgataacacgcaactccggtttgccgagagaatcaaaaaatcagctaacctcgttaacaggtggagcaaggggacaaaaaatatcggcgccaacgcggcacgcgagatcgagtcgttcgccgggaaaggtcgtttctggctggatatcgaccatctgtcagataccccgacgctgccggagattatcgacccgcaggaatggagtgtggaaaagcaggcagcgtttaccctgggtgtatggatgggacagcatccggatctgaactcagagaaaaaggtttcggaagcggccggtatcggccaggcgaccgtaaatcgcatcctgaactgcgaaggctccaccagcattggcgtactgtcggctatcgccagggcgttcggccgcgatgcatatgagctgatcctgccgcctggtaatgctggtctgattgactatgaccaccatgaatacgccgggctgccgcaggaagagaaaaacaagatcaccgccttcatcaagttcatcgtcagccagaaccagtaa

SEQ ID NO: 4416 - DNA, 213 bp, Klebsiella pneumoniae
tgccgccaggcaaattctgttttatcaacacgtcctgcggacgcatcgactaatctgtatcagctgaaaatcttctcaaatccgccaaaacatcttcggcgttgtaaggttaagcctcacggttcattagtaccggttagctcaacgcatcgctgcgcttacacacccggcctatcaacgtcgtcgtcttcaacgttccttcaggagacttaa

SEQ ID NO: 4417 - DNA, 1497 bp, Klebsiella pneumoniae
ttgtatgaggcatttaacatgatacctgtggtcgcgcttgtcgggcgccctaacgttggaaaatccacgctctttaaccgcctgacgcgcactcgtgatgcgctggttgcggatttcccggggctgactcgtgaccgtaagtacggtcgggccgaagtcgaaggccgcgaattcatctgtatcgataccggtggtattgatggtacggaagagggcgtggaaacccggatggcggagcagtcgctgctggcaatcgaagaggccgatgtggtgttgtttatggtcgatgcgcgcgcgggcctgatgccggcggacatcgcgatcgctaaacacctgcgctctcgtgaaaagcccaccttcctggtggctaacaaaaccgacggcatcgacgtcgaccaggcgatggcggacttctggtcgctcggcctgggcgatatctatccgattgccgcttcgcacggccgcggcgtgaccagcctgctggagcaggccctgctgccatgggtcgatgaggttaatccgcaggaagaggtggatgaagacgccgaatactgggcgaaattcgaagccgagcagaatggcgaagcggaagaagagccggaagacgacttcaatccgcaggatctgccgatcaagctggcgattgtcgggcgtcctaatgtcggtaaatcaaccctcaccaatcgcatcctcggtgaagatcgcgtggtggtctacgatatgccgggcaccacccgtgacagcatttatatcccgatgcagcgtgacgagcgcgaatacgtgctcatcgataccgctggggtgcgcaagcgcgggaaaatcaccgacgtagtggaaaagttctcggtgattaaaacgctgcaggcgattgaagacgccaacgtcgtgctgctggtgatcgatgctcgcgaagggatctccgaccaggacctctcgctgctgggctttatcctcaacagcggccgttcgctggtgatcgtcgttaacaagtgggatggcctcagtcaggaagtgaaggagcaggtgaaggagaccctcgactatcgtctgggctttatcgactttgcccgggtgcacttcatctccgccctgcacggcagcggcgtcggcaacctgtttgaatcggtacgcgaagcctacgacagcgctacgcgccgcgtaagcaccgcgatgctgacccggatcatgaacatggcggcggaagatcatcagccaccgctggtgcgtggccgtcgcgtgaagctgaaatacgcccacgccgggggctacaacccgcctatcgtggtgatccacggtaaccaggtcaaggatctgccggattcctacaagcgctacctgatgaactacttccgtaaatccctggacgtgatgggcacgccaatccggatccagttcaaggaaggggaaaacccgttcgctaacaagcgtaacaccctgacgccgaaccagatgcgtaaacgtaagcgcttgatcaagcacatcaagaaaagcaaataa

SEQ ID NO: 4418 - DNA, 537 bp, Klebsiella pneumoniae
gtacaggaggccgccatgtttctggtctccctggctgaaggctttatccacctgttccaggccgcaggcaaaatcttcctcgacatgatgaccgggcttatcccgatgctcatctgcctgctgctggccatcaacttcctgatgaagctggtcggcaccgtacggatagagaaaatcgccgccctgctcggccgctcgcgcatcctcacctacggcgtgctgccggtgctcggctggttttttatgagcagccccggtgcgctcactttaggcaaactcctgcccgaaaagagcaagcccggctatgaggatgcgctcggcaccactgcccatcccctcaccagcctgtttccccacgtggtgccgtcggagctgttcgtctggctcggcgtggccgccggggttaaggcgctcggcctgcccgtcacctcgctggcgctgcgctatatcgccgccgccatgctgattggcctgatacgcgggattatcaccgagtacctgttcctgcggctcagcaaacgggggaatgcgccatga

SEQ ID NO: 4419 - DNA, 327 bp, Klebsiella pneumoniae
aattttcgggcttttaatatgacaccgggctccgttcctcgatggggcccggttgttttattcacacaagaggatgttatggtaactattcgtttagcacgtcacggcgctaaaaagcgtccgttctaccaggttgttgtcaccgacagccgtaatgcacgcaacggtcgcttcatcgagcgcgttggtttcttcaacccgatcgctaacggtgcggaagaagaaactcgcctggatctggatcgtatcgctcactgggttggccagggcgctactgtttccgatcgcgttgccgcgctgatcaaagccgctaacaaagcagcttaa

SEQ ID NO: 4420 - DNA, 1560 bp, Klebsiella pneumoniae
gcgacaagggcgagtagagcaaaaacaggcataggtgtcggctgttggctaaataagaaagagaagcagtataacgttagcaggcctctgctccaaccgttgcagcacattcagattgatgtcgtgttatactccgccacattcgttttgtgtgtcgctgcggcgaccgaccgtttccacctcaggcgagagacaatgtttgataatttaaccgatcgtttgtcgcgtacgctgcgcaacattagcggccgcggacgccttacagaagacaatattaaagacaccctgcgcgaagtgcgcatggcgctgctggaagcggacgttgcgcttccggtggtccgtgatttcatcagccgcgtcaaagagagcgcggtcggccatgaagtcaataaaagcctgaccccgggtcaggagttcgtcaaaatcgtccgcaacgagctggtggcggcgatgggcgaagagaaccagacgctcgacctggccgcgcagccgccggccgtggtgctgatggcgggcctgcaaggtgctggtaaaaccaccagcgtcggtaagctggggaaattcctgcgcgagaagcacaagaagaaagtgctggtcgtttccgcagacgtttaccgcccggcggcgatcaaacagctggaaaccctggccgagcaggtcggcgtcgatttcttcccgtctgatgtcgggcagaagccggttgatatcgtcaacgcggcgctgaaagaagcgaaactcaaattctacgacgtgctgctggtggataccgccggtcgtctgcacgttgacgaagcgatgatggacgaaatcaagcacgtccacgccgccattaacccggttgaaaccctgttcgtcgtcgatgcgatgaccggtcaggatgcggcgaataccgcgaaggcctttaacgaagcgctgccgctgaccggcgtggtgctgaccaaagtggacggcgacgcccgcggcggcgcggcgctgtcgattcgccatattaccggcaagccgattaaattcctcggcgtcggcgagaaaaccgaagcgctggagccgttccatccggaccgcgtcgcttcccgtatcctcggcatgggcgacgtgctgtcgctgattgaagatatcgagagcaaggttgaccgcgcgcaggccgagaagctggcctccaagctgaagaaaggcgacggtttcgacctcaccgacttccttgagcagctgcgccagatgaaaaacatgggcggcatggccagcctgatgggcaagctgccgggcatggggcagatcccggacaacgtgaaagcgcagatggacgacaaagtgctggtgcgtatggaagcgatcatcaactcgatgaccctgaaagagcgcgctaagccggaaatcatcaaaggttcgcgtaagcgccgtatcgccgccggctgcggcatgcaggtgcaggatgtgaaccgtctgctcaagcagttcgacgacatgcagcgcatgatgaagaagatgaagtcgaaaggcggcatgatgaagatgatgcgcgggatgaaagggatgatgccgccaggcttcccgggtcgttaa

SEQ ID NO: 4421 - DNA, 405 bp, Klebsiella pneumoniae
atcacacattttgacattgggaaaggtatgctggattcaccaagacgggaaagacaagaggtaaaatttatgacaatgaacattaccagtaaacaaatggaaattactccggcaatccgccagcatgtcgcagaccgtctcgccaaactggataagtggcaaactcatttaatcaacccgcacatcattctgtctaaggagccgcagggttttatcgctgatgcaaccatcaacacgccaaacggccatctggttgccagtgcgcgtcatgaagatatgtacgccgccattaacgaattgatcaacaagctggaacggcagctcaataaagtgcaacacaaaggggaagcccgccgcgccgcgacgtcggtgaaagaggcaggctttgtggaagaagaagagtaa

SEQ ID NO: 4422 - DNA, 204 bp, Klebsiella pneumoniae
cacgccgtttatttcactataaaatccaatgccatcaaccttccccgcgtctcattttcagcgcgcaagacgccgtttccgttcgccttttgtttagccgtcacaacagcagacaaaaaaattgtacgattcctcacggaccggtgctattgtgagctaaatgtgtttagtaaattaaacaaagacaatgaatatcactcctga

SEQ ID NO: 4423 - DNA, 192 bp, Klebsiella pneumoniae
tcgaaaagttacgtatattcttcatatttagagttaattatgccttacgagtatcatgaggccgctgtactgtgcctgacgttttttaatccgaaaacgccgcattctacactacatccgcgaaaccaggaaatgctgttagatccagcatacccgcagaaattgtggcgttgtaacaggaaaggtaaataa

SEQ ID NO: 4424 - DNA, 243 bp, Klebsiella pneumoniae
taccattactacccgctaatgtggtcaacaattgcggtcagcgtcgcgcgattatccctgattcaggggcagcgacaggctgacaatcccatcttccagctgaatatcgacggtgaatcccagctttctggcgaggcctatcatgcctcggttattcggcatcgtaataccattaaggcgctgcaagccatggctttgcgtataggcgatcagcttttccagcaaccttcgccccaggcctaa

SEQ ID NO: 4425 - DNA, 1422 bp, Klebsiella pneumoniae
cctgctgatttaaagtttgatcttgctcacatgttaccctctcaatcccccgcaatttttaccgtaagccgcctcaatcagacggtgcgtctgctgcttgagcgcgaaatgggccaggtttggatcagcggcgagatctctaacttcagccagccttcctccggccattggtacttcaccttaaaagacgataacgcccaggtgcgctgcgcgatgttccgcaacagcaaccgccgggtcacgttccgcccgcagcacgggcagcaggtgctggttcgcgccaacatcacgctgtatgagccgcgcggcgactaccagattatcgtcgaaagcatgcagcccgccggcgaagggttgctgcagcagaagtatgagcagctgaaagcgcagttaacggcggaaggactgttcgagcaaaaacataagcaggcgctcccctctcccgcccactgcgtcggcgtcatcacctcgaaaaccggtgccgcgctgcacgatattctccatgtcctcaggcgccgcgatcccgggctgccggtgatcatctacccaaccgcggtccagggtgacgacgcccccgggcagattgtgcgcgccatcgcgctggccaacgcgcgccaggagtgtgacgtactgattgtcggacgcggcggcggttcgctggaggatctgtggagttttaacgatgagcgggtggcgcgggctattttcgccagccagatccctatcgtcagcgccgtcggccatgaaaccgacgtcacgatcgctgattttgttgccgacctgcgggcaccgactccctcagccgccgcggaaatcgtcagccgcaaccagcaggagctgctgcgccagctgcagtccggacagcagcggctggagatggcgatggactatttcctcgccagtcgccagcgccgttttacccagctgttccatcgcctgcagcaacagcatccacagctgcgcttggcccgccagcagaccgccctggaacgcctgcgccagcggatgcgtatcgccgtggagtcacagcttaagcgcgcagaacagcggcaaaagcgcaccgttcagcgtctgaatcactacaacccgcagccacggatccaccgcgcgcagtcgcggatccagcagctggaataccggctggcggaaattatgcgtggccgcctcagcgagcggcgtgaacggtttggcaacgcggtgacccatctggaggcggtgagccccttagccaccctggcgcggggctacagcgtcacctcggtgagcgacggtacggtgctgaagcagacaaaacaggtcaaaaccggcgatctgctcaccacccgcctgaaagacggctgggtcgaaagcgaagtgaagcagatcgcgccggtgaaaaaaacgcgggccagaaagccttcgcccactaaaccagcggaataa

SEQ ID NO: 4426 - DNA, 1575 bp, Klebsiella pneumoniae
gccgaccgatacctcatcatgaaacgcgccccctttctctgtaagcagtctccggaccgcacgctcgaggtggtaatccttgccggaagcctggcatgggagacctcacgcgagtggcgaaaagatcccgaccaagaagatgatgtacctccagtggtactcggcccggatgaactggccgatctggacaacctgaccattatcaggcccgacacactctacgcccgggtattccgcaccggcgatatccgcgaagaagatctgctgaaaatcgccgtaaaactggcgcacgcgggtgtgcagatggcccggctgatgacccctgacggtgaggtactggagaactggaccggacagcttgaacgcctgcgacaggaaaggccttccgacatcctgccggatcactttcgtctcgatgaagaggcactgtggtttgacaagctgaccgagcgacgcgacggcgaaagcgacatccagccccagcgcatctgctcccctctgcgcgttaccgctatcacctgcgacagccatgacggcagctatggccgcctgctggaatggcacaccaccaccgggcagttacggcgctgggccatgccaatggcaatgctcagcggcaacggcgaggagctgcggcgcatcctgctggaaaacggcctgacctatatctccacccgccccgccctgcgcagcctgctgtgcgaatacatctcacggtcacgccccggacgccgggtcacctgcgtggagaaaaccggctggcacaacggggtttacgtgctcccggatgaggttatcggtccggatggcgacagcgttatccttcagggcagccactacctgactggtggctttgcgcaggcagggacgctggcagagtggcaggagcaggtcgccgcactctgtgcaggcaattcacggctggtctttgccgtctgctgtgcgctggccgccccgttgctgcgcctgaccggaacgggcggtggcggttttcacctgcgcggtgagtccaccgacggcaaaaccacggtgatgaaggtggccgcctccgtctgtggcggcacggactactggcactcctggcgggccaccgggaatgcgctggaaggaattgccagccgccacaacgatgccctgctgccgctcgatgaactgcgcgaagtggacccgcgtgaggccgggatgattgcctatatgctggcgaacggtcagggcaaggggcgcgcccgaaccgacggcgaggtacgtaaccgcaggcactggacgctgctgctgttctccaccggggagctgtcgctggcggaacataccgaacgcgccggggagcgcctctacgccgggatggacgtgcgcatggtacaaatccccagcgacaccggacagcatggtgcgtttgaacagttgcacgggtttgccagcggccagcagttcgccgatgccctctgcgaccgggtggcccgtttccatggcaccgcttttcgtgcctggctggccttccttaccagcaacctggacgccagcaccaccctagcaagagagttacttcgccgctaccagaccgccctgacgccgtag

SEQ ID NO: 4427 - DNA, 927 bp, Klebsiella pneumoniae
ccaactggatacggcgagggacgcagcatgatgaataacgttggcagcatggacagaaccaagtatctcggcggcagtgatgtcgccggtattctcgggattagcccgtggcgcactccgcttgagatttacctcgacaaagttcagccacgtattaagccaatagatccagggaaacagagagtgtttacgcgtggccagcgtatggagccatacgtaatcgacctgctggctgaagaaacaggactcgaaatcatccaccgcgggaaccggtacatccaccgtgattacggctttatcgcagctgagattgatgcagaagcagctaccggagagaacatcgagatcaaaacggttagcccgttcaaggctaaggaatggggagaggttcagacagatgcgatccctgtgcattacacggcgcaggccatgcatgggctgatggttaccgggaaacaggtatgcgtatttggtgtgctgatcggcggtgatgacttccgtatctatcgggttgagcgtgacgaagaaaccatccaggccatcctggagaaagaagtctccttctgggacagggtgataaacctcaacccgccggaggccaccagcgtaagcgatatttcgctgatgtttgagaaggacgccggtaccagtattgaggcagacggtaaagctctgtcgctatacaacgaccttagagatatgaagtcacgctgcaaagcgctggaagcagaaatagctgtatcagaagagaaactgaagatttatatgcaggataactcaattctgacgctggatggtaagccgatctgcacatggaaatctcaggttagcaatcgatttgaccaaaagctattccaggcagaacaccctgccctttacgaaaaattcaaaacagcaacgacatcacgcgtattcagaatgaagtaa

SEQ ID NO: 4428 - DNA, 273 bp, Klebsiella pneumoniae
ggaattctgtaccagtgctctgcctccccatcaggcaaagcgaactcggcaggaacaagccctgcggcagcacagagtaaccggtttagcgagaagcagaagaaagtgggagagaaaatcagaaattatttagtgaccgcggaacgggaggcccgcggtcacgccgtgtttacggagcggcaggggccggttcaatcggcagatcgctccgcgcgccccattcgctccaggagccgtcatacaggcagacgccgttcacgccaagcgtggtga

SEQ ID NO: 4429 - DNA, 1548 bp, Klebsiella pneumoniae
agacgcgctcaggagatcgagatgaaaagattcaaccttctgcaaatgttacaaagcatcgggcgatcgttaatgatccccattgccatgctgcctgccgccggtattttgctggccttcggcgtcagctttcaggatctcaatattgtcgccagcctgccgtttctcgccgctgactggctggttcacgtgctgaagctgatggcggaagcgggcagtgcgattttcgctaacctgccgctgctgtttgcggtcggcgtggcggtagggcttagtgacgatcaggggattgccgggttgtcggcgatcgccggttttctgattatgaacgtcaccatcggccagtttcttgggatcacgcccgagtcggtggcgcaggtgcgtgactacacgatggtgctgggcatcccttcgctgcagaccggcgtgtttggcggcatcattatcgggattatcgccgcctggctgtataaacgctattaccgcatccagcttccgtcatggctggagttcttttccggcaagcgatttgtgccgatagtgacctccttcgtcgcgctgtttgtcgggctggtgatggcagtggtctggccgccggttcagcatttgattaatggcctgtcgaataccatgacggtgcaggggccgggcgtttccgccttcctgttcggttttgtcgagcggctgctgatcccgtttggtcttaaccatgtctggtggccgacgttctggctgcagtttggcgagtacgtaaacaaggccgggcaggtggtgcatggcgaccagcttatcttctttgcccagttgaaagaccaggtgccgattaccgccggaacctttatggccgggttgacgcccatcaaaatgttctgtattccggcgattgcgctggcgatctaccgctgcgccagcccggaaaacagagcgcgggtaaagggtattatgctctctggtgcgatcacctccatcgtctgcggtatcaccgagccgattgagttctccttcctgtttgttgcgcccgtgctgtatggcattcacgccgtcctggcgggactggtattcctgctgatggagtggttcagcgtgcacatcgggctctctttctccggcgggcttatcgactatctcttctttggcgtcctgccgcgcgcgcctcactggtacatggtgttcccggtcgggctggtgatgggggcgctgtactacgtcctgtttacctttgccattcgccgctggaatttgctgacgccggggcgtgaagtcgaagaaagcgcagtgactcaggaaagcgaacagaacgacctggtgagcggcatcattctggcctatggcgggctggagaatatgaccagtatcgaagcctgcatgtcgcgtctgcgcattgacgtgacggataagacgctggtggacaaagcgctgctgaaacagcttggcgcggcgggcgtcgttgaggtcgggaacaacattcagagcgtctttggcatgaaatccgatcggctgaaagaggcgatccgcgcagctaacgcgtatacacaggaggcaaaatga

SEQ ID NO: 4430 - DNA, 390 bp, Klebsiella pneumoniae
ccggctgatcagccgtattctctgactatcagccccgcctcgacggggcttttttctggaagcgctatgcgtacgatattagtgattgcttcgctgctgttaaccggctgcagccacatggcaaatgatgcatggtccggtcaggacaaagcccagcattttctggcctcagcgatgctctctgccgctggcaatgaatatgcgcaatatcagggttacagccgggaccgcagcgccgctatcggcctgatgttttccgtcagccttggcgcctcaaaagagctttgggacagccgcccggctgggagcggctggagctggaaggattttgcctgggatgtcgccggcgcgaccaccggctacgctgtatggcagttggctcatcagtaa

SEQ ID NO: 4431 - DNA, 1386 bp, Klebsiella pneumoniae
aacgcccgtcaccagggttgcaatcaccaggatcagggcaaacatgttcgccatgccaactccttagggttatttgccgtctttaccaacgtgcagaatggcgaggaacgcttcctgcggcagctcaacgttaccgacctgcttcatacgcttcttaccttctttctgcttctgcagcagctttttcttacggctgacgtcgccgccgtagcatttcgccaggacgtttttacgcagctgtttcaccgtagagcgcgcgataatgtggttaccgatggccgcctgaatcgcgatatcgaactgctgacgcggaatcagatctttcattttttccaccagctcgcggccgcgatacggcgcgttatcgttgtgggtgatcagcgccagcgcatcgacgcgctcaccgttgatcagcacatcgacgcgtaccatgttcgacgcctggaagcgtttgaagttgtagtccagcgacgcatagccgcgggaggtggacttcaggcggtcgaagaagtcgagaaccacttccgccatcggaatttcataggtcagcgccacctgtttaccgtggtaaaccatgttggtctgcaccccacgcttctcgacacacaaggtaatcacgttgccgaggaactcctgcggcagcagcatgtgacactcggcgatcggctcgcgcagctcctgaatattattcagcggcggcagcttggacgggctgtcgacgtagataacttctttggaggtggtctctacttcgtagactaccgtcggcgcggtggtgatcaggtcgagatcgtattcacgctccagacgctcctgaatgatctccatgtgcagcaggccgaggaagccgcagcggaagccgaagcccagcgcggtagagctttccggctcgtagaacagagaggcatcgttaaggctcagtttgcccagcgcgtcgcggaaagcttcataatcatcggagctcaccgggaacaggccggcatacacctgcggtttcaccttcttaaagccaggcagcgctttgtctgccgggttgcgggcggcggtcagggtatcgcccaccggcgcgccgaggatgtctttgatcgcgcagaccagccagcctacctcgccgcatttcagctcggtacggtcaacctgtttcggggtgaagatgcccagacgatcagcgttatagacctggccggtgctcatgaccttgatcttgtcgcccttgcgcatggtgccgtttttaatccgcaccagcgacaccacgccgaggtagttatcgaaccaggagtcaataatcagcgcctgcagcggcgcgtccggatcgccttccggcggtgggatatcgcgcaccagacgctccagcacgtcggtcacgccgacgccggtttttgctga

SEQ ID NO: 4432 - DNA, 762 bp, Klebsiella pneumoniae
agaggccgtcatggtgctgggcgacgccatgatagtgaatctggcgcagtcgacgggatatcgtttaaccaaaggttttgcgctacacgccaacctcgaatagtcattcgacacaaggaaaccaacatgaaattacagcttgccctggacgagttaaccctgcctgaagcgctagcatttatcgataaggtggttgacgacgttgatattattgaagtgggtacaccttttcttattcgggaaggcgtgaatgcaattaaagccattaaagagaaatatccgcataaggaagtactggcggatgcgaaaattatggatggcggccattttgagtcgcagctgcttttcgacgctggggcagactatgtcacggtgttaggtgtgaccgacgtgctgacgatccagtcctgcatcctcgcggcaaaagaggccggaaagcaggtgatggtggatatgatctgcgtcgacgatctcccagcgcgggtccgaatgctggaggaggcgggggcagatatgctggcggtacacacaggcaccgaccagcaggcagcagggcgcaaaccgattgatgatttgataacgatgttgaaggcgcgccggaaagcgcggattgccgtggcaggcggtataagcagtcagactgtgaaggactacgcactgttaggcccggatgtggtgattgtgggatctgcgatcacgcattcggcggatccggcggatgaagcgaggaagatttcacaggtgttgttgcagcagcactga

SEQ ID NO: 4433 - DNA, 930 bp, Klebsiella pneumoniae
tcatgccgtctgtcggtaagctgctcgctacaggagagaaagaaggtggatcgtattcaggctatgcagatgtttatgcgcgtcgcggaggcaggaagcttcgtgcgtgccgcggaaaccctttccctgccggcctccactgtcaccagtaccattaaaaaccttgaaaaatacctgaaggtgcggctgctgaaccggaccacaaggcgggtgagccttaccccggaagggatgcagtatctggcgcagtgccgggaaattctcgccctcatcgaacatagtgaatccaccctgagcgagtctgtcgcgcggcctcaggggcgcctgcgggttgatatgcccgcgggcatcgcgcatttcatcgtcatgccgcatctgccggacttttaccggcgctatcccgatatctacctgatgatcggcgtcagcgatcgccaggtcgatctcattcaggaaggcgtcgactgcgtgatacgaacgggagagctgaacaactccagcctggtggcccgccctctgggccgctttcgctgggtgacctgcgcgtcaccggactatcttcgggaatatggtgtgccgccgtcaccggaggcgctcactcagcaccgggctgtgcattatttctccggtcaggcgaggcgggccgatgagttccgcttcgtccgccatggcgagaccttttctgtacccgtcagcggcaacgccgcggtgaatgaaacggggctctatataaaaatgtgcctggcaggatttgggctggcgcagctggcggagaatatcgttgctgaccacctgcaggaggggagactggtggaagtgctgacggactggcagccgcccccggtacccgtcacattgctctatccgcaccagcgctttctctctcccgccgtgcgggcgtttgctgagtggatgagcgaggtggtttga

SEQ ID NO: 4434 - DNA, 195 bp, Klebsiella pneumoniae
cacccctgccatttgcgcgataacaatgtaccagcccagcggcgtattcacgccccgggcgctcatcagcgcgatctgcgccggcaaaatcgtctggaacccgagggtaagtatcatgagaagacgcaggtccgccagctgagcgtcgaacgtgcgggccaggcgccgggcgtcacgcaggagcagcacccctga

SEQ ID NO: 4435 - DNA, 1215 bp, Klebsiella pneumoniae
gcgcagcgccacccggcaaggccattaatcagctgtcagcaggttagcaatggtacgcacgccaagcccggtggcgcccgccgaccactgctcaacggcagatttgcggtaggttgccgaacagtcgatatgcagccaaccctgatggtagttttccacgaagtgggacaggaagcccgccgcggtgctggcgccggccggataggccgcgctgccggtgttgttcaggtcagcaaagttggacggcagctggttgcggtggaactcggccagcggcagacgccagaaggcttcgttttccgcctgagcgctcgccagcaggcgattcgccagcgcatcgtcaaagctgaacagcgcgtggtaatcattgcccaacgcggttttcgccgcgccggtcagggtggcggcgtcgatgatcagctctggcttctgcgccgaggcgtcaatcaggccatccgccagcaccaggcggccttccgcgtcagtgttcatgacttcaacggttttgccgttgcgataatgaataatatcgcccagtttgaaggcgttaccgctgatcaggttgtcggcgcagcacaggaacagcttcacacgtttgttcagaccgcgggtaatggcgaaagccagcgcgccggtgatagtcgccgcaccgcccatatcggatttcatcgaatccataaaggcgctttgcttgatgctgtagccgccggaatcaaaggtgatgcctttgcccaccaggcaggcgtataccggcgcctctttatcgccggtcgggttgtagtccagcgccagcaggaccggcgggcgctcggagccgcggcccacggtatgcagaccaagatagccctgctcgcgcagatcttcgcctttggtgatgcgatagctaatcttctcacccgccacgccgcacagcaggtcgacagcgcgctgcgccagctgctccggacccagctcttccgccggcgcattgatggtgtcgcgcacccagtcgatgatcgtcaggcggttatccagctcgctgcgctgcgcgtcgtcaagggatggccattcgacctgacgctgacctttcggccctttatagccggcccaaaaggcccaggcgcgatcggtgttccagccttcgccgctcagggcgacgtgcttgatgcccatgccgtcaattttgcgcgccgcgcgctggataagcccgaggtcgtctttaccgttgagatgtag

SEQ ID NO: 4436 - DNA, 354 bp, Klebsiella pneumoniae; identical to SEQ ID NO: 1586

SEQ ID NO: 4437 - DNA, 1386 bp, Klebsiella pneumoniae
aatggcaaacaagatagccttatgcccttgtttttaacgacccgggaagcctggcggcatcatccctttcatcccgcgcatcatcttcatcatgccgcctttcgacttcatcttcttcatcatgcgctgcatgtcgtcgaactgcttgagcagacggttcacatcctgcacctgcatgccgcagccggcggcgatacggcgcttacgcgaacctttgatgatttccggcttagcgcgctctttcagggtcatcgagttgatgatcgcttccatacgcaccagcactttgtcgtccatctgcgctttcacgttgtccgggatctgccccatgcccggcagcttgcccatcaggctggccatgccgcccatgtttttcatctggcgcagctgctcaaggaagtcggtgaggtcgaaaccgtcgcctttcttcagcttggaggccagcttctcggcctgcgcgcggtcaaccttgctctcgatatcttcaatcagcgacagcacgtcgcccatgccgaggatacgggaagcgacgcggtccggatggaacggctccagcgcttcggttttctcgccgacgccgaggaatttaatcggcttgccggtaatatggcgaatcgacagcgccgcgccgccgcgggcgtcgccgtccactttggtcagcaccacgccggtcagcggcagcgcttcgttaaaggccttcgcggtattcgccgcatcctgaccggtcatcgcatcgacgacgaacagggtttcaaccgggttaatggcggcgtggacgtgcttgatttcgtccatcatcgcttcgtcaacgtgcagacgaccggcggtatccaccagcagcacgtcgtagaatttgagtttcgcttctttcagcgccgcgttgacgatatcaaccggcttctgcccgacatcagacgggaagaaatcgacgccgacctgctcggccagggtttccagctgtttgatcgccgccgggcggtaaacgtctgcggaaacgaccagcactttcttcttgtgcttctcgcgcaggaatttccccagcttaccgacgctggtggttttaccagcaccttgcaggcccgccatcagcaccacggccggcggctgcgcggccaggtcgagcgtctggttctcttcgcccatcgccgccaccagctcgttgcggacgattttgacgaactcctgacccggggtcaggcttttattgacttcatggccgaccgcgctctctttgacgcggctgatgaaatcacggaccaccggaagcgcaacgtccgcttccagcagcgccatgcgcacttcgcgcagggtgtctttaatattgtcttctgtaaggcgtccgcggccgctaatgttgcgcagcgtacgcgacaaacgatcggttaa

SEQ ID NO: 4438 - DNA, 2436 bp, Klebsiella pneumoniae
ccactggagcagactatgacagtttcaacgcaggtaagccgtaacgagtacaccgggaacggcgccactacccaatacgatttcacgttccgcattcttgataaaagccacctgctggtgcagacgatggatacctccgaaaacatcgtgacgctaacgctcggaaccgactacacggttaccggcgtgaatcgctacaatggcgggaaggtggtgctgacatcggcgctgccagctggttacaaaatctctatcgagcgcagcactcctgttacgcaggaagccagcatcaggaaccaggggggctttttccctgagatccacgaagatgctctcgataagttaaccatgcttgtgcagcaggcatacgggtggtggtctggtctatctctcaggaagccatcatggctcgcgaactattacgacgcactcaataaccgcattcgtaacctgcgtgacccgtcacaggcgcaggatgcggccacgaagaattatgttgataacagtattgatgggtcaaatgcacacgcagatgatttatttaaaaaaacattacggtttcctgattatgttgaaacaatgtcaggagtgccaggcaggcgtgacagtttgcaggggtttaataatataggtaaacctgttcctgttttttcttttacagaaactgctgatctttctctaaagttatcagacactgatggccttcaatatataggtcagtgtcctgatatcaatacgttgcgctcaactgaattcagctcagttaaccagcaaatatttgttgctgagcacacaacaggcacggagcaaggtggaggtattttttattgccattcgcttactaatgacgatgggcttattgatgataacggatttcagattatcaataatttcggccaggtaatccggcgtaaagatcgtagcagaatgtcggctgaaatgtttggtgcgattggcgggcaggatgtcatgcccgtcctgctgaacatccgtaaagcgtcgattacttttaacagggctgtttgttattttccaccaccggctaatggtattaattacctccatactggtgggtttgttgtcgatgtaactcaagggtacggattatgtattgtatgtgagtctacagatgagatagatgtaccttttgaccacattggcgataacattgcattcacttttaaacgtgacaatgcggcagcaggaacagctttctataaacagagtggtataactggtgcgcttatccgtggcaggaactctgataacacagcagctggtaatggtgggtttgctgttagagtgtctgacataattaaagctaaagttaatgtgtttgttaatggctacactaacactgctggtgccgccatttccctatataacgatactggttatactgagaagagtaggataaaagctaccatacgcggttgctgtaatggtgtacttatacatcgtaatgcggcagaaggagcaacgagcacaaactcgtttatgggtactcaccttgatattgaatatcaggccggtgttcctggaaaggcgaataaaggtgtcgtagttggaaatattgacggaaccactactagcaacacttttgatattaatttttacgcttcaaatatatctctaaaatattgggcggaggccggatcgataacgaatggaatttatgttggaagcaaggcaattgtccctgagtcaacaaccgttgatttgatttccgatggctatggatttagcacatcagatactgacaccacgacaatcgcggcaaccaatttgatccgtgttgagaatggcggtattttcagggcgaaatgtatggaccagtcgatgcagacaggattaagtcatcgccttaatcaacttcaacgtctgaggaatagcattttttcattccaggatgacacctacaaggtgccatatactgatgcacgcccgtacatcaaccccgtagggatgtcatgtatttgttccgggactatcgacgtcgccactcaacaggctgggtcctcatggttaatatccgggctgccgatgggcatgcggatcaaggttacgataaaccaatacctggagggagaatcggtcactagtgtacaagaggtgtgggaagtcctcgttcgtggtgatgcgcagtcagtcatttgcacacctctggtgacgaatgatgttcttacaacgactgccggtttggcagtaataaattcgtcatttgcaactgcttcatttcttaagtcagtagcagccgcattcggtaaattctggcaaggtgattcaacaagaacccgtcttacggtacgtaataataatgacgataactccttaaccactggagcgtctgatggacgcaagttcaggatatttctacctataaatgcatctgcaaacagcattttgcattattcagtaaaactcgaggtggtttaa

SEQ ID NO: 4439 - DNA, 1017 bp, Klebsiella pneumoniae
  unsure (496),(504): Identity of nucleotide at the above locations are unknown.
cctgcacggcaatctggtgatagaggaggggcggccatgaatacggtgcttattcctcccggtcccggtggctacggtaaagggttgtggctgcccgttggcagcggcaaaaaggtgctgtcgctaaccgggcgcgaaatccatcccgtcgccatcgaaatcggcgcactcaccgaatcggaaatcgtcaacggcttcgctgatatcccaccggataacgacatcctgtgcgtggtaattaactgcgccgggtccctgcgctgcggcctgtacccgcagaagggcattcctaccatcaacgtgctccccacctggcgggccggaccgctggcgcagtttattaacgaggataactacgtctccggcgtgacgatggagcaactggttctggtggttaccgccgaagccccggacggtgaaccggaatccgtgcctgtcgctgcgccacaggttatcagcacgccaccgcctccacgtggcgcggaaaaactggtgngcatggtngagcagaccggcaccgccgtcggtcacgttatcgccctgctgtttgccgccagccgtgaagcggtggacgtgtccctgcgcaacatcatcccgtttatggcctttgtctcgctgctgatagccctggtgcaggagaccgcactcggcagcctgattgcccacgccctgacgccgctggcgaactcgctgtgggggctggtgctgctgtcgctcatctgtggcattccgttcctctccccggtgctcggaccgggcgcggccatctcgcaggtgattggcgtgatgataggcacacagattggctcaggggcgatatctccggccttcgccctgcccgcgctgttcgccattaacgtgcaggtcggctgcgacttcgtgcctgttggtctttcgatgcaggaggcaaagccggagaccatcgcgaaaggtgtccccgcctttctgctctcgcgtcagttaaccgggccgctggcggtaatagtcggctggttgttttccctgggcttattctga

SEQ ID NO: 4440 - DNA, 267 bp, Klebsiella pneumoniae
atgcatcttaaagaaataaccctgcgttgtaaatggttctttaacacattcccccgatccagttacaacatgaagaatttgcatcacaaacctgaaaagaaatccgatgatactgagagaggcgttattgctcaaagccttgtgtcatgcggagccaatcgtttgcgtaaaatcctttgtcaagacctgttatcacagaatgattcggctatactgtgggccgttgtccaatcggaccgcctttttaggccgaaattttattgttag

SEQ ID NO: 4441 - DNA, 1251 bp, Klebsiella pneumoniae
aacatgcctaagcaactgaaacccttaacaaatgtggagatcgctggcgcgaagccccgtagcacggattatgagctgcgggacggtgaaggcctgtacttgctggttaagacttcagggaggaaggcttggcatttcgagtattatcatcccgtcaccaaaaagcgcaccaaaaccagccttggcccttacccggtcgttacactggccatggctcgcgaaactcgcacgaaatacagacgactgctctggcagggcatcgatccccgtcaacacttagcagggatagctgaagaaaaacgcatccagaatgaatgcacgctggaaaaagttgcggaacagtggctcaaagagaaaaaacggaccagcgatcttagcgaagatcacgccaaagatgtctggcgctcgctggagatgcatgtcttcccttctctgggcagtacgcccgtcaccgagatccgtcctaagatgctcaaggagcacctcacaccactggaagaacaaggcattctcgaaacactgcggcgtgttatctcacggctcaatgaaatcttccgcttcgccatctccgaagagcttatcgagtttaacccagcagacaacctggtcgcccgcttcaagaaaccgaaaaagcagaacatgcccgcccttccccccagcgaactgggcaggctaatgctggcgctacagaacgcctctatccgcaaggaaacacgctgccttatcgaatgggagctactgacctgggttcgccccggcgaagccgtcagcgcccgctggtgcgatatcgatatgaaaaaagcggaatggcgtatccctgacacctttatgaagatgaaccgttcgcatacggtgccgctcagcaaacaggcgctgcgcgttcttcagatcatggagccagtcagccgccatcgcccgtgggtcttccccagcatccgcaaaccgctggagcatatgcatcagcagaccgctaacgccgcgcttatccgtatggggttcggcggtgagctggttgcccatggtatgcgcagcattgccagaacggcgggagcaggtcatttcccccgtgaagtcctggagtctgcgctggcgcaccagaaagaagacgagatcgaagcggcctataaccgcagcgactacctggaacaaaggcggccgctcatgcagtggtggggaaactacgttgatgccgccagacggcaggcgctgctcggtgcagaagaaccgctgcggatcgtggaaggagaataa

SEQ ID NO: 4442 - DNA, 1284 bp, Klebsiella pneumoniae
tatcatgctaaacctctcatctatgtttattgcgccaataatagtcaacaagtatttcaaaaaagtcccaagcaaattataatgctggagtttcataatgtccctttaaaaaccattttaagaagagctattatgtccctccctacaaattttaataatattcttcgtctttttgaaaaagattacgatacagccaaagaagataatgccttaagtgcacgcggccaatttctgcaactttacccccttaatcgcctaaaaaaaatgacgcttgatgactatgtcatcggcaaaggcacggcctcattttgtgcttgtgttgaagtaaaaaccagaacatgggcaaatatgcaaggtgcgacggctctcaaatttggtatttattatggaaaatcaaaatcagatccaaccgtccgctatcgttttactcagaaatttggcgatgatgatagtactaataaagaagttttcgctaatgttaaagacgctttactagacctaatacagtcagggaaagaattagattttagagcgattgacgagaaccccctatcccagatgtttaaggctaaaatattgagcctttactttccagaacactttataaacatttgcagcaaagatcatcttaaagaaattgctatggaaatgggtataaaagagcaacagtttattagtaaatatcaacatttgttattcaagaaaaaactagagcataaaatcacccgaaactggagcaatccaaaatatatgtccttcctttatgcccagttcatacgtaaggatcttagcagtactcctgctgtgatagttaaaaaaccacaaaaaagaaaccatcccgaagtcaatttcgaagaaataacggacaatcgtgatttaataggcaaaaaaagcgaagaatatgcattaaactgggaaaaaaaccgcctaatcggtctcggctattcaaaactagctgaggaaatagatgatcgccgtaatcgtccaacttatggttacgactttctttcttttaatgccccaggtgatgagcgatacatcgaagttaaatcaattggccgagatggaaaagagggagcattccgttttttcctctcaggaaatgaactcaccgtttctaatttaagtaaccaccgtaaaaactattatttttatcttgtacagtatgggaaagatggagagccatgcaatctatatgtaaaacatgctcaagatctttacactaagagtgaaatgtccccttgtgcttacgttgttaggttcgatctggaagaacctgcttaa

SEQ ID NO: 4443 - DNA, 369 bp, Klebsiella pneumoniae
attaccaataaggtaaaaatcatgcgaaagacactacaggcacttggccggcttaaagcgggccagatgaacaaaaccgaaacggcgtatgcgcaagagcttgagctgcgtaagcgctacggggaaatcgcctggtaccggttcgaaggcatcaagctgcgtctggctgacaacacgttctacacgcctgacttcgccgtgatgctggcaaacggccaactggaaatgcacgaagtgaaggggggttactggaccgacgatgcgagggtgaaaaccaaagtcgcagccgaccagtacccattccggatcatcggagtaacgaagctcccggcaaaagccggcggcgggtggaaggtcgaagagttctaa

SEQ ID NO: 4444 - DNA, 1359 bp, Klebsiella pneumoniae
cgggttctcaatctgctgctgaatagcacgtttcaatggccgcgcgccgtataccggatcgtaaccattggcgctcagcagcttcagcgcctcatcggacatctgcacttcatatccgcgctcttccagacgtttatacagacgctgcagctggatctgggcaatagaggcaatatgtttctcgcccagcggatggaagaccaccacttcgtcgatacggttgatgaactccggacggaagttctggctgactacccccagcaccaggtccttcatatgtccgtagtccagctcgccgaaccgttcctgaataagatcggaaccgaggttcgaggtcatgatgactaccgtattacggaagtcgaccgttctcccctgcccgtcggtgagacgcccgtcgtcgagtacctgcagcagaatgttgaacacatccgggtgcgctttttccacttcatccagcaggatgacggaataaggacgacggcgcaccgcctcggtcaggtaaccgccctcttcatagccgacgtatcccggaggcgcaccgaccagacgcgagacggaatgtttctccataaactcggacatatcgatacgcaccatcgcgtcgtcgctatcgaacataaagttagccagcgttttacacagctcggttttaccgaccccggttggaccgaggaacaggaacgaaccaatcggccggttcggatcggacagcccggcgcggctgcggcgaatggcgttggataccgcttcaaccgcctcatcctggccaatcacccgatgatgcagctcctgctccatacgcagcagtttgtcacgctcgctttccatcatgcgggagaccgggataccggtccagcgagccagcacttcggcgatttcagcatccgtcactttattacgcagcagacgcatggttttcccttcggactgagtggcagccgccagctgtttctccagttccggaattttgccgtactgcagctcggacatccgcgccagatcgccgacgcggcgcgcctgttcgatggcgattttcgcctgctccagctcagctttgatggtctgggtgccggagagcgacgctttttccgctttccactcttcttccagcaccgagtactgccgttctttatccgccagctcctcgttgagcatatcgagacgcttcaggctcgcctcatcagactctttcttcagcgcctgctgttccagtttcagctggataatacgccgatcgagacggtccagctcttccggtttggagtcaatctgcatacggatgctggatgccgcctcatcgatgaggtcgatggctttatccggcagctgacggtcggcaatatagcgatgcgataa

SEQ ID NO: 4445 - DNA, 189 bp, Klebsiella pneumoniae
gtcagtgtcctgatatcaatacgttgcgctcaactgaattcagctcagttaaccagcaaatatttgttgctgagcacacaacaggcacggagcaaggtggaggtattttttattgccattcgcttactaatgacgatgggcttattgatgataacggatttcagattatcaataatttcggccaggtaa

SEQ ID NO: 4446 - DNA, 390 bp, Klebsiella pneumoniae
acctgcgccaagcattccggactgcttatcaattttcccttgcgctcggctggtatcagcctggaactgcaacccggcggcctgtcgctggccgttgttgatggtggtcagcgcgtcgagcgtgccctgctgcatggtttcagttgtcaggtccaatgcgttaccgctcgtcaggtcggcgccgttagcagccagtgcattggtttgctgtccggcaacccgccgggcctgctgccgctgctggtatgcctggtcattagctgtattgatagtgtcgcgggcggcctgctcctgagcgtcggcgttagcgttcgccagcgcggcattagcgcggcctgtctgaatctgactgtaagcgctgagaccgccagcaactgcggttacggctag

SEQ ID NO: 4447 - DNA, 351 bp, Klebsiella pneumoniae
cacccagccaaggacggcactttccatcatccctgtttcgcccggttcgccgggcatttttttagagaggcaactatgaaatttggcgaagctcttgaggcagttaaatccggcgcaaagatttatcgcgaaggctggaacggtaaagggcagtttgtcattaaggcaggcggatacaccgtcagcgaacctcgccccggcagtgattatgcaaaggcggggatcacaggcgagtttaccattgcgccacacctcgacctgaagaacgcacaaggcattatgcagcctggctgggttccgtcgcagggcgatctgtttgccgatgattggctggcaacgcctatcgattaa

SEQ ID NO: 4448 - DNA, 900 bp, Klebsiella pneumoniae
aacgccgacaattcagtcatgaataataaaacggaggcacctatgtccacctcgttttttgtcgctgccgactggctggcagaacatattgatgacccggaaattcagattatcgacgcccgcatggcgcccgccgggcaggaggccctgcgggatatggccgcggaataccgcgccggccatgtgccgaacgcgctgtttttcgatatcgaggcgctatccgaccacaccagtccgctgccgcatatgatgccgcgggccgaagcgtttgccgtcgccatgcgcgaactgggcgtctgcagcgataagcatctggtggtctatgacgaaggcaatctgttttccgccccgcgcgcgtggtggatgctgcgcacctttggcgtagagaaggtgtcaattctggccggcgggctggagggctggcggcgcgacgaactgccgctggaacaagggatgccggaggtggccgaaggggaattcgacgtgcggttcgatcctcaacaaattaagcgtctgaccgacgttctgttggtcagccatgaaggatcggcgcagattgtcgatgcccgtccggcggcccggtttaacggccaggccgacgaaccgcgcccgggcctgcgccgcgggcatatccccggcgcgctgaacgtaccgtggacggatctggtgattaacggcgaactgaaaaccgttgacgagctgaacgacatctttttacgtcagggtgtcgattttgaacggccgatcatcgccagctgcggctcgggggtgacggcggcggtggtcgtgctggcgctcaccacgcttggcgtgaacggcgtctgcctgtatgacggctcctggagcgaatggggcgcgcggagcgatctgccgattgaaccggcccctgccgctccgtaa

SEQ ID NO: 4449 - DNA, 552 bp, Klebsiella pneumoniae
atgtgctgcaacggttggagcagaggcctgctaacgttatactgcttctctttcttatttagccaacagccgacacctatgcctgtttttgctctactcgcccttgtcgcctactccgtcagcctcgcgctgattatccccggcttgctgcaaaaaaacagcagctggcggcgaatggcgattttatctgcgactatcgccttgatctgccatgcttttgcgctggaagcacggatattccccggcggcgagagcgggcaaaatctcagcttactgaacgtcgggtcgctggtcagcctgatgatctgtacggtgatgactatcgtggcctcgcgcaatcgcggctggctgctgctgcctatcgtctatgccttcgcgctgatcaacctggccttcgccacattcgtgcctaacgaatatatcacccacctggacaccaccccggggatgctggtgcatatcggcctgtcgctcttctcgtacgccacgctgatcattgccgcgctgtatgcggttgcagctggcgtggatcgactaccagctcaagtataa

SEQ ID NO: 4450 - DNA, 246 bp, Klebsiella pneumoniae
accggtagcaattttccgagtttaccttttttggatcttcgcagacaaagaatggaagatccggacgccgcattacaacagatgtaccgcaaagttatgcctggccggaccttcgacttgctgcaggttattgcagccaacgccgtattggtgtggactgagcccaccacggtagacaaattctgtccttacgtcgaggcctgttcaaaggctatcggactgatacacaagctctccatcgtttaa

SEQ ID NO: 4451 - DNA, 351 bp, Klebsiella pneumoniae
attatgagcaacattattaagcaacttgaacaagaacagatgaagcaggacgtaccttccttccgtccgggtgataccgtggaagtgaaagtatgggttgttgaaggttccaaaaaacgtctgcaggcattcgagggcgtggttatcgctattcgtaaccgcggtctgcactctgcattcactgttcgcaaaatttccaacggcgaaggcgttgagcgtgtcttccagactcactctccggtagttgacagcattgctgttaaacgtcgtggtgctgtacgtaaagctaaactgtactacctgcgtgagcgcactggtaagtctgctcgtatcaaagagcgtcttaactaa

SEQ ID NO: 4452 - DNA, 1812 bp, Klebsiella pneumoniae
ttaactctaaatatgaagaatatacgtaacttttcgatcatcgctcacatcgaccacggtaagtcgacgctgtctgaccgtatcatccagatttgcggtggcctttctgatcgtgaaatggaagcccaggttctggactccatggatcttgagcgcgaacgcgggatcaccatcaaggcgcagagcgtcaccctggactataaggccagcgacggtgagacctatcagctgaactttatcgacaccccgggccacgtggacttctcttatgaagtttcccgttctcttgccgcgtgcgaaggcgcgctgctggtggtagacgccgggcagggggtagaagcccagaccctggccaactgctacaccgccatggagatggatctcgaagtggttccggtactcaacaagatcgacctgcctgcggccgaccctgagcgcgtagcggacgagattgaagatatcgtcgggatcgacgcccacgacgcggtgcgctgctcagcaaaaaccggcgtcggcgtgaccgacgtgctggagcgtctggtgcgcgatatcccaccgccggaaggcgatccggacgcgccgctgcaggcgctgattattgactcctggttcgataactacctcggcgtggtgtcgctggtgcggattaaaaacggcaccatgcgcaagggcgacaagatcaaggtcatgagcaccggccaggtctataacgctgatcgtctgggcatcttcaccccgaaacaggttgaccgtaccgagctgaaatgcggcgaggtaggctggctggtctgcgcgatcaaagacatcctcggcgcgccggtgggcgataccctgaccgccgcccgcaacccggcagacaaagcgctgcctggctttaagaaggtgaaaccgcaggtgtatgccggcctgttcccggtgagctccgatgattatgaagctttccgcgacgcgctgggcaaactgagccttaacgatgcctctctgttctacgagccggaaagctctaccgcgctgggcttcggcttccgctgcggcttcctcggcctgctgcacatggagatcattcaggagcgtctggagcgtgaatacgatctcgacctgatcaccaccgcgccgacggtagtctacgaagtagagaccacctccaaagaagttatctacgtcgacagcccgtccaagctgccgccgctgaataatattcaggagctgcgcgagccgatcgccgagtgtcacatgctgctgccgcaggagttcctcggcaacgtgattaccttgtgtgtcgagaagcgtggggtgcagaccaacatggtttaccacggtaaacaggtggcgctgacctatgaaattccgatggcggaagtggttctcgacttcttcgaccgcctgaagtccacctcccgcggctatgcgtcgctggactacaacttcaaacgcttccaggcgtcgaacatggtacgcgtcgatgtgctgatcaacggtgagcgcgtcgatgcgctggcgctgatcacccacaacgataacgcgccgtatcgcggccgcgagctggtggaaaaaatgaaagatctgattccgcgtcagcagttcgatatcgcgattcaggcggccatcggtaaccacattatcgcgcgctctacggtgaaacagctgcgtaaaaacgtcctggcgaaatgctacggcggcgacgtcagccgtaagaaaaagctgctgcagaagcagaaagaaggtaagaagcgtatgaagcaggtcggtaacgttgagctgccgcaggaagcgttcctcgccattctgcacgttggtaaagacggcaaataa

SEQ ID NO: 4453 - DNA, 5004 bp, Klebsiella pneumoniae
cgcataataaatgtgacaaattgcatcaggctcatcggccgaggggttagaaggatgaaaccatttcgtttagcggcgctatcactggcgctccttaccgcattttcattaaccgggtgtgatgacagcggtacaccgcaggcctcggccccggcgccagccgcggatagcaacccaggcgcgacggcaaaaccggaccgcgcccagctggcggcgctggcggaaaaaagccagggtaaagcgctgacgctcctcgacgcctcggaggtgcaactggatggcgccgcgaccctggtgctgacgttttccgtcccgctgcagccggaccaggatttctcccgcagcgtgcatctggtcgacaagaaaagcggtaaggtggacggtgcctgggagctggcgccgaatctgaaagagctgcgtctgcgtcaccttgagccaaagcgcgagctgattgtctcggtcgacccgacgctgaccgccctgaacaaggcgatgctcgacaaaccgtttgagaagaccctgaccacccgcgatatcgcaccgagcgttgggtttgccagccgcggctcgctgctgccgggcaacgtggtcgccgggctgccggtgatggcgcttaacgtcgataatgtcgacgttaatttcttccgcattaagccggaatcgctctccgcctttgtcagtcagtgggaataccgtaactcgttaagcaactgggaatctgatgaactgctgaagatggcggatctggtctacagcggccgcttcgatctcaacccggcgcgtaatactcgcgaaaagctgctgctgccgctgagcgacatcaagccgctccagcagcctggcgtctacgtggcggtcatgaacccggcgggccgttatagctacagcaacgcggcgacgctgtttaccctcagcgatatcggcgtctcggcgcatcgctaccataaccggctggacgtttttacccagagtctggaaaacggcgccgcccagtcgggtattgaggtgcagttgctcaatgccaaagggcagaccctggcggaagcgaaaagcgacagccagggccacgtcaccctgcaaaccgataaagaagccgcgctgctgctggcgcgcaaagaggggcagaccacgctgctcgacctcaagctgccggcgctggatctggcggaattctctatcgcaggcgcgcccggctttagcaaacagttctttatgtttggcccgcgcgatctctatcgtcccggcgaaacggtgatccttaatgcgctgttgcgcgatagcgacggcaagccgctggcggagcagccggtgaaactggaggtggttcagccggacggccaggtgatccgctcggtgatgagcaaaccagtgaatggcctgtaccagtttacttatccgctcgacagcggcgcggctaccggcatgtggcacattcgcgccagcgccggcgacaatcagccgcgcgaatgggatttccacgttgaagactttatgccggaacgcatggccctgaacctgacgccgcaggccgcgccagtcgcgccggatgccgacgtcacctttggcgttagcggcgcttatctctacggcgcgccggccagcggcaaccagctgcagggcaagctgttcctgcgcccgctgcgcgacgccgtcgctgcgctgccgggcttccagttcggcgatattgcggaagaaaacctctcccgtagtctggatgaagtccagctgacgctggacgaaaaaggccatggcgaagtgaccacctcaagccagtggcaggatagccattcgccgctgcaggtggtgttgcaggccagcctgctggaatccggcggtcgcccggtgacccgtacggttaagcagccgatctggcccgccgaggcgctgccggggatccgcccgcaatttacgctgaaggacgtttacgattaccgcaccgataccaccatgaaacagccggtggtggatgaaaacagtaacgccgcgtttgatatcgtctatgccgacgtcaaaggcgagaaaaaagcgatctccggtctccaggtgcggctgatccgcgagcggcgcgactactactggaactggtccgacagcgaaggctggcagtcgcagttcgatcaaaaagatctgctggagggcgaggagtcgcttgacctgcaggccggccagatcggcaaagtgagcttcccggtggagtggggatcctatcgcctggaggtgaaaggaccggacgacgtggtcagcagcgtgcgcttctgggcgggctacagctggcaggataacagcgaaggcgccggcgcggcgcgtcctgaccgggtcaccatgaagctggataaaccgagctataaaccgggcgacaccatcaggctgcacatcgccgctccggcggcgggtaaaggctacgcaatggtggaatccagcgaagggccgctgtggtggcaggaaattgacgtcccggcggaggggatggacctgtcgatcccggtggataaaacctggaatcgccacgacctctacctcagcacgctggtggttcgtcccggcgataaatcgcgctcggcaacgccgaaacgcgcggtgggcctgctgcatctgccgctgggcgatgaaaaccgtcgcctgacgctggcgctggaggccccggacaaaatgcgccccaaccagccgctgacggtgaaagtgaaagccagcgtcaaagagggcgaggcgccgaaacaggtcaatgtcctgctctcggcggtggatagcggggtactgaatatcaccgattacgctaccccggatccgtggaacgccttctttggccagaagcgttacggcgcagatatctatgacatctacggccaggtgatcgaagggcagggacgtgtggccagcctgcgcttcggcggcgatggcgacgagttaaaacgcggcggcaaaccgccggtcaaccacgtgacgatcgtcgcccagcaggcgcagccggtggtattgaacgatcagggcgaaggcacggtgacgttacccattggcgattttaacggcgagctgcgggtgatggcccaggcgtggacggcggatgacttcggcagcagcgaagataaagtggtggtggccgccccggtcatcgccgaactgaacaccccgcgattcctcgccagcggcgatactacgcgtctggcgctggatctcagcaatctgaccgataaaccgcaaaccctgcaggttcatcttaccgccagcgggctggtgaccttgaccgatggccaactgccgccggtgcaactggcgccgggggcgcgcagcacgctgtttataccagtgagcgcgctggcgggcttcggcgatggtcaggttaatgccaccatcagcggcctgagcctgccgggcgaaaccttcgccccgctgcaaaaacagtggaaaatcggcgtgcgtccggcgtacccggcacagaccgtcaacagcggtgcagtgctgcagccaggtgaaaactggcagccgccggcggcgcagagccagggctttgccccgcaaacgctgcagggccaactgctgctcagcggtaaaccaccgttgaatctcgcccgctatatccgcgagctgaaagcctatccttacggctgccttgagcagaccgccagcggcctgttcccgtccctgtataccagcgcggcgcagctaaaggcgctgggcattagcggggacagcgacgaaaaacgccgcgcggccatcgatgtcggtatttcacgcctgctgcagatgcagctggaaaacggcggctttgcgctatgggatagagaggggccggaagagtactggctgaccgcctacgccatggacttcctcgtgcgcgccagcgagcagggctatagcgtaccggtcaacgccattaataaaggcaacgagcgcctgctgcgctatctgcaggagccgggcctgatgaccgtgcgctacagcgacgacgcccaggctagccgctttgccgctcaggcctatgccgcgctggtgctggcgcgtcagcaaaaagcgccgctcggcgccttgcgtgaaatctggagccgtcacgaccaggcgcgatccggcttgccgctgctgcagctcggcattgcgctgaaaaccatgggcgatgcgccgcgcggcgacgccgccctgaagctggcggttgccaccccgcgccaggatgagaatcgttggctgggcgattacggtagcccgctgcgcgataacgccctgaagctggtgctgctggaagagaataagctgctgccggaggtgcaaaatcagctgttgagcacgctgtcggaagaggcctatggccagcgctggctgtcgacccaggaaaccaacgccttgttccttgccggacgtacgctggcggacctgccgggcagctggcaggcgcaaacctcgctgcaggcggagccgttggccggcgacaaagcgcaaacccgcaacctcgacggcgatcggctggcggcgctgcaggtgagtaataccggcagtcagccgctgtggctgcgtctcgacagcagcggctatccgcaaagcgcgccgcagccgggcggtaacgtcctggggattgaacgcactattttcgatacccaggggcagcagaaatcgctgtcttcactgcgcagcggcgaactggtgctcgtcaagctggaggtgaccgccaaacgcaacgtgcctgacgcgctggtggttgatctgttgccagccggtctggagctggaaaaccagaatctggccaacagcagcgccagcctgcaggagaatggcgacgcggtgcaaaacctgcttaaccagatgcagcaggcggatattcagcatatcgagttccgcgatgaccgtttcgtcgccgccgtcgctgtcaatgaaggccagccggtgacgctggtctatctggcgcgggcggtgacgccgggcacttatcaggtcccgcagccgcaggtggaatcgatgtatgcgccgcagtggcgggcgacaggagcggccagcggtccgctcaccgtgacgccgtaa

SEQ ID NO: 4454 - DNA, 1686 bp, Klebsiella pneumoniae
ccatcaccaaagagtccccgaactaccgtctgggctcctgatttcttcgcccgaccttgcgtcgggcgatttatttactctgtttcacttgcctcggaattagcgtcaatgacggaaaacattcataaacatcgcatcctcatcctcgacttcgggtctcagtatactcagctggtggcgcgtcgcgtgcgtgagctgggcgtctactgtgagctgtgggcatgggatgtcacggaagcacagatccgcgaatttaatccaagcggcatcattctttccggcggcccggaaagcaccaccgaagagaacagcccgcgcgcgccgcagtatgtgttcgaagccggcgtgccggtatttggcgtctgctacggcatgcagaccatggcgatgcagctgggcggccatgtagaaggttctaacgagcgtgagtttggttacgcgcaggttgaagtggttaacgacagcgcgctggtgcgcggtatcgaagattccctgaccgcagacggcaaaccgctgctggacgtgtggatgagccacggcgacaaagtgaccgctatcccggcggacttcgtaaccgtcgctagcaccgacaactgcccgttcgccattatggccaacgaagaaaaacgcttctacggcgtgcagttccacccggaagtgacccacacccgtcaggggatgcgtatgctggagcgcttcgtgcgcgacatctgccagtgcgaagcgctgtggaccccggcgaaaatcattgacgacgccgttgagcgtatccgtcagcaggttggcgacgacaaagtgatcctcggcctctccggcggtgtggactcttcggtgaccgcgatgctgctgcaccgcgctatcggcaaaaacctgacctgcgtattcgtggacaacggtctgctgcgcctgaacgaagcgcagcaggtgatggagatgttcggcgaccactttggcctgaacattgttcacgttgaaggcgagcagcgtttcctcgacgcgctggcgggtgaaagcgatccggaagcgaagcgtaaaattatcggtcgcgttttcgtggaagtgttcgacgaagaagcgctgaagctggacgacgtcaaatggctggcgcagggtaccatctaccctgacgttatcgagtctgctgcttccgccaccggtaaagcgcacgtcatcaaatctcaccacaacgtgggcggcctgccgaaagagatgaagatgggcctggttgagccgctgcgtgagctgttcaaagacgaagtacgtaagatcggcctggaactgggcctgccgtacgacatgctttaccgtcacccgttcccgggccccggccttggcgtgcgcgtgctgggcgaagtgaagaaagagtactgcgacctgctgcgtcgtgcggacgctatcttcatcgaagagctgcacaaagctgatctgtataacaaagtcagccaggcgttcactgtgttcctgccggttcgttccgtcggcgtgatgggcgatggccgtaaatacgactgggtggtttccctgcgtgcggtggaaaccatcgacttcatgaccgcgcactgggcacacctgccgtacgatttcctcggccgcgtctccaaccgtatcatcaatgaagtgaacggtatctcccgcgtggtgtatgacatcagcggcaagccgccagcaacgattgagtgggaatga

SEQ ID NO: 4455 - DNA, 753 bp, Klebsiella pneumoniae
ggaagtcaaaacgtcatgacgcgcatgaaatacctggtggcagccgccacactgagcctggctttggtgggttgctccggctctaaggaagaggtgcctgataatccgccgaatgaaatctacgcgaccgcccagcaaaaactgcaggacggtaactggaaacaggcgataacgcaactggaagcgttggataatcgttatccattcggcccttattcccaacaggtacagctggatctgatttatgcgtattataaaaacgccgatcttcctctggctcaggcggctatcgatcgcttcatgcgtttgaaccccacccatccgaacatcgactatgtcatctatatgcgcggcctgaccaacatggccctggatgacagcgccctgcagggcttcttcggcgttgatcgctccgaccgcgatccgcagcacgcgcgcgatgccttcaatgacttctccaaactggtgcgaggttatccgaacagccagtacgccactgacgcctataaacgcatggtgttcctgaaagatcgtctggccaaatatgagctgtcggtcgtggattactacaccgatcgtggcgcatgggttgccgtggttaaccgtgtggaagggatgatgcgtaattatccggatacccaggccacccgcgatgccctgccgaagatggaaaacgcctatcgtcagatgcaaatgaacgctcaggcggacaaagtcgcgaagattatcgccgcgaacagcaagaacacctga

SEQ ID NO: 4456 - DNA, 900 bp, Klebsiella pneumoniae
tcgaataaaaattctgtcagtcacgagccggacggctccagcggagctccaatgaactgtttaacgcgtattcgtcagcgctatcccaccctggcggcgagcgacaaaaagttggccgattatattctgagccagcccgatgagacccggcacctcagctcgcagcagctggcggcggaagccggtgtgagtcagtccagcgtggttaaatttgcccagaagctgggattcaaaggctttccggcgctgaagctggcccttagtgaagcgctggcgagtagcccggatccgcactccgtcccggtgcataaccacattcgcggtgacgatccgctgcgtctggtcggcgagaaactcattaaagacaatgtcgccgccatgcatgcctcgctggacgtcaacactgaagagacgctacgggaagccgtcacgctgctgcgcaacgcccggcgagtgatcgtcaccgggattggcgcctccggcctggtggcgcgtaactttagctggaagctgatgaagatcggcatcaacgctgtttctgagcaggatatgcatgccctgctggcgacggtgcaggccatgtccagcgacgatcttctgctggcgatctcttactccggcgagcgccgggaaatcaatatggcggccggtgaagcgctgcgcgtcggctgtaagatcctggcgatcaccgggtttagcccgaacgccctgcaacagcaggcgacccactgcctgtatactatcgccgaagagcaggcgacgcgcagcgccgccatctcctccaccagcgcgcaaatgatgctcaccgatctgctgtttatggggctggtgcagcaggatctggagcgggcgccggagcgcattcgccatagcgaagcgctggtgaaaaagctggtctga

SEQ ID NO: 4457 - DNA, 483 bp, Klebsiella pneumoniae
catcacagaaacatatcggccacgtgccacgttgcaacccataaccagaggttagttatgaataccgtttgtgccagttgtcaggctctgaaccgcctcccggacgatcgtagcgcggatggcgcaaagtgcggacgctgcggtcacgatctttttgacggcgacgtcatcaacgcgaccggggcaacgctggataaactcttgaaggacgatctgccggtcgttgtcgatttctgggcgccatggtgcggaccctgccgtagcttcgcgccgatctttgaagacgtcgcggaagagcgtagcgggaagatgcgttttgtgaaagtcaacaccgaagcggaacgtgagcttagcgcccggtttcgtatccgcagcatcccgaccattatgatgttcaaaaatggcgaagtgatcgacatgctcaatggcgcagtgccaaaagcgccattcgatagctggcttaacgaagccggccaacaataa

SEQ ID NO: 4458 - DNA, 513 bp, Klebsiella pneumoniae
aatgccggaaaccaggtgcagcgcatcgtggcccgatttgccctgctggcggtggccggagagatggcgacgctgcagggtatcacgggctggcaggaaggcacggcatatgaggcggtgcagatctgcctgcacgcctggctgaacgagcgcggccatattgccaaccaggaggatgaaggcgtgctggcgcagatcaaacggtttatcaccgcgcaccagtacagccgctttgcctcgtgggatggcccggaccgcccgctgaatatggtgggctttcgccgggtggaaaaagatcctctgacgggtgaagagcacacactgttcttcatcctgccggagggctggcgggaaatgtgccggggattcagtcccgccagagcagccagattatgtctggaagcggaatgccttctgcccggcagcgacgggaaataccagtcgcaggttcgcctgccggagatcggcaaaaccagggtctatcggctcacctcccgcatcctcagtatctga

SEQ ID NO: 4459 - DNA, 1371 bp, Klebsiella pneumoniae
acgaggccgaataatttcgcgttaagcgaaaacattttaacgggctgccatagggtggcccgtttgctaagaaggataatgataatgaccgaagctatgaagattacgctttctactcagccagccgatggacgctggggagaaaaagcgacctggagcatcaataacgacggcatcgctctacatctcaacggtaaagacgacctcgggcttatccagcgcgcggcgcgcaaaattgacggcatgggcatcaagcacgtcgccctgagcggcgaaggctggaacaccgatcgcgcctgggccttttgggccggctataaagggccgaaaggtcagcgtcaggtcgaatggccatcccttgacgacgcgcagcgcagcgagctggataaccgcctgacgatcatcgactgggtgcgcgacaccatcaatgcgccggcggaagagctgggtccggagcagctggcgcagcgcgctgtcgacctgctgtgcggcgtggcgggtgagaagattagctatcgcatcaccaaaggcgaagatctgcgcgagcagggctatcttggtctgcataccgtgggccgcggctccgagcgcccgccggtcctgctggcgctggactacaacccgaccggcgataaagaggcgccggtatacgcctgcctggtgggcaaaggcatcacctttgattccggcggctacagcatcaagcaaagcgcctttatggattcgatgaaatccgatatgggcggtgcggcgactatcaccggcgcgctggctttcgccattacccgcggtctgaacaaacgtgtgaagctgttcctgtgctgcgccgacaacctgatcagcggtaacgccttcaaactgggcgatattattcattatcgcaacggcaaaaccgttgaagtcatgaacactgacgcggaaggccgcctggtgctggcggatggcctgattgacgcctcggcgcagaagccagagctgatcatcgacgccgccaccctgaccggcgcggcgaaaaccgcgttgggcaatgattaccacgcgctgttcagctttgacgatgcgctggcgaatcgcctgctggcgagcgctcaggcggaaaacgaagccttctggcgtctgccgctggccgagttccaccgcaaccagctgccgtccaactttgctgacctgaacaacaccggcagcgcggcctatccggccggcgccagcaccgcggcgggcttcctgtcccacttcgtggaaaactaccatcagggttggctgcatatcgactgttcggcaacctaccgcaaatctgccgttgagcagtggtcggcgggcgccaccgggcttggcgtgcgtaccattgctaacctgctgacagctgattaa

SEQ ID NO: 4460 - DNA, 267 bp, Klebsiella pneumoniae
aaatcaaagaacagacgaacaaagaggcccgaaaagcttcaggtggaggtagatcgcctcaaggccgagctagaggcctacaagggaaaggaagaacaatggctacgccgctggcagcaaatcgcctttcatgtgcggcagaaaggcatacagatggctagtgtggataaaacctctactcaaagggctgagctgccttataatactgaaaccgcgcagacacaccggccttttgataaagaaattccaccttcagggagaatataa

SEQ ID NO: 4461 - DNA, 1377 bp, Klebsiella pneumoniae
acagagaagaaacgcactgtgatgttgtcaaaatttaagcgtaataaacatcaacaacaccttgcccaactccctaagctttctcagtcagttgatgatgtagagttcttttacgcccctgcggaattcagggaagcgttactgacccggattgcccacgccactcagcgtatatgcattattgcgctctatctggagcaagatgatggcggaaaaggaattttgcaggccctttatgacgccaaacgccagcgtccggaactggatgtccgcgttctggtggactggcaccgcgctcagcgtggccgtatcggcgccgccgcctctaataccaatgccgactggtattgtcggatggccaatgaaaatccaggggtagatatccccgtttacggcgtgccgattaacacccgggaggcgctcggcgttctccatttcaaaggctttattattgatgactgcgtcctctacagcggcgccagcctgaatgatgtttatctgcatcagcatgataagtatcgctatgatcgctatcagtgcatccgtaacggcaaaatggcggacatcatgttcgactgggtcgacaacaatctggttcaggggcgcggcgttaaccgtctcgacagaccggatcggccaagaagcccggaaatcaaaaacgacattcgccagtaccgtcaggagctccgcgaccgcagctaccattttgtcggcaccgctggtgacgaagaactctccgtcaccccgctggtaggcctgggtaaatcgagcctgctgaataaaaccatctttcacctgatgccctgtgccgaacacaagctgacgatctgcaccccctacttcaacctccctgccgtactggtaagaaatatcatccagctgctgcgcgacggaaaacaggtggagattattgtcggcgataaaacggctaacgatttctacattcctgaagatcagccgtttaaaatcatcggcgcccttccctatctgtatgagatcaacctgcggcgtttcctcagccggctgcagtattatgtcaataccgatcagctgatcgtccgcctgtggaaggatgacgataacagctaccacctgaaaggcatgtgggttgacgatgagtggatgctgctcactggcaacaacctgaacccgcgcgcctggcggctcgatctggaaaacgccattctgatccacgatccaaagcggcagctgggggccatgcgggagaaagagctgaagctcatccgcacccacaccacggtagtgaaacattatcgggatctgcaaagtatcgccgactatccggtgaaagtgcgaaaactgatccgccgtctgcggcggatccgcattgaccggctgatcagccgtattctctga

SEQ ID NO: 4462 - DNA, 1209 bp, Klebsiella pneumoniae
cacataaggaagcacgctatgcttgacgctcaaaccatcgccacggtaaaagccaccattcccctgctggtagagaccggcccgaaattaaccgcccatttctacgatcgtatgttcgcgcataatccggagctcaaagagatcttcaacatgagcaaccagcgcaacggcgatcagcgtgaagcgttattcaacgctattgccgcctacgccagcaatatcgataacctgcctgccctgctgccggcggtggaaaagatcgcccagaaacacaccagcttccagatcaaaccggagcagtacaatattgttggcagccatctgctggcgaccctcgatgaaatgttcagtccgggccaggaagtgctcgatgcctggggtaaagcctacggcgtgctggcgaacgtctttatcggccgtgaagccgagatctatcagcaaaacgccagtaaaaccggcggctgggaagggacccgcgcgtttcgcatcgtgaagaaaaccccgcgcagccagcttatcaccagctttgagctcgaaccggttgatggccagccggtcgccgattaccagcctggccagtacctggccatctggctgaaaccggaaggcttcgaatatcaggaaatccgccagtattccctgacccgcaaagcggacggcaaaggctaccgcattgcggttaaacgcgaggaaggcggtcaggtttccagctggctgcataaccatgccagcgaaggcgatgtggtctatctggccgccccggcgggagatttcttccttaacgttaagccacagacgccggtcaccctgctctctggcggcgtcgggcaaacgccgatgctggcgatgctggatgcgctggcgaagagcggtcatcagggtcaggtgaactggttccatgcggcggaaaatggcgacgttcacgcctttgccgatgaagtgaaggcgctcggcgcggcgctgccggcgtttacctctcacgtctggtatcgcaccccgactgaggccgaccgtcaggctggacgttttgatagcgaaggtttgatggatttagcagcagtggcggacaatattcgcgacccgcagatgcagtattatctctgcggcccggtagcgtttatgcagtttgcagcgaagcagctggtcgaattagggatcaacaaagacaacattcattacgaatgcttcggcccgcataaggtgctgtaa

SEQ ID NO: 4463 - DNA, 684 bp, Klebsiella pneumoniae
cgacccgggaagcctggcggcatcatccctttcatcccgcgcatcatcttcatcatgccgcctttcgacttcatcttcttcatcatgcgctgcatgtcgtcgaactgcttgagcagacggttcacatcctgcacctgcatgccgcagccggcggcgatacggcgcttacgcgaacctttgatgatttccggcttagcgcgctctttcagggtcatcgagttgatgatcgcttccatacgcaccagcactttgtcgtccatctgcgctttcacgttgtccgggatctgccccatgcccggcagcttgcccatcaggctggccatgccgcccatgtttttcatctggcgcagctgctcaaggaagtcggtgaggtcgaaaccgtcgcctttcttcagcttggaggccagcttctcggcctgcgcgcggtcaaccttgctctcgatatcttcaatcagcgacagcacgtcgcccatgccgaggatacgggaagcgacgcggtccggatggaacggctccagcgcttcggttttctcgccgacgccgaggaatttaatcggcttgccggtaatatggcgaatcgacagcgccgcgccgccgcgggcgtcgccgtccactttggtcagcaccacgccggtcagcggcagcgcttcgttaaaggccttcgcggtattcgccgcatcctga

SEQ ID NO: 4464 - DNA, 219 bp, Klebsiella pneumoniae
aaaccctacctaaaaaccgaagtgcgtgaggttatgcaaaatctggagtcgatcgactggtcaacctacgtcaaattttacgtaggagtgcatttttcgactctgttctacaccctttctacgatcgctaacgttttcacacagcctgcgctcagagctgacggtgagatagcgacatcttttgtgaagcgtttgtggtcgtgcgttgccattcgttaa

SEQ ID NO: 4465 - DNA, 765 bp, Klebsiella pneumoniae
cacgggactgaaagtcttttccgacgtgatggaagcgtgtcccgatcagtatctggcaatggccaaagaggccagcgaggaatagcgatgaatttatttgagcgtctgatgtatcggcgtttgtgcaatgagcagcctgcagatggtggagcagctccagcagcatccgaaccatccccgactcctgcggctgagcaatctgaagcagcgcaacaaccagcagcagatccagaaccttcgccagctgatggtgataaacctgagccgactggcgataagccagctccttctgctgaaccatcggttccagaaaaatatgaactaacggcacctgaatgcactgagctggactcaaaagctgttgagttgtttgagcccgtggcgcgcgatcttggtctttctaatgaccaggcgcagaagttggctggactgtggccacaactgcaggagcaaatccagaaccgccaggctgagtcgtgggggcagcaggttgaacagtgggcagctgacacgaaggctgacaaagaaatcggtggcgacaaattaacggtatccgtcggacacgcgcagaaggcgctggataccttcgcatcgaaagagttccgcgaattccttgactcgaccggcctgggtaaccacccggaaatggttcgggcattcgcaaaggtaggcaagttgatgagtgaagacagtttcgtcactggccagggtaacggatcgccgaaaaacgatctggtcgaagcgttttatccaagcaaaaaatag

SEQ ID NO: 4466 - DNA, 624 bp, Klebsiella pneumoniae
ttggtggatgatatggcatcagtgatcaatatctgcaatatcgcgctggcacgtataggcaacagccggacgattaacagcctcaccgaaaagaccaaagaggcatatacctgcaaccttttttacgagtccatgcgcgacgcagttctggcagacaacgactggaactttgccatgtctcgcgttgtcctggctgaccttggcgaccctgcgccgggatggttgttccggtatcagtacccgaccgactgcgcgcgcatagctgccatattaccgaagtggttcactgggtctcatatcgctctgcaggataagcctgtttttgaagttggcagcaatgaagatggcactggccgcgtcattcataccaatgagtctcaggcggtgctgctatatgtgaaaagcattactgacccgacgatgtttgatgccctgttcgctgatgcgctttcgtggcgtatggcggctgaaatagccatgcctatcgcggcaaatgccagtctcggccagcaggcaatggccaattatcagcaggtgcttacagcggccatgcaacgctctcttgatgaggcgcatgaaccgcagcaggcgatgtcagaccttgccagtgcgaggatctgctga

SEQ ID NO: 4467 - DNA, 501 bp, Klebsiella pneumoniae
cccatgtgtgaaccagctaccgcagcactagccgtaaccgcagttgctggcggtctcagcgcttacagtcagattcagacaggccgcgctaatgccgcgctggcgaacgctaacgccgacgctcaggagcaggccgcccgcgacactatcaatacagctaatgaccaggcataccagcagcggcagcaggcccggcgggttgccggacagcaaaccaatgcactggctgctaacggcgccgacctgacgagcggtaacgcattggacctgacaactgaaaccatgcagcagggcacgctcgacgcgctgaccaccatcaacaacggccagcgacaggccgccgggttgcagttccaggctgataccagccgagcgcaagggaaaattgataagcagtccggaatgcttggcgcaggttcaacactgctcaactccacgctgaccggtcttaatgcatacaagacgctgggcggtacctggaagccgctttccgctaagtaa

SEQ ID NO: 4468 - DNA, 993 bp, Klebsiella pneumoniae
cgaggcggtgagctgctggcgcgagacgctcgaaaatctcccgattatgcgcccgctcatcgtctgctgggcgtttactcctggaataaacagcaggatgcaacgcatgcgctggcttatctgcagcgcgccgtagcgctggagccggacaatgcgcgcttcctgtttgaactcgattttttgcaaaaattactggccaggccggtacatgagcgactgacgacgctggtggaacgtaaagccgtggtgctgaagcgggacgacctgaccgctgagctgctaagcctgtggaacgcgtccggtcattatgccgatgccgccgcgattctggatacgcgcgtattccatccctgggaaggaggagaagggaaaatcaccggccagtatttgctcaatcagctccatcgggcattacagttcatcgagcgtggggcgtttaaacaggccacggactgtctgaaagccgcattacgctatcccgacaatctgggggaggggcgactgcctgggcaaacggataacgatatctggtatttgctgggctactgcgcagaacaggctggggatgcgcagcaggcggcggaatattaccagcttgcccggcaagggggctcaacgctggacgccgggcggtactacaacgatcaacccgccgattaccttttctggcagggcattgcgctgcgtaagagcggtaacccagcgcaggccgagcagcacttccgccattttatcgactgggccgcgcagcatcgggatgacgttccgcaagtcgatttttttgccgtctctcttccggacctggtggttctcgatgtatcagcgcagcagagacatcagcagcactgcttgtttattgaagcgctgggccatctggggctgggcaacgtatccgcctgccagcagaggatgcagcagcttctgcaaataaatccggctcatgataaggcgcatctgattcgccatgccctgcaaagcggcattttttcctga

SEQ ID NO: 4469 - DNA, 405 bp, Klebsiella pneumoniae
cccactaccgaattatggaacatttccgcatccatacccgcctgcgtctgcgtctggaaaccggtcgtacacatcagatccgcgtgcatatgtcgcatatcacccatccgctggtgggtgaccaggtctatggcggccggccgcgtccgccgaagggcgcgtcggaggaattcattaccgcgctgcgtaaattcgaccgccaggcgctgcatgccaccatgctgcgcctgtatcacccgatctccggcattgaaatggagtggcacgcgcccatcccgcaggatatggtcgagctcatcgaggcgatgcgcgccgattttgaagcccataaggacgatattgactggttatgacgaaactgattgtaccgcagtggccaatgcccggcagcgtggcggcctgtag

SEQ ID NO: 4470 - DNA, 1683 bp, Klebsiella pneumoniae
tccatggccgaactctctccgaaacagcattacctcaaacacctggggcagctcaaaaatgagcgcaccagctttgaggagcactggcgcgaactggcggaatttatcgatccgcgcagcacgcgctttcttacgacggagagaaacaacggcagcaagcgtaatacccgcatcgttgaccctaccgcctctaaagctgcccgcactctgcaatcaggcatgctgtcaggtatcaccagcccaacccgcccatggtttaagctggcaacgccggatccggagatgatgcaatatggaccggtaaaacgctggcttgatgtggtcatgaccaggatgaacgacgtcatgaaccgctctaacgtctaccagtccctgccgattatctaccggcaccttggtgtttttggtaccgcggctatggcggttctcgaagacgacgaagatgtgattcgtactcatcctctgccgatcggaagttactacctgtcaaactcgcatcgtttgtcagtcgataccacgtatcgcgttttctccatgactgcccgccagattgttatgcagtttggcctggacaatgtcagtaacgccgtacgcggcgcctgggataacgcgaactatgaagcatggttcgatgtggtccatctgacagaacccaatatcgatcgtgtgaacggcaagctgaattcccgtaacaaggcattcaaatcggtgtatttcgagttgtccggggacggtgacaagctccttcgtgaggctggttttgatgagccgcctatcctttcaccgcgctgggagattaacggggaggacgtttacgggagcaactgcccgggaatgatggcgctcggtactggtaaggcgctgcagctggagcaaattcgcaaagctaacgcgatcgataagcttgttaacccgccaatggtggccccgacaggtcttaaaaataagctgatcaaccttgcccctggcggcgtcacttatgttgatgaggttgatgctaccaagctagtgcgtccggcttacgccgtcagccctcagcttaatgacatgctcggcagcattgctgatgaccgccaaatgattgaagcctgcttcttctctgacctgtttaacctgttcagcaccatcaacaccaggagcatgccagtggaggctgtggccgcaatgcaggatgagaaactcctgcagcttggtccagtactggagcgacttaatgatgaattccttgatcctttcgttgatcgcacattcaacatcatggcgcgccgcaacctctttcctgagccaccggaagaactgcagggcactcctctgaaagttgaatatgtatccattttggcacaggcccagaaatctatagggatcagcagcgttgagcgctttgttggctttgttgggaatcttgcaaaagccaatcccgcggcgctcgacaaactcaatatcgaccagacgattgacgagtacggaaatatgctcggcgtaccggccacgatcgttaactctgatgatgaggtgcaagccacgcgcgaacagcgcgctcaaatggaacaacagcagcagatgatggctatggcccagcaagctggcgcaaccgctaagaccctgagcgataccaacaccgctgaccctagcctgttaaaaaccctctctgatgctgctcagcagccagcggtgacgcaatga

SEQ ID NO: 4471 - DNA, 225 bp, Klebsiella pneumoniae
ctccacggcgatacgcatccgctggcgcaggcgttccagggcggtctgctggcgggccaagcgcagctgtggatgctgttgctgcaggcgatggaacagctgggtaaaacggcgctggcgactggcgaggaaatagtccatcgccatctccagccgctgctgtccggactgcagctggcgcagcagctcctgctggttgcggctgacgatttccgcggcggctga

SEQ ID NO: 4472 - DNA, 426 bp, Klebsiella pneumoniae
ccgacgggcgaggtcaatcattccgcgataaccaataatcagctgcgcttctgtcgatacagtttcccagcggccatttactttctggcgtttgtcgaacggaatcaggtatgcgtggccaagtgcgccgcctggctcaagaccgagttgagcacattgcataatcgccccgaggaagctggcctggtcacaggccgccagttttgggatcttgcggatctctgtagtagctatgcgcgcaaggcggtcggctgtcatgtgctttggaagagccagcgccatctgagccttaatttttggatctgcgagcaagccagccagagtggttggtttatcgctatgctgcgcgacctggtttcctgtcgctgctgccttaagtgcgttggtagacatgttttctccttacttcattctgaatacgcgtga

SEQ ID NO: 4473 - DNA, 516 bp, Klebsiella pneumoniae
gcgagggtagagccgggtcacttcctctgtgagcgtgctgtcgatgccgatagcaaacacgctgcggatcaacgcctgcgacaaatgaatatagagttgatcgctgagcccctgctcatcactgaacgctctgccagcgaggatctggaagcggtggatcaggccggagatagccagccgcaggcggcgatcgtgcgggtgaccgtcgcggaccgggtcgggggttttgagcaacataaacagcagcgagaggaaaaaaggttctccgacatggggcggagcgccgacccgacgctgccagtggcggacaatctcctgcgccagggtgaactcggcggcggtttgagcccagcgttgctgttcctcattgaagtccggagagtatccccggtgatgttcgagcagacagtactgcaggtacaagcgcagaaactgcacgtcgcggcagtcaaactggcgattgagcgcccgcgcgcagcggttcaccagcgcctgcagattggtatcatcgtataa

SEQ ID NO: 4474 - DNA, 1881 bp, Klebsiella pneumoniae
ataatgtcagaccttttttctctggtcccggagggccaggcatggctggacaatcaggctatggaaaagccctcacgccctgaagacttcgaaccgtcggcatttcagggtggcgcgtcggcatttttccgcggcgccggagagggggctttgggcctggctcagtctgccgtaggatttagcaagcgactgataagtgacccggcatttaccgacaatgtcgcacctaccatcaacatgttccgcgtcatgttcccggatgccgacaaagcgctgaatgagtcatatgacgatttcggtaagcaactgagcagcgccagggaatacatcaagcccgaggccggaagtcagggcatagccgctcaggtcattcacgggttgggccagtttgcacctgcgatcggtgcttcagttattggcggaccggtggtcggcgcagcggcggcggcaggcagcacctacgagcaggcctaccaggatgctttggcaaagggtgttgacgaacagaccgcacgcgccgtggcagctgaacaaagcggattcaatgcggtaggtatgggattgccagcggcagtaggcggaagactggcgacaagacttctctccggtgtaggcatcaacgcggcattcggtggcctaaaccgctttgctgtcggtgagactctggaagagaacggctatgcagatatggcgaagcagtaccgtgtctttgacagtcaggccatcctgatcgattccgtactcggggctgcgtttggcggcgctcatcactttgcagcgcgcggtaattccgttgatgccagggctgatgcgccgccgacagttgatgagggtactacgccgccgcaggatgcaacggtaacagcagaaacggcgcatgcacaggaatctggtgttgtgcctggtgctgataccagtacgccaggtgcgacgtatgattcacggctggcagaactgcagcaactggccgggcaggttttatctcgcggtgaccgtaaagctctcaccgacgagatatatcgggcagagtatgaaattgcacggataggagaacagcgccaggcactgcgtgaccaacgcgtgggaaacagcagcagccgtcgcattcgtaatcgggaactggcagcgctcgagcagagggtgcaggaaattcagagcaggattgaacccagcaggcaggctcttgcagacagcacccctggcggacggttctacgatgcgcgctctgatctttccaggttggagcagggaattatcccggagagtatgcgcggactgatccctgaatcatcagctaaacccagtgatatcgatgcggcccataccctgaatgaagggctgcattatgatattgagtccgcgccggttctgcacggcagcgaagccagcattaacagtcacgttgctgcgatggatgaggccgcaaggcagttgatgacagggcagcctgtgaacgtcagcatgcaggcgcgtgggcttgatggcgttgtgcgtcctgatttgctggccgatgcatcggagcagcgcgcggcgatggaacaggtataccgtgaaaacgggatcccgctagcccagcgtgaagccgtcagtgaatcgccggctagaatgaccgacaatagcgctttctccggaaaagaagatacttcacaggtcagcgtggatcccgatacgggagaaaccatttcctcaggtagttacgatctgatggctgcgcgcgaccttgccggcgttgagtcggatatcaccgtcgctcatcctgacaccgggcagccggtgaagctttcagaagtgctcgccgatctggataaccagatcgcgaccgttaaaaacgaatcccgcgcctactctgtggctgcttcctgcttcctgaggaatccgtga

SEQ ID NO: 4475 - DNA, 1455 bp, Klebsiella pneumoniae
catcgaccagagctaatgattgagacaacatccttgaagcgactctctcttttcccccgttcgctgcgtcagctggtgacgctctcctttgtgctgatcctgctgccattgctggtgctggcctggcaggcctggcagagcctgaacgccctcagcgcccaggcggcgcatattaaccgtaccaccctggtcgacgcccgacgcagcgaggcgatgatcaatgccgcactggagatggagcgcagctatcgccagtactgcgtgctggacgatccgacgctggcgcgcgtctatcaaaaccagcggcagcgctacagccagatgctggacgcccacgccggcgtgctgccggacgagaagctctggcaggcgctgcgtcaggatgtcagcgatctggcgcagctgcagtgtaaaaatagcggacccgatgcccaggcagccgccagactggaagttttcgccagtaataacagcgatatggtgcaggcgacccgggcggtcgtctattctcgtggccaacagctgcagcaggagatagccgaacgcggccagtttttcggctggcaggcgctggtgctgtttctgctgagcctggcgctggtgctactcttcacccgcatgattatcggcccggtgaaaggcatcgaaagaatgatcaatcagctgggggcagggaagtcgctggacgacgccgcattgtttaccggcccgcgggagctgcgatcggtgggcaagcgcatcatctggctcagcgagcgcctggcgtggctggagtcgcagcggcatcaatttcttcgccatctgtcgcatgagctgaaaaccccgttggccagtatgcgtgaaggtaccgagctgttggccgaccgggtcgcggggcccctgacccctgagcagcaggagatcgtcgagatcctcgacagcagtagccgtaacctgcaaaagctgattgaacagctgctggactataaccgaaaacaggccgacggcccggtggctcgcgaagcggtggacctggtggacctggtggaaaacgtcgtggcggcgcacagcctgcccgcgcgggctaaactgatgcataccgaactgacgctgcaggcgcggcgttgcctggcagagcctgcgctattgataagcgtaatggataatctgtactccaatgcggtgcagtatggcgctgaatccggtaacatccgtatccatagctaccggcacggagagcaggtgcgtattgatgtcgccaacagcggcgaaccgatcccggccgcggaaaaaaatatgatattcgagcctttttaccaggggagtcaccagcgtaaaggggccgttaagggcagtggactggggttgagtatcgcccgcgactgcgtccggcagatgcaaggggagctcagcttagttgatgcgcccgccgggcaggtctgttttcgcattacgcttccctcagcgccggaataa

SEQ ID NO: 4476 - DNA, 1479 bp, Klebsiella pneumoniae
ccagtgacagacgccgctttatccccggaagaacagctgatcgacgatatcgccagctttacgcatgacccgctgggctatgcgctgtatgcgttcccgtggggcgaggatggcacagagctggcgcacgcctccgggccgcgacagtggcaggctgacgcattccgcgagataggagagcacctgcagaatcccgcgacacgtcaccagccgctaatgatttcccgcgcatccggccacggcatcggcaaatctgcgttcatctcaatgctgattaactgggccatgtccacctgtgaagattgcaaggtggtggtgaccgctaacaccgacaaccagctgcgcacgaagacctggccggaaatcatcaaatggtcgaaccttgctatcacgaaagaatggttcacctgcaccgccaccgcgatgtacagcaacgatccgggccacgacaaacgctggcgcgccgatgctattccctggtctgagcacaacaccgaggcgtttgctggcctgcacaacgagcgtaagcgcatcgttgtggtgttcgacgaagcatccaacatcgcggatctggtctgggaggttgctgagggcgcgctgacggacgaagacaccgaaatcatctgggtggcgttcggtaaccatacgcgcaacaccgggcggttccgggagtgcttccgcaaatacaagcaccgctggaagtgcgcgcaaatcgacagccgcaccgtcgaaggcaccaacaagcagcagctgcagaaatgggtggacgactacggcgaggacagcgactttgtgaaggtccgcgtgcgcgggatcttccctgatgcgtcggagctgcagttcatccctaccgggctgactgatgaggcgatgaagcgcgtggttaccgctgcgcaggtggcgcatgccccgcgaataatcggcgtcgacccggcatattccggcgtggatgacgcagtgatttatctccgccaggggctgcacagcaaagtgctctggaccggcaacaaaaccacagacgatctgattatggcgaagcgtatcgctgactttgaggaccagtaccaggctgatgcggtgtttatcgacttcggctatggcaccgggctgaagtctataggtgacggctggggtcgcacctggcagcttgtgccgttcggcggcgcatcggcagacccacagatgctgaataagcgtggcgagatgttcaacgcctgtaagacgtggctcaagctaggcggcgctctggacgaccaggagacggcggacgacctgtccgcggcagagtacaaggttagggtggacggcaagatcgttatggagccgaaagaggatatcaaagagcgtcttggccggtctccgggcaagggcgatgcgctgcttctgacattcgcatacccggtgacgaagcgttcagatttccctgctgccggcggcaagcagcccaacgtgatcagcgagtacgacccatacgcatga

SEQ ID NO: 4477 - DNA, 555 bp, Klebsiella pneumoniae
aaagaccaagatcgcgcgccacgggctcaaacaactcaacagcttttgagtccagctcagtgcattcaggtgccgttagttcatatttttctggaaccgatggttcagcagaaggagctggcttatcgccagtcggctcaggtttatcaccatcagctggcgaaggttctggatctgctgctggttgttgcgctgcttcagattgctcagccgcaggagtcggggatggttcggatgctgctggagctgctccaccatctgcaggctgctcattgcacaaacgccgatacatcagacgctcaaataaattcatcgctattcctcgctggcctctttggccattgccagatactgatcgggacacgcttccatcacgtcggaaaagactttcagtcccgtgttacgttttccttcggcgaaggctgccgagagcgcctcaccggtataagtcgtacgccacacgccagcctgctcaatcaggcgccagatgaaacggcggccgtgttctgtcccgcagatgaggcgcaggtcattaagttcgttctcgcgccgtaa

SEQ ID NO: 4478 - DNA, 786 bp, Klebsiella pneumoniae
acggtaaaagacggcgctatgtggattggcataattagcctgtttcctgaaatgttccgcgcaattaccgattacggggtaactggccgggcagtaaaaaatggcctgctgagcatcgaaagctggagtcctcgcgacttcacgcatgaccggcaccgtaccgtggacgatcgtccttacggcggcggaccggggatgctaatgatggtgcaacccttacgggatgccattcatgcagcaaaagccgcggcaggtgaaggcgcgaaggtgatttatctgtcacctcagggacgcaagcttgatcaagcgggcgtcagcgaactggcaacgaatcagaaactgattctggtgtgcggtcgctacgaagggatagacgagcgcgtaatccaaaccgaaattgacgaagaatggtcaatcggcgattacgttctcagcggtggtgagttaccggcaatgacgctgattgactccgtttcccggttcattccgggagtactgggccatgaagcatcggcaacggaagattcctttgctgatgggttgctggattgcccccactatacccgtcctgaagtgttagaggagatggaagtaccgccagtattgctgtcgggaaaccatgctgagatacgtcgctggcgtctgaagcagtcgctgggccgcacctggcttagaagacctgaacttctggaaaacctggctctgactgaagagcaagcaaagctgctggcggagttcaaaactgaacacgcgcaacagcagcataaacatgatgggcaggcgtga

SEQ ID NO: 4479 - DNA, 576 bp, Klebsiella pneumoniae
aatcaacgagatatatgcaaccttaatacggagctcttgatggtcaccacacatgttttcatcgcggtcagtcttgatggttatatcgcccgacaagatggcgatatcgactggctgttgaagcgcgatgacccgacagaagaccatggctatgccgcattcatcgcggacaaagattggatcactatggggcgaggcagctttgagaaggtgctgacttttgacgaatggccttatgatcgacccgtgctggtactttcccggcagctaaccaataccccggtgcctgaggcgctgaagggcaaagtgcagttttcatgccgcacgcccagggaagctcttactgacctgatggagaagaacgtgcaccgggtctatatcgatggtgggcagttaatacagtcgttcctgcgcgaaggtctggtcgacgatatcgttatcactaccgttcctgtcctgctcggttcgggaaaaccgctgttcggagtgctgccccatgatatcgatttgacgctattatccagccgcagcttcccttcgggtctggtgcagtcgcactatcggctgacgtcataa

SEQ ID NO: 4480 - DNA, 225 bp, Klebsiella pneumoniae
acgcgtatggagcgcagcaaaatgtgcatcagcaagccgaaagtgagttctccgcaggttcaggcggcgccgcaggtttccgattctgctgtacagaacgccgctgatagcgatcgtcgtcgccgtgccgcagcgggagggcagaaatcaacaatcctgacgtcgagccagggtgtaacgcagccttctggcggcactcagggtaagaccctgctcggggcgtaa

SEQ ID NO: 4481 - DNA, 744 bp, Klebsiella pneumoniae
cgcaacgtggatggatggcagcgcgcctttgtcctgcatagccgtccgtggagcgaaaccagcctgatgctggacgtcttcacggaagaatccggtcgtgtgcgcctggttgccaagggcgcacgctccaaacgctctaatctcaaaggcgctttacagccctttacccccttgctggttcgcttcggcgggcgcggcgaagtcaaaaccctgcgcagcgcggaagccgtttcgctggcgctgccgctcagcggcatcaccctctacagcggtctctacgttaacgagcttatctcccgcgtgctggagcacgaaacacgtttctccgaactctttttcgactacctgcactgcattcaggcgctcgccggggccagcggctcgccggagcccgcgctgcggcgttttgagctggcgctgctcgggcacctggggtatggcgtggattttctccactgcgccgggagcggcgagccggtagacgacaccatgacctaccgctatcgtgaagaaaaaggctttattgccagcctggtgattgataacaacacgtttaccgggcaccatttgaaagcattggcgagtcgcgagtttcctgatgttgatacgctgcgcgccgcgaagcgctttacccgtatcgccctgaagccctatctcggcggcaaaccgctcaagagccgggagttgtttcgccagtttatgcccgcgcgaaaggcgcgagccgataatacgaataatgattaa

SEQ ID NO: 4482 - DNA, 222 bp, Klebsiella pneumoniae
cgtatgacggacctgtcgcgaccggccggaccaacatatccgtttgataccgggacgcttcgccgcagcccgcgactggcctgcgttcagcagctttttagcggctatcagttcatccctggcttcggggggcgtgataccgtcacgaccatgctgaccgataaccagcgtctcccggcggccgttgatgcggtaatcgtaacgaaacgagatggtgcctga

SEQ ID NO: 4483 - DNA, 1356 bp, Klebsiella pneumoniae
gtaaaagcggacgctcttccctgcccacgccgcggtcattgtctatccttagcggaaaccctaactggaacttaccagatgatgaccgtcattgaaccaccatctgcgctttccagtccacagcgccgtagccaggtgctcctgatgttttatctgcccggacagtcggtgacgactgaacggcttggcaggatcaacctcgttgatgagaccacggcccggcaggatattgaggagaccggacgcgaaattcagcgttaccaccgtttgaccctccagtcacaggtggacggcagctatcggattgaaggcgccgcgctcgaccaacgtttatgtctgctgcatgcgctgcggcgggggctgcgcctctgcccacagttcgttaatcatcattttaccccggcgctgaaaacgcagcttaaacaggaaggcattgcccgcaccttatacgatgataccaatctgcaggcgctggtgaaccgctgcgcgcgggcgctcaatcgccagtttgactgccgcgacgtgcagtttctgcgcttgtacctgcagtactgtctgctcgaacatcaccggggatactctccggacttcaatgaggaacagcaacgctgggctcaaaccgccgccgagttcaccctggcgcaggagattgtccgccactggcagcgtcgggtcggcgctccgccccatgtcggagaaccttttttcctctcgctgctgtttatgttgctcaaaacccccgacccggtccgcgacggtcacccgcacgatcgccgcctgcggctggctatctccggcctgatccaccgcttccagatcctcgctggcagagcgttcagtgatgagcaggggctcagcgatcaactctatattcatttgtcgcaggcgttgatccgcagcgtgtttgctatcggcatcgacagcacgctcacagaggaagtgacccggctctaccctcgcttactgcgtaccacccaggcggcattgagcgaattcgaggaggcctggcacatccgttttaatgaggaagagaccggtttaatcgcggtgatctttggcgcctggctgatgcagaaaagcgacctgcacgagaaacaggtgctgttgctaaccgatgacaacccagcaattgaagaggccctggaacaacagctgcgcgaactaacgctgctgccgctgaatatcaaataccagagcgtagagcgctttcagaaggaaggtgcgcccaaaggggtgacgcttatcgtcaccccctatgcgacggcgctgccgctgttttcgccgccgctgatccacgcggagaactacttcactgaacgccagcagcagcatatctgcgccatgctcgaggactag

SEQ ID NO: 4484 - DNA, 1272 bp, Klebsiella pneumoniae
ctgagtcaggagatgcggatgttaaagcgtgaaatgaacattgccgattatgatgccgaactgtggcaggctatggagcaggaaaaagtacgtcaggaagagcacatcgaactgatcgcctccgaaaactacaccagtccgcgcgttatgcaggcgcagggctctcagctgaccaacaaatatgctgaagggtatccgggcaagcgttactacggcggctgtgaatacgtcgacgtggttgaacagctggcaatcgaccgcgcgaaagaactgttcggcgctgactatgctaacgtccagccgcactccggctcccaggctaactttgccgtctacaccgcgctgctgcagccgggcgacaccgtgctcggtatgaacctggcgcagggcggccacctgactcacggctccccggttaacttctccggcaaactgtacaatatcatcccttacggtatcgatgagtccggtaaaattgactatgacgacatggcgaagcaggctcaggaacacaaaccgaagatgatcatcggtggtttctccgcttactccggtatcgttgactgggcgaaaatgcgtgaaatcgctgacagcatcggcgcttacctgttcgtcgatatggcgcacgtggcaggcctgattgccgctggcgtgtacccgaacccggttccgcatgctcacgttgtgaccaccaccacccacaaaaccctggcgggtccgcgcggcggcctgattctggcgaaaggcggtagcgaagagctgtacaaaaaactgaactctgcggtattcccaagcgcgcagggcggcccgctgatgcacgttatcgcggcgaaagcggtggcgctgaaagaagcgatggagccagagtttaaagtttaccagcagcaggttgcgaaaaacgctaaagcgatggtggaagtgttcctgaaccgcggctacaaagtggtgtctggcggtactgagaaccacctgttcctgctggatctggtggataaaaacctgaccggtaaagaagctgacgccgctctgggccgcgccaacatcaccgtcaacaaaaacagcgtgccgaacgatccgaagagcccgttcgtaacctccggtatccgtatcggttctccggcagtgactcgccgcggctttaaagaagcggaagtcaaagagctggctggctggatgtgtgacgtgctggacaatatcaatgacgacgcggtcattgagcgcgtgaaaggtaaagtgctggatatctgcgcccgcttcccggtatatgcgtaa

SEQ ID NO: 4485 - DNA, 324 bp, Klebsiella pneumoniae
tcccgggaggaaaagacgatgacaggccatgatctgctgctgatcgccaatgccctcatctgcggcgggatagcgctgagggtgatgttcttccagcgcaacggatcgcgccaccgccgctggggcgggtggatagcctatttcctcatcgtggcggcggccagtatcccgcttcgcaccgcgtactcatacctgtaccacttccccatgaccgcagatctttctgaggtcgttatcaatgctgtgatgttcgccgcggtgctgaagacgcgcggcaacgtcgtgcaaatattcaagatatcgaggtcgcaacatggacattaa

SEQ ID NO: 4486 - DNA, 426 bp, Klebsiella pneumoniae
cggctggtactgcgttacggcatgcgggctgatgagctggaagtttcgcacgctgccggaagcaatcagctgggcgttcgtcagcaaactggcagcaaaaacggaaatgggtatgggggtgagcaagtgaacattcagcagattaacaacctgaaaaaaatcatgaacaacatcgacggagactaccagcttaaccagatgctgtatgagcgccacgtcgagcttatcgacgcgatcaagttccatcaactgcaaaagccattctacgaactggagcgcaaaggcgtgcgcagcgagatcctggaagagctgatgatgagctctgagtttgaagaatgcctggccgcgtatcagcgggaactcaccggcatcattgccaagtgggatctggctgaccaactggatacggcgagggacgcagcatga

SEQ ID NO: 4487 - DNA, 720 bp, Klebsiella pneumoniae
cgtttttcactagcgactcccatgactgataacgctgtccttcgcctgcgcgccgaacgtctcgcgcgagctacccgccctttccttgcgcgcggcaatcgcatccgccgctgccagcgctgtctgctgccgctcaagcagtgcctgtgcgccacgttaacctcggcgcaggccgccagccgcttctgcctggtgatgtttgatacggaaccgatgaagcccagcaacactggccggctcatcgccgatattctgccagataccgaagcgtttcagtggtcgcgtaccgaaccgccgcaggcgctgctcgatctggtcgcccatcctgattatcagcccatggtcgtatttccggcctcctatgccgggccggatcgccaggtcctgagcgcgccgccgtccggtaaacccccgctgtttatcatgctcgacggcacctggaccgaagcgcgcaaaatgttccgtaagagtccttatctcgacgcgctgccgattatctccgtcgatctgtcgcgcatctctgcctaccatctgcgcgaggcgcacgccgacggacaatattgtaccgcggaagtggccatcgccctgctggatctggcgggcgatgccccggccgccgctgcgcttggcgagcacttcacccgcttccggacccgctatctggcgggaaaaacccagcataagggcagtatcacagcgggccaggtggaaaacgtttaa

SEQ ID NO: 4488 - DNA, 1581 bp, Klebsiella pneumoniae
tcattcccactcaatcgttgctggcggcttgccgctgatgtcatacaccacgcgggagataccgttcacttcattgatgatacggttggagacgcggccgaggaaatcgtacggcaggtgtgcccagtgcgcggtcatgaagtcgatggtttccaccgcacgcagggaaaccacccagtcgtatttacggccatcgcccatcacgccgacggaacgaaccggcaggaacacagtgaacgcctggctgactttgttatacagatcagctttgtgcagctcttcgatgaagatagcgtccgcacgacgcagcaggtcgcagtactctttcttcacttcgcccagcacgcgcacgccaaggccggggcccgggaacgggtgacggtaaagcatgtcgtacggcaggcccagttccaggccgatcttacgtacttcgtctttgaacagctcacgcagcggctcaaccaggcccatcttcatctctttcggcaggccgcccacgttgtggtgagatttgatgacgtgcgctttaccggtggcggaagcagcagactcgataacgtcagggtagatggtaccctgcgccagccatttgacgtcgtccagcttcagcgcttcttcgtcgaacacttccacgaaaacgcgaccgataattttacgcttcgcttccggatcgctttcacccgccagcgcgtcgaggaaacgctgctcgccttcaacgtgaacaatgttcaggccaaagtggtcgccgaacatctccatcacctgctgcgcttcgttcaggcgcagcagaccgttgtccacgaatacgcaggtcaggtttttgccgatagcgcggtgcagcagcatcgcggtcaccgaagagtccacaccgccggagaggccgaggatcactttgtcgtcgccaacctgctgacggatacgctcaacggcgtcgtcaatgattttcgccggggtccacagcgcttcgcactggcagatgtcgcgcacgaagcgctccagcatacgcatcccctgacgggtgtgggtcacttccgggtggaactgcacgccgtagaagcgtttttcttcgttggccataatggcgaacgggcagttgtcggtgctagcgacggttacgaagtccgccgggatagcggtcactttgtcgccgtggctcatccacacgtccagcagcggtttgccgtctgcggtcagggaatcttcgataccgcgcaccagcgcgctgtcgttaaccacttcaacctgcgcgtaaccaaactcacgctcgttagaaccttctacatggccgcccagctgcatcgccatggtctgcatgccgtagcagacgccaaataccggcacgccggcttcgaacacatactgcggcgcgcgcgggctgttctcttcggtggtgctttccgggccgccggaaagaatgatgccgcttggattaaattcgcggatctgtgcttccgtgacatcccatgcccacagctcacagtagacgcccagctcacgcacgcgacgcgccaccagctgagtatactgagacccgaagtcgaggatgaggatgcgatgtttatgaatgttttccgtcattga

SEQ ID NO: 4489 - DNA, 384 bp, Klebsiella pneumoniae
atgatggcactgaccaaaaaacagcgcgcagagctgcgtatgaagtttggcggacgctgcgcttactgtggctgtgagcttggcgataaatggcacgctgaccacgtcgaagcagtacgaaggaatatcagtaatggctacgcaatggacaggcctgaaaacgatacggtcagcaacatggttccggcatgcattccctgtaacctgttcaaaatgtgcagcacggttgaagattttcgcaatcgcattgcaactcaggttgatgtgactcgccgggcatcgagaagctaccgcacagcggaatcattcggcctggttcaaccaactaacgcgccggtagtgttctggttcgaaaagtatcaggaagaaggagccaaccaatga

SEQ ID NO: 4490 - DNA, 258 bp, Klebsiella pneumoniae
ggaaatttttgtgccaacccggttggaaaacctgtaaaggaacttggactttccatgttttacggcggggaagccaaaaaaggcttaagttcccggggggcttttcccttcccacccccccccccggccttaaccgggggggaagcttttataaacacaaacccctgtggcccctcaaaaaccccctttaccttaaaaaggaggatgggggaaaccgcccttgttttaacccaaagccaggtttatgtgtctcattaa

SEQ ID NO: 4491 - DNA, 1056 bp, Klebsiella pneumoniae
tcggctggttgttttccctgggcttattctgaggactcaatgatgaacaaaatcagagccgccgtggtcggcgcaggtatctacggcagacaccatatgaacgcgtaccgccacaacccggacacggtgctggtcgccatctgcgacaccgacacagaacgctgtgacgaccttgccatggcctacggcgtaatcggctatacccggctggatgccctgctgcaggaggaagccatcgacgtggtttcggtggcgacacctgacccgtaccacaccgaatccatcctcactgccctgcgccaaggcaagcatgtgctggcggaaaagccgctcgccacctcggtacgcaagtgcgagcttatcgtggagatggcgcagcagcgggacctgctggtcggcgtcgatttccacaagcgctgggacccggcggtgatgcgcatcaaagctgaactggagaagccggaagccgggcgcatcctgcgcggccatatcagcatggatgacgtaatcagcgtgccgacggagtggctgaactgggcgggcgcaagctccccggtgtggtttctcggctcgcactgctttgacctggtgcgccatctttccggacaggaggtggtgtcggtgtacgccgtcgggcagaagcggctgatggctgaatgcggcctcgacaccttcgacagcgtgcagagcctgctgacgatggccgacggcagttcgtgggtggtggaaaactcgtgggtgctgccggagggcttcccgaaggacaacgacgggcgcattgatattctctgtgaggcaacgtatatccgcagcacctcgcagcatcgcgggctggaaatcaccacgccaggcatgacgctcacgcccaacagctacttcatcaactaccgcaacggtgtcgccagcggtttcggtatcgatccgataaacgactttattcgcgcggtcaggaaccgttcgccgtacccggtgacggcagaggacgggctggcggtcagccggatttgcgaggcggtgcaccgcagtctggagagcgggaaacctgaagatgtttaa

SEQ ID NO: 4492 - DNA, 381 bp, Klebsiella pneumoniae
gccacgtactgctcgggcccaaaaaggaatcaaatcactatgcgctgtaaaacgctgactgctgccgcagcggttcttcttatgttgaccgcaggctgttccactctggaacgagtggtttaccgtcctgacatcaaccagggtaactatctggcaccaaacgatgtagcaaaaattcgtgtcggtatgacgcaacagcaggtagcttatgctctggggacgccaatgatgacggatccgttcggcaccaatacctggttctatgtcttccgtcaggagccgggccaccagaaagtgactcagcagaccctaaccctgaccttcaacagcggcggtgtgttgactaacattgataacaagcctgcgctgaccagtcagtaa

SEQ ID NO: 4493 - DNA, 219 bp, Klebsiella pneumoniae
ccaccaaactgtatcgagattaaggtgatgagcgaaattctgaccttcggtttgatggtaggccaaccggcattgcgtaatctgtgcctcgcgggttcacctagaacgctgttagcaatgtccgctcttcgctcacagcggaccttcatcttaggtaacttgctcgcttcgtgcctggagcggacattgctaaaatcaacgagatatatgcaaccttaa

SEQ ID NO: 4494 - DNA, 495 bp, Klebsiella pneumoniae
gacatgagactgacatctaaagggcgttatgccgtgaccgcaatgcttgacgttgcgctcaactctgaaacgggcccggtgccgttggcagatatttcagagcgtcagggaatttcgctttcctatctggaacagctgttctctcgcctgcgtaaaaatggcctggtttccagcgttcgtggcccaggtggtggttatctgttaggtaaagatgccggcagtatcgccgtcggcgaagtcattagcgccgtggacgaatccgttgacgccacccgttgccagggcaagggcggctgtcagggcggcgataaatgcctgactcacgcgctgtggcgcgacctgagcgagcgcctgaccggcttcctgaacaatatcaccctcggggaactggtgaataaccaggagatcctcgatgtttccggtcgtcagcatcagcacgaaacccagcgcaatgcgcgcacccaggacgcgattgacgttaaactgcgcgcctga

SEQ ID NO: 4495 - DNA, 1239 bp, Klebsiella pneumoniae
aatgcgcaatgctcacgcaatatagttaagggagttaagtgtatgcagcgtactggctttaataacgcccgggtccggcaggccaataagtcgatttttctttcccatctatggcgggaaaagcagctcagtaaatcacagctctctcaactcaccggtctctccattccggcggtgagcaatattctggccgagctgcttagcgagggattgatcggtcactcaacggaacacttgagcaaacggggcgtgaacagcggcagctaccagatccccgagcacggcgcctggacactgtgcatgaatatcaccccgaccagcattgaatatcagcttgccgacgcccgcctgctggcagtggatggccatcagcatttgccggtcaacgcgcccactcctcaggccctgcttgaggccatcgttgaatgctggcggcatatccaccgccgctacccgcagcacagcatcaatctcgcccttggcgtgcatggtcaggttgatccgattaccggcgtttcacaaaccatgccccaggcacgctggaaaacaccgatcgaaataaagtatctgcttgaggagcggcttggcgtgcaggttcgggtggataacgactgcgtgatgctggcgctggcggagaagtggcagcatcagggtacacagcaggatttttgcgtgatcaacgtcgactacggtatcggctcgtcatttgtgattaacgatcatatttatcgcggcagtctgtacggcagcgggcagattgggcatacgattgtcaatcctgacggcaacgcctgcgactgcggaagatacggttgcctcgaaaccgtcgcctctctcagcgcgctgaaaaaacaggcccgaatgtggctcaaaacgcagcctgaagcaacgctcgcccccgagcagttaaccacggcgtcgctcattgaggcctggaaagagggagatgtgcaaattcgcgcatgggttgataacgctgccaacgcgattggcttaagcctctataatttcctgaatatattaaatattaatcaaatctggctttacgggcgcagctgcgccttcggtgagcagtggctggaaagtatcgttaaacaaacgggtttcaacccctttgaccaccgggatacgccgcgagcgcacgccacccaaataggctttggccagctgacacgcgcccagcagctgatggggataggttatctgtacgttgaggagcaattgcagacgctggtttag

SEQ ID NO: 4496 - DNA, 624 bp, Klebsiella pneumoniae
cgagatgaatgcgaaaaaaacgcggagaaattcatgagtagtaaagaacagaaaacgcctgaggggcaagccccggaagaaattatcacggagcagcacgacgacgttgaggcagtagagcctgaagtttcggctgagcaggtggatccgcgcgatgaaaaaattgcgaatctggaagcccagctggctgaagcgcagaaacgtgaacgtgaagtgatgctgcgtgccaaagccgacgaagataacctgcgtcgccgtaccgagcaggatatcgagaaagcgcacaaattcgcgctggaaaaattcgtcaatgaactgctgccggtgatcgacagcctggaccgcgcgctggaagtggctgacaaggctaacccggagctggcgccgatggtggaggggatcgaactgaccctgaaatctatgctggacgtagtgcgtaagttcggcgtggaagtgatcgccgacaccaacgttccgctggatccgaacgtccaccaggccattgcgatggtcgagtctgaagatgtggcggcgggcaacgtgctgtccgtgatgcagaaaggttataccctgaacggccgtactattcgcgccgcgatggtgacggtagcgaaagcgaaataa

SEQ ID NO: 4497 - DNA, 228 bp, Klebsiella pneumoniae
gccaccgaatgccgcgttgatgcctacaccggagagaagtcttgtcgccagtcttccgcctactgccgctggcaatcccatacctaccgcattgaatccgctttgttcagctgccacggcgcgtgcggtctgttcgtcaacaccctttgccaaagcatcctggtaggcctgctcgtaggtgctgcctgccgccgccgctgcgccgaccaccggtccgccaataactga

SEQ ID NO: 4498 - DNA, 381 bp, Klebsiella pneumoniae
cccactggatggcgcctccagccgccccgcaggaggttagtgatgcctaaatcccccgcagaacgcaaagccgcgcagcgcgcgcggcagtccgccgccggtgagcgcaaaattgaactggtgctggatgaacaggagcaggaaatgctggcgcggaactgcgccgcccggcgccctggtcgcgatccctacgaaatggccgagtacatcgcgctgctgatccgccaggatgatgcccgcgtgcgcggccggattaacgccatcagcaaacggcgctgcggcaagtgcggcgatcaactgccggtggcatcctgcccttgcactggtgattctcagtgctgggccactcttggctggcacgaaacaaaactaccgctgtga

SEQ ID NO: 4499 - DNA, 387 bp, Klebsiella pneumoniae
ctaaatcctcgcatgattgtactgtttaaatatacagtatttttatgtgaggtcatcatggggtttccatcacctgccgcagactacgttgagcaaacgctaaccgtttcccgcctttgtcagtatgacgccaactgtcgcgccctggagactgccgccggttatgccatcgtcgatgtctgccgccggccaaagcagggtgatcatgttcttatcgcatatgccgggaaaactgaattcgctgttgtccgcgggcaggcgctgatcactgatgatggtgaggcgctggaaggggacgccctggacgatgttgaagtgcggggtgtcgttacctacctgataaaccgggccgggtgggtgagtgatgatgatattccgatcatgtaa

SEQ ID NO: 4500 - DNA, 480 bp, Klebsiella pneumoniae
gctgaatatcggtcacgcgattattggccgtgcggtgatgagcggcctgaaagaggcggtggcggaaatgaagcgtctgatgctggaagcgcgcggctaatggccattctcgggttgggtaccgacatcgtcgagatcgcccgcatcgaagcggtgatcgcccgcagcggcgatcgccttgcccgccgggtgctgagcgaccatgaatggagcatctgggagcagcaccagcagccggtgcgtttcctggcgaaacgctttgcggtcaaggaagcggcggcgaaagcgctgggaaccgggatccgtaacgggctggcgtttaaccagttcgaggtttacaacgacgagctgggcaagccgaagctgcggctatggggtgaagcaaaccttttagctgaacgcatgggagtaagcgctattcacgttactctcgctgatgaacgccactacgcctgcgccacggtgattgtcgaaagctag

SEQ ID NO: 4501 - DNA, 486 bp, Klebsiella pneumoniae
caaagtcatcgggcattatctgaacataaaacactatcaataagttggagtcattaccaaaacaggccacctttaaatgcaactgacaaagatgcttttaaccggccgcgagggggtaacatgatgaacactggcgccatcattcaggatctgattgactggatcgacaaccatcttgatagccgtctggatattgacaccgttgcccgacgagccggctattcgaagtggcacctgcagcggatcttcaaagaacataccgggcagcccctcggagaatatattcgggcgaaaaagctgcaaaagtcgatcgaacgcttggcccacagcaacgagccgatcctgaacgtggcgattgccctcggctttgattcccagcagtccttcaaccgcagcttcaagcgccagtacggcaaggcgcccggcgtctggcgccggagtatcagccgctctgttgcgcagacatctcgtcagcgatccgcatga

SEQ ID NO: 4502 - DNA, 321 bp, Klebsiella pneumoniae
ggtatcggtcggctcatccctgagcgtggattagcggatggcggtgcggcgctgctgccactgacggatttcagcagcatcgaaaaccaccagtcgggaagagaggtggacggggcggggaaagtcggtgtttttaatcaggcggtaaaccgacgattcactcatcgccagaaactggaccacctgccgcatacgcacattgccgctttcgggaaaagcatcgttgctgtcagcacgggttttcatgattgcacctcacgggaacagagtgtcgaggcggttatagcgcggaagggtggggagaggtataggtccggatga

SEQ ID NO: 4503 - DNA, 1305 bp, Klebsiella pneumoniae
aacttgtcccgttcttcttcgcattcttttttaccttcccctgaccgggaggcaattcgtcgtataagaaagaatgcgaagacgaacaataaggcctcccacccgggaggccttttttatttgataacaacaaaggcaacatctatgaccgaggaaaacccattactggcgctgcgcgataagataagcgccctggacgagaagctgcttgctctgctggcggagcgccgcggactggctgttgaggttggaaaagccaaactggcctcccatcgtccggtgcgtgatattgaccgcgaacgcgatctgctggagcgcctgatgactatcggcaagcgccataatctggatgcgcactatatcacccgcctgttccagctgattatcgaagactctgttcttacccagcaaaccctgctgcagcagcatctgaataaaattaacccgcattcggcccgcgtggcgttcctcggtcccaagggctcttactcgcatctggcggcgcgtcagtacgccgctcgccactttgagcagtttattgagagcggctgcgcgaagttcgccgatatttttaatcaggtagaaaccggccaggccgattacgcggtggtgccgattgaaaacaccagctccggcgggatcaacgacgtctacgatctgctgcagcacaccagcctgtcgatcgttggcgagctgacgatccctatcgatcattgcgtactggtgagcacctcgacggatgccgataaaattcagaccgtttacagccatccgcagccattccagcagtgcagccagtacctgagccgctacccgcactggaagattgagtataccgagagcacctcggcggcaatggaaaaagtggcgcaggcgaactccccggccgtcgcggccctgggtagcgaagcgggcggcgctctgtatggtctgcaggtgctggagcactgccaggccaaccagacgcagaacatcacgcgcttcctcgtcctggcgcgcaaagcggtgaacgtctccgatcaggtgccggccaagaccacgctgttaatggcgaccggtcagcaggcgggcgccctggtggaagccctgctggtgttgcgcaaccacaatctgatcatgaccaaactggaatcccgcccgatccacggcaatccctgggaagagatgttttatctcgatattcaggccaacctggattcgctgcccatgcgcaaggcgctgaaggagctggcggatatcacccgctccatgaaggtcctcggctgctaccctagcgaaaacgtggtcccggtggatccggtttaa

SEQ ID NO: 4504 - DNA, 330 bp, Klebsiella pneumoniae
tttccagcccgcgatgctgcgaggtgctgcggatatacgttgcctcacagagaatatcaatgcgcccgtcgttgtccttcgggaagccctccggcagcacccacgagttttccaccacccacgaactgccgtcggccatcgtcagcaggctctgcacgctgtcgaaggtgtcgaggccgcattcagccatcagccgcttctgcccgacggcgtacaccgacaccacctcctgtccggaaagatggcgcaccaggtcaaagcagtgcgagccgagaaaccacaccggggagcttgcgcccgcccagttcagccactccgtcggcacgctga

SEQ ID NO: 4505 - DNA, 201 bp, Klebsiella pneumoniae
ggggctcaccgcctccagatgggtcaccgcgttgccaaaccgttcacgccgctcgctgaggcggccacgcataatttccgccagccggtattccagctgctggatccgcgactgcgcgcggtggatccgtggctgcgggttgtagtgattcagacgctgaacggtgcgcttttgccgctgttctgcgcgcttaagctgtga

SEQ ID NO: 4506 - DNA, 189 bp, Klebsiella pneumoniae
ctatgtgaccggggtgaacgcgcgcagccaacgccgcgacggtcgaaaagacgaggtttgtatctccaaagtatttcaggtcacagcgagacggcgagttcgcaaatccccgggagcatagataactatgtgaccggggtgcgcgaaggaagccaacaatgctgtggcgtgaaagacgcaggagattag

SEQ ID NO: 4507 - DNA, 771 bp, Klebsiella pneumoniae
tgcgcccgccgggcaggtctgttttcgcattacgcttccctcagcgccggaataatccaacttatgaatcaatatcggggaactatgtcccaattcctggcctggcgccgttccctcagtggatggctgctttcaggcattgcttgtcttacgctggcggggtgttccgccggcttttcaccgcataccgcggaaggtaccgccgcccccgggcaggcgcagcatcaggtggccgattttgtcgcggtagactgcgcggatatctgggcgcacagcagcgatgccagcgacaaaaatcccctctactggcttcggggcattgactgtgccgatcgcctcgcgccggcgcaggcgcgggcggaggcgaaacgccataccgacgacagctggcaggacgcgttccgtcgcggcatcctgcttgctgatgctaaaattacccctgaggagcgccgcgacctggtggcgcgtctcgataccttcagcccgcaaatcgccgttcaggtccgcccgctgtatcagctctggcgcgacggccagacccgtcagctgcagctggtggaagagcgtgcccgttacgctaagcttcagcagtccagcgatagcgaactggagacactgcgtcagcaggagctggcgctgcgcgagcagctggagctgaccacccgcaagctggagaacctgacggatatcgaacgccagctctccagccgcaagccgggcggcaatttcggcagcgaaaaagtgccggaggtgatccatgacgatccgtaa

SEQ ID NO: 4508 - DNA, 327 bp, Klebsiella pneumoniae
ggtcgccgccgccacgatagccgggtcagtgatctgcacgtggtggtgcagctcataacgttctttcagaccgcgcagaatcgcgatggtatcttctaccgaaggctcggcaacgaacactttctggaagcgacgttccagcgcggcgtctttttcgatgtactgacggtattcatcaagcgtcgtcgccccgacgcagtgcagttcaccacgcgccagcgccggcttcagcatgttacccgcatccatcgcgccgtcggctttaccagcgccaaccatggtatgcagttcgtcgataaacagaatgacgttaccttcctgttttga

SEQ ID NO: 4509 - DNA, 225 bp, Klebsiella pneumoniae
ggagcgcgccggagaaaagcgctaccgctggttactgcgccgcagaaacaacaaagccaggcgcaaggcctggctttgttcaggaatgaggcggtgccttactcgacgtttcgcccgatgtctgataaagccaggctgttatcaggagttggacggcaggcacctgtttgtgcgtcattcgatgtttatgtagcgcgtcccgaaggggctgacataagaaggtga

SEQ ID NO: 4510 - DNA, 216 bp, Klebsiella pneumoniae
gagcccgcacggcgcaagccctgcgggcttttttgtgccttgaatttatcccgcgcagtccaaagagaactcattaaatccgcaccttttaggcccattgataggcacaacgaaaagctctggtattttcacgttaccgataccccgctagcccccctctcagaattagacctcccacgacactcgcacaaccctttaaccttccggccgcgttag

SEQ ID NO: 4511 - DNA, 339 bp, Klebsiella pneumoniae
ctggtactgcgccgaccaccggcaaagtcactgccggtatcaccggaggcgtgcaaaccaatgcctgagtacaaagtcgctaagcggtcattcatcaatggccgcctgcatgagccgggtgacatcgttacttacgacggtgagccgggaagtaatctggtttccgttgatgccagcctgagcgaaaagattgtcccggtcagtgcagaagagttaaccgagattgatgatttgcgcaaacagtatgaagaaatgttcggcgaagcgccgcatttcaataccaaagcggaaactctgaaggcgaagatcgccgaaaggcggaaagaactcggggtgtaa

SEQ ID NO: 4512 - DNA, 192 bp, Klebsiella pneumoniae
gaacttatgcgagcacttgcagaatcttcctcaagaccagctcgtacccccaactccgtctgtgtcaggcctgcattaacccttgaaatcttaagtcttttaccgatcacagctacaatccacccgattaaacacaccaagattatccctttcttagctaaacccatcttcaagacttacattgaaaattaa

SEQ ID NO: 4513 - DNA, 348 bp, Klebsiella pneumoniae
attaccatgcgctgtaacacgtggcgcgccctcattgtctccaggctcaccattctgctgcatgaactgaatatactgttgcgatgctgcagtactcagcgcgctatctgccgcctgctctttcagcttttctttttccgctataacctgttcctggctccatccatgggcagcggcgtactgctctatcgcatcaaaccccatttttaccgtattaacaaacgctgtatcatcaccatagagcccctgagactgggttaccacgttttgcttgatagcggagaactgctgatcctgaaactgctggaactggctcacctcataccggcgggcctggttgtgaaatga

SEQ ID NO: 4514 - DNA, 717 bp, Klebsiella pneumoniae
aagggtgtgcgggaacatcggcaccagggtgatggcgtccagcgacggcgtaaggattgggccgccggccgacagcgaataggcggtggagccggtcggagtggagataatcaggccatcggatcgctgagagaacgcaaagacttcgtcgatatagacttcgaactcaatcatatgcgccactttgccggggtgcagcaccacttcgttgatggcggtgctgatacgtttctggcaatcctgctgacacacctgggcctccagcagaaagcgtttctcggcgatgtagtggccttccagcacgtcggcgagctgctgcagggcgttgtccgggtcaaggtcggtgagaaagccgaggttgccgcggttaatgccgatgacgttaatgtcgtaacgggccagggtccgcgccgcgccgagcatattgccgtcgccgcccaccaccaccgcaagatcggcctgttggccaatctccgccagcgtgccggttttcacgttgctgagctgaagttcatgggcgatctgctgttcaaccagcacttcataccctttgctgcacagccagcgccagagcatttcatgtgtggtcagggcggtggggtgacgaggatgtcccacaatgccgatacacttgaaatggttcttcatgatctggatgtccttgcgttaaatgaaatagtgacaatctgtccgcttcccttgaaacccggaaactga

SEQ ID NO: 4515 - DNA, 378 bp, Klebsiella pneumoniae
tcattgccgcgctgtatgcggttgcagctggcgtggatcgactaccagctcaagtataaaaagctggccttcagcagcgaaatgccgccgctgatgagcattgagcgcaaaatgttccacatcacccaggtcggcgtggtgctgctgaccctgacgctgtgcagcggcctgttctacatgcacaatctgttcagcagcgaaaatatcgataaagcggtgctgtcgattattgcgtggttcgtctatatcgtcctgctgtgggggcactatcatgaagggtggcgcggacgtcgtgtggtctggttcagcgtcgctggcgccggtctgctgacgctggcctattttggtagccgcgtgctgcagcagttcgtgagctaa

SEQ ID NO: 4516 - DNA, 210 bp, Klebsiella pneumoniae
ctcattcagcgctttgtcggcatccgggaacatgacgcggaacatgttgatggtaggtgcgacattgtcggtaaatgccgggtcacttatcagtcgcttgctaaatcctacggcagactgagccaggcccaaagccccctctccggcgccgcggaaaaatgccgacgcgccaccctgaaatgccgacggttcgaagtcttcagggcgtga

SEQ ID NO: 4517 - DNA, 219 bp, Klebsiella pneumoniae
ctaaaccagcgtctgcaattgctcctcaacgtacagataacctatccccatcagctgctgggcgcgtgtcagctggccaaagcctatttgggtggcgtgcgctcgcggcgtatcccggtggtcaaaggggttgaaacccgtttgtttaacgatactttccagccactgctcaccgaaggcgcagctgcgcccgtaaagccagatttgattaatatttaa

SEQ ID NO: 4518 - DNA, 195 bp, Klebsiella pneumoniae
tggatgaagcgggtcagacggcagccgccagctttaccctgcaataaccagggtaaatttgttgttggcggtttgtgttttcaatactcatcttattttaacaaaatgttaccttcatccgtaggcaggggcggggatgctcattataatgcgcgccaggccatacaatcgtatgtgcaacaacagaacatttaa

SEQ ID NO: 4519 - DNA, 252 bp, Klebsiella pneumoniae
acgctcaggcggacaaagtcgcgaagattatcgccgcgaacagcaagaacacctgagcctgactcatcgatcgcaaacggcagccactggctgccgtttttttatacgtttcccgacgagctgaagcggtttagcgccgggttaactcatcaaatatggcctgctttatcgggttcgacaagtaaaatctcacttcttcctgccctgtctcacaaaatgaatttgttgacaaaaagtgacaataaaatgtga

SEQ ID NO: 4520 - DNA, 282 bp, Klebsiella pneumoniae
gctgccaggcgcgcgtcaccgacgaagatctggtcgttgagatcccgcgttacaccatcaaccacgcacgcgagcactaatatggcactgaaatggaccgacagccgtgaaatcggcgaagccttgtatgacgcttacccggatctcgacccgaaaaccgttcgctttaccgacatgcatcagtggatttgcgatttggaagagtttgatgatgatccaaacgcatccaatgaaaaaattctcgaggcgattctgctagtctggctagacgaggccgaataa

SEQ ID NO: 4521 - DNA, 198 bp, Klebsiella pneumoniae
attttaaggcgcttccctgcgccagcagcctcagtaacccttggccttagccatcacgtactgagcatgcgtctctatgtcgcgcagtacggcgccgataccaacaatgtagctgagcatggccgtgacttctgcggcggcgccggatacatcatgcccgtcagcatcgagttcgcggagcaacttcatcaccattga

SEQ ID NO: 4522 - DNA, 1329 bp, Klebsiella pneumoniae
acctgcgggcgcgaggcgccggggttcatttttgtatatataaagagaataaacgtggcaaagaacattcaagccatccgtggcatgaacgattatctgccgggcgaaaccgctctctggcagcgcattgaaggctcactgaagcaggtgctcggtagctacggttacagcgaaatccgtttgccgattgtagagcagaccccgttattcaaacgcgcgatcggcgaagtgaccgacgtggttgaaaaagagatgtataccttcgaagaccgcaatggcgacagcctgacgctgcgtccggaagggacggcgggctgcgtacgtgccggcatcgaacatggtctgctgtacaatcaagaacagcgtctgtggtacgtcgggccaatgttccgtcacgagcgcccgcagaaaggtcgctaccgtcagttccatcagatcggcgccgaagtgtttggcctgcagggcccggacatcgacgcggagttgattatgctgaccgcgcgctggtggcgtgagctgggcatctccgaacacgtcagcctggagctgaactccatcggttcgctggaagcgcgcgccaactaccgcgacgcgctggtggcatacctggagcaatttaccgataaactggatgaagacagtaaacaccggatgtataccaacccgctgcgggtgctggactccaaaaacccggacgttcaggcgctgctcaacgacacgccggcgctcggcgattatcttgacgaagagtcgaaagcccactttgccggcctgtgcgcgctgcttgacgatgccgggatccgctacaccgtcaaccagcgcctggtgcgcggccttgattactataaccgcaccgtgttcgagtgggtgaccaccagccttggttcccagggcaccgtctgcgccggcggtcgttacgacggcctggttgagcagctgggcggtcgcgctaccccgggcgtgggttttgccatggggctggaacgtcttgttttactggtccaggcagtgaatccggaatttaaagccgatcctgttgtcgatatatacctggtagcctccgggaccgatactcagtctgctgcaatgcgtctggctgagcaggttcgcgatgcgctgcccggcgtgaagctgatgaccaaccacggcggcggcaactttaagaagcagttcgcccgcgctgacaagtggggggcgcgcgtcgcgctggtggtcggtgaatcagagatcgctgacggaaacgtggtagtgaaggatttacgctcaggtgagcaaactaccgtaacgcaggagagcgttgccgcgcatttgcgcacacttctgggttaa

SEQ ID NO: 4523 - DNA, 1809 bp, Klebsiella pneumoniae
agattacagctatttcaatacattaagcaccaagctcggctggtcgaaaaaattgttctgattttcacggctgcctctttactggataaaaaaccagtctatactgtacgaaaacacagtattggtttttcatacaggaaggcagctatgttggcgcaactcaccatcagtaattttgctatcgttcgtgaactggaaattgatttccacagcggcatgaccgccatcaccggggaaaccggcgccggaaaatccattgccatcgacgcgctggggctgtgcctcggcggcagagcggaagccgacatggtgcgtcgcggcgccacccgtgccgacctgtgcgcgcgcttcgcgctgaaagatacccctgccgcccagcgctggctggaagagaatcagctggagagcgggcgtgagtgtttgcttcgccgggtgatcagcgccgactgccgctcgcgcggcttcatcaacggcaccgccgtcccgctctcgcagctgcgcgagctgggccagctgctgatccatatccacggccagcatgcccaccagctgctgaccaaacccgaacaccaaaaaacgctgctcgacggctataccggtgagtatgcgcttactcagcgtatgtccgagcactatcgccagtggcaccagagctgccgcgagttggcccagcatcagcagcagagccaggagcgcgccgcccgcgccgatctgctgcagtatcagcttaaagagctgaacgaatttaacccgctgccgggagaattcgagcagattgacgaagagtacaagcgcctggccaacagcggccagctgctcagcacctgccagcacgcccttacggtactggcggacggcgaagatgccaatctgcagagccagctttataccgcgaagcagctggttagcgagctggtgggcatggacagcaagctttccggcgtcctggatatgctggaagaggcggccattcagctcagcgaggccagcgacgagttgcgccactaccatgaccgtctggatctcgatccgaaccgtctgtttgaacttgagcaacggatttcccgacaaatcgcgctggcgcgtaaacatcaggtgatgccggaagagctgccggcggtttatcaggcgatgctggaagagcagcgcctgctggacgacagcgccggctcgctggaatccctcagccagcaggtggtcgaacatcatcagctggcgctggagaccgcgcgccagctgcatgccctgcgccaggccagcgccgacgagctgacccagcttatcaccgaaagtatgcactcactttcgatgccgcacggggtcttcgcgattgaggtcgcgttcgatgaacgccatctcaccgccgacggcgccgaccatattgagttccgcgtcaccactaacccaggtcagccgctgcagccaatcgccaaagtggcctccgggggcgaactgtcgcgcattgcgctggcgattcaggtgatcaccgcgcgtaaaatggaaaccccggcgctgattttcgacgaagtggacgtcggtatcagcggccccaccgccgccgtggtcggcaagctgctgcgccagctgggcgagtccacgcaggtgatgtgcgtgacccacctgccgcaggtcgcaggctgcggccaccatcatttctttgtctgcaaagagaccgatggcgagatgaccgaaacccatatgcagccgctggataaacgtgctcgcttgcaggagctggcccgtctgctgggcggcagcgaagtcacgcgcaacaccctggcgaacgcgaaagagttgcttgcggcgtaa

SEQ ID NO: 4524 - DNA, 198 bp, Klebsiella pneumoniae
cgtcataagctgaatctaagcacagtggtagaacgagaaaatgcctcagttgccagcgataccgttttacttctacaaccttgcttcagttcgctgaaaaagcagtgcatcagaaaacggtcctacaaaacccaggatctggatcatgcagatatcttcgatgacattgacctgttcagcaatcggagctggaggtaa

SEQ ID NO: 4525 - DNA, 996 bp, Klebsiella pneumoniae
acgaagaagctgtatatggcacaacgagtacaactcaccgcaacggtgaccgaaaatcaactcggtcaacgcttagatcaggctttggccgaattgttccctgattattcgcgatcgcggataaaagaatggatcctcgaccaacgtgtattagtcaatggcaccattggcgataaaccgaaagaaaaagtgctggggggagaacgcatcgctatcgatgtcgaaatcgaagaagaggcgcgcttccagccgcaggatattccgctcaatatcgtttacgaagatgatgacatcatcgtgatcaataaaccgcgcgatctggttgtacatcctggcgcgggcaaccctgacggtactgtgctgaatgcgctgctgcactactatccgcctattgccgatgtgccgcgcgcgggtattgttcatcgtctggataaagacaccaccggtctgatggtggtggcgaaaaccattccggcgcaaacccggctggtggagtcgctgcagctgcgcgagatcacccgtgaatacgaagcggtggcgatcggtcatatgaccgccggtggcacagtggaagagccgatcagccgtcacccgaccaagcgtacccatatggcggtgcatccgatgggcaaaccggcggtgacccactaccgaattatggaacatttccgcatccatacccgcctgcgtctgcgtctggaaaccggtcgtacacatcagatccgcgtgcatatgtcgcatatcacccatccgctggtgggtgaccaggtctatggcggccggccgcgtccgccgaagggcgcgtcggaggaattcattaccgcgctgcgtaaattcgaccgccaggcgctgcatgccaccatgctgcgcctgtatcacccgatctccggcattgaaatggagtggcacgcgcccatcccgcaggatatggtcgagctcatcgaggcgatgcgcgccgattttgaagcccataaggacgatattgactggttatga

SEQ ID NO: 4526 - DNA, 828 bp, Klebsiella pneumoniae
cgcgccggtagtgttctggttcgaaaagtatcaggaagaaggagccaaccaatgaccaaatcaaccataaccagagatgagcttaacgaagtgattgccacatacggaaagcaccacattgctcatcgaatggctaatttattgttggccgcaatggacagcgagccagattgcaaggagcgaaaacttttctgttcaaccgatacagcaaggatgaggaaggtaatctctgtctctgctggaaccggtgatgcaccgctctatcgccacgcgcagccggtgccggtagtcagcgcagacttgcttcataccgcagcatcagcaattgaagacctgctgactactaaagacaggacggggacatgtgtgtggttcgacttgccattccggctccgctcggcggctaacgcgcagccagcgccggtagtgcaggaagttgacgctgatgacaatttctattcatggtttggcagggagtggcgtgagaattatcagcacaaccaatacaccacagcggctaagcaaatgctgggtgtaatagctgaatctgcgtggaaagctgggtgccgcgccgctatgctcgcagccgcaccgcaatcacccggcagtgaacccgctaccgtgccgggtaaatggattccggtaagcgagcggatgccggaagactgcgcgcaggtaatcctatgggatgctgaaattggagaagtaacaagcggtcactacagtcataaaacacatactttttatcattgtggcgatgctatcgaaaacgagataacccactggatggcgcctccagccgccccgcaggaggttagtgatgcctaa

SEQ ID NO: 4527 - DNA, 438 bp, Klebsiella pneumoniae
ctaaacctcagacatggctgcaggcccttgtctaaaggtgggtcgttcggcatttacggggacttcctttttcaggaccacacgcagtatggctccagtattgctggcattctcggtggcccagtacttggttttgcagagcaactctcgaaaacggtgctgactaactcgcagaaggcgatggccggtgaagatacgacattcacagctgatgcgttaaaaactgccaggatgattacccctttcgctaacctgtggtatacaaaagcgataaccaatcacctgatcctgcagcaacttcaggagatggcaaaccctgggtataacgctcgcgtgcgtgaccgcgcgatgcgtgagtttaatacaactagctggtgggagcctggcgaagaaacgccacggagagcgccagatttaggcaaggcggtgggaaaatga

SEQ ID NO: 4528 - DNA, 1215 bp, Klebsiella pneumoniae
cgagctatcagcagacaagagcatcttgcgcccgccggggtttatcgccagactatcgccaccattcgggaggaaatcatggtcttgcactccacgcgctggctggcgctcagttatttcacctacttttttagctacggtatttttctgcccttctggagcgtctggctggctggaaacgggctgactccggaaaccatcggcattttacttggcgccggtctggtggcccgttttctcggcagtctgctgattgccccgcgggtgagcgatccctcccggctgatcgccgcgctgcgcgtgctggcgctgttaaccttgctcttcgcgctggccttctgggccggcagccacgtagcatggctgctggcgatcatcatcggcttcaacctgttcttttcgccgctggtgccgctgacggatgctctggccaatacctggcaaaagcagatcaccatggactatggccgggtgcggctgtggggctctattgcctttgtgattggttcggcgctgaccggcaagctggtgagcctgttcgattaccgggcgatcctgctgatgctaagcctgggggtcgcctcgatgctgctcggcatgctgcttaagccgtcggtgatgccccagggggagtcgcgccagcagcagggggccggaatggcggcctggctgacgctggtgcgccaaagctggcgctttctcgcctgcgtttgtctgctgcagggagcgcatgccgcctactatggctttagcgccatctactggcagcaggccggctattccgcctcggcggtcggttatctgtggtcgttaggcgtggtggcggaagtggtgatcttcgcgttgagtaaaaaggtgttccgccgcttcagcgcccgcgacctgctgttgctctccgccgtctgcgggctgattcgctggggactgatgggctggaccacggcgctgccgggactcatccttgcgcagatccttcactgtggcaccttcacggtgtgtcatctggcggcgatgcggtatatcgccgcccgtcagggtagcgaagtgatccgtctgcaggccgtctactccgcggtggcgatgggcggcagtattgccatcatgaccgtcttcgccggtttcctctatcagcacctgcaccagggcgtattctgggtgatggccctgctgacgctcccggcgatggctatacggccaaaagcggtggcggcctag

SEQ ID NO: 4529 - DNA, 375 bp, Klebsiella pneumoniae
ttgagatggcttttggccggatcttcaaagagctggccgctaacatggtgcaggcgttcacttcgcgcgccaaagaggtttacagtgccggctaatattcgtgttgaagtcgcctacgcgctgcctgaaaagcagtatctgcagcgggtcacgctggacgagggggcgacggtcgagcaggcgattatcgccagcggtctgctggcgctgcgtgatgacatcgatctggcgaaaaacaagctgggtatctatagtcgtccggtaaagctgcatgacgaagttcacgacggcgaccgggtggaaatctatcgtccgctgatcgcagacccgaaagagctgcgtcgccagcgggcagagaaaagcgccgcaaagtaa

SEQ ID NO: 4530 - DNA, 237 bp, Klebsiella pneumoniae
gttgctgccaggctgcgcggtgccggtagtgaagacggaggccgcatgaacattgccgaagaggcctcgctgatacgacaactcgaagaggcgcgcgccattatcaaccagaggaatggtgagatcattcacctgcagcgagaagcggcgcgctaccgtgagcagcgggattctgcaaatgcgatggttaagttcctgcgcggactctttgagaattcttcgaaggcgacacaatga

SEQ ID NO: 4531 - DNA, 495 bp, Klebsiella pneumoniae
attcaaggcagtacaatgattaaagagtgggctaccgtggtttcctggcataacggcgtggcgcaggtgcactgcgacgttaaagcctcctgcagcagctgcgcctcccgtgccggctgtggtagccgggtgctaaacaagctggggccgcagaccagccataccattagcgtgccctgcgagcagccgttggccgcggggcaaaaagtggagctggggatcgctgaaagcagcctgctgggctcagcgatgctggtgtatatggcgccgctggcggggctgtttgtaatggcgtctatttttcaggtgctgtttgccagcgatattgcgtcactttgcggcgcgctgctgggcggcgtcggcggcttcctggtggcgcgcggtctgtcgccgcgactggcggcacgtcagtcctggcagccggtgattttgaacgtcgcactgccgccggatctgctgcgtgttgatacgccttcctccgacatgggccagtga

SEQ ID NO: 4532 - DNA, 930 bp, Klebsiella pneumoniae
tggggaggcagagcactggtacagaattcctcagggctgatagcgcatccagtccatcccaatctgatgtcaccacaaggagtgaaaatggcattagtctctaacccacattcggcttattcaccgcgccttccctggctgggaggtatagctggcctgctggcaggcggcgcgatcctttatttttggccgcaatggaaccggacatggctaagcctggtgcctgcgccagtctccgtgtatacccgctttctcggggtcactctcgaagacgttccgttagtcacctattgccatcaggcgctgctgggttttctgatggtgctgctcgcgcccggttacggtaagtcgacccttgccgcgtggatgatgcataacccagcgtcaagccggcgctggcccggcgaggtattccgtgcctgggtcacaaaatttggcctgctggtcatggtcttttgcaatctgttctttttgtcccgggtcccatccggaaccctggcgttatatatttttattctccagcacgtcagcgttgccgcggcggtggcgtcaggggtgctgctcctgcgtgacgcccggcgcctggcccgcacgttcgacgctcagctggcggacctgcgtcttctcatgatacttaccctcgggttccagacgattttgccggcgcagatcgcgctgatgagcgcccggggcgtgaatacgccgctgggctggtacattgttatcgcgcaaatggcaggggtgttactggcgtttatgctggtcggcgggctggtggcagcgctacgttctctgctgggcgaagagaggtgccgggcctggcgcggggatatggcgctcttcaacggcattgtcacactgtgcgtgacgggatttctcctttatcacatggtgtctgcctatccgcgaatctttgccgccctgcattag

SEQ ID NO: 4533 - DNA, 5307 bp, Klebsiella pneumoniae
aggcctacaagggaaaggaagaacaatggctacgccgctggcagcaaatcgcctttcatgtgcggcagaaaggcatacagatggctagtgtggataaaacctctactcaaagggctgagctgccttataatactgaaaccgcgcagacacaccggccttttgataaagaaattccaccttcagggagaatataaaatgagtctagaaataaaaaaacaaagtaacccgttttctactggcggtgggggagttaattttgaaacaagagttcaagcagctttcgcactatccttattgactaaatcttgtgttccttgtttgagtaactacatgagggctaaagagttaaaattccagaacaaatatgatggtgtaaatactgatgattttgtattgactgccacagacaactcaaataatgaaagtaagatctttgctcagattaaacatgaaataactattagtggctcatcaaactcagtatttgcagaagttatacatagtgcttgggcggactttaaaaatgtgggctttaagtcagaaagagattctatcgcgttaataacaggtaatttaccaaaaactgacataaataatactttgccgttacttgaatgggctaagttttcatcgaactcagaagattttataaagaaatctcaaacccaaggatttaccagtgaagcaaagctcgaaagattagggatatttagagatcagcttactcatgcgaataacggggtagctatctcagaagaagaattgtggtctttcttaaaatcgtttcagattttaccttttgacttagatgcagaacattcaatcgtagcaaacttactttgctcattgattcagtgttactcagacgtattaccttctctagtcttagctagacttgtttcctgcgttcaaagtttcaaccagaatgcgggggttttaactcaaaataatataccagaagacgttaaaggattatttaataaatcaagccacttatatttcgaggatgacttgataaagctttatgaacgcagtcagcatatttttgaaggtatttctacaactataaatggactccatgttgataggacagaacaactagcagcactatctaactgctatagcgatagtgagtttgtatttgttaccggtgcaagaggggctggaaagtcaggcgttgttaaagattttatcacaacaaaaaatttagatattccagtcttctacttaagagctgaagatttagataaaagtaacttaaatgaagttttcacttccatgggaattacatcttctttgggagaaattgaaagtcatttctcattgcttcacgaaaaagtactcgtaatagagtccctggaaaaagttttagagctaaattatccaaatacttttgttgagttattgcaatacattagaaaacagtctggttggactatcattgcaactggccgggactatgcttatcaacaattgttatttaatttcctacagccttgctctataaattttagcagcatgaatattgaagggcttgaagatagtcaagtcgagcaagtttgcgagcatattccagagctaaaatctttagtatctaataactcattagtagaactactaagaataccattttttattgagattgctgtaagagctataaaaaatggcgctcaatttgggattggagatactgaagaagactttagggatacagtgtggcggactgtcgttgcaaaagaagctgatagaaagtcagggatgccagatagaagaagagcaacctttatcaaaatagcaatagagagagctaaaaagatgctttttggtgtcagagcaagcggttttgacccggaagtaatcgcaaagttggaagaagacaatttgatctacagagatcaaaaatcatcttgtgtaagtcctatgcatgatgttttggaagattgggctttagaggagttcatcgatagagagcattttgataattctcataatgttgcaagctttttgttaaatataggaaatgaacctgcgataagtagggcattcaggttatggctgtataggaagctaaaatttgatgatacaactaatgaattcgtagaaggtttattatcttcggacgagatagagagttattggaaggacgaggcaatttctgcaatcatgcagcatgactctcccgggatattttttaattcactcaaacgccaacttcttaaagatgattgtgctcttttgacacggttttgttttattctcagaataacgtgtcaaagaccaatatctctacacaacggactattgataaaagataaaaaatcgggattgctcaaatcccttttcctgaaaccatatggagaaggttgggaagcactattccattttatttatcaggaaagagatgatttgagtagtcctgtgcgcactcaagttattgaattaatagatgaatggactggtctcattaatatacatgatgagttgccaaaagcgtctgaaaaggttggttttttaagtttatggctccttgaaaaggttaaagattcatatcgtggtgaggggcaaagaaaaaaaatattaaatgctttattaaaagtttcaacggctattaaagatgattttgatgaattgatgaaacaggacgttttcacctcaaagataaagcctagacgattaagttatgttgatgaactgagtagtttggcacttataggcttcaatgttcctatgttgtgtaagttttatcctgacttcgtagttaaactttcaatgcatgagtggctgttggaagaatccgaagagaacgattatggctacgggtcatatcgagtagacgtagaggaatcatttgggctagatacagaacgagattttttccctgcaagcggtgccaaaggccctttcaaatatcttcttcaattcaagccaaggctaggcttggatttcattattagattgtgcaatttgacagcacaaaaatactcagaatcggatttttctaaaactcaagacaataaagaagacactatttacgccttcgaaacagtagctaaacaagtcgatataaccctgaatgatggcacagtagttaaacagtatgcatctccccacctctggaagggatatagaggacagtctacgttgccctacttattacagagtgctcttatggcattggagaactggttagttgagtacgttgaaaattgtggtaagaataatgaaatagattggatttttgattatgttcttcgctctagtaattcagtaatgcctacatctgttttatcttctgtggccacaggcttccctaataaagtaggtaaagcagcctttcctttgcttaaaactgctgatttataccatttagatttgattcgaatgacacaagaaatgggtggaaatgagatgcatttctttggtcttaatagggatgcattgtcgaaaatatacctagaagagagaagagaagcagcacttcgaccatggagaaaagagtcattagaaaccttattaacaaggcttcagttcgtaaatgagttaagggatgatattttaaaaattgttgatgaactgaaaaatgaagctactgcaagtaatgaaaaaagccttcggtatatggtgcacagagtcgatacaaggacttggaaagtagttgaagacaaagaaaatgacagagtattgtttcaaagctcatcagagcttccggaagatttaaagctggatcaacaagaatttaatgaaaagcacgcaatggataacaccgtaactagtttaaacttatggggtaaaaaactattcgatgagcaattactagaagaaaaatacttctcttcatatcaggatgcattaatagctactaagggattgctcagcgccctccaaaaaggtgaagtacacaactttgctgatatggcggttggcacaatcacaactgttgcagcggtttgtgttcgtgatgttcttttagaattgagctatgaagataaaaagtggtgcttagaaatcatcctagaatcaatattcatgcacgcagacaatatgaatgggacagctgcacatgataagactgattattatggctctggagcatgcgcatttgtcttacctaagttatttgatttagatctagattcagaacaaatagaatatctgaagtttgcgttagctacagcattaacgcatgagaacctgaacgttagtgcttgtgctgctaagggagtaagagagtttctttggtctagagacgctgaattagcatcccgttgtataggtggaatagttgagtatgccagattacgaagggaagatagtgaggtacgtaggttttatcatttacaaggtgctgaattgcaagccgcactcgaaaaatggaatgatcttttaacaagttttcgtaacgacttgattgagggaaagtttaagctttcagttaacgatatatctttggaaagccactgttcgtggtttattcatttaccaatgctaatggttccttactgtactaaggatgagatacaaattcagttggtcaataggttaatgagttttgtatttgatacggagtatcaaaaccatcgttcgagtgatgatgaaaaaataaatcatgaaattaaaaagcagattcaagactgtctctctgaacatgttgtttcttcaagaaaaaataacttcatgccctttaaagatctattggtgttagggtgtacaaaagctcccggcttcatttattctttaacactctcctatcatgtcgctgtagaaaaagaaggtgattatgatgctatatgggcactttggtgcctgttagcaccagaagcacacaagatagctttgaatgatgttaatgatcgttatatcggtttacagaatgacctaaatcagctcctgcgtggaatgatgtatgcggattgcccttggcaaggacatgagaatgaagagaaagatatgaagcgaggtgctaaatatttgctcgattttgctaggcaatctgcacataatagccatgtgtttgaagccttgtcttcattgatttataacttctacaacgtattcttcgaagaaggcattctgattttagctgagcattatagtgccaatcgacatattatcgggaagcaagtcaatacagcattttatatagaaatggttgttggaagatttttgcagatagaaaatcgcggaactctcaatagaaaaatgtacgatatatgcctgcttctcttaacaggaattgtagaaactggctctgctagagcttattacttacgtgaagaattgattcgttctcgaaagatttcagcctag

SEQ ID NO: 4534 - DNA, 318 bp, Klebsiella pneumoniae
tttttacaaagggttgataacatgcaagcaatagggtttatggaatatgttgtagttgttctattccaatgggcggctattatggccggccttgagtcgtggtggggcttgcactggataatagcggcaccgattgcattcatcgtcagctatataccactggttggatctatcgtgggaatgattggggccatggacgtatggcgctgggagtggtggcaggctggtctacttttctttggtggtctaatctttgctatcgcctgtgggggtatgtcttcattattcgaatggctatcattcagaaagagagcgtga

SEQ ID NO: 4535 - DNA, 813 bp, Klebsiella pneumoniae
acaggaaaaagtatgcttaatacgctacccgatttacacagaagttttgcagagcaactgaagcttaaattacagtctgattcgcggatccactcccttctcgccggcggctcgtttatccatggcgggtttgatcaatactccgatctggatttcgtggtggtgatcgaccctctctattatgacgaaatcatggctcagcgtatggcgttcgccggaacgctcggccatctgctacatgctttcaccggggaacacgtcggtgagcctcgcctgctgatctgcctgtttggcccggaacttctgcatgtcgatctgaaatttatcaccctggatatgctcactcagcgcgttgaggagcctgccgtgctatttacccgtgataacgatgctctcaagcgacagctggcaaaatttagcgcgcactggccgaacatgacgccggagtggtttgagtcccgggcctggatctggctgcattatgccgtggttaaactgggcaggggggaactcttcgaagcgctggggatgctgtctttcttccgggaacaagtgctgggaccgatgctgtttcgtcgcgccaatctaccgcaacgcggcgttcgtcgaatagaagccctcggcattgatcccgatggcctgctgacttccactctggcaacacacgatcgtcactccgtcgggattgccattcgaagggctgctgacgcttatatcaacctgcgggctgatgcgctgcctgacgatatcgcagacgatgcggcgcgtcgggcggtccttgccatgctggacgcgtattctgacaaggggtaa

SEQ ID NO: 4536 - DNA, 1383 bp, Klebsiella pneumoniae
aaaaggaaaagtatgacaacctgcacctcgcgcgcggcatggctgaacctgctgcgtcgcctccatttctatattggtctgtttatcggaccgtttatctttgtcgctgccctgaccggcacgctgtacgtggcgacgccgcagctggaaaactggctctatcacgacgcgctgcatggccttgccgaggggactccgcagccgctcagcgcccagattgcggtggccgaagaagcgacccagggcaatctgcggctgctggcggtgcgtccggcgcctgcgttgggcgagaccacgcgcattatgtttgccgatccgggtctcggagagtcggaatcccgggctatttttgtcgatccgatcgcgctgcgggtgaagggcgatatgacggtctacggcaccagcggcatcctgccgctgcgccagtggattgattatgcgcatcgctctctgctgctgggcgacagcgggaggttatacagcgaactggccgcctcctggatgtgggtggccgcgctcggaggcattgccctgtgggcgatgacgcgtccaaaacggcggctgaataacgccctgcagaaccatcgtcggctgcacgtgacgctgggctggggcttactggtgggtatgctgctcttctccgccaccggcctgacctggtcgcaatgggccggcggcaatgtggacaaaatgcgggcagcgttcggctggctgacgccgcaggtcaatacccagctgcatggcgagatgccgatgacgcacgatccccatgccggacatcatatggatgcgatggccatggcccagcatcagccggcgctgcagttggcccagtttgaccaggcgctggcggcggcccgtcaggcggggctgaacgccagccggctggagatccgtccgccagtgtcagacgaccgcgcctggacggtgaatgagatcgaccgtcgctggccgacgcaggtggacgcggtggcgatcgatggcgccacgatgcaggtggtggatcgcacgcgttttgccgactttccgctgatggcgaagctcacccgctggggcgtcgatttccatatggggatcctctttggtctggcgaatcagctgctgctggtgggatttggctgcgcgctgtgcgttaccatcggggtggggtaccggttatggtggatccgccgtccgcctcaggcggcctgggatccggcgcattcgctgctgcaggcgtggctgtcgctcgcctggcctgcccgaagcctggtgcttgggctggcgtttgcccttggattggccatgccgttaatgggagccagcctgctgctgttcattgccgttgactacctgcgctggcgcgcggcaacggcaatgaggatgatgaagtccagcgactaa

SEQ ID NO: 4537 - DNA, 240 bp, Klebsiella pneumoniae
aaaaatatgagcgatgtgcaaaaatttgacttcaaacgctgctggctcgacctctctccggcagagcgtgaagagttcgcaagtgacgccggcacgaccagccactacattcaggttcacctgactggccgtagaagaattccacgtaagcctctgttagaaagactgtttaaagcctgcaaatcccgtaagtggataaccgcaaaatccgacctggtcctctggttccacgaacgttaa

SEQ ID NO: 4538 - DNA, 267 bp, Klebsiella pneumoniae
tctttttttggcttgctgcaaaattaccgtaaccacaaccagagtgagacaggaactatggagatcattactcgcgtcgaagcggcaaaggcaggactaaagcgctactacaccggtaagcaatgtaagcacggccatgacagtgagcgatgggtatacaacgggcattgtgtcgaatgcaccctcgagactaaccgccgccgccatgctgagataaaacggctaatgcatgaggcctcaagaggtaatgccgtggaggtgatctga

SEQ ID NO: 4539 - DNA, 369 bp, Klebsiella pneumoniae
tttgcgcttgggatcctttggcatggtaaacaccccgaaaataattaccttttaggtaataataccatgccaccagcgatgttacatgatcggaatatcatcatcactcacccacccggcccggtttatcaggtaggtaacgacaccccgcacttcaacatcgtccagggcgtccccttccagcgcctcaccatcatcagtgatcagcgcctgcccgcggacaacagcgaattcagttttcccggcatatgcgataagaacatgatcaccctgctttggccggcggcagacatcgacgatggcataaccggcggcagtctccagggcgcgacagttggcgtcatactgacaaaggcgggaaacggttag

SEQ ID NO: 4540 - DNA, 2484 bp, Klebsiella pneumoniae
cagcgaattggcgatatagactcctgttattgcaacttttacttcgttttgtttagtggaggcatcatgtacggttcggttaaggtctggcaggaaatcatttcattaccaacgtggacgacgggcgcggaagatccgaaccctatgtttctggaaaaacgtgtttatcaaggatcttccggcagcgtctatccctacggcgtgattgataccctgaccggcgaacgcgaaatgcgcgattatcaggcagtgtggatggagaatgatttccttcgggtcatgctgctaccggagcttggcggccgtattcaccgggcatatgacaaagtcaaacaacgtgatttcgtctattacaatgaggtggttaagccagccctggtagggctgctcgggccctggatctccggcggaatcgaatttaactggccgcaacatcaccggccgacgacctttaagccggtcgatttttctattcagcagggagaaaacggcgcgcagaccgtatggatgggggaagcggagcccatgcgcggtttgcaggttatggccgggtttacgctctatcctgaccgcgcgctgattgaaatcactggcaagatcttcaatggtaacgccacgccgcgccatttcctgtggtgggccaaccctgcagtaaaaggcggcgatgcccaccagagtgtattcccacccgatgtcaccgctgtattcgaccatggtaagcgtgatgtttccgctttcccgattgccaccggtacctactacaaagtggactattctgcgggggttgatatctcccgttataaaaacgtcccggtacccacttcgtatatggcggagaagtcggattacgattttgtcggcgcttatcatcatgacgagcgaggcgggttactgcatgttgccgatcaccatgtctctcctggcaagaaacagtggagctgggggtacggggattttggccaggcctgggatcgaaatctgaccgatgaaaatggcccttatattgagctgatgaccggcgtcttcaccgataaccagcctgactttacgtggcttgcgccttatgaagagaaggtgtttgtgcaaaatttccttccctacagcgagttagggatggtgcaaaatgccaatacacagctggcactgaagctggttcgcgagtctgggcaactgcagcttggcgtatatgccattgctccgctaaatcatatcgtggttgaactcagcgctgaccatcagccattgtacgaaactcagctgacgctgaagcccggtgagagctggcagcagacgctgccggaaaatggcgtcgggcgcttaaccctcaaagtgaaaaccgccgagaaccagccgctgctggattatcaggaacatattacccaacagacgccgctgcccgaaccagctatagcgcccgcgttaccggaagcgatccacaatggcgacgagctctattttatcggccagcaccttgaacaatacaaccacgcaagccgctacgccggggattactatcgtcgggcggttgagctcgatccgcaggattatcgcaataatgttgccctcggtaccctggcgttcaacagtgccgactgggcgctggcggaacagtgtgcccgtgctgcgctacagcgcgcgcatcgtttgaataagaacccgcgagatggcgaagccagtatgctgcttgccagcgtgctggaaaggatgggggatgatgcaggcgcctgggatcactattacaaagcctcctggagcggtaactgccgtgacgccgcctggtggtcgctggcgcggctggcgatgaagcgcggtgatgttgccgatgcgctggaaaaagtaaacaccagtctgcggttcaacgccagcaatcctctggcgatggggttgaaagcgctggcattagccaacagtgggcagaagaaagcagcgctggagtttattttcgcctctcttgagcaatacccattgagctatccgctgcactgcgcgcgctggatgattgagcggagcgacgacgcgcgagaagccctgctgcgcatcacggggcgcagaggggtcaacgccagcctgctggcgggttggctgctctctatcggacagacgtcggcggtgaaagaggttcttgcggttctggacagtcaggaagcgctgccgatgctctggcgtgcgtcgctaagtgatgatgccaatgaacgccaacagtttattgccgccgccgagcactgccatgcgcacaatgttcgtttccctaactcgctcgatgaagttcagatgctgcagtcgctgggcgacagcgcttttgcccgctatctactcggttgcttctggtacagcaaacgtcgctatgacgaggcggtgagctgctggcgcgagacgctcgaaaatctcccgattatgcgcccgctcatcgtctgctgggcgtttactcctggaataaacagcaggatgcaacgcatgcgctggcttatctgcagcgcgccgtag

SEQ ID NO: 4541 - DNA, 1011 bp, Klebsiella pneumoniae
tgccggtctgggcgcggcaggaagcttcctgctgtatggtgttatttgcgctgccggctacctctatatcctgcgcaacgtcccggaaacgaaaggtatcaccctcgaagcgctggaagagcagctggcgcagcgtcatacgggcgtgaatgcggcgaagcaggagcagatgcgctaatggcggaagagtggattctggagaacgcgcatctgcggatgtgcgtctcttctctgggcggcaaagtgcaaagtttattctcgcggcaatatcaagcgccggtgctatatgaaaatcccgccggcggcatgtttccgatgctgccattggccaatcgcgtcgccggcaaccgttttatttttcatgggcaggagattatcctgcctcgccaccatgccgacgagtatttctttcttcacggtgacggctggttacagcgctgggatatcattgagtacggcgccgagtattgtgtattacagctgcgtcggcagcatgcctgcggtttcgattatctggcgcagctccgctaccagttgctgcgtaaccagctgatagcggagctaacgcttacccactatggggaggtccctgcgctttacggctgcggctttcatccctttttccctttcgatgaacgcagcaaggttcagttccaggtcagcggttactggccggaaggggagaatcacttacctctcaactggcaaggaaacttgcccgactatgccaatttcagcgtggctcagttcggtgaagatcgttggctgaacgtgggttattccggctggggcgggcgggcgagggtaagcaatgacgtgatgagtatcacaattctatcgcaaactccgtggttgatgctgttcagaatgcaaggtgaatcattcctttgcctcgagccgcaaagccatccggtaaacgcccacaacatggacgggcagccggggctgcgagttttaggcgcgggagagaagctgaatttttcgctgaaaatcatcatcgagggggcataa

SEQ ID NO: 4542 - DNA, 405 bp, Klebsiella pneumoniae
acactgcctgggaggcatcaaatgattactggtatccaaattactaaagcggcaaacgacgacctgctcaactctttctggctgctggatagcgaaaaaggcgaagcgcgctgcctgtgcgccaaaggtggttttgcggaagatgatgtggttgcggtaagcaaactgggtgaaatcgaataccgtgaaatcccggtggacgtgaaaccggaagtgcgcgtcgaaggcggtcagcacctgaacgttaacgtgctgcgtcgcgaaaccctgctggacgcggttgagcatccggaaaaatatccgcagctgaccattcgtgtttccggctacgcggtacgcttcaactctctgacgccggaacagcagcgcgacgttatcgcccgtacctttaccgaaagcctgtaa

SEQ ID NO: 4543 - DNA, 480 bp, Klebsiella pneumoniae
ccagtgcctggctggagtaagaaaatgaaaaacgaagtcgaacagattgcacagcaaaacgatatgagcattgaattcgtaacctggttctttaacgagaagaaggtggggtgcggaaatgtctggttcatgatgatggctgcaatgtgggagggctggaaaggtcgtagcatcgaaatggataagctggctgcggagaatgtggtgctgaaacagttccctgaacagatagttcagtttatcggcggacttgggaccagtgagattggcatcgacacgaaagagaaaatcgggttggcggcaatccgcattaaaacacccgtcaccgacgcctacctggccgggattaaggctgatggggtggagtcaggaattaaaaccatcatgacgatgctgaatcaccaggctccgggcgtcagtgatgcaatcaacgtgttgcgcgtccactcctctgagctgcgcgagggggccgacaaatga

SEQ ID NO: 4544 - DNA, 345 bp, Klebsiella pneumoniae
cgaagcgctggtgaaaaagctggtctgagcagaaaatgggcgtataatgcccgccctgtttgtgttgtttctgagactttcctgatggcgctgttaattaccaaaaaatgcatcaactgcgatatgtgcgagccggagtgcccgaatgaggccatttcgatgggtgacagcatttatgagattaacagcgaccgctgcaccgagtgcgtgggtcattacgacacgccaacctgccagaaagtgtgcccgatcccgaatacgatcctgaaagatccggcacacgtcgagagtgaagaacagctgtgggataaattcgtgctgatgcaccacgcggataaaatttaa

SEQ ID NO: 4545 - DNA, 720 bp, Klebsiella pneumoniae
ccgcggcgtgggcagggaagagcgtccgcttttactcaggattgctggcgaagttcacagaatttttcacgtgaggaacagatgaacagagtgaaacaatgcacaagcgcggcgtttttcatggttttatcatggtcggccgctgcgcatccgcatagcttcatcagcctgcaaagcgagccggtggtcaaggacggtctgctgagcgcctttaaaatgcgctggacgatggatgaaattacctcatcggatctgctctatgatgccggaaacgccaaaccgggcagcgaagtctggaaaaagctggcggcggaggtgatggccaacgtgctcggtcagcactatttcagcgagctgtggcataacggtcagcgggttaaatttgacaatcgtcccgacggttacggcctcgaacgtgacggactgcaggcggtactcacctttactctgccgctggcgacgccgcaacccattgccgggcagacgtttaccttttccaccttcgacccgacctactacgtcgatatgttttatgacaaggatagcgatttttccctgcccgcagggctgcgggccgcctgtaaggcaacggtgatgacgccaaaaccgaacgacaaaatgctctcatacgcccagtcgctggataaagcggatgcgccgccggaggatatggcgctgggcagctattttgcccagaaggtgaccctgacatgtcagtaa

SEQ ID NO: 4546 - DNA, 1245 bp, Klebsiella pneumoniae
tgcttgcccggaagaaaccacatgaataaggacttttcacagactccgcgcccgactttcaaacgcgcgctccgtcgcattagcgtgataagcgtggtgatctccatgacgctggtctggctgctgctgagtacagcctcaatcttcacgctcaagcagtacgcgcagaaaaatcttgagctcactgccgcgaccatggggcgcagcctcgaagccgccctggtgtttggcgacagcgcggcggcagaggagaccctcgcgtcgttgggcaagcaagggcagatctcccaggcaatcgtgctaaacggccagatgcagcacttcgccgcgtggcgccatgaaccgctggccaataaagagcaagtgagcgggcttatcagtaaatggctgtttccggagcccacggtgcagcccatctggcaccagggcaaacaaatcggcgagctgagattgaccgcgcttgatgaactgattagccactttctcggtatctcgattctggtgctgaccggcagcattctgctcgcctcgttcatcgccctgctgctgacccactccctacaccgggggatcgtcgccgccctgcagagcatcactgaggtcgtgcatgatatacgtgaaaaccgccacttctcccggcgggtgccggaggagcgtatcgaggagttccatcttttcgcccaggactttaacagcctgctgggggaaatggaggactggcagcgccagctgcaggccaaaaacgcgcagctgttgcgcagttcgttacacgatccgttgaccggcctggctaaccgcgccgcctttcgtaacgcgctcgccgagctgatgcagaatgaagtcgatcatcaaacctcggcattgctgtttcttgatggcgataatttcaaactgattaacgacaactgggggcatgcggcgggcgataaagtgctgatggaggtcgccagccgcctgatgacttttgccggtaaacgccatctggcgtggcgtcttggcggcgatgagtttgccgttctgctgcgcgaggtgcgctcggaagcagaagtgcaggccctgtgccaggcgctaacggaacaatttcttccgccattcaacctgcacaacggtcatagcgccacgctctcgctgagcgtcggttatgccctggcgtgggagcacgccaccgcggaatcactgcaagaacttgccgatcagaatatgtatcggatgaaaaaccaacgtatccagcagacgctgaaataa

SEQ ID NO: 4547 - DNA, 2664 bp, Klebsiella pneumoniae
aaggagaccggtatgagccaacgaggcctggaagcgctgctgcgaccaaagtccatcgccgttattggcgcatcaatgaagccgcagcgcgctggctatctcatgatgcgcaacctgttagccggcggcttcaatggcccggtgatgccggtcacccccgcctggaaggcggttcttggggtactggcatggcctaccatcgagagcctgccgtttacgccggatctggcggtgctctgtactaacgccaggcgtaatctcgaattgctcgaagccttagggcaaaaaggctgcaagacctgcatcatcctctcttcgcagccggaacagtacccggcgctgctcgaatgcgccgcgcgctatcagatgcgtctgctcggccccaacagtctcggactgctggccccatggcaagggctgaacgccagcttttcaccggtgccgatccatcgcggtaaactggcctttatctcgcagtcggccgccgtctccaatactatccttgactgggcgcaacagcgcgagatgggtttttcctacttcatcgccctgggcgatagcctggatattgatgtcgatgacctgctggactttctggcccgcgacagcaagaccagcgccattttgctgtacctcgagcatctcagcgacgcgcgccgctttgtctccgccgcgcgcagcgcttcgcgaaacaaacctatcctggtgattaaaagcggccgtagtccggcggcgcagaagctattgcacgccaattccgggatggacccggcatggggtgcggccattcagcgcgctggtctgctgcgggtgcaggatacccatgagctgttctctgcggtggaaaccctcagccacatgcgcccgctgcgcggtgaaaaactgatgatcgtcagcaacggtgcggcgccggcggcgctggcgctggatgagctttggttgcgaaacggtaagctggcggctctcagcgaggagacgcgcgacgccctgcgccaggcgttgccggttggcgtggagatcgccaacccgctggatctacgcgatgacgccagtagcgaacactatcagcgggcggtgaatgttttgctcaacagtcaggactatgacgcgctgctggtgatccactctcccagcgccgccgcgccgggcaccgagagtgccctggccctgattgacgctctgaagcatcacccacgcggtaaatatgtcaccgtgctgaccaactggtgcggcgaattttcctcgcaggaagcgcgacgtttattcagcgatgccggcctccctacctaccgtacgccggagggcacgatcaccgcttttatgcatatggtggaataccgtcgcaaccagaaacaactgcgcgagacgccggtgctaccagactccttaaccgccaataccagcgaggcgcatgctctgctgcagcaagcgatagaagacggcgccaccacgctggatactcacgaggtcagcccggtgcttcgggcctatggcatccacacgctgccaacctggattgccgctgacagcgcggaagcggtgcatatcgctgagcagataggctatccggttgcgctgaagctgcgttctccggatatcccgcacaaatcagaagtacagggggtcatgctctatttgcgtaccgccgccgaggtgcagcaggctgcagatgcgatgatcgatcgcgtcaaactggcctggccccaggcgcgcattcatggattgctggtgcaaagcatggccaatcgcgctggcgcccaggagctaagagtagtggttgagcacgatcccgtcttcggcccgttgattatgctaggcgagggcggcgtggagtggcgggccgaggaccaggccgccgtggcgctgccgccgctgaatatgaacctggcgcgttatctggtgatccaggcgatcaaaaataagaagatccgcggccgcagcgccttgcgcccgctggatatcgctggcttaagccaactgctggttcaggtctcgaacctgatcgtcgactgcccggagatccagcgcctggatattcatcccctgctcgcctccggcaacgagtttacggcgctggacgttaccctggggcttgctcccttcagcggcgacagtgaaagccgtctcgctattcgtccctatccgcaccaactggaggagtgggtggtgatgaaaaatggcgatcgctgtctgttccggccgatcctcccggaagatgagccacagttgctcgcatttatcgcccaggtcaccaaagaagatctctattatcgctattttagtgagatcaacgaatttagccatgacgacttagccaatatgacccagatcgactacgatcgagaaatggcgttcgttgccgtcaggaccagcgcagagaagagcgagatcctcggcgtgacgcgggcgatctccgatcccgataatattgacgccgagtttgccgttctggtccgttcagatttaaaagggttaggcctggggcgaaggttgctggaaaagctgatcgcctatacgcaaagccatggcttgcagcgccttaatggtattacgatgccgaataaccgaggcatgataggcctcgccagaaagctgggattcaccgtcgatattcagctggaagatgggattgtcagcctgtcgctgcccctgaatcagggataa

SEQ ID NO: 4548 - DNA, 240 bp, Klebsiella pneumoniae
atacgaagcggtggcgatcggtcatatgaccgccggtggcacagtggaagagccgatcagccgtcacccgaccaagcgtacccatatggcggtgcatccgatgggcaaaccggcggtgacccactaccgaattatggaacatttccgcatccatacccgcctgcgtctgcgtctggaaaccggtcgtacacatcagatccgcgtgcatatgtcgcatatcacccatccgctggtgggtga

SEQ ID NO: 4549 - DNA, 273 bp, Klebsiella pneumoniae
ggaaatggcggcaccagcagtgttagtgtagccattaacaaacacattaactttagctttaattatgtcagacactctaacagcaaacccaccattaccagctgctgtgttatcagagttcctgccacggataagcgcaccagttataccactctgtttatagaaagctgttcctgctgccgcattgtcacgtttaaaagtgaatgcaatgttatcgccaatgtggtcaaaaggtacatctatctcatctgtagactcacatacaatacataa

SEQ ID NO: 4550 - DNA, 186 bp, Klebsiella pneumoniae
ccagccgtaggctggcctccggtgagaggcaggagcctctcattaatccacgggagcatagataactatgtgaccggggtgaacgcgcgcagccaacgccgcgacggtcgaaaagacgaggtttgtatctccaaagtatttcaggtcacagcgagacggcgagttcgcaaatccccgggagcatag

SEQ ID NO: 4551 - DNA, 2523 bp, Klebsiella pneumoniae
accgcagcaggcgatgtcagaccttgccagtgcgaggatctgctgatggcctattcactggtgcagccgtcccttgctggcggcgagatatctccttcactgtatggtcgcatcgatcttgaaaaataccagacgtcattacgccgctgccgcaacttcatcgtccggcagtcaggcggcattgaaaatcgccccgggttccggttcctggggagcgctaaatatgcagaccgttactgtcggctaataccgtttcagttcagcgtatcgcaaacctatgcgctcgagctcggcgatcactattttcgtgtctggtctaacggtgccctggttgcggacggcggcgtccctgttgaagtggctaccccatggccggtgagcgtcatctctgagctgaaatttacgcagtctgctgatgtgatgacagtgtgccacaacgattatccaccgcttgagatccgccgttatggagaggctgactggcgcaccgccgcagtgacaacaaccagcgggccattccaggacctgaacaccgacgactcggtaactgtctacgcctcaggcagaacgggatccgtaacgttgactgccaacagctcgattttcaaaagccagcacgtgggaaaactgttctatatggaacagaaagcggtagatagtgttggtcggtgggaaaccgataaagacatcgggatcggtgacgagtgccgataccaggagaacttttatcgctgtgttgacggcggttctaatggcaccaccggcactgttgctccgacccatacaacgggagattcctgggatggctggggtcttggtggccgtaacggtgtgttgtggcgctatctgcatagtggttttggcgtgtgccgtattaccgccgtcgccggagatggactaactgcaacggcagacgttgtgccacgtcaggatggtgagatcgagctgccggcgcaggtggtgggtagcaccttcgccacttacaaatgggcgcattatgcctggaacgatactgacggctacccgggtacagttacctattaccagcagcggcttattttcggcggaagccgggcatttcctcaaactatatggtgtagccgtaccggtgattatcacaacttctatcgcagcaacccgaaggttgacgacgatgcgataacctataactatgccggtcgccagctgaacaaaatcctgcaccttcttgatgtcggtcagcttatcgtgctgaccagcggcggagagttcaaggtgacaggcgacagcaacggtaacctgacgggaaccggtggctttgcgatgtccggtcagtcgttcaacggtagcagcgatctggcgccaatcaacgttggcagcgttgcactgtacgttcagcagaagggctccatcatccgtgacctgttttactcattcgaccaggacagctatcaatccagtgatctgaccctccttgccagtcatctgtttaacggttacagcatcagagactgggctttgtctgtacagccgttcagcgttgcatggtgtgcgaggagtgacggcatgctgcttggccttacttatctccgcgagcagcaggtatatgcctggcatcctcacccaatgactaatggctatgtcgaatcgatctgcagtattagcgaagggcaggaagatgcagtctatgcacttattcgccgtacggtgaatggatcgacagttcgttatgttgagcgactgaacaccaggcagtttacagaacagcaggatgcatttttcgtggattctggcctgtcttacagcggagaaaacaccgactcttcacgcacaatgacgatcggttccaccggtggctggacataccaggatgaattcacgctaacgtgcagctctgcaatcttcgactcatcgagcactgattacgagatccatattccctacaccgaaggcggtgtcagcaagtcgatgcgtttgagcattgctggtgttatctcatcaacagtggctaccgtattagcaaaccgtgatgtgccgacagcgctgcgcaacactgcgcaatcaacctggtcgatagcacgtcggatatttgcgggactgtctcacctcgaggggcagacggttagcattcttgccgacggtaacgttgaacctcagcaggttgtatcaggcggcgaagtgacgatcgaaaaccactcgtcagtggtgcatatcggtttgccggtagccgcggttatcgaaacgctggacgtgaacgttgcagggcagtctacgctgctggataagaccaaactcatcaatcagctttgcgtaatgctcaacagcgggcgctcggtttgggccggaacagatgatgctcacttactggagtatacccagcgtgagtgggaattctacgacgacccggtagggctaaagacgggcatcatcgatatgaacctcgatgcaaactgggagcgtaacgggcgggttgtaatcagccattccgatccgctgccgcttggcattctggccattataccgcgcgtaacggtagggggatga

SEQ ID NO: 4552 - DNA, 954 bp, Klebsiella pneumoniae
ggcggagcaggctgccgccgaacaggcgctgaaaaagctggagctggaatgagcgaagaaaaaagttattgtgggtttgtcgccatcgtgggtcgtccaaacgttggcaaatccacgctgttgaacaagctgcttgggcagaagatctcgatcacctcccgtaaagcgcagaccacccgtcaccgcatcgtcggtatccataccgaagggccgtatcaggcgatttacgttgatactccgggcctgcatatggaagagaagcgtgccattaaccgcttaatgaacaaagcggccagcagttcgattggcgacgtggaactggtcatcttcgtggtggaaggcactcgctggacgcaggacgacgagatggtgctcaacaagctgcgcgacgcgaaagcgccggtgatcctcgcggtcaacaaggtggataacgtgcaggaaaaagcggatctgttaccgcacctgcagttcctcgccagccagatgaatttcctcgatatcgtaccgatctcagcggaaaccggcaccaacgttgataccatcgcggcgatcgtgcgtaagcatctgccggaagcgatccatcacttcccggaagattatattaccgatcgctcacaacgctttatggcctccgaaatcatccgtgaaaaactgatgcgtttcctcggcgctgagctgccgtactccgtcaccgtggaaatcgaacgtttcgtcagcaacgagcgcggcggttacgatatcaacggcctgatcctcgtcgagcgcgaagggcagaaaaagatggtgattggcaacaaaggcgccaaaattaaaaccatcggtatcgaagcgcgtaaggacatgcaggagatgtttgaagcgccggtgcacctcgagctgtgggtgaaagtgaaatccggctgggccgatgacgagcgcgccctgcgcagtctcggttacgttgacgacctctga

SEQ ID NO: 4553 - DNA, 501 bp, Klebsiella pneumoniae
aataataaaggactcattatgatcagaaaatatttcgtccccgccctgatggcggcggcgcttttgacaggttgccaggctcctcagggaaaatttaccccggagcaggtggcggcgatgaaatcttacggcttcactgaaagcaatggcgattggtccctgggcttatccgatagcatcctgtttgacaagaatgactaccgactacgtcccgacagccgccagcagatcaccacgatggcctcgcggctggcggctaccgggatcacccatagccgccttgaaggccataccgataattatggtgaagatagctacaatgaagccctgtcgcttaagcgggccaacagcgtggccgatgcctgggcggaaggcgctcatgtcccacgcagtaatttagtcacccgcggccttggcaaaaaatacccgatcgccagcaacgacacggcggccgggcgcgccgaaaaccgccgggtaacggtggtcatcagcacgccgtaa

SEQ ID NO: 4554 - DNA, 804 bp, Klebsiella pneumoniae
aggctggaaggatttcttatgagtaacgtattcgcagcaattcagaatcgtgatgccggcgccctggctcgcatgatgggtccggacaatcaccaggctcagcaagacaatgttgtgaacatcagcgcagagagacttgtcgatgccctgtttaaacagctcaagcaactgtttccggcagcagagcagaccaaccttaagaccgcacagcaggagaccgacgctaagcgccagtggatcgccgcgttcgccgaaggtggtatccgtacccgtgagcaggtatcagcaggaatgcgccatgcccgtgccagtgaatcaccgttctggccgtcaccaggtcaattcatcaagtggtgcaaagacagcaagatggtgcttggcgtgagtatcgaagatgtgatgggggagtttcaccgctatgccaaggagaaaagcctacagcctggcggaccagaacaattcccgtggcgccaccctgtcatgtactggattgtgtgcgataccaggcgtgcgatgtaccagcgtcagttgagtgagattgaggttgagaaacatgcgcgtaagcttctggacgaatgggcgtcgaaggtcgcggcagggcatcagatacccgatccgattctgagcatccaggcgaatccagagcctataaatacccctccagaccccggtggcaatacctaccatccgccaggtcgaagtttcggatgtatgcctaacgcggcgacactcggaggtataaccccggcacagtggctgatggaggaataccggcgagggaaggcagcaggactcatcaagtaa

SEQ ID NO: 4555 - DNA, 228 bp, Klebsiella pneumoniae
gctgcgcgagggggccgacaaatgagcaatcgcatccctaatttcggctggaaccgcctgaaactggcaacgctcacctatgagcaactggctcaactggaagagcaagtgaaggccgagcatgcctgcaaaaacggcattcacctcttcgacaaggccggtcagcgcaaactcgatgcccttagctgggccgtatacaacaagcagaaggcggagcgtgccgcatga

SEQ ID NO: 4556 - DNA, 237 bp, Klebsiella pneumoniae
acgttgagaggaatggttatggaacttgattgccctctgtgccacgcgccgttagatgtcaaaggcagtagcgcgcattgcgcccagtgcgaaagggtatttacccttgaggcccgctgcccggaatgccaccagccgctggaggtgctgaaggcgtgcggcgcggtggattacttttgccagcatgggcatggccttatctcgaaaaaacgggtggaatttattccgctggtttag

SEQ ID NO: 4557 - DNA, 786 bp, Klebsiella pneumoniae
tgccgtggaggtgatctgatggcccgcattcgtaccattaagcccgagttctggaccgatgaagacatggcagaggtatcagaaccagcctgcttgctggctattggtctgctcaattacgcagatgatgaaggctatttcaatgcaaacccgaagcttatcaaagctgcagttttccctatccgagaaccatccgttcctattccggtactaatacgggagctttccaactgtggctatttatccatgttttccacccctgatggaaagcattttggggtcataacgaatttccttaaacatcaggtagtgaataagccaaaagaaagcaaaatcaaatgtttacccttagtaccgtatgagtacggtactgatacggtacaagtaccattaggaatggatcagggatcagggatcagggaaataaaaacccctctctctgcgcgcgaagtaattcaagtccctccggttgtcgttgatggtatcggagagccaattggcaaattcaccatgcatgaaaactggaagccgtcagaggactttgtcatgcgcgccagaacatggggccatgcgctaccagctgacggttacaagaaatcagacctgatcgaattcatcacctactggatggcagaaggcaatgtgatgcaacacgtgcagtgggagcagaagtttgcccggctgctgatgaacaggaaaaaaagagcggcaggaaagcgcggtgaaagctctgacgatgaagtaccacactggaacagccctgaaggctggaaggatttcttatga

SEQ ID NO: 4558 - DNA, 651 bp, Klebsiella pneumoniae
gataaaggaggcagtttgcagcacactgaacggagagtggtgtttttcgatctggacggaaccttacaccaacaggatatgttcggcagttttctgcgctatctgctgcgccatttgccgctgaacctgttgctggtggtgccgatggggccggtgatccttgccggactggcagtgagcggacgggcggcgcgctggccgatgagcctcctgctgtgggcgacaacctttggccgccgcgaggcggtgctgaagcggctggaagcggagtttgtcggctggtttcgccatcatgtgacggcgtttccggtagttcatgcgcggcttaccgcctacctgaccagcaccgatgccgacgtctggttgatcaccggctcgccgcagtcgctggtggagcaggtctatcgcgataccctctggttgccgcgggtgaatctgatagccagccgcaccgcgcgccgctggggcggctgggtattgaccctgcgctgcctggggcatgaaaaggtggtacagctggagaaaaagattggcgccccgctgcggctgtatagcggctatagcgatagtgagcaggataatccattgctcggcttttgccagcatcgctggcgggtaacccctcagggagagcttcagcagctggagtaa

SEQ ID NO: 4559 - DNA, 615 bp, Klebsiella pneumoniae
agacgcatgggaattgggtttggggagacattacctcggatgagcgagcagttaacggatcaggtccttgttgaacgggtccagaaaggagatcagaaagcgtttaatttgctggtagtgcgctatcagcataaggtcgcgagcctggtttcccgctatgtaccgccgggcgatatcgctgacgttgttcaggaatcgttcgttaaggcatggcgtgcgctggactctttccggggagatagcgctttttacacctggttataccgtatcgccgtcaacacggcgaagaattatctggttgctcaggggcgccgtccgccgtccagcgatgttgacgccaacgaggcggaaaacttcgaaagcggcggggcgttgaaagaaatttcgaaccctgagaacttaatgttgtcagaagaactgagacaaatagtttttcgtaccattgaatcgctcccggaagatttacgcatggcaattacgttacgggagctggatggcctgagctatgaagagatagccgctatcatggattgtccggttgggacggtgcgttcgcgtatcttccgggcgcgagaagctattgataataaagttcaaccgcttatcaggcgttga

SEQ ID NO: 4560 - DNA, 1506 bp, Klebsiella pneumoniae
acctcaatgggcgggctcggcccgcctgaaccctactgttccctgcgtttcccttatagaggaatcattatgaacaacgcgcagacacatctgaaaatgggctacgtctggacgatttgtctggtcgccgcctgcggtggtttactgtttggctatgactgggtggtgattggcggcgctaagccattttatgaagcctggttttcaattacggacccggcgcagtccggctgggcgatgagctcagcgctgttgggctgtattttcggcgcattaatttcgggatggtgcgcagacaaactggggcgcaagctgccattaattctttccgccgtgctgttcagcgcgtcggcctgggggacggcggtcgccagtcatttcgatatgtttgtggtttaccgcattgtgggcggcgtagggattggtctggcttccgctctcagcccgctttacattgccgaagtcagcccggcagagaaaagaggacgttttgtcgcggtcaatcagctcaccatcgtgattggcgtgctggccgctcagttaatcaatctgatgattgctgaaccggtggagccgggggcgacgcagcagatgattgtggacagctggaatgggcagatgggctggcgctggatgttcggtgcggaactggtgccggcactggcgtttctggtcctgatgttttttgtccccgagtcgccgcgctggctcatgaaggccggtaaaccggagcgcgcccgggctgcgctggaacgcattggttctgccgactatgccgacaggatcctgcgtgaaatcgcgcataccctggaaaaggataacaataaagtctcctacggcgcgctgttggctccccaggtgaaaccgattgtgatcattggcatggtgctcgccatattccagcagtggtgtgggattaacgtcatctttaactacgcgcaggagatttttgcctcggcggggttcgatattaacagcacgctgaaatcgatcgtcgcgacgggcgtcgttaatctggtctttaccattgcggcgctgccgctggtggataaaatcggtcgccgtaaattaatgctgcttggcgcttcgggattgacgctgatctatgtgctgatcgccggcgcttacgccatgggcattatggggtggccggtactgttgctggtgctggcggcgattgctatttatgcgttgaccctggcgccggtgacctgggtgctgctggcggagatttttcccaaccgcgtacgtggactcgcgatgtctttaggtaccctggcgctgtggatcgcctgtttcctgttaacctatactttcccgctgcttaatgccggtctgggcgcggcaggaagcttcctgctgtatggtgttatttgcgctgccggctacctctatatcctgcgcaacgtcccggaaacgaaaggtatcaccctcgaagcgctggaagagcagctggcgcagcgtcatacgggcgtgaatgcggcgaagcaggagcagatgcgctaa

SEQ ID NO: 4561 - DNA, 525 bp, Klebsiella pneumoniae
gtcgtggtggggcttgcactggataatagcggcaccgattgcattcatcgtcagctatataccactggttggatctatcgtgggaatgattggggccatggacgtatggcgctgggagtggtggcaggctggtctacttttctttggtggtctaatctttgctatcgcctgtgggggtatgtcttcattattcgaatggctatcattcagaaagagagcgtgacatgtcactccaacaaacaggccgctttcgcggccttaattatcactgaccgccggggcgggagtcagcagaacggccgccacagcgtgagccatcagctgcagtatcatcaggatgctggcagttaccagcgaaagcctgtgcggaagaacccagagacaacagaacaaacagcactgcgaatgcttttttcattttcacttaccatgtgtagaccactgaaccgtggctttatgattgtagcgctgtgctcagatttcatccatcaaaaagcccgctatgcgggcttcttaactaaataa

SEQ ID NO: 4562 - DNA, 447 bp, Klebsiella pneumoniae
ctgctgacgggcctcgccatccggcactgtacccagcaagtcctgagctttctgctgcatgttctgcatgacgacatcgctttgcccgagcgcagcctttccctgcttcgttatcagaccattgtcaggattgttgaactggtcatcaccgaactgattaaactgcagcagagcatcctgactaagcgcgacatcagccttgcgctttgcatcagccatcatattgatcgacgtatcagcagcctgctggatgccctgcaccagcggattttccggcacacgaagattactcgtcatcaccggcgcggtttgcgtctggctctggcgttgatattgcggaacggttggcatagtcagctccttttacttagcggaaagcggcttccaggtaccgcccagcgtcttgtatgcattaagaccggtcagcgtggagttgagcagtgttga

SEQ ID NO: 4563 - DNA, 543 bp, Klebsiella pneumoniae
gcgggccgggggggttaccgggttgataaagtcaacttacgatccgggttgccaaacagttcattattcagccggggtgcagttccggacaggcctgcggcaaacgcgctgccggtgacctattccaacgtggagccgagcgattttgttcagactttctcccgcagcaacggcggcgaagcgagcagcggtttctggcagttgccgaagggcgaaaccaaagccgacggcattcgtcttaccgagcgtcaggagacattgggcgacgtgacgcaccgaattctgatggtgccgattgcccaggatcaggttgggatgtactaccatcagtccggtctgccgctggctacctggattgtgccgcccggtcagtacttcatgatgggcgacaaccgggataacagcgccgacagccggtactggggctttgtgccggaagccaacctggtcggaaaagcaaccgctatctggatgagttttgaaaagcaggaaggtgaatggccgaccggcgtgcggttatcgcgcattggtggaattcattaa

SEQ ID NO: 4564 - DNA, 222 bp, Klebsiella pneumoniae
gatttctttataaaatcttctgagttcgatgaaaacttagcccattcaagtaacggcaaagtattatttatgtcagtttttggtaaattacctgttattaacgcgatagaatctctttctgacttaaagcccacatttttaaagtccgcccaagcactatgtataacttctgcaaatactgagtttgatgagccactaatagttatttcatgtttaatctga

SEQ ID NO: 4565 - DNA, 612 bp, Klebsiella pneumoniae
aaggtaattattttcggggtgtttaccatgccaaaggatcccaagcgcaaatcaactcagtacaaaccgttgacggtgatgcaggaagcctacgcccaggagtatgttaaatgccctgaaaatcagacgcaggcggccatcaatgccgggttctccccaaagtctgcccacgtcaaagccagcacgatgatgcgtgatgagcgtatccagaaacgaatcgctgagctcatggaggagcgcaacaagcgcctgcgcgtcagtgccgattacgtgctgctgcgcctggtggaaatcgaccagatggacgtgctggatatcctgaacgacgacggcagcctgaagcctatccgcgagtggccgaaaatctggcgaaccacgcttagcgggtttgacctgtcctcaaccatcatgaacatggatgagacctcgatagagaccatcctcaagaaaatcaaatggcccgataaggtgaaaaacctcgagctcatcggtaagcacgtcgacgttaacgcgttcaaagagcgcatggaagttaacgtgaacgttaccattgccgaccgcattgccgccgcccggcgccgcctgaaagagcgccagggtggtgaccagtga

SEQ ID NO: 4566 - DNA, 333 bp, Klebsiella pneumoniae
ggttttgttatgtcgattactcttagcgacagtgcagcagcgcgagtcaatgccttcctggcgaaccgcggtaaagggtttggcctgcgcctgggcgtaagaacctccggctgctcgggtatggcctatgtactggagtttgttgacgagccggcggctgaagacaccgtgtttgaagacaaaggcgtgaaggtcgtgatcgacggcaaaagtctgcaattcctcgacggcactcaactggacttcgtcaaagaaggcctcaacgaagggttcaaattcactaaccctaacgtcaaagatgagtgcggctgcggcgaaagctttaacgtataa

SEQ ID NO: 4567 - DNA, 300 bp, Klebsiella pneumoniae
tatatgtatatatatacagtatttatgggagtattcctaatgccagagcggtaccagtatcctgtcgacgaaggtttttcagatcgtattcacacccctgaaggggtcagatccctggttgtaaaatcacagctgatggagttgctcagggagatggagcgagacggccacgatgtcagcggtgcggcggcggaactggtggcactggttaactatgtaacgagctcgcagttgtcgatgcgggagctgcagacgcacctggacttctgcgcaatgcagttacggcagcaactcagatag

SEQ ID NO: 4568 - DNA, 1980 bp, Klebsiella pneumoniae
ggggatgatatctcagcaaacagtatacagggacacaaaatgcatcatttaaatgatttccccaaaagagatagaaaccacaggattgaaagacttgcgatatccgcttttgaaaattttcttagagattcaaatgatttcttcattcaaagtcaggatataaatgattacggcgtagactatcaactcgaaatcacaacaaatggtcaagcaactaatattagattgtttgttcaactaaaaggtactgagcaagaattgaataatgatggatcggtcagtatatctgttaatagagccaacctgaattatttattaatgcacccttattctttttatgtgtgtttccatgcaccaagtaatagtctaaaaataacattcgctgaaagcgtaattcgaagctatgaacagtctgaaaaacaatggatagagcaagaaacactcacagtaagattcattgagaatatttctgactctcgtttgcatgaaattgcagagttggctagatttaatgccatgaatgaccgtaatgctagaatcgagttgataacaaatcatatttcaaatgttagcaatgttattaataaagccataccgaagatacatataccagaggataaaaaattagcttatgaattgcttaattcattgtatgaaaataaccatgatgatgtaataagtgctaatttttatgagtttttggctattttcggccctgaccatccggcgatgatcattccatatatgtcggaaattaataaagctatggatagagttaatggcaatgaagcaagggttttaaatgggatacaatatcttagagatagattggaagagggtaatataacaaagggaagtttatattattcaataggtaatggatttacggcacttgacagggacaaagaagctattcaagagtataaaactgctcttgagcatataatcgaagcagataaattagctgcgcaatgctacaaaaatatgggtagtagttactcaaggctagggaatgaaaatgaagcatatgaatgctataagaaggctcttgagttagaaccaaacttaagtgaagctaatttggctttgggagtaattcataatcgtaggggtaattatgaattgtcattagaatatttagatagagtgcttttcccgggaaattatcaacataaaataatttatgttgataaatggagaataaacactcttttcaatataggggattatcgttcggcatatagagagataaataatctattaactcggaatgataataaagaggacttatggaaatggtgcttaatgctagttgcatcgttctgtcgaacttcgactgcgtctgctaagcttagcttgcctttttgggctcgttttttagaattctaccctaatcaccctgatgcatctagagagattctattggcgaaaaattacttaagagttaatgataatttaactaaatattcgtaccatgattttaagaaggagtttgaattacgaataaataatgttagtaatgaagatagtgctttcttgtgggatcgtataggtcattgggcacaagatgaagacgagtgggaagatgcagagatgcatttccgtaaagcatatgaaattgcgggtggcgaatatggatattgtcttggagtagctctgaatcatcttggtcgcttccaggaaagcttgcctattttggttgagcaagctgaaaaaatccaacctgatgattttagctggttccaggtcgctgttgcctacgaatttcaaggatatattcaagaggcaatcgactcttatgaaaaatgcttatcaataaataataaaaatgaattggcattattcaaccttggaggtctttactggaattcgagaaattatgatgaagcaagtcgcgtctggaagttggctgtggcgtattatcccgaacatgagctttcgcataagcttcgaaaggacattccatttattttaaattaa

SEQ ID NO: 4569 - DNA, 318 bp, Klebsiella pneumoniae
ggggatgatatgcgaaaagttgagatagttccggtgaccgaagagcaaattgccgccatgctgccccatgtccgccaggctgaccgggacgaattcatggctgcagccggtatgactccggcggaggtcataactcgcgctatgaaaagcgcttcggtagccgctgcagggatgattaacggccaggtggtaaccatcttcggtatatctcctgcatcgatcatcaccggacgaggtattccgtggctggttagcactgaccacattgagcatcagccgctgacattcctccgccattgccgaccggtgtcttcgtga

SEQ ID NO: 4570 - DNA, 555 bp, Klebsiella pneumoniae
cgcccatgtataatgcgccccgctttttctgctggagtggccgctgtgtctgacctcgaactcaatgatgaatactggatgcgtcatgccctgacgctggcgaaacgcgcctgggaagagggcgaggtgccggtgggcgcggtgctggtgcataacaatcaggtcattggcgagggctggaaccggccgataggccgtcacgaccccaccgcccatgcggagattatggccttacgccagggcggactggtgctgcaaaactaccgcctgatcgacgccacgctgtacgtgaccctcgagccctgcgtcatgtgcgcgggcgcgatggtgcacagccgtatcgcccgcctggtgtttggcgccagggatgccaagaccggcgccgccggctcgctgatggatgttctgcaccacccgggaatgaaccatcgggttgcgataagcgaaggcgtgctggcagagtcctgctctgccatgctgagcgacttcttccgctggcggcgggaagagaaaaaagcgctgaagaaagcccgggcgcagaccggggaaagttaa

SEQ ID NO: 4571 - DNA, 390 bp, Klebsiella pneumoniae
ctgggccgtatacaacaagcagaaggcggagcgtgccgcatgacaactgatatcaccgaactggcgcagcgtatgaaggctgcagctgtaagagccaaaacggcaacagaagaatatgcatctggacacatgtctatttcagtctgctatgccgaatgcgaagagtttaacaggctaaccgatgggccagacaatatcatcgcgctggtagaggcgctggagaaggcgcagcagcgcatcgccgagctggagtcccgcaccgtgaagctgccagacttacggcagattgtatctggggacagatatgtatggtctgatggtgtttataactacagccaggacgtaaaggtagcgctggccgccgctggcatcaaggtggaggctgaatga

SEQ ID NO: 4572 - DNA, 1131 bp, Klebsiella pneumoniae
gaggaaagtatggttgctgaactgaccgcgttacgcgatcaaattgatgaagtggataaagcgttgcttagcctgctggctaagcgtctggagctggtggccgaagtcggcgaggtgaagagccagtatggcctgccgatttacgtcccggagcgcgagtcggcgatgctcgcctcccgacgtgaagaggcggctgcgctcggcgtaccaccggatctgatcgaagacgttctgcgtcgcgtgatgcgggaatcctattccagcgaaaacgacaaaggcttcaaaaccctgcagccgaatctgcggccggtggtgatcgtcggcggcggtgggcagatgggccgtctgtttgagaagatgttaacgctgtccggctaccaggtgcgtattctggaaaaaaacgattgggcccgggcggcggatatcgtcgccgatgccggcatggttatcgtcagcgtaccgattcacaccaccgtggagacgatcggcaggctgccgccccttccggcggattgcattctggttgaccttgcctcggtgaaagcggagccgctgcaggcgatgctggcggcgcatcagggcccggttcttggcctgcacccgatgttcggtccggacagcggcagcctggcgaagcaggtggtggtctattgtgatggccgccagccggaggcctatcagtggttcctcgaacaaatccaggtttggggcgcgcggctgcaccgcatcagcgccgttgagcacgatcagaacatggcctttattcaggcgctgcgccactttgccaccttcgcctatggcctgcacctggcggaagagaatgtacgtcttgagcaactgctggcgctctcgtcacccatttaccgactggagctggcgatggtaggccgtctgtttgcccatgatccgcagctgtacgccgatattattatgtcatcggaaaacaacctggcgctgattaagcgctactaccagcgtttcggcgaagcgatcggcctgctggagcagggcgataagcaggcgtttatcgacagcttccgtaaagtcgaacactggtttggcgattacgctcagcgtttccagagcgagagccgcacgctgctgcgtcaggcgaacgataatcggcagtaa

SEQ ID NO: 4573 - DNA, 399 bp, Klebsiella pneumoniae
ggagaattcatcatggcttacagcgaaaaagttatcgatcattacgagaatccgcgcaacgtcggctcttttgacaacagcgacgagaacgtcggcagcggcatggtcggcgcgccggcctgcggcgacgtgatgaagctgcagattaaagtcaacaatgaaggtatcattgaagacgcgcgcttcaagacctacggctgcggttccgctatcgcttccagctccctggttaccgagtgggtgaagggcaaatcgctggacgaagcgcaggcgatcaagaacaccgatatcgccgatgaactggaactgccgccggtgaaaatccactgctcgatcctggcggaagacgcgattaaagccgcgattgcggattacaaaagcaaacgtgaagcaaaataa

SEQ ID NO: 4574 - DNA, 1017 bp, Klebsiella pneumoniae
ggtgtaatcatggctttaattggtcagacgctgccttctcttcttgacgtgtacagccgtaccgacaagaacgggcggatcgctaaaatcgtcgagcaactggcgaaaagcaacgatgtcattaccgatgcgatttacgtgccgtgtaatgacggttccaagcacaaaaccaccattcgtgccggtattcccgagccggtgtggcgccgttacaaccagggcgtgcagcctaccaaaacccagaccgttccggtgactgacactaccggtatgctgtacgaccttggctttgtggacaaagacctggccgatcgctccggtaatgcggactcgttccgcgtgtccgagaacatgggcaagctgcagggctttaacaacaaggtttcccgctacaccttctacggcaataccgatgctgagccggaagcgttcatgggcctggctccgcgcttcaacactctgagcacttccaaagcggccagcgcggagaacgtattcagcgctggcggtgcaggctccaccaatacctccatctggttcatgtcatggggcgagaacaccgcgcacatgatctacccggaaggtatggtcgccgggttccagcatcaggatctgggtaatgacctggtcagcgatgcgaacggcggtcagttcctggcttaccgtgatgagttcaaatggcatctcggcctgtcagtccgtgactggcgttcgatctcgcgcatctgcaacattgatgtcaccacgttgaccaaagatgctgcaaccggcgccgacctcatcagcatgatggttgatgcgtactacgcgcgtgatgtagcaatgctgggcgatggcaaagaggtcatctactgcaacaagaccatccatgcctggctgcacaagcaggctatgaatgcgaaaaacgttaacctgacgatcgacgaatatgccggtaagaaaatcgtttctttcctgggtattccgatccgtcgcgctgacgccatcctgaatactgaatcagccgtaacggcgtaa

SEQ ID NO: 4575 - DNA, 225 bp, Klebsiella pneumoniae
ggtgcaatcatgaaaacccgtgctgacagcaacgatgcttttcccgaaagcggcaatgtgcgtatgcggcaggtggtccagtttctggcgatgagtgaatcgtcggtttaccgcctgattaaaaacaccgactttccccgccccgtccacctctcttcccgactggtggttttcgatgctgctgaaatccgtcagtggcagcagcgccgcaccgccatccgctaa

SEQ ID NO: 4576 - DNA, 402 bp, Klebsiella pneumoniae
ggggggatcatgctgctcgaccagcaagcgcttttttccgcagctcaggccattacggccacggctgcttctaccaacgtcattgataccggcagcaataaagacgtcggtaaatatggcgatatcccgctgctgatccaggtggttgaaggtttcaacaacctgaccagcctgactgtgacggtgcaaaccgatgacaactctgcattcagttctgctgcggacgtgctgtccatgacgatcccactggcgtctctggtgctgggctataagtcgccggttatcacgttgccgatgaagatggaacgttacatccgtctgaactatacggtgactggtactgcgccgaccaccggcaaagtcactgccggtatcaccggaggcgtgcaaaccaatgcctga

SEQ ID NO: 4577 - DNA, 417 bp, Klebsiella pneumoniae
acggtggtcatcatgtctgcatcgctaaccgctgatacaataaatcaggggcttagctacggtgcgctggcggcagtcatcgcgggcgtacctccagaagtggcgctgggatcgctggccggggcggtaatttttgttacctctgcagttgagtatccggtcaagcgccgcgttctcctggcgctactcagctttctctgcggtcttctcttctacaaacccacagcatcaatccttatcggcgttgccagcatgatccccaccatcacacaggactcgtttgagcggggtattgtctactccgccggtgcgttcgttgcggcaattgtcgcggtgcgggtcgggatatggctgtatcaccgctctgacaatccgagcgatttaatcccgggaggaaaagacgatgacaggccatga

SEQ ID NO: 4578 - DNA, 993 bp, Klebsiella pneumoniae
  unsure (723),(964),(976),(983): Identity of nucleotide at the above locations are unknown.
ggagaaaacatgtctaccaacgcacttaaggcagcagcgacaggaaaccaggtcgcgcagcatagcgataaaccaaccactctggctggcttgctcgcagatccaaaaattaaggctcagatggcgctggctcttccaaagcacatgacagccgaccgccttgcgcgcatagctactacagagatccgcaagatcccaaaactggcggcctgtgaccaggccagcttcctcggggcgattatgcaatgtgctcaactcggtcttgagccaggcggcgcacttggccacgcatacctgattccgttcgacaaacgccagaaagtaaatggccgctgggaaactgtatcgacagaagcgcagctgattattggttatcgcggaatgattgacctcgcccgtcggtcaggtcaaatcctgagcatatcagcgcgcacagtccatgcgaacgacaaattcagttactcatacggactggaagaaacgctcgagcattcaccttgcgagaccggtgaccgaggagaacttacgcatgtttatgccgttgcacgcctgaaagatggcggcgttcagttcgaagttatgagccgggcagacgttgagaaagttcgtgccatgagcaaagccggaagcagcggaccgtgggtggaccactttgacgagatggccaaaaagacggtgatccgtcgcctgtgtaaatacctgcctgtttctatcgaactgcanaaagcggttgtgatggatgaacgagctgaagccggcctgagccaggataacgcagctgttatcaccggtgagtattccgtcgtagacgatgagcagcagagcatgacagcagtttctgaatctgttcgagaagaagcacgtgaatacgctagcgccattctgaacagccttgatccttctgtggatgatgcaaaggcgctttttaagcgggcagaagacgaaataaacgcactggctgaanaagttagggggncccgggnaaaattttga

SEQ ID NO: 4579 - DNA, 495 bp, Klebsiella pneumoniae
cttcaggacattatgactaagaaaaaagcccacaaacctggatcagccaccattgcgctgaataaacgcgcccgtcacgaatactttatcgaagatgaatacgaggctggtctcgccctgcagggctgggaagtcaaatccctgcgtgcaggtaaagccaacatcggcgatagctatgtcatcctgaaggatggcgaagccttcctgttcggcgccaactttacgcctatggccgtggcttccacccactatgtctgcgacccgacgcgcacccgtaagctgctgctcaaccagcgcgaactcgacacgctgtacggccgcattaaccgcgaaggttacaccgtcgtcgccctgtcgctgtactggaagaacgcctggtgcaaagtgaaaatcggcgtcgccaaaggtaagaaacagcacgacaagcgtaccgacctgaaagatcgtgaatgggcgctggataaggcgcgtattatgaagcacgccggacgttaa

SEQ ID NO: 4580 - DNA, 897 bp, Klebsiella pneumoniae
cgcaaggacatccagatcatgaagaaccatttcaagtgtatcggcattgtgggacatcctcgtcaccccaccgccctgaccacacatgaaatgctctggcgctggctgtgcagcaaagggtatgaagtgctggttgaacagcagatcgcccatgaacttcagctcagcaacgtgaaaaccggcacgctggcggagattggccaacaggccgatcttgcggtggtggtgggcggcgacggcaatatgctcggcgcggcgcggaccctggcccgttacgacattaacgtcatcggcattaaccgcggcaacctcggctttctcaccgaccttgacccggacaacgccctgcagcagctcgccgacgtgctggaaggccactacatcgccgagaaacgctttctgctggaggcccaggtgtgtcagcaggattgccagaaacgtatcagcaccgccatcaacgaagtggtgctgcaccccggcaaagtggcgcatatgattgagttcgaagtctatatcgacgaagtctttgcgttctctcagcgatccgatggcctgattatctccactccgaccggctccaccgcctattcgctgtcggccggcggcccaatccttacgccgtcgctggacgccatcaccctggtgccgatgttcccgcacaccctttcagcgcgaccgctggtgatcaacggcgacagcaccatccgcctgcgcttctctcaccgctgcagcgatctggagatcagctgcgacagccagattgccctgccgatccaggatggcgaagatgtcctcattcgccgctgtgattatcacctcaatctgattcaccctaaagattacagctatttcaatacattaagcaccaagctcggctggtcgaaaaaattgttctga

SEQ ID NO: 4581 - DNA, 1059 bp, Klebsiella pneumoniae
accgttcgcatacggtgccgctcagcaaacaggcgctgcgcgttcttcagatcatggagccagtcagccgccatcgcccgtgggtcttccccagcatccgcaaaccgctggagcatatgcatcagcagaccgctaacgccgcgcttatccgtatggggttcggcggtgagctggttgcccatggtatgcgcagcattgccagaacggcgggagcaggtcatttcccccgtgaagtcctggagtctgcgctggcgcaccagaaagaagacgagatcgaagcggcctataaccgcagcgactacctggaacaaaggcggccgctcatgcagtggtggggaaactacgttgatgccgccagacggcaggcgctgctcggtgcagaagaaccgctgcggatcgtggaaggagaataatgtgaccagtcccattcgtcagaatctgtttgaacgggaatgtgatatgccgctgctggaagcgcggcatctcgcccttctgcttctcggcctcgatgcttcccaaccggcaaacgccctgccggaagaacatcaggaaaattaccgtatcctgcacgacgccatcagccgcaccatcaaagctacaggcatggtcagcgccccggctaataaacgcatgttctatgccgatgagatgttcgccctggcatggcgatttattgatgacgaacttacgccgccagaaattaaggcccgcagcctgaaggcggtgatgaaactgtcgtgtaacagccgtggccgcaagtggctgaagacgctcggtgacgacgctctaccggatctcactgcttcagcacaaccttcccagcgtgggatgcataaacgcgacaaggcacgggagaatactgcccgactctgctggctactggttcagctcctggttgaggagactgacggacggtatggcacgtctgataaaccggcttcggatcggatacttcgtaagctgaaaacactgctgcaggagcgggaattgccgtcagacgggcttgggcgagggaccttttatgaggtgttaaagatggggcgggaaaagggaacgtag

SEQ ID NO: 4582 - DNA, 1254 bp, Klebsiella pneumoniae
cgcttacgcatataccgggaagcgggcgcagatatccagcactttacctttcacgcgctcaatgaccgcgtcgtcattgatattgtccagcacgtcacacatccagccagccagctctttgacttccgcttctttaaagccgcggcgagtcactgccggagaaccgatacggataccggaggttacgaacgggctcttcggatcgttcggcacgctgtttttgttgacggtgatgttggcgcggcccagagcggcgtcagcttctttaccggtcaggtttttatccaccagatccagcaggaacaggtggttctcagtaccgccagacaccactttgtagccgcggttcaggaacacttccaccatcgctttagcgtttttcgcaacctgctgctggtaaactttaaactctggctccatcgcttctttcagcgccaccgctttcgccgcgataacgtgcatcagcgggccgccctgcgcgcttgggaataccgcagagttcagttttttgtacagctcttcgctaccgcctttcgccagaatcaggccgccgcgcggacccgccagggttttgtgggtggtggtggtcacaacgtgagcatgcggaaccgggttcgggtacacgccagcggcaatcaggcctgccacgtgcgccatatcgacgaacaggtaagcgccgatgctgtcagcgatttcacgcattttcgcccagtcaacgataccggagtaagcggagaaaccaccgatgatcatcttcggtttgtgttcctgagcctgcttcgccatgtcgtcatagtcaattttaccggactcatcgataccgtaagggatgatattgtacagtttgccggagaagttaaccggggagccgtgagtcaggtggccgccctgcgccaggttcataccgagcacggtgtcgcccggctgcagcagcgcggtgtagacggcaaagttagcctgggagccggagtgcggctggacgttagcatagtcagcgccgaacagttctttcgcgcggtcgattgccagctgttcaaccacgtcgacgtattcacagccgccgtagtaacgcttgcccggatacccttcagcatatttgttggtcagctgagagccctgcgcctgcataacgcgcggactggtgtagttttcggaggcgatcagttcgatgtgctcttcctgacgtactttttcctgctccatagcctgccacagttcggcatcataatcggcaatgttcatttcacgctttaa

SEQ ID NO: 4583 - DNA, 447 bp, Klebsiella pneumoniae
ggagttggcatggcgaacatgtttgccctgatcctggtgattgcaaccctggtgacgggcgttttatggtgcctggacaagttcatttttgcaccgaaacgtcgtgaacgtcaggccgctgctcaggcagcgaccggcgagcaactggacaagaagacgctgaagaaagtcggcccgaaaccgggctggctggaaaccggcgcatcggttttcccggtgctggcgatcgttatggtggtacgttcatttatttatgagcctttccagatcccttcaggttcgatgatgccaacgctgctcatcggcgattttattctggtggagaaatttgcctacggcattaaagatcctatctaccagaaaacgctgatcgagaccggccatccgaagcgcggcgacatcgtggtgtttaaatatccgggaagacccgggtctggaaaacattaa

SEQ ID NO: 4584 - DNA, 2622 bp, Klebsiella pneumoniae
cctcatttaatctccagtagcaaatttgacctgtttatgggaggagttatgcgtctggatcgtcttaccaataaattccagcttgctcttgccgatgcccagtcgctcgcactcgggcacgacaaccaattcatcgaacctcttcatttaatgagcgccttgctgaatcaggaagggggatcggtacgtcctttattaacctcggcgggcgtgaatgccgggaaactgcgcactgacatcgaacaggccttgagccgtttaccgcaggtggaaggcaccggcggcgatgtgcaaccttctcaggatttagtgcggatcctcaacctttgcgacaagctggcgcaaaagaaaaaggacaactttatttcgtcggaactgttcgttctggcggcgcttgaatcacgcggtacgctgaccgaccttttaaaatccgccggagcaacaaccgccaacgtgactcaggcgattgaacaaatgcgcggaggggaaagcgtgaacgatcagggtgccgaagaccaacgtcaggcattgaagaaatttaccgtcgatctcaccgagcgtgccgagcagggcaagctggatccggtgatcggccgtgatgaagagattcgccgtaccattcaggtactgcagcgtcgtaccaaaaacaacccggtgctgatcggtgaacccggggtgggtaaaacggcaatcgtcgaaggcctggcgcagcgtatcgtcaacggcgaagtaccagaagggctgaaaggccgtcgggtattggcgctggatatgggggcgctggtggccggggcgaaataccgcggtgagtttgaagagcgtctgaaaggcgtgctgaccgacctgtcaaaacaggaaggtaacgtcattctgtttatcgacgaactgcataccatggttggcgctggtaaagccgacggcgcgatggatgcgggtaacatgctgaagccggcgctggcgcgtggtgaactgcactgcgtcggggcgacgacgcttgatgaataccgtcagtacatcgaaaaagacgccgcgctggaacgtcgcttccagaaagtgttcgttgccgagccttcggtagaagataccatcgcgattctgcgcggtctgaaagaacgttatgagctgcaccaccacgtgcagatcactgacccggctatcgtggcggcggcgaccttatcgcatcgctatattgccgaccgtcagctgccggataaagccatcgacctcatcgatgaggcggcatccagcatccgtatgcagattgactccaaaccggaagagctggaccgtctcgatcggcgtattatccagctgaaactggaacagcaggcgctgaagaaagagtctgatgaggcgagcctgaagcgtctcgatatgctcaacgaggagctggcggataaagaacggcagtactcggtgctggaagaagagtggaaagcggaaaaagcgtcgctctccggcacccagaccatcaaagctgagctggagcaggcgaaaatcgccatcgaacaggcgcgccgcgtcggcgatctggcgcggatgtccgagctgcagtacggcaaaattccggaactggagaaacagctggcggctgccactcagtccgaagggaaaaccatgcgtctgctgcgtaataaagtgacggatgctgaaatcgccgaagtgctggctcgctggaccggtatcccggtctcccgcatgatggaaagcgagcgtgacaaactgctgcgtatggagcaggagctgcatcatcgggtgattggccaggatgaggcggttgaagcggtatccaacgccattcgccgcagccgcgccgggctgtccgatccgaaccggccgattggttcgttcctgttcctcggtccaaccggggtcggtaaaaccgagctgtgtaaaacgctggctaactttatgttcgatagcgacgacgcgatggtgcgtatcgatatgtccgagtttatggagaaacattccgtctcgcgtctggtcggtgcgcctccgggatacgtcggctatgaagagggcggttacctgaccgaggcggtgcgccgtcgtccttattccgtcatcctgctggatgaagtggaaaaagcgcacccggatgtgttcaacattctgctgcaggtactcgacgacgggcgtctcaccgacgggcaggggagaacggtcgacttccgtaatacggtagtcatcatgacctcgaacctcggttccgatcttattcaggaacggttcggcgagctggactacggacatatgaaggacctggtgctgggggtagtcagccagaacttccgtccggagttcatcaaccgtatcgacgaagtggtggtcttccatccgctgggcgagaaacatattgcctctattgcccagatccagctgcagcgtctgtataaacgtctggaagagcgcggatatgaagtgcagatgtccgatgaggcgctgaagctgctgagcgccaatggttacgatccggtatacggcgcgcggccattgaaacgtgctattcagcagcagattgagaacccgttagcccagcagatcctttccggtgagctggttccgggtaaaaccatcgagctggtagtaaaagacgaccgcattgtggcagtgcagtaa

SEQ ID NO: 4585 - DNA, 444 bp, Klebsiella pneumoniae
ttagaggtaatcatggctattgaacgtactttttccatcatcaaaccaaacgcggtggcaaaaaacgttattggcagcatcttttcccgctttgaagctgcagggttcaaaatcgtcggcaccaaaatgctgcacctgaccgttgaacaggctcgtggtttctatgctgagcacgaaggtcgcccgttcttcgacggtctggttgagttcatgacctccggcccgatcgtggtttccgttctggaaggcgaaaatgcggtacagcgtcaccgtgacctgctgggcgccaccaatccggcaaacgccctggcgggtaccctgcgcgctgactacgctgacagcttcaccgagaacggcacccacggttccgactctgtagaatccgctgcccgcgaaatcgcgttcttctttgctgaaggcgaggtttgcccgcgcactcgctaa

SEQ ID NO: 4586 - DNA, 1629 bp, Klebsiella pneumoniae
acaaagacaatgaatatcactcctgacttctcttgtgatgtgttgattatcggcagcggcgctgccggtctttcccttgccctgcgcctggctgagcacagttcggtgacagtgctgagtaaagggccgatcagcgaaggttcgacgttctacgcccagggtgggattgccgccgtcttcgatgagacggacagtattgaatcccatgtcgaagataccctcatcgccggcgcggggctctgcgatcgtcatgcggtcaccttcgtcgccagcaacgcccgatcatgcgtccagtggcttatcgatcagggagtgctgtttgacacccaggtccaggccaatggcgaagagagctatcatctcacgcgcgaaggggggcacagccatcggcgcattcttcacgccgccgacgccaccggcaaagcggtagagacgacgctggtcgataaagcgcttgcccatcctaatatccgcatccttgagcgcagcaatgccgtcgatttaatcgtatcggataagattggcctgccgggcacccgccgggtggtcggggcatggatctggaatcgtaataaagagcgggtggaaacctgcagcgcgaaagccgtagtactcgctaccggcggggccgcgaaggtttatcaatataccactaaccccgacgtctcttccggagacgggattgcaatggcctggcgggcgggatgtcgggtggcgaatctggagtttaaccagttccaccccaccgcgctatatcacccccaggcgcgaaatttcctgcttactgaagcgctgcgcggcgaaggcgcccaccttaaacgcccggatggcacccgctttatgccggactttgacgagcgcggcgagctggccccgcgcgatatcgtcgcccgcgccatcgaccatgaaatgaagcgcctgggcgtggactgcatgttccttgatatcagccataaacccgaggcgtttgttcgccagcatttcccgatgatttatgaaaagctgctcggcctgggaattgatttaaccaaagatccggtgccggtcgtccccgccgcgcattacacctgcggcggcgtgatggtggatgataatggccgcaccgacgtcgatggtttatacgccatcggcgaagtcagctacaccgggctgcacggcgcgaatcgtatggcgtcgaactcgttgctggagtgcctggtctatggctggtccgccgcggaagatattacccggcgcctgccgctcgcccagaaggtcgccacgctgccagcatgggatgaaagtcaggtggagatcccggatgaactggtggatatccagcacaactggcacgaactgcgcctgctgatgtgggattacgtggggattgtgcgcaccacccgcaggctggagcgcgccctgcggcgcattaccatgctccagcaggaactggatgagtattacgcccgcttccgcgtctcgaataatttgctggaactgcgcaatctggtgcaggtggcggagcttatcgtacgctgcgcgatgttgcgtaaggagagccgcggtctgcattataccctcgactatccgcagccgctgcctgacagcggcccgtcgatactctcgcccctggctcacataaagagataa

SEQ ID NO: 4587 - DNA, 243 bp, Klebsiella pneumoniae
agcgtaaaaattaatatcaaaagtgttgctagtagtggttccgtcaatatttccaactacgacacctttattcgcctttccaggaacaccggcctgatattcaatatcaaggtgagtacccataaacgagtttgtgctcgttgctccttctgccgcattacgatgtataagtacaccattacagcaaccgcgtatggtagcttttatcctactcttctcagtataaccagtatcgttatatag

SEQ ID NO: 4588 - DNA, 768 bp, Klebsiella pneumoniae
catgcacgaataatctttagccgaagaaccataatgctgcaaaatattcgaatcgtactggtagaaacctcccataccggcaacatgggctccgtagcccgcgcgatgaaaaccatgggcttaactaacctgtggctggtcaatccgctggtcaaacctgattcgcaggcgatagccctggccgcgggcgccagcgacgtgatcggcaacgcgcagattgtcgatacccttgatgaagcgctggcaggctgtagcctggtggttggcaccagcgcgcgctcccgcacgttgcggtggcggatgttagacccgcgcgaatgcggtctgaaaagcgtcgccgaaggtcagcatgcgccggtggcgttggtctttggccgcgagcgcgttgttctgaccaacgatgaactgcagaagtgccactatcacgtggcgatcgccgccaacccggagtacagctcgctgaacctggcgatggcggtgcaggttatcgcctatgaagtgcggatggcctggctggcggcgcaggagcaagcgcagccggcggttgagcatgaagaggcgccgtacccgctggtggacgatctggagcgattctacgaccatcttgagcagacgctgctggcgaccggctttatccgcccgaatcatccggggcaggtgatgaacaagctgcgtcgtctgttcacccgcgcgcgtccggaaagccaggagttgaacatcctgcgcggcatgctggcgtctattgagcagcagaataaaggtaagtaa

SEQ ID NO: 4589 - DNA, 183 bp, Klebsiella pneumoniae; identical to SEQ ID NO: 1431

SEQ ID NO: 4590 - DNA, 213 bp, Klebsiella pneumoniae
cgtcaatcgatgaggttattaaccttaacgccttcctccccgctgaaagtgctttacaacccgaaggccttcttcacacacgcggcatggctgcatcaggcttgcgcccattgtgcaatattccccactgctgcctcccgtaggagtctggaccgtgtctcagttccagtgtggctggtcatcctctcagaccagctagggatcgtcgcctag

SEQ ID NO: 4591 - DNA, 813 bp, Klebsiella pneumoniae
gagagaccgatgcatccgatgctgaacatcgccgtgcgcgccgcgcgcaaggcgggtaatttaattgccaaacactacgaaacgccagacaccgtagaaaccagccagaaaggcagcaatgattttgtgaccaacgtcgataaagccgccgaagcgattattatcgaaaccattcgcaaatcttacccgcagcacaccattatcaccgaagaaagcggtgaacacgctggcgaagagcaggatgttcaatgggttatcgatccactggatggcaccaccaacttcgttaaacgtctgccgcacttctctgtttccatcgccgtacgcatcaaaggtcgtactgaagtcgcggtggtctacgatccgatgcgtaacgaactgtttaccgcgacccgcggccagggcgcgcagctgaacggctaccgtctgcgcggcagcaacgctcgcgacctcgacggcaccattatcgcgaccggcttcccgttcaaagcgaagcagcacgccaccacctacatgaatattctcggcaacatgtttaccgaatgtgccgacttccgtcgcaccggctctgccgcgctggatctggcctatgtggccgccggccgcgttgacggttactttgagatcgccctgaaaccatgggatttcgccgcaggcgagctgatcgcccgtgaagctggcgcgattgtctgcgacttcaccggcggtcataactatatgctgacgggcaacatcgttgccggtaacccgcgcgtggtgaaagcgatgctggcgaacatgcgcgagcagctgagcgacgcgctgaagcgttaa

SEQ ID NO: 4592 - DNA, 1341 bp, Klebsiella pneumoniae
tccatgacgatccgtaaaccggcgcgtttactgctggtggatgacgatccgggactgttgaagctactgggcatgcgcctggtcagcgaaggctacagcgtggtcaccgccgagagcgggccggaagcgctgcgcgtgctggggcgtgagaaagtggatctggtgattagcgatctgcggatggatgaaatggacggcctgcagctgtttagcgagatccagaagggccaccccggcatgccggtgatcattctcaccgctcacggttcgattcccgacgccgtggcggctacccagcagggggtgttcagcttcctgaccaagccggtcgataaagatgccttatataaagccattgatgaggcgctggagcagcgctcgccggccaccgacgaagcctggcgccaggcgattgtaacccgcagcccgctgatgctgcgcctgcttgagcaggccgggatggtggcgcaatcggatgtcagcgtactgattaatggccagagcgggaccgggaaggagatcgtcgcccaggcgatccacaacgccagcccgcgtcatgataagccgttcgtggcgatcaactgcggcgcgctgccggaacagctgctcgaatccgaactgtttggccatgcgcggggcgcttttaccggcgcggtcagtaaccgtgaaggattattccaggccgctgagggtggtacgctgtttctcgacgagatcggtgatatgccggttgcgttgcaggtgaagctgctgcgcgtcctgcaggagcgcaaggtgcgcccgctgggcagcaaccgcgatatcgaaatcaacgtgcggattatctccgccacccaccgcgacctgccgaaggcgatggcccgcggcgagtttcgtgaagacctgttctaccgcctcaacgtagtgaacctgaaaataccgccgctctccgaacgtacggaagacatcccgctgttggccaaccatctgctgcgtcagtccgccgatcgccataagccgttcgtgcgggcgttttccagcgatgcgatgaagcggctgatggccgccaagtggccgggcaacgtacgccagctggtgaacgtgatcgagcagtgcgtggccctgacttcgtcgccagtgatcggcgacgcgctggttgagcaagcgctggagggcgagaacacggcgctgccgaccttcgtggaggcgcgcaatcagtttgagctgaactacctgcgcaagctgctgcaaattaccaagggcaacgtcactcacgccgcgcgaatggcagggcgcaaccgcaccgaattctataagctgctgtcgcgccatgagctcgacgccaacgactttaaagagtag

SEQ ID NO: 4593 - DNA, 723 bp, Klebsiella pneumoniae
gctatagcgatgacccttttgcaggagagcaagatgaccacccctttaacctggcatgacgtgctggcggatgaaaagcaacaaccctattttctcaatactctgaagaccgtcgccgaagagcgccagtcggggatcaccatctatccaccgcaaaaagacgtcttcaatgcgtttcgctttactgaactgggcgatgtcaaagtcgtcattctcggccaggacccctatcacggcccgggtcaggcccacggtctggcgttctcagttcgtccgggcgtcgcgatcccgccttcgttgctgaatatgtataaagagctggaggccacgatccccggctttacccgccccacccacggttatctcgaaagctgggcacgacagggcgtgctgctgctgaatacggtcctgaccgtccgcgccggacaggcgcactcgcacgccagtctgggctgggagacctttaccgataaggttatcgctttaatcaatgagcattgcgagggagtagtttttctgctgtggggctcccatgcgcagaagaaaggcgcgattatcgatcgtcagcgccactgcgtgctgaaggcgccgcatccatcaccgctctctgcgcatcgcggcttctttggctgcaaccatttcgtacagaccaaccagtggctggttgaccgcggcgaaacgccgatcgactggatgccggtccttcccgctgaaagcgagtga

SEQ ID NO: 4594 - DNA, 354 bp, Klebsiella pneumoniae
gtcttgaagatgggtttagctaagaaagggataatcttggtgtgtttaatcgggtggattgtagctgtgatcggtaaaagacttaagatttcaagggttaatgcaggcctgacacagacggagttgggggtacgagctggtcttgaggaagattctgcaagtgctcgcataagttcttatgaaaaagaagttcatgcgccggactttaagttggtctgtaaatttgcagcagtacttgatgtgcctgaggcttatttttacacagtagatgaagacctttctgaattaatactacaatatcatagatataaaaagagtaatcctaactctaccattataatatcctttcaatga

SEQ ID NO: 4595 - DNA, 357 bp, Klebsiella pneumoniae
tttgcggagatgtccatgtcaaaaatagttgctctgaacgcggatgaagaacaaggcaaaaagccttctattcgccagcgccggctgctaactagagctggcttgcgtaaggctaggagaatgactcatctcgatgcgctggctgaaaagcttggctatcagattgtgcgcggaacatacgttgcttttcgccatacagttaccgttgagagcataagaaagcttcctcatgccgaggtaaatcttgtgccgcgcgtgaaaaaaatgacgtttaccgaagcatgtaacatttcccgggaactatctgattctcgggaagagcgcctgatgagtgccagctttgatgggccagaataa

SEQ ID NO: 4596 - DNA, 747 bp, Klebsiella pneumoniae
ttaacgaggattgtcatggctgaattattgttaggggtcaatattgaccatatcgcgaccttgcgtaacgcccgcggcaccgcttacccggatccggttcaggcggctttcattgccgaacaggccggcgccgacggcattaccgtgcatctgcgcgaagaccgtcgccatatcaccgatcgcgatgtgcgtatcctgcgccagacgctgcacacccgcatgaatcttgaaatggcggtcaccgaagagatgctgacgatcgcctgcgaaaccaaaccgcacttctgctgcctggtgccggagaagcgtcaggaagtgaccaccgaaggcgggctggacgtcgccggccagcgcgacaagatgcgcgatgcctgtcaacgcctggcggatgccggcatcctggtctccctgtttatcgatgcggatgaagcgcagatcaaagcggcggcggacgttggcgcgccctatatcgaaatccacaccggctgctatgccgatgccaaaaccgacgccgagcaggccagggagctggaacgtattgccaaagcggccacctacgccgccagcctcgggctgaaggtgaatgccggccacggtctgacctaccacaacgtgaaagcgattgctgcgctgccggaaatgcatgagctgaatatcggtcacgcgattattggccgtgcggtgatgagcggcctgaaagaggcggtggcggaaatgaagcgtctgatgctggaagcgcgcggctaa

SEQ ID NO: 4597 - DNA, 1152 bp, Klebsiella pneumoniae
attctttactttgtgtggtatcgttacgtcatgccctctgaggcaacccttatcgcaaacgagctacacaggatcgcaatcatgcaaaaagacgcgctgaacaacgtacatattaccgacgaacatgtattaatgaccccggagcaactgaaggcggaattcccgctgagcgtcgagcaggaagcgcagatcgcgcacgcccgtcagaccatttcggatatcatcgccggtcgcgatccgcgcctgctggtggtatgtggtccttgctccattcacgatccggaagctgcgattgaatatgctcgtcggtttaaagcccttgccgcagaggtcagcgatagcctctacctggtgatgcgcgtctattttgaaaaaccccgtaccaccgtcggatggaaggggctgattaacgatccgcacatggatggttcgtttgatgttgaaggcggcctgaagattgcgcgtcgtctgctggtcgagctcgtcaatatgggactgccgctggcgacggaagcgctggatcccaacagcccgcagtaccttggggatctgttcagctggtccgctatcggcgcgcgtaccacggaatcacaaacgcaccgcgaaatggcctctggcctgtcgatgccggtcggctttaaaaacggtaccgacggtagcctggccacggccatcaacgccatgcgcgccgcggcgatgccgcaccgtttcgtcggcatcaatcaggccgggcaggtctgcctgctgcaaacgcagggtaatccgaacggccatgtgatcctccgcggcggcaaggcgccgaactacggtccggaagatgtggcgaaatgcgaaaaagagatggcgcaggcgggactgaagccgtcgctgatggtagattgcagtcatgggaactccaataaagatttccgccgccagccggccgtggctgaatccgtggtcgcgcagatcaaagatggcaaccgctccattatcggcctgatgatcgaaagtaatatccacgaaggcaatcagtcctctgaacagccgcgtgaggcgatgaaatacggcgtctcggtgacggatgcctgcatcagctgggagactaccgaggcgctgctgcgtgaactggataaggatctccgcggccacctggcggcccgtttggtttaa

SEQ ID NO: 4598 - DNA, 273 bp, Klebsiella pneumoniae
gtttgtactgtggaaacgcaacaacaagccttcctgcagccacatcatccgcaatctgagatcaaaagcgcttatgacaacgcaaaacgagcactgtcgggcggactggtgaaaatcaaagaacagacgaacaaagaggcccgaaaagcttcaggtggaggtagatcgcctcaaggccgagctagaggcctacaagggaaaggaagaacaatggctacgccgctggcagcaaatcgcctttcatgtgcggcagaaaggcatacagatggctag

SEQ ID NO: 4599 - DNA, 1329 bp, Klebsiella pneumoniae
aacatgactgtaacgactttttccgaacttgaactcgacgaaaacctgctggaggccctccaggataaaggtttcactcgcccgacagccattcaggccgccgctattccgcctgcgctcgatggccgtgacattctcggttcagcgccgaccggcaccggtaaaacggcggcgtatctgctgccagcgttgcagcacctgctcgatttcccgcgtaagaaatccggcccgccgcgcattcttatcctgacgccgacccgtgagctggcgatgcaggtggccgaccacgcccgcgagctggcgaagcatacccatctggacattgctaccattaccggcggcgtggcgtacatgaaccacgcggaagtgttcagcgaaaaccaggacatcgtagtcgccaccaccggtcgcctgctgcaatatattaaagaagagaatttcgactgccgcgccgtcgagaccctaatcctcgatgaagccgaccgcatgctggatatgggttttgcccaggatatcgaaaccatcgccggtgaaactcgctggcgcaagcagactatgctgttctccgcgacgctggaaggcgatgcgatcaaagacttcgctgagcgtctgctggaggagccggttgaagtttccgccaatccgtcaacccgcgagcgtaagaaaatccatcagtggtactaccgcgccgacgatatcgaacataaaaccaaactgctggtgaatctgctgcaacagccggaagccacccgtgctatcgtgtttgaacgtaagcgtgagcgcgtgcatgagctggctaactggctgcgtgaggccgggattaacacctgctggctggaaggcgagatggtgcaggccaagcgaaacgaagctattaagcgcctgaccgacggccgcgtcaacgtgctgatcgccaccgacgtcgctgcccgcggtatcgatattccggacgtcagccacgtctttaacttcgatatgccgcgtaccgcggatacctacctgcaccgtatcggtcgtaccggccgcgccggtaaaaaagggaccgccatttctgtggtcgaggctcatgaccacctgctgctgggtaagattggtcgctatattgaagagccgttgaaagccagggttatcgatgaactccgcccgacgacccgtgcgccgagcgagaagctgacgggtaagccatcgaagaaagtgctggcgaagcgtgcgcagaagaaaaaagatgaaaaagagaaaccgcgggtgaagaagcgccaccgcgatacgaaaaatatcggtaagcgccggaagccaagcgcggccgggacgccgtccagcgatgagtaa

SEQ ID NO: 4600 - DNA, 243 bp, Klebsiella pneumoniae
tgcggcaatgtacgcttctgtgttattgccatcgctggccggcgcccaacgattaacgatctcgctaactgtgtcgtaaccctgccgctggtacgaaagcaggtttttacccagcgcacgaataccatgctcaggggtcacgaatttcgcaaaacgcccatcactacccgcctggccatcccacgaattggaaccggcttcgatattccctggattattattccgcagccctctggcggctga

SEQ ID NO: 4601 - DNA, 471 bp, Klebsiella pneumoniae; identical to SEQ ID NO: 1445

SEQ ID NO: 4602 - DNA, 609 bp, Klebsiella pneumoniae
caagaaggtgtcagcatgagtggaaaatacaccctgatctatgcggatccgccttgggcataccgcgacaaggcagccgacggtgaccgcggagccggtttcaagtatccagtgatgaatgttctggatatctgccggctgccagtatgggagctcgccgccgaagattgccttctggcgatgtggtgggtaccgactcagccggtagaggcgctgaaagtcatggaggcctggggattccgcctgatgaccatgaagggattcacctggcacaagacgaacaagcataaagggaacagtgcgatcggcatgggacatatgacccgggcgaacagcgaagactgcctgtttgcggtgcgtggtaaactaccggcccgcattgacgcctcgatctgccagcacgtcacggcgccgcgcctggagaactcgcgcaaaccggacgttatccgcgagaaactggtgcagctgcttggcgatgtcccgcgtattgagctctttgcccgccagtcgtctcacggtttcgacgtgtggggtaaccagtgcacggcgcctgcggttgagttgctgccaggctgcgcggtgccggtagtgaagacggaggccgcatga

SEQ ID NO: 4603 - DNA, 1122 bp, Klebsiella pneumoniae
tctgcgcgcttcgcgcagcgcaggtggagaaaattgatgagcgacgaactgaaaaataaaagcggcaaggtcaaagtgatgtatgtccgcagtgatgatgattctgacaaacgcacccataacccacgtaccgggaaagggggaggtcgtccaggaaaatctcgtgttgacggccgcagccgccctgcgcgtgacgaacgaaacagccgcggcgacgatcgcaaacgtgacgaccgtaagcgtgacgagcgcaaacgcgatgattttcatcgcgacgatgcgtctccgtggcgtaccgtttcccgcgctcctggcgatgagacgccggtaaaagaagatcacggcgggatcagcgggaagagctttatcgatccggaagtgctgcgtcgtcagcgtgcggaagagacccgcgtatatggcgaaaacgcctgccaggcgctgttccagagccgtccggaagctatcgttcgcgcctggtttattcagagcgtgacgccgcgctttaaagaggcgctgcgctggatggcggccaaccgtaaggcctatcacgtggtggacgaaaccgatctggcgaaagccttcggcaccgagcaccacggcggcgtctgctttctgatcaaaaaacgccacggcacttctgttgctcaatgggtcgcgaaggccggggaagaagattgcgttctggcgctggaagatgtgggtaacccacataatctcggggcgatcatgcgcagctgcgcgcactttggcgtgaagggcgtggtggttcaggatgctggcgtgctggagtccggggcggcgatccgtacggcggagggcggtgcggagcatgttgaaccgatcactggcgacagctttatcgataccctcgatcagttccgcaaagcgggctacgcgattgtctcaacgtccagccataatggtaccccgctgtttaaagccgagctgccgaagaaaatggtgctggcgttaggccaggaacgtgatggtctgtccgatgcggcgatttccagcgccgatctcagcgttgccatcgagggtaccggcaacgttgaaagcctgaacgtctctgtggcgaccggcgtcctgctggcggaatggtggcgtcagaacaaggcgtga

SEQ ID NO: 4604 - DNA, 1041 bp, Klebsiella pneumoniae
gcagcttcagtttggccaggcccagactcagcaggccgcagtccaggtaccgggctatcaaactttaggaacacaatcgcagtaatgaagcaactttggtgtgccatgtcgctcatggcaggcagcctgttgttctctgtcaacgcctcggctgatacatcgtccggggcgttgttgcagcagatgaacctggccagccagtctctcaattatgagctgtcttttgttagcatcagcaaacaaggcgttgagtcgctgcgctatcgtcacgcgcgactgaacaaccaaccgctggcgcagttgctgcagctggacggtccgcgccgggaagtggtcctgcgcggcacggaaatcagctattttgaacccggtctcgatccgttcaccctgaacggggactatatcgtcgattcgctgccatcgctggtatatagcgatttcaaacgcctctccgcggcgtatgattttatctccgtgggccgtacccgtatcgctgaccgcctctgcgacgtgatccgcgtcgtggctcgcgacggcacgcgctacagctttatcgcctggctggatgctgaaaccaagctgccgctgcgcgtcgatttgctcgaccgcgacggggaaacgctggagcagttccgggtcgtctccttcaacgttggcgataacgtcagcgccagcatggagacgctggcaaaagcgaatttgccgccgcagctgtcggtgcctgaaggaggcgacaaagctaacttcaactgggcgccgacgtggctcccgcagggcgtgactgaggtttccagcagccagcgccgtcttcccacctttgacggtccggtagaatcacgtctctattccgacggcttgttcagcttctcgatcaatatcaaccgcgccacggcggccagcagcgaccagctgttgcgcaccggccgacgcaccgtcagcacgacggtgcgcgataacgcggagataaccgtagtgggcgagctgccgccgcagacggcgaagcgtatctctgacagtattaaattcaaggcagtacaatga

SEQ ID NO: 4605 - DNA, 291 bp, Klebsiella pneumoniae
tggacgcaagttcaggatatttctacctataaatgcatctgcaaacagcattttgcattattcagtaaaactcgaggtggtttaatgcatgacttaatctgcacatctgtaacaggaattgcctccagttacttcgtcgttggtgagacttacagcgcagacgaagagtggaggcttacaactccgaatcctgatggaagcctggctttatggactgttgaggggaatatgatatatggaattgttggcgatcatgactctgaggttttagcaaaattcgaaggtttatag

SEQ ID NO: 4606 - DNA, 1122 bp, Klebsiella pneumoniae
ggagagcgagtcggtagtggatttgcggtatcaggagtaaactactcaggttctaccttagcgttgaagtatttaactatgcgtcagcgccccgaactttctgcattaaaaaccaaaggactgaatatggtcactacagtagtagctgcctttaacgaatttatgaaagatactgtgaatctcagaaaggcagataccgatgacgcgcgtgcaagtcgcgactggcttatcggtaagattaatgattttgagaaggacaatgcatttccggtgagttatcccgcgatccatattgcctttggatcgtttgccagaagaactaaaatccgtcctctggatgatatcgatctgatgtttggcttatctgcgcagggggccacctataacattctgagtgaccgaatcacactgacctcttccggagagggatcgcggctgcacgggtatcgacactcgggagctgatactatctgctccgtcagaattctgaatgcctttaaaagccacctgcaggatattgcccagtatgcccaagctgatatcaggcgtaaccaggaagccgtcacactgaagctgatcagcaaggactggaattttgacatcgtgccctgcttcatgaccagcgaagacgtttttggacggactaactacctgatccccgacggcaatggacactggaagtttaccgatccccgcaaagacagggacagagtaacaactatcaatgtgcagaatgacggcaatgtgctcaatgtcatcagagctgtcaagtactggcagcggcgaccaacgatgccctccatgagctcctacctgctggagacgctgattctggactattacgccagcaggacatcctgttcatcgtttgtcgatatagagctagaggcgcttttccgccatcttggtctattcgtgcagttctccgtcaacgatcccaaaggtatacagggagatatcaactctctttcagccgaggcacgccaggcgatttcggacagatgttatctcgatgcgcagaaggcttcggaggcgagatggtttgaaaagggtaaagagtatgaaaaatccatcaacaaatggcgcgacctgttcgggcccttctttccgatttacgggtaa

SEQ ID NO: 4607 - DNA, 1533 bp, Klebsiella pneumoniae
atgcaatcggttacgctctgtataatgccacggcaatatttatccaccctggtcgagatattgcccatgctacgtatcgctaaagaagccctgacgtttgacgacgtcctcctcgttcccgctcattctaccgttctgccgaatactgccgatctcagcactcagctgacgaaaaccattcgtctgaatattcctatgctctccgcagccatggataccgtaacggaagcgcgtctggctattgccctggcacaggaaggcggcatcggctttattcacaaaaacatgtccatcgagcgccaggcggaagaagttcgtcgcgtgaagaaacatgagtccggcgtggtcaccgacccgcagactgttctgccgacgaccactctgcgtgaagtgaaagagctgaccgagcgcaacggtttcgccggctacccggtggttaccgaagaaaacgagctggttggcatcatcaccggccgcgacgtgcgtttcgtcaccgatctgaaccagccggtcagcgtctacatgacgccgaaagagcgtctggtcaccgttcgtgaaggcgaaagccgtgaagtggtcttcgctaagatgcacgaaaaacgcgttgagaaagcgctggtcgtggatgagagcttccacctgcgcggcatgatcaccgtcaaagacttccagaaagcagaacgtaaaccgaacgcctgtaaagatgagcagggccgtctgcgcgtaggcgcggcggtcggcgctggtgccggcaacgaagagcgcgtagacgcgttggtagcggcaggcgttgacgttctgctgatcgactcctcgcacggtcactcagaaggcgttctgcagcgtatccgtgaaacgcgcgcgaaatatcctgacctgcagatcatcggcggcaacgttgccactggcgcaggcgcacgcgcgctggcggaagccggctgcagcgcggtgaaagtgggcatcggcccgggctccatctgtactacccgtatcgtcaccggcgtgggtgtgccgcagatcactgctgtttccgacgcggtggaagcgctggaagggaccggtattccggttatcgctgacggcggtatccgtttctccggcgatatcgccaaagcgatcgccgccggtgcggcggcggtgatggttggctccatgctggcgggtaccgaagagtccccgggtgaaatcgaactctatcagggtcgctcttacaaatcctaccgcgggatgggctcccttggcgcgatgtccaaaggctcctctgatcgctatttccagagcgataacgccgctgacaaactggtgccggaaggtatcgaaggccgcgtggcctataaaggccgcctgaaagagatcattcaccagcagatgggcggtctgcgttcctgtatgggtctgaccggctgtggtaccattgatctgctgcgtaccaaagctgaattcgtacgcatcagcggtgcgggcattcaggaaagccacgttcacgacgtgaccatcaccaaagagtccccgaactaccgtctgggctcctga

SEQ ID NO: 4608 - DNA, 567 bp, Klebsiella pneumoniae
tctgtcacggtggtcatgatgagcaagcaacacaccgcgcaagcacctgttgatccgatcgtattggggaaaatgggttcttcctacggtatccgtggttggctcagagtgttttcctccaccgaagacgccgaaagcatttttgactatcagccctggttaatccagaaggcgggtcagtggcaggtcgttgagctggaaagctggcgccaccacaatcaggacatcatcatcaagctgaaaggcgttgacgatcgtgatgccgcgaatctactgactaattgcgaaattatcgtggattcatcgcagttgccggagctggaagagggtgactactactggaaagacctgatgggctgccaggtagttacgacggaaggctatagcctcggtaaagtcatcgatatgatggaaaccgggtcgaatgacgtgctcgtcatcaaggcaaacctgaaagatgcatttggtatcaaggagcggttggttccgttcctcgatgggcaggttatcaagaaagtcgatctcactacgcgtactatcgaagtagattgggatcctggtttttaa

SEQ ID NO: 4609 - DNA, 279 bp, Klebsiella pneumoniae
cataagaaggtgaatgagccactggttaatattatgcatgaactatgccagctctcaaaacattttattaacatactgatatatatgacattaaccgcaagaacagtcgaactacctctgtttatttttcacccgcgttgtcgctatttagcgacaccaaataggctaccgattactcatcatttaaatcaatggcttaagtgtcgcctattgacgacactgcaatatcgcagttgtcggcaattcccgacaccctggcgtgccgaccatcacagataa

SEQ ID NO: 4610 - DNA, 201 bp, Klebsiella pneumoniae
ggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtagcattctgatctacgattactag

SEQ ID NO: 4611 - DNA, 477 bp, Klebsiella pneumoniae
atgatattatttgcactgtgtttaaatgtggaacctgctatgcctcagattagccgtactgcgctggtgcctttcagcgcggaacagatgtatcaactggtaaacgatgtgaagtcctatcctgattttctgccaggctgcaccggtagccgcgtgctggaattggggccgacgcaaatgacggcggcggttgatgtgtccaaagccggcatcagtaagaccttcaccacacgcaatacactgaccagcaaccagagcattttgatgagcctggtggatggcccgttcaagaagctgattggcggctggaagtttattccgctgagccccgaggcctgcaaaatagaattccatctcgatttcgagtttaccaataaactgattgagatggcttttggccggatcttcaaagagctggccgctaacatggtgcaggcgttcacttcgcgcgccaaagaggtttacagtgccggctaa

SEQ ID NO: 4612 - DNA, 2325 bp, Klebsiella pneumoniae
atgcgcgtattgcctcgggtaaaacgccgctggcgctggctggcggcgtttatttttctgctgtggctggcggtgctggcggccgatcgcctgtggccgctgccgctgcatgacgtcacgcctgcccgtgtggtggtggcggaagacgggacgccgctgtggcggtttgccgacgcgcagggcgtctggcgttatccggtcacgctcgccgacgtgtcgccgcgctatctgcaggcgctcatccagtatgaagaccgctggttctggcgccatccgggggtcaatcccttcgcggtgctgcgcgccgcctggcaggatcttacttccgggcgagttatctcgggcggcagcacgcttaccatgcaggtggcacgcctgcttgatccccatccacgcaccttcggcggcaagctgcgccagctgtggcgagcgctgcagctggagtggcatctgtcaaaaagcgacattctaaccctctatttgaaccgcgcgccgtttggcggcaccctgcaggggatcggcgcggccagctgggcctatctcggtaagccgcctgccagtcttagctacggcgaggcggcgctgctggcggtacttccccaggcgcccagtcgtttacgtccggaccgctggccgcagcgggcccaggcggcgcgtgataaagtgcttacgcgaatggtcagccagggcgtctggccggagcaggcggtaaaggaagcgatggaggagccagtatggctgtttccgcgccagatgccgcagctggcgccgcttttttcacgccgggcgctggcgaccagtcgtgatgaaaaggtggtgacgactctggatgccggactgcagcggcaactggaagatctggcgctgaactggaaatcgcgcctgccgccgcgcagttcgctggcgatgattgtcgtcgaccacacggatatgaaagttcgcggctgggtgggctcggcggatatcaccgacgacagccgcttcggccatattgatatggtctcggcggtacgctcgccggggtcggtgctgaaaccctttatctacgcgatggcgatggatgaggggctgattcacccggcatcgctattacaggatgtgccacggcgttttagcgattatcgccccggtaatttcgacagcgggtttcatggcccggtgagcgccagcgaggctctggtgcgttcgttgaatctgccggcggtgcaggtgctcgaagcctatggaccaaaacgctttgcggctaatttacgcaacgccgggctgcccctgacgctgcccgctggcgcagagccgaatctgtcgctaatcctcggcggcgccggggcgcggctggaagatattgtcgcggcgtacagcgccttcgcccgccatggcaaggcggcgcggctgcgcctgaagccgagcgatccattgaccgagcgcgcgctgatgtcgcccggggcggcatggatcgtccggcgtattttggccggcgaagcgcaaccggttcccgatgcctcgctgccgcaggcggtgccgctggcgtggaaaaccggcaccagctacggctatcgcgacgcgtgggcggtcggcctcaatgcgcgatatctgataggcatctggaccgggcgcccggacggtacgccggtggtgggccagtttggcttcgccagcgccgtgccgctgctcaaccaggtcaataatctgctgctggcccgcccggcgatgagccgcggcgggctgccgagcgatccgcgcccggcaacggtcagccaggggacaatctgctggcctggcgggcaggatctgccggcgggcgacagaaactgtcgtcgtcgcctggccagctggcttttggatgccagccagccgccgaccctgctgctgccggggcaggagagcgtacgcgggatccgcttcccggtgtggcgcaatgaacacggcgaacgggtggcggcggattgtcccggcgctcgggaaagccaggtcgaagtctggccgctgccgctggatccctggctgccggccagcgaaaggcggcgcgcgcgcctgggaccggcatcggagtcatgcccgccgttacagactcaggataccgcgccgctggtgctgtccggcatccgtgatggggcagtgataaaacgtctcccgggtgaggcgcgggtgatgttgccgctacaaaccagcggtggggaggggcggtgctggtggtttattaatggcgaaccgttagaggccgccggcgcaagaaccacgctaacgctggataaacccggcgagtggcagttggtggtgatggatgaagcgggtcagacggcagccgccagctttaccctgcaataa

SEQ ID NO: 4613 - DNA, 498 bp, Klebsiella pneumoniae
tgtaaatcatttacaatacgccctctatacggaggggcggtggtcagcaacagttttcagcaaacgacacctaaacggcgagccgcctggctggcgctgttggcgatcctgctgatcgtggtggccccgctaatctccgtctccctgcaaaaagaccccatgagcgccatgcccggcatgcaccacgccatgatgagggatagctcgtccgcgaacatggcgcagatgcctgggcacaagatggcaatgatgcacagcatagacggcgctacgcataccggacacgaaatgccgctggaccatgccgaagcgtgtggctattgcgtgctgttagcccatgtcccggggctccttttcgcgctggcgctgttcgtcgccatgctcctgcggcgcattcgcctgccggtttctcgcccggtattaaagcactggcactactttccctggctctaccccgaaacccgcgccccgccgcggctgtctgctttttccctttaa

SEQ ID NO: 4614 - DNA, 1311 bp, Klebsiella pneumoniae
gctaagtcttttaaggaatcctacgtggaacatatctccaccaccacgctgatcataacgctgatcgtcatggtgattatctctgcctatttctccggttccgaaaccggcatgatgacgctgaaccgctaccggttgcgccacatggcgaaacaaggcaaccgccccgccaagcgcgtggagaagctgctgcgcaagccggaccgcctgattagcctcgtgctgatcggcaataaccttgtcaacattctcgcctcggcgctgggcaccatcgtcggcatgcgcctgtacggcgacgccggcgtcgcgatcgccaccggcgtacttacctttgtggtgctggtatttgccgaagtgctgccgaagaccatcgccgccctctatccggaaaaggttgcctaccccagcagcttcctgttggcgcccctgcaggtgctgatgatgccgctggtgtggctgctgaataccatcacccgcatactgatgcgcatgatgggcatccgcaccgataccgtcatcagcagcgccctgagcaaagatgaactgcgcacgattgtgaatgaatcccgttcacaaatctcacgacgtaatcaggatatgctgctgtcggtgctggacctggagaaggtcagcgttaacgacatcatggtgccgcgcaatgagattgtcggcatcgacatcaatgatgactggaaatctatcgtccgccagctgacccactccccgcatggccgcatcgtgctctaccgcgattcgctggacgatgccatcagcatgctgcgcgttcgcgaagcctaccgtctgatgacggagaagaaagagttcacaaaagagatcatgctgcgggcggcagatgagatctactttgtgccggaaggcacgccgctcagcacccagctggtgaaatttcagcgcaataaaaagaaagtcggtctggtggtcgatgaatacggcgatattcaggggcttgtcaccgtcgaagatattcttgaagagattgtcggcgacttcaccacctccatgtcacccaccctggcggaggaagtgaccccgcttaacgacggcacggtgattatcgacggcagcgccaacgttcgcgaaatcaacaaagcgtttaactggcacctgccggaagatgaagcgcgcaccgtcaacggtattatcctcgaagcgctggaagagatcccggtcccgggcacccgcgtgcgcattgagcagtacgatatagatatcctcgacgtgcaggacaacatgatcaaacaggtgaaagtgatgccggtgaaatcattacgcgagagcgtcgcggagtag

SEQ ID NO: 4615 - DNA, 1251 bp, Klebsiella pneumoniae
ttccttgcattgagtgatgtacggagtttaagagcaatgaaattaccgatttacctcgattactccgcaaccacgccggtggacccgcgtgttgccgagaaaatgatgcagttcctgaccatggacgggacctttggtaacccggcctcccgttcccaccgttttggctggcaggctgaagaggcggttgatatcgcccgcaatcagattgccgagctggtcggcgccgacccgcgcgaaatcgtctttacctctggtgcgactgaatccgacaacctggcgatcaagggtgcagccaacttttatcagaaaaaaggcaagcacatcatcaccagcaaaaccgagcataaagcggttctggatacctgccgtcagctggagcgcgaaggcttcgaagtgacctacctggcgccgcagagcaacgggattatcgatctgaaagagctggaagcggcgatgcgtgacgacaccatcctggtttccatcatgcatgtgaataacgaaatcggcgtggtgcaggatatcgctaccatcggcgagatgtgtcgcgcccgcggtatcatttaccacgtagacgccacccagagcgtgggcaagctgcctatcgatctgagccagctgaaagttgacctgatgtccttctccggtcacaaaatctacggtccgaaaggcatcggcgcgctgtacgtgcgccgtaagccgcgtattcgtatcgaagcgcaaatccacggcggcggccacgagcgcggtatgcgttccggtactctgcctgttcaccagatcgtcggcatgggtgaagcttaccgtatcgccaaagaagagatggaaagcgagatggcgcgtctgcgcacgctgcgcaaccgtctgtggaacggcgtgaaggatatggaagaagtgtacctcaacggcgacctcgagcagggcgcgccgaacattcttaacgtcagcttcaactatgttgaaggcgagtcgctgattatggcgctgaaagacttggcggtttcctccggttcagcctgtacttccgcgagccttgagccatcctacgtgctgcgcgcgttaggcatgactgatgaactggcgcacagttctattcgtttctctttaggtcgtttcactaccgaagaagagattgactatgccatcgatctgattcgcaaatccattggccgtctgcgcgagctttctccgctgtgggaaatgttcaaacagggcgtggatctgaacagcattgaatggtcacatcactaa

SEQ ID NO: 4616 - DNA, 372 bp, Klebsiella pneumoniae
agttcgatttcacccggggactcttcggtacccgccagcatggagccaaccatcaccgccgccgcaccggcggcgatcgctttggcgatatcgccggagaaacggataccgccgtcagcgataaccggaataccggtcccttccagcgcttccaccgcgtcggaaacagcagtgatctgcggcacacccacgccggtgacgatacgggtagtacagatggagcccgggccgatgcccactttcaccgcgctgcagccggcttccgccagcgcgcgtgcgcctgcgccagtggcaacgttgccgccgatgatctgcaggtcaggatatttcgcgcgcgtttcacggatacgctgcagaacgccttctgagtga

SEQ ID NO: 4617 - DNA, 213 bp, Klebsiella pneumoniae; identical to SEQ ID NO: 1885

SEQ ID NO: 4618 - DNA, 828 bp, Klebsiella pneumoniae
cgcacctattcaatggtgggctgggcgggggtccgaaaggacgccggtatccgtttaggccggtacgccaactccgttcagttcaccaccagtaattggcgttgcggtggtgataactctactaagcggggtatcacaatgaacaccaaaccttccattttcaatttcgaatccgactcaactattcgcgccattatgatcgatggcaatccttggttttttgcatccgatgtttgccgcgcgattggcatcgcaaaccatcgtgatgcagttcgcaaacttgatgatgatgagaagggcgtcggctcaaccgacacccttggtggtgagcaggaatcagttatcatctcagagtctggcctctacacccttatcctccgctgccgcgatgcggtgacgccgggtaccatcccctaccgctttcgcaaatgggtaaccagcgaggtgctgcctcagatccgcaagactggccgctacgttcgggaagaactctcccagaccgataaagcccgcatgctggcgcaggagatgaccagcagcatgttgccggcgatcatggatgcattgcaggtcgagcagaagcactacaccttccctcttaaccgacgctatcaggatcacatccattcacctgatggcctgcgtgaactggcgaaaagctcaatggtgatgaagttgctccgcgaactcgatgctgacgggcatgatgtatccggcgccgccgcagaagtcacggccatgctcagctacattgttggtatcggcgccgtactgcgcgacatagagacgcatgctcagtacgtgatggctaaggccaagggttactga

SEQ ID NO: 4619 - DNA, 579 bp, Klebsiella pneumoniae
cagtggtattcttcgccgggcatcggcagcggcttttcccgcgctatggcgactttgacggaagcgttaatgacagtattacaccgtcttttattgactgtattttttctcatcgcggtatctcctgtttttgctgccggaccttcagaacatgttcgcgctattgtttccgggatcgtgacctacacccgttggccgtcattaacaggagcgccaaagctgtgcatttttgcctcatcacgcttcacccatagcctggctcatgaagatccggatgcattaccctatcaaccggtgatagtacgtaatcgtgaagaagcgttaaaaacgacctgcgatggtttttattttggcagcgaatcgccgactgaacagtcagaactcactcgccgctatggcccgaggccgctgttactcatcgcagaacaaaatacggattgttcaattggtagcgcgttttgcctgatcatcaatgacgaccgggtccgcttctccgttaatctggacgttctgacgcacagcggggttcgggttaacccggacgtcctgatgcttgcccggaagaaaccacatgaataa

SEQ ID NO: 4620 - DNA, 354 bp, Klebsiella pneumoniae; identical to SEQ ID NO: 1586

SEQ ID NO: 4621 - DNA, 183 bp, Klebsiella pneumoniae; identical to SEQ ID NO: 1431

SEQ ID NO: 4622 - DNA, 201 bp, Klebsiella pneumoniae
ggtaaggaggtgatccaaccgcaggttcccctacggttaccttgttacgacttcaccccagtcatgaatcacaaagtggtaagcgccctcccgaaggttaagctacctatatcttttgcaacccactcccatggtgggacgggcggtgtgtacaaggcccgggaacgtattcacagtagcattctgatctacgagtactag

SEQ ID NO: 4623 - DNA, 213 bp, Klebsiella pneumoniae; identical to SEQ ID NO: 1885

SEQ ID NO: 4624 - DNA, 1113 bp, Klebsiella pneumoniae
tatcaccgatttatccgtgtcttagagggacaatcgatgtctaaagaaaagtttgaacgtacaaaaccgcacgttaacgtcggtactatcggccacgttgaccatggtaaaacaacgctgaccgctgccatcactaccgtactggctaaaacctacggtggttccgctcgcgcattcgaccagatcgataacgcgccggaagaaaaagctcgtggtatcaccatcaacacctctcacgttgaatatgacaccccgactcgccactacgcgcacgtagactgcccgggccacgccgactatgttaaaaacatgatcaccggtgctgcgcagatggacggcgcgatcctggttgttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgagatggaagttcgtgaactgctgtctcagtacgatttcccgggcgacgacactccgatcgttcgtggttctgctctgaaagcgctggaaggcgacgcagagtgggaagcgaaaatcatcgaactggctggccacctggatacctatatcccggaaccagagcgtgcgattgacaagccgttcctgctgccgatcgaagacgtattctccatctccggtcgtggtaccgttgttaccggtcgtgtagagcgcggtatcatcaaagtaggtgaagaagttgaaatcgttggtatcaaagaaaccgcgaaaaccacctgtactggcgttgaaatgttcccaaaaatggtggacgaaggccgtgctggtgagaacctaggtgttctgctgcgtggtatcaaacgtgaagaaatcgaacgtggtcaggtactggctaagccgggcaccatcaacccgcacaccaagttcgaatctgaagtggacatcctggccaaagacgaaagcgggcgtcatactcccgttcttcaaaggctaccgtccggagttctactttccgacctactggagtggactggacccatcgaacttgcggaagggcgtaaaaatggtattgccggggcgacaccataa

SEQ ID NO: 4625 - DNA, 1092 bp, Klebsiella pneumoniae
tcagacaagccttcccccgccagatacgataaactaacgccgattttgcatcaggaagccactatgaaccactccctcaaaccctggaatacctttggcattgaacgcttcgccaagacgatagtacgcgccgaaactgagcaacagttgctaagcgcctggcaaaccgctgccgcggcaggcgaacccacgctgatccttggggaaggcagtaatgtcctgtttctgaacgactatgccggtacggtgatcctcaaccggattatggggatcgaggtgagcgaaacgccggaagcctggcgcttgcacgtcggcgccggcgaaaactggcatcagttggtgcagttcacgctacagcatgcgatgccaggtctggaaaatctggcgttaatccctggctgcgcaggatcttcgccgatccagaatattggcgcctacggcgttgagctacagcgggtttgcgaatatgttgactgcattgagctggaaaccgggcgtaagcaacgtctttcagccgcggaatgccgttttggctatcgcgacagtatcttcaaacatgaatatcaggaccgctatgccatcgtcgcgattggcttatcgttagcgaaaacatggcagcctgtactgagttacggtgatttaacgcgtctcgatccgcagaccgtcacgccgcagcaggtatttgatgcggtctgtcatatgcgaatgactaaattgccggatccaaagattaacggtaatgccggcagcttttttaagaacccgatcatcagcgctcaggttgcggaagcgctgctggcgcagttccctcatgcaccgcactatccgcaggcaaatggcagcgtcaagctggccgctggctggctaatcgatcaatgtgagctcaaaggacaacgcatcggcggcgctgccgtccatcggcagcaggcgctggtactgattaatgaagatcgagcgaccagcgaggatgtggtgaaacttgctcattatgttcgccagcgggtgggtgcgaaattcgatgtatggcttcagcccgaggtgcgcttcattggcacgcatggtgaagtcaacgcagaggagagcattgcgtga

SEQ ID NO: 4626 - DNA, 339 bp, Klebsiella pneumoniae
gccatatcagcacgtctggagcgggcagcgggaatcgaacccgcatcatcagcttggaaggctgaggtaatagccattatacgatgcccgcatcctgaaactcggctacccagttctttctgtaatactaaagagactgctctctttagtattgagctgattagtttacccaaccaactccggctccgcaaagcgtcgccagaaagtggtggtgggggaaggattcgaaccttcgaagtcgatgacggcagatttacagtctgctccctttggccgctcgggaaccccacccaaattgttatggtgccgactaccggaatcgaactggtgacctactga

SEQ ID NO: 4627 - DNA, 354 bp, Klebsiella pneumoniae
cccattatacaaaaggtacgcagtcacacccgaaggtgctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcttcgagttcacaacctgtgcattttggtgtacgggactatcaccctgtaccgtcggactttccagaccgttccactaacacacaagctgattcagactctgggctgctccccgttcgctcgccgctactgggggaatctcggttga

SEQ ID NO: 4628 - DNA, 351 bp, Klebsiella pneumoniae
gtgttctgctgcgtggtatcaaacgtgaagaaatcgaacgtggtcaggtactggctaagccgggcaccatcaacccgcacaccaagttcgaatctgaagtggacatcctggccaaagacgaaagcgggcgtcatactcccgttcttcaaaggctaccgtccggagttctactttccgacctactggagtggactggacccatcgaacttgcggaagggcgtaaaaatggtattgccggggcgacaccataaaaagggtggttccccttatcccccccaacgcaaaggccaacggtttgcgtttttaaatccgggaagggggccgaacccttgcccgggccgtgggtgttaa

SEQ ID NO: 4629 - DNA, 987 bp, Klebsiella pneumoniae
agtcaacgcagaggagagcattgcgtgaaagaccatactatccctttaacgctaatttctatccttgctgatggcgagtttcactctggcgaacagcttggtgagcagttaggcatgagccgggcggcgattaataagcacatccagaccttacgtgactggggcgtcgatgtgtttactgtgccgggcaagggttacagcctgccggagcctattcatctattagatgagaaaaagatttctcaagagatagaccatggccgagtgacggtccttcccgtcatcgactctactaaccagtatttgctggacaggcttgatgagctgacgtccggagatgcctgtgtggctgaatatcagcaagcagggcgaggccggcgaggcagaaaatggttttcgccctttggcgcgaatctctatctctcgatgtactggcgtctggagcagggcccggcagcggctattggcctaagcctggtgatcggtattgtgatcgctgaagttctgcagcagctcggggccgaacaggttcgcgtgaaatggccaaacgatatttacctgcaggatcgtaagctgtcagggatcctcgtggaactgacggggaaaacgggcgatgccgcacaaatcgtcagcggcgcgggtatcaaccttgtgatgcgtcgcgtggagtctgatgtcgtcaatcaggggtggatcagccttcaggaagcgggggtggtcatcgaccgtaacctcctcgccgcgcgcctgattaaagagctgcgcctgggactggagctgttcgagcaggaaggattggctccctatctaccgcgctgggaaaaactggataactttattcatcgcccggtgaaactgattatcggtgataaagaaatttacggcatttcgcgtggcattgacgcccagggcgcactattgctggagcaggatggtgtaataaaagcctgggtgggtggtgaaatatcattgcgcagtgcagaataa

SEQ ID NO: 4630 - DNA, 183 bp, Klebsiella pneumoniae; identical to SEQ ID NO: 1431

SEQ ID NO: 4631 - DNA, 276 bp, Klebsiella pneumoniae
ccacgttcgatttcttcacgtttgataccacgcagcagaacacctaggttctcaccagcacggccttcgtccaccatttttgggaacatttcaacgccagtacaggtggttttcgcggtttctttgataccaacgatttcaacttcttcacctactttgatgataccgcgctctacacgaccggtaacaacggtaccacgaccggagatggagaatacgtcttcgatcggcagcaggaacggcttgtcaatcgcacgctctggttccgggatatag

SEQ ID NO: 4632 - DNA, 471 bp, Klebsiella pneumoniae; identical to SEQ ID NO: 1445

SEQ ID NO: 4633 - DNA, 1008 bp, Klebsiella pneumoniae
ttaactcgtgtgaagcatcaccgtttcaaggtattcggtgatagtaagaacatgcttatgagccaaaaagagcagacgttaatgacaccgtacctacaatttaaccgccaccaatgggctgcacttcgtgattctgtcccgatgacgttaaccgaggaagaaatcacgcggttaaaaggcatcaacgaagatctctctctggaagaggttgccgagatctatttgccgctgtcgcgtttgctcaacttctatatcagttctaacctgcgtcgccaggctgttctcgaacaatttcttggcaccaatggtcagcgaattccctatattatcagtatcgctggcagcgttgcggtaggaaaaagcaccaccgcccgcgttctgcaagctttgcttagtcgttggccggagcatcgccatgtcgaactcattaccaccgacggttttttgcaccctaactcggttttaaaagaacgtgggttaatgaagaaaaaaggctttccgcagtcctatgatatgcatcgcctggtgaagtttgtctccgatctcaaatcaggggtaccgcaggcaaccgcgccggtttattcccatctgatttatgatgttattcccaatggtgacaaaaccgtcgcgcaaccggatattttaattcttgaagggctgaatgttctgcaaagtggaatggattatccgcacgatccccatcatgtattcgtttccgattttgtcgacttttctatttatgtcgatgccccggaagaattattgaaaagctggtatatcaaccgctttcttaaattccgggaaggggcgtttaccgatccggattcctatttccataattacgctaagctctcgaaggaagaagcggtagatattgccacttcgctatggaatgaaatcaacctaatgaatcttaaagaaaatatccttccaactcgcgagcgcgccagcctgatcatgactaagagcgccaatcactcagtgaatcaggtacgcttacgtaaataa

SEQ ID NO: 4634 - DNA, 201 bp, Klebsiella pneumoniae
ggtaaggaggtgatccaaccgcaggttcccctacggttaccttgttacgacttcaccccagtcatgaatcacaaagtggtaagcgccctcccgaaggttaagctacatacttcttttgcaacccactcccatggtgtgacgggcggtgtgtacaaggcccgggaacgtattcaccgtagcattctgatctacgattactag

SEQ ID NO: 4635 - DNA, 237 bp, Klebsiella pneumoniae
tatggtctttcacgcaatgctctcctctgcgttgacttcaccatgcgtgccaatgaagcgcacctcgggctgaagccatacatcgaatttcgcacccacccgctggcgaacataatgagcaagtttcaccacatcctcgctggtcgctcgatcttcattaatcagtaccagcgcctgctgccgatggacggcagcgccgccgatgcgttgtcctttgagctcacattgatcgattag

SEQ ID NO: 4636 - DNA, 213 bp, Klebsiella pneumoniae; identical to SEQ ID NO: 1885

SEQ ID NO: 4637 - DNA, 3036 bp, Klebsiella pneumoniae
gcatttctgttaaaaataccgcatcggataatttacgagggaaactatatggcaaggaggcagattctttctctgtcggaaagagaatcattactggcattaccggacgaagagttaacgctgacccggatggcgtatttcagtgaacatgatctggcacttatcagtgcccaccgtaaacctgccagccgttttggttttgccgtccttctttgctatctgaaaaatgtcggctttaccccggataaaaaaatccctccctctgatgcgctgctgaagcatatcgccagcaggctaaaacttaccggggatctctggccagcttacctttccggcagggaaaccacgcgacgcgaacatttaaccgaactgtaccgctatcttggcttaaaagcgttcaccggcaaaatacagcaggactgtattacacacctgctgccgatggcgacgcgcaccgataaaggtattctcctggccgaagaactactggtctggctccggcagaacaacgtgataatcccctcgattgatgtcgtggagcgttcctgtgctgaggccatggcaggcggcgataaaatcgtgtttcagaccctgaatgctccgttaactccggctcacagggatgctctggattgtttacttgagtcatcggataatcagtcttccaggctgacatggcttctgcaacctccgggtaaaatcaatggtaagaacgtgctgcaacaccttgatcggctcagtagcattgaatcgctggcattaccggaaggtatagatcgtaccattcaccagaaccggttgctgaaactggcgcgggaaggccgaaagatgagcagccgggatttgacccgattttcagcagcccggcgtcatgcgatcctggtgtgcgtgctggaagaagccagagccacactgacagacgaagtgattgagttgcatgagcgaatgctgaacagccttttcagcaaagccaaaagaacacaggctgagcgccttcagcagaccggaaagctgatccagtcaaaactgaggcagtacatcaatgtcggtcaggcgctgtctgatgcccgtgattccgggggagatccatggctcgcaatagaaaacatactcccatggcctgaatttgtcgccagtctggaggaaacacgccatctcgccagaaaaaataattttgacccgctgcatattattaccgagaaatacagcacattacggaaatatgccccgcgcatgttgtcagctttacagttaatcgcaactccggcagcgcaacctctggctgatgcgctggttgtgatcaaggatatgtaccggaagcagtcacgtaaagttccggccaccgcgccgcttgagtttgtcccagaaagttggcgcaaggtggtaattacacctgcgggtattgaccggcagtactatgaattttgtgcgctcagcgagcttaagggggcgttgcgttccggggacatctgggttaaaggctcacgccgctacaaaaattttgatgattacctcattcccgaaaaggactttgacaaactcacaccggcgctgccacttcccgtatctgctgattatcatgagtacattaccagccgtatgaccctgcttcagtccaggcttgaagaggtcaatgccatggctgcccttggtgaactgcccgatgtggaaatatcttacaggggcgtaaaagtctctccgctggataacagcgttccggtgcaggtttcaccgctggcagagctggtttacagcatgctaccgcgccctaaaatcacggaaattctcgatgaggtaaacagctggacgacgtttacccgacatttttcgcatataaaaactgacattacccgtcccgatatccgcctgcttctcaccaccattcttgcggatggcatcaatcttggcctgaccaaaatggcggaagcctgccccggtagcaccaaatcatcactcgaagatattcaggcatggtacatccgcgacgaaacctattcagcagcccttgcagagctggtaaacgcgcaggggaaaaggccgctggcggcattctggggagacgggacaacatcatcatcagatggacagaatttcagaacaggcagatcaggccgctacgcagggcaggttaacccgaaatacgggcaggagcccggacgtcagttttatacccatatttcggatcaatacagcccgttttacacctgcataatcagtcgggtcagagattcaacccatgtgctcgatggcttgctgtaccacgaaagcgacctggaaatcagggagcattacaccgatacagcgggtttcaccgatcatgtctttgccctgatgcatctgctgggatttgcgttctgtccgcgaatcagggatctccacgacaagaagctatttatcaaagggaaagcaggccagtacccggcgcttcagtcactgatatcaacaaccagcctgaatctgaaagagatcgaaattcactggcgtgaagtgctgcgtctggcaacctcgataaagcagggaaccgtgacggcatccctgatgctgaaaaagcttgccagctaccccaagcaaaacgggctggccaaagcactgagagaaattggccgtattgaacgaactctgtttatgctcgactggttccgcgatcctgcactgcgtcggcgggtacaggcggggctgaataaaggtgaagcccgtaacgcgctggcgcgagcggtatttatgcaccggctgggagaaatcagggaccgaaaaccggaaaatcagagctatcgcgccagtggactgacgctcctgacagctgccatatccctgtggaataccgtctatatggaaagagctgtcgatgctctgaagcgtaagggagtgaagatcaacgagcaactgctgtcgcatttgtccccgctaggctgggaacacatcaatctgacaggcgattatatatggaaaagcaaccggataccgtcagccggtaagtttcgtcggctgaggccagctaaattaggcaggtcaaaaaataaccttaacgtacaataa

SEQ ID NO: 4638 - DNA, 240 bp, Klebsiella pneumoniae
ccggcgcggccggtctggcccttctgggggggctggttgtcgccgtgtttatcgagagctggggagaaaccgtcctgcgtccggacctctacgcaaacgcagattattacctgctgcagccggctaacctgttcgggattgcctggtgcgcgggcgggctggctgtcgggattgtgttggcgcggctgctggcgttcctgctgcttgacggtcattttgcggctgctgacgaggcggtga

SEQ ID NO: 4639 - DNA, 390 bp, Klebsiella pneumoniae
cggggtgagacaatggcgtgggtgacggtgagacaggcgacggaactgacgggtaaagcccgaagttccctgtatcgggatatggcgaaaggccgcgtatcataccgtacggaagctgatggcggccgggtggtggataccagcgagcttatccgggtgtacggtgagttaagacaggatgagactcacgagcgggacgagttgagactgtcgggtgagactgaaaaaatggcctccgacgcgttgatcgcggagataaaagcactcagggaggaggtggccgggctacggcaggaaatgcagtccatgagactgctggaacacaaaccggagacagcagagaccccggccggaacaccgcgccggtggtggccgtggggaaaacgctga

SEQ ID NO: 4640 - DNA, 1872 bp, Klebsiella pneumoniae
cgttgtacagctccagcgccatcagtaaatccccgcaaaatcatcatccgctttcggcccgccgccgtcggccgggggccggaactccgccaggggatcggttttcgccagcaccgggaaacgctgcaacgggatttcccggcgctcaacccgcagcggactgctgaacgccatccgggccacacccagcccggtcatgaccgcgaacccgtccggcaggtgttgcagggtgttcacgtcaaacagcggccgcgcctccttctggatgaagctgtccccgctgatatgctccacgttccccgcctcccggctggcacggcggcgctccacgtccaccctgatttccccggtctgccccgccgcccactgcgcggactccaggcaggccgcccggtaaaaccagcggatcggcgtgttatccagtaccgtggttttcacaaattcagcgggcagatcctgcccgcactgcccgaaatcgcccagcgactggtgcgcgagcaacagattgcagtcccggctgcgcagcgtccccagtgcgttcagtacatacttcgacagcagatatttaatttcatcgagcatcacgctgacgtgtggccactcccggaactcgtcccgcgcaatgatgatttgcgcgcagcgggcaaacagcattttttgcacacggatcaccgcctcgtcgtccatcgagccgataacgtacaggcagccgccgccgttgataatccccgccacatcgatgccactgtccgtctgcaggacgctcaggtcagcgacgttttccagcctagtgatcaaccccttcacgtcctttttcagggcctccggcagcgcgtacgccgccgccagcacctgctgaatgtttgccccctgcggaaactgctccgcaatcagcttcgccgctttctgctcgctgatgcggtagtggtccgccacgtcgccggtctcgcccaggttaagcccggcaatcagcaggtttttcagcgcgtactggtcgagatcgcggaacagattcagctgcgccggtttccccggccgcagatccagcagggtgaagtccggacagtgcgcccggaagacgtgcggcgcccatgcgtcccctttggggtcgaagtacaccaccgcgtccccgaaatcgcgtacgcagcgaatgagcgcgttggtggccatcacgctcttgccgctcccgggcaggccgaggatctgaatgttggtcttgcgccaggtatcacgcggaaccagcaccggcttgccctgctcatccttacccagaaacaccgcctgctcctgccgggcctgctccgaggaaaaatcggccagcgcattaaccggtaccggctccccgaaatgcaggtggcgcacgtcggtcatctctcctgtccgctggctgctgcgccggctctcctgattcagtttcgcgttcaccgcctcgtcagcagccgcaaaatgaccgtcaagcagcaggaacgccagcagccgcgccaacacaatcccgacagccagcccgcccgcgcaccaggcaatcccgaacaggttagccggctgcagcaggtaataatctgcgtttgcgtagaggtccggacgcaggacggtttctccccagctctcgataaacacggcgacaaccagcccccccagaagggccagaccggccgcgccggtcagccagtacgcgtagttccagacatgtcgacgtgccctgaccatccgcccgggcgaatccagcgaggccagcaccgaaaatggcgctggccgtttattatcgcgcttatagcgatcggcatactcccgtcgctccttatgactcagccccacaaaacgcatccgtccggcccaaagttcagccagaccgaaaaacaggccgataactag

SEQ ID NO: 4641 - DNA, 537 bp, Klebsiella pneumoniae
gggattatggcgctgtacatggtatttattgaagacgcggaggaccggaacggcgagcgctgcatcatgccgaccagcgagcatctggaagatatggtggtgctcgcctggcagaccggggcgtatgttttctgttttgtcgaccgggcccagcatctggcgatgatgaaatccatcgggatgtatgacgagcggctcaacagcgacgaaaaagccacgtactttttcactggtaaaaatccgcaatgggaacggaacaaacccacaggaatgaagctgtgtgattacctctatcgcaaggtggagcggttcgccatcgagaacggtgtgcaggtggttgatgccgggaagtgctcaccggagcagattaacgcgatgattgacgtggtgagtgagcggcacggggaaagcgcggtgaacgagaagctgaaagcggagctgatgcgggaatataacagccgctattttaacgtgccggtacctgaactgccggaggacaaacctgcccgccggtggtggccgttcggcaaaaaataa

SEQ ID NO: 4642 - DNA, 384 bp, Klebsiella pneumoniae
gctcgctggtatccaccacccggccgccatcagcttccgtacggtatgatacgcggcctttcgccatatcccgatacagggaacttcgggctttacccgtcagttccgtcgcctgtctcaccgtcacccacgccattgtctcaccccgctatttttgagacagtatacctgacaggcgcacaccatgcccggaaggaaagaatcatgacaaaacaggaaaaaacagccctcaatatggctaaatttattaaggagcagtcgctgctattgctcgataaactgaatgagctggatatggataccccggccgacatgtgcgagcggctacacgaggatgcggaaacactctggcaggtgatgcgggataagctcggggaggaataa

SEQ ID NO: 4643 - DNA, 1140 bp, Klebsiella pneumoniae
ctaagccatcacattgaggataatttacatatgaaatcacgtgctgccgttgcatttgcaccagggaagcccctggagattgttgaaattgatgttgcaccacctaaaaaaggcgaggtgctgattaaaaatacccacaccggtgtctgccacaccgatgcctttaccctctccgggaacgatcctgagggcgttttcccggtggttctcggccacgaaggggccggtgtcgtcgtggaggtcggtgaaggcgtgaccagcgtgaagccgggagaccatgtgattccgctttacaccgccgaatgcggggagtgtgaattctgtcagtccgggaaaacgaacctctgtgtatcggttcgcgaaactcagggaaaaggactgatgcctgacggaaccacccgcttttcttacaatggccagcctctttaccactacatgggatgctccaccttcagtgagtatacggtagtggccgaggtttctctggcaaaaattaacccggaggcaaaccatgaacacgtctgcctgctgggctgtggcgtgactaccgggattggcgctgttcacaacacagcgaaagtacagcctggagattctgtcgctatttttggtcttggcgcaatcggtctggctgccgttcagggggctcgccaggcaaaagcaggacgcattatcgctatcgacaccaacccggccaaattcgaacttgcccgtcagttcggtgcaaccgactgcatcaacccgaacgaccatgacaaaccgattaaagatgtgctgcttgaaatcaacaaatggggcattgaccacacttttgaatgtatcggtaacgtcaacgttatgcgtgcggcgctggaaagtgctcaccgtggctggggccagtccattgtcatcggcgtggccggcgccgggcaggagatatccacccgtccattccagctcgttaccgggcgcgtatggaaaggttctgctttcggcggagtgaaaggccgtacgcaacttccggccatggtagaagatgccatgaagggtgaaattgaactggagccatttgttacccacacgatgacgctggatgaaatcaatgaggccttcgatcttatgcatgaaggtaaatcaatccgtacggtaatccgttactga

SEQ ID NO: 4644 - DNA, 342 bp, Klebsiella pneumoniae
gttgatttccagcctcagaaaatgtgcttaattttcaggcctgaacagggcctgaatcctgcagacctgagatgtgctgtaaccggtggcttcagcagtttctcttatgctcagtttcttgacctgtcggtaatacagaactttcttatgtcgttcctgatcggcctgtttgccccggtattttcccagcgtatgtgcccgttcaattccctgcttctgccgatggcggcggctcagccagtccttatgcgacatcgaggccatcaggtcgataagcatattattgatggcggttatcacggcgcgggtgattgggtcagcctgcgaaggatctttatctga

SEQ ID NO: 4645 - DNA, 351 bp, Klebsiella pneumoniae
ccacggaacaactccgccagcgcctgcatggccgttatcaggaactgcgcgatgccgtatgacgtggaatggaagcagggagccatcgaggatgtaacgacgctgtttgactatatcgcggaaaattcatccctgtgggatgcgcagaacgttaccgaccgggttctcgctgcggcggacaaactggccgacttcccgcgactctatgaagtggactcacgctatggcgaggacgttcgccggatcagtctgatgggacagcatgtcctctatgatgttgatgaccagaccagaaaagtccgggttctggccgtggtcggccagcgccagaatccccatattgttctctaa

SEQ ID NO: 4646 - DNA, 648 bp, Klebsiella pneumoniae
cgtggtggaaaaatgttcatcagagcttatttaagggcatcgacggaagatcagttcgccgatcgggcaaaagagatgctggagcagtttgttcaggagcggggacataaaatagccagttactaccgggagaacatcagcggtacaaaacttgaccgcccggaactggggcgcttactgatggacagtcaccgcaatgatattttactggtcgagcagatagaccgtctgacccgtctgagcaacagcgactggatgacgctgaaaaagcaaatcgagcaacacgagctgcggattgtcagcctcgatgtacccacctcatggcaggcgctgtcagataaagatccttcgcaggctgacccaatcacccgcgccgtgataaccgccatcaataatatgcttatcgacctgatggcctcgatgtcgcataaggactggctgagccgccgccatcggcagaagcagggaattgaacgggcacatacgctgggaaaataccggggcaaacaggccgatcaggaacgacataagaaagttctgtattaccgacaggtcaagaaactgagcataagagaaactgctgaagccaccggttacagcacatctcaggtctgcaggattcaggccctgttcaggcctgaaaattaa

SEQ ID NO: 4647 - DNA, 1977 bp, Klebsiella pneumoniae
aggagagagaacatgtttaatacggattcgcttgcctggaagtggcacattccggagctggcccggcagatttatccgtgggtcagctggctgtaccaggagtattacggtctggccggggctttcctagttatcggcctgtttttcggtctggctgaactttgggccggacggatgcgttttgtggggctgagtcataaggagcgacgggagtatgccgatcgctataagcgcgataataaacggccagcgccattttcggtgctggcctcgctggattcgcccgggcggatggtcagggcacgtcgacatgtctggaactacgcgtactggctgaccggcgcggccggtctggcccttctgggggggctggttgtcgccgtgtttatcgagagctggggagaaaccgtcctgcgtccggacctctacgcaaacgcagattattacctgctgcagccggctaacctgttcgggattgcctggtgcgcgggcgggctggctgtcgggattgtgttggcgcggctgctggcgttcctgctgcttgacggtcattttgcggctgctgacgaggcggtgaacgcgaaactgaatcaggagagccggcgcagcagccagcggacaggagagatgaccgacgtgcgccacctgcatttcggggagccggtaccggttaatgcgctggccgatttttcctcggagcaggcccggcaggagcaggcggtgtttctgggtaaggatgagcagggcaagccggtgctggttccgcgtgatacctggcgcaagaccaacattcagatcctcggcctgcccgggagcggcaagagcgtgatggccaccaacgcgctcattcgctgcgtacgcgatttcggggacgcggtggtgtacttcgaccccaaaggggacgcatgggcgccgcacgtcttccgggcgcactgtccggacttcaccctgctggatctgcggccggggaaaccggcgcagctgaatctgttccgcgatctcgaccagtacgcgctgaaaaacctgctgattgccgggcttaacctgggcgagaccggcgacgtggcggaccactaccgcatcagcgagcagaaagcggcgaagctgattgcggagcagtttccgcagggggcaaacattcagcaggtgctggcggcggcgtacgcgctgccggaggccctgaaaaaggacgtgaaggggttgatcactaggctggaaaacgtcgctgacctgagcgtcctgcagacggacagtggcatcgatgtggcggggattatcaacggcggcggctgcctgtacgttatcggctcgatggacgacgaggcggtgatccgtgtgcaaaaaatgctgtttgcccgctgcgcgcaaatcatcattgcgcgggacgagttccgggagtggccacacgtcagcgtgatgctcgatgaaattaaatatctgctgtcgaagtatgtactgaacgcactggggacgctgcgcagccgggactgcaatctgttgctcgcgcaccagtcgctgggcgatttcgggcagtgcgggcaggatctgcccgctgaatttgtgaaaaccacggtactggataacacgccgatccgctggttttaccgggcggcctgcctggagtccgcgcagtgggcggcggggcagaccggggaaatcagggtggacgtggagcgccgccgtgccagccgggaggcggggaacgtggagcatatcagcggggacagcttcatccagaaggaggcgcggccgctgtttgacgtgaacaccctgcaacacctgccggacgggttcgcggtcatgaccgggctgggtgtggcccggatggcgttcagcagtccgctgcgggttgagcgccgggaaatcccgttgcagcgtttcccggtgctggcgaaaaccgatcccctggcggagttccggcccccggccgacggcggcgggccgaaagcggatgatgattttgcggggatttactga

SEQ ID NO: 4648 - DNA, 276 bp, Klebsiella pneumoniae
gactgctggaacacaaaccggagacagcagagaccccggccggaacaccgcgccggtggtggccgtggggaaaacgctgacgcgctgtgcttgtccaaccggcgacggccacgcaatgaattgcgtccccgtcaccggttattagagaacaatatggggattctggcgctggccgaccacggccagaacccggacttttctggtctggtcatcaacatcatagaggacatgctgtcccatcagactgatccggcgaacgtcctcgccatagcgtga

SEQ ID NO: 4649 - DNA, 186 bp, Klebsiella pneumoniae
cccctttacctttttcatataccttccctgtatttaaaaaccccggtattcatccctgaacaccggaagtctgtatttcaaatcatccttgataacttttgcttaccagttaccatcccggtaaacaaaggatacaaagtaatcaaatttactaatatcgattacatttttaaagtgtggctgtaa

SEQ ID NO: 4650 - DNA, 750 bp, Klebsiella pneumoniae
ttttgcggggatttactgatggcgctggagctgtacaacgtcagccacgcgaaacgacaggcgcggaacgcggagaaaacccggctgaccctgcgctggttgcgggaagagctgtgttccacggcggagctggttgcgcggcggctggggattgcggcggtgcagccggtctaccgcttcctcgacagcctggtggcgaaagggctgctggtccggaccaaatatccggtggacggccgtcaggtcagcgtgtgggggctgacgccgcatggcgtggcgttctcgttcgacgaggacgaaccgctggcggatgttattccgtttcagccgtcaagggtgtcggcagcacatctgccgcaccggctggccgtgcaatccctgcgccttgatatggaagccagaggggccaccggctggcgcattctgcaccgtctgagtcttaaaggcatgaaagtgccggacgccctggcggagctggacggtaaaacggtggcgtttgaggtggagcgcaccgtcaagagccgtcgccggtatcaggaagtggtgtccgggtatctgttcaaccgcaaagctaacggcatcgatgaaatctggtacatctgcccggaccgggcgacgcaggtcagggtgcagcgggcaatcctgtcggtggatgaaatcgtgaacccacagaccggcgaggcccgcaaaacggcagagctggatcgtgaacggttgtttgcgtgctttaaatttatgacaacggagtga

SEQ ID NO: 4651 - DNA, 267 bp, Klebsiella pneumoniae
ccccgaatgcggcgaacacgggtaaggaccttttttttctcttcaggagtactgggcattatttacctcaccatttttgattttatatactatagtggagtatataattatcgtcaatgcatactccactatagtataactaagaataaacataactacctttatttacgatataaatcatatatttatattatttttggctgtgatactgtcggaaggaaagttactacaaaaatgatatctaccgatacgggatttggggcatag

SEQ ID NO: 4652 - DNA, 279 bp, Klebsiella pneumoniae
ataatgcccagtactcctgaagagaaaaaaaaggtccttacccgtgttcgccgcattcggggtcagattgatgctctggaaagagcgctggaaaatggtgctgaatgccgttccattcttcagcagatagctgccgttcgcggagcagctaacggtcttatggcagaggtgctcgagagccacatacgggaaacctttgaccagaatgacagctacagccatgaaatcagtaaatccgttgacgatacgattgaactggttcgcgcctatcttaaatag

SEQ ID NO: 4653 - DNA, 930 bp, Klebsiella pneumoniae
caaaatcacggcttatacgttcatctgacgtccggctataaagagacttcccctgactccctgtcaggggaaataaccatgagacagaggctgatggaactcatcgagcagcatgccagcgctggcggctggcaaaacgtataccgccataattcacaaacacttaattgtgggatgaatttcggtgtttatcttccccccaaagcagcaacagaaaaactgccggtcctgtactggctctcgggtctgacctgtacggagcagaatttcatcaccaaatcgggtatgcagcattatgccgccaggaacaacatcatcgtcgttgttcctgataccagtccccgtggagagcatgtcgcagatgctgacagctacgatctgggccagggtgccggattttatctgaacgcgacggaacatccgtggaacacgcattacaggatgtatgactatattctccatgagcttccggatgttgtcatggagcatttacctgtaacatcaaggaaatcaatatccggtcactccatgggggggctgggagcgctggttctgtcgctgcgaaatcctgatgaatatgtgagtgtatcggcattttcaccaatagtgtcaccttctcaggtgccatggggacaacaggcattcaccgcgtacctgggtgaaaataaaaaaacgtgggagcactacgatcccgtcagtctcattttacagggtgcgaaattaccagaaatttttattgaccagggattaagtgacgccttttatgaagatcagttacgcactaaaagtcttgaaagagtgtgcaacgagatgaacatcaacacatcattccgatatcatactggttacgaccacagctattatttcatttccagctttattggtgagcacattgcttaccatgccaacaggctcaggctgtcagcatga

SEQ ID NO: 4654 - DNA, 267 bp, Klebsiella pneumoniae
gaggtaaatatggggcttaaattacatattcattggtttgataagaaaaccgaagagtttaaaggtggtgaatactcaaaagacttcggtgatgatggttctgtcattgaaagtctggggatgcctttaaaggataatattaataatggttggtttgatgttgaaaaatcatgggtttcgatattacagccacactttaaaaatgtaatcgatattagtaaatttgattactttgtatcctttgtttaccgggatggtaactggtaa

SEQ ID NO: 4655 - DNA, 1719 bp, Klebsiella pneumoniae
tttattgttttaaaagtcaaagaggaaaagtatatgagtggcggagacggacgaggtccgggtaattcaggtctgggacacaatggtggtcaggccagtgggaatgtgaacggtacatcaggtaaaggtggcccttcatcaggtggtggtacggatccaaacagcgggccgggctggggtacgacgcatacacctaacggggatattcataactataacccgggggagtttggtaacggcgggagtaaacccggtggtaatggcggtaacagcggcaatcatagcgggagctctggtggcggacagtcttcggccaccgcgatggccttcggtctgcctgccctggccactccgggggctgaaggactggctttatccgtttccggcgatgcgttgtcggccgctgttgctgatgtgctggctgccctgaaaggtccgtttaagtttggtctgtgggggattgcgatttacggagtgctgccttctgagatagcaaaagatgatccgaaaatgatgtcaaaaatcgtgacgtcattgccggcagacacggtaacggagacgccggtcagctccctgccgctggaccaggcgacggtcagcgtcactaaacgtgtggcggatattgtgaaggacgagcggcagcatattgcggttgtcaccggccggccaatgagtgttcctgtggtggatgcgaaaccgacaaaacgtccgggggtattcagtgtgtcgattccgggtctcccgtctctgcaggtgagcgtacctaaaggtgttccggccgcgaaagccccgccaaaaggcattattgctgaaaaaggtgattcacgtccggctggttttacggccggtggtaactcccgtgaggccgttattcgtttcccgaaagagagcggacagaaaccggtctatgtgtcggtgacggatgttcttactccggcacaggtaaaacagcgtctggaggaagaaaagcgtcgccagcaggcatgggacgctgctcacccggaagaggggctgaaaagagagtatgataaagcgaaagctgagctggatgctgaagataaaaatattgcgaccttaaacagtcgcattgcatcgacagagaaggcgatccccggtgcaagggctgctgttcaggaagccgataaaaaggtaaaagaggcagaggcaaataaagatgattttgtgacttataacccgcctcatgaatatggctccgggtggcaggatcaggttcgctatcttgataaggatattcagaatcagaatgagaaattaaaagctgcccagacatctttaaacgaaatgaatgaatccttatccagggataaggctgcgctttccggggcgatggagagccggaaacaaaaggagaaaaaagcgaaggatgcagaaaataaattaaatgaggaaaagaaaaaacctcgtaagggaactaaagattacggccatgattattttcctgatcccaagactgaagatattaaggggttgggagagttgaaagagggtaaacctaaaacccctaaacaaggtggtggtggtaagcgggcccgatggtatggtgataaaaagcgtaaaatttatgaatgggattcccagcacggtgagcttgaagggtaccgcgccagtgatggcgaacacctcggggcattcgatccaaaaacgggtaagcaggttaaagggccggatccaaaacgaaacattaaaaaatatctttaa

SEQ ID NO: 4656 - DNA, 450 bp, Klebsiella pneumoniae
gaaaaaagaattaaaggtaaggagacgctcatgagacgttccggcagcaaactgtgtcttatcgccatgataacagcgacagcaactctcactgcctgtgctccaaagggcagcgtggaacagcatacccggcattacgtatatgcttcagatgacggttttgatcccaatttttccacccagaaagctgacacaacacgaatgatggtgccttttttccggcagttctgggatatgggcgcaaaggataaagcgaccggaaaatcacggagtgatgtgcagcaacgcattcagcagtttcacagtcaggaatttttaaactcactccaaggcacaacacaatttgcgggtaccgattaccgcagcaaagacctcacaccgaaaaaatcaaggctactggctgacaccatttcagctgtttatctcgatggctatgaaggcagacagtaa

SEQ ID NO: 4657 - DNA, 411 bp, Klebsiella pneumoniae
aggaaatggatcatggcaacacctgtaatttctggtaatgacgttttttcccacgtcttcatcggtgcatccgatgttgaaaaatccgctgatttttacgatgctgtcctcggtacgcttggcatcaataacctcggcccgtttggcaatggctgggtactttatggtcgcgaaaagccagcctttattattgcacatccgggcaacggtgaagcgccatcggccaacggcgttactgtcggctttgcagctgcaagtccggaagaagttgatgctttccacgccgcgggccttgccgccggagggaaagatgaaggtcagcctggcccgcgcagccatctccctggagcctatgcagcctacctgcgagaccctgcgggtaacaaaatcacggcttatacgttcatctga

SEQ ID NO: 4658 - DNA, 192 bp, Klebsiella pneumoniae
agcatatacgtaatgccgggtatgctgttccacgctgccctttggagcacaggcagtgagagttgctgtcgctgttatcatggcgataagacacagtttgctgccggaacgtctcatgagcgtctccttacctttaattcttttttctcattgagttatatatccgcaggctatcttatcatcagtttctga

SEQ ID NO: 4659 - DNA, 501 bp, Klebsiella pneumoniae
tcacacagcttcattcctgtgggtttgttccgttcccattgcggatttttaccagtgaaaaagtacgtggctttttcgtcgctgttgagccgctcgtcatacatcccgatggatttcatcatcgccagatgctgggcccggtcgacaaaacagaaaacatacgccccggtctgccaggcgagcaccaccatatcttccagatgctcgctggtcggcatgatgcagcgctcgccgttccggtcctccgcgtcttcaataaataccatgtacagcgccataatccctcactccgttgtcataaatttaaagcacgcaaacaaccgttcacgatccagctctgccgttttgcgggcctcgccggtctgtgggttcacgatttcatccaccgacaggattgcccgctgcaccctgacctgcgtcgcccggtccgggcagatgtaccagatttcatcgatgccgttagctttgcggttgaacagatacccggacaccacttcctga

SEQ ID NO: 4660 - DNA, 543 bp, Klebsiella pneumoniae
ccgggctgggtgtggcccggatggcgttcagcagtccgctgcgggttgagcgccgggaaatcccgttgcagcgtttcccggtgctggcgaaaaccgatcccctggcggagttccggcccccggccgacggcggcgggccgaaagcggatgatgattttgcggggatttactgatggcgctggagctgtacaacgtcagccacgcgaaacgacaggcgcggaacgcggagaaaacccggctgaccctgcgctggttgcgggaagagctgtgttccacggcggagctggttgcgcggcggctggggattgcggcggtgcagccggtctaccgcttcctcgacagcctggtggcgaaagggctgctggtccggaccaaatatccggtggacggccgtcaggtcagcgtgtgggggctgacgccgcatggcgtggcgttctcgttcgacgaggacgaaccgctggcggatgttattccgtttcagccgtcaagggtgtcggcagcacatctgccgcaccggctggccgtgcaatccctgcgccttga

SEQ ID NO: 4661 - DNA, 240 bp, Klebsiella pneumoniae
gttattgcatttaatctatcgcatataggttatgtcattcatcgtgtgccgtcacgttttgaatatggcgtcagggtgtacccttatgcgataagcatttctgttaaaaataccgcatcggataatttacgagggaaactatatggcaaggaggcagattctttctctgtcggaaagagaatcattactggcattaccggacgaagagttaacgctgacccggatggcgtatttcagtga

SEQ ID NO: 4662 - DNA, 210 bp, Klebsiella pneumoniae
ccccatgattggtcacagttagagaaccaaaaaagaaaagcatgtcagaaaagaaaaaacattaatgaggatacggacgccagtgggagtgagctggtgcttcctatccccttgcaggaccaggcagaggctggactaattgttgctgggactgccagccctgcgtttgttaaaatacatcattgccgagataaaagcaaagagatttag

SEQ ID NO: 4663 - DNA, 291 bp, Klebsiella pneumoniae
gatggcagttatgaccgaccccaaagcaaagaggatgatgtcaagtatgtagatatccctgcgcccgtacctgtcggagagcttcgccatgaggggagtcccgaccatgaagaagagtatataggatatgaatgtccaggatgcaagccggggatccaccttgaagtagccctctatggctggaagtgcggggccaatgattcctatgtcgagggcccccatgaatactccaacaaagagcagaagcagtatccggttccttttttctgtctcaatcttatgattaatcct

SEQ ID NO: 4664 - DNA, 1392 bp, Klebsiella pneumoniae
  unsure (876): Identity of nucleotide at the above locations are unknown.
aggattaatcataagattgagacagaaaaaaggaaccggatactgcttctgctctttgttggagtattcatgggggccctcgacataggaatcattggccccgcacttccagccatagagggctacttcaaggtggatccccggcttgcatcctggacattcatatcctatatactcttcttcatggtcgggactcccctcatggcgaagctctccgacaggtacgggcgcagggatatctacatacttgacatcatcctctttgctttggggtcggtcataactgccatctcaccatcatatcccctcctaatcctcggaagatccatacagggcttcggtgcaggggggatattccctgttgcaagtgcattcataggggacacatttccccccgaaagccgtgggaaagccctcggtatcataggatccgtacttggtttctcatcaatagccggacctatcctggcgggtttcatactcccctatggctggcagtggctcttcctcatcaacatcccaattgcggccacgatagttgtcgggggattccttatgctgccagttacaggcaaaacggacgatggtgaatttgatgccagagggacccttcttcttgccatcattgtggcctcccttgcagtcgggataaaccagatcgataccactgacctcacagggagtttgatgaggcccattgtagtggtacctctcatcctggcagcggcactcacacccatattttggagggttgaaagggctgcacccgatcccgtggtgcaggttgacctgctggccagccgtgaggtccgcattgcaaccgcaatctctgctggtaatggcctatcccaggctgcaatcgtattcatacccagntacgccttcttcgccctttcactgtcagagtccatggccagtttcagcttcctccctttcgtcaccaccatggccttctcggcccccattgtgggtgttctgctggacagggttggttcaagggtagtgatgatctcagggagccttatcctgatggttgggtgtaccatcatggccctcctctcatcaaccacccctctcttcatacttgctgaggtgctcatggccctcggactcataaccgtcataggggcacccctcaggtacataatgctatctgaaactccccccgaacacagggcatctggacaggccctgataaacatattatcaagtgcagggcagcttgttggaggtgcactcatcggtggcattgtagcgtccatgggtagtggagtaatgggttacaggttctcattcctcttccttgttgcagttgcattcacactcttcctgctatcaaccggtctcaagggaagaaaggaacagcttgagacaatgaaggggaacatttaa

SEQ ID NO: 4665 - DNA, 210 bp, Klebsiella pneumoniae
tctttctcctccgccggaaagacatcgatcaatctctccaccgccggcgccgcgccgcgggtatgtaatgtcgccattaccaggtgcccggtctccgccgcggttaacgccaggcgaatggtttcgctgtcgcgtagctccccgagcaggatcacatccggatcctggcgcagcgccacgcggagcgccgcggcgaacgaagggcagtga

SEQ ID NO: 4666 - DNA, 276 bp, Klebsiella pneumoniae
ctcggcctatccctgggcctcgcccctacggggccagcgcaagcgctgttcaaaacggctagccgttttgtccggcaactcgaattatttagggtatataccaaacgtgattatcgcgatgggttgccggataaagccgaatggggccaggggattatcgccaccttcgaatccggctttacccagggaccggtcggcttcggtgtggactgtatcgcccagtatgcggtgcgccttaacggcggtcgcgggcccagcggcctgcgccttgattaa

SEQ ID NO: 4667 - DNA, 1479 bp, Klebsiella pneumoniae
agacgaagatcaggaagagctggagatgtctctggaggagattatcgagtatgtccgcgttgccgcactgctgtgccacgacacctttgcccgtcagcagccaaccgcaccggaagtccgcaaaccgacattacactaactaaaattcgttcagggggcgtcatgactcagcaggaatttctatcgcgtcgccagacgctgttggcgcagatgcagccaggcagcgcggcgctgattttcgccgcaccggaagcggtgcgcagtgcagattcggaatatccctaccggcagaacagcgatttctggtacttcaccggctttaacgaaccggaagcgctgctggtgttgattaaaagcgatgaaacccacaaccatagcgtgctgttcaaccgggttcgcgatctgaccgctgagatctggtttggacgccgtctgggccaggaggccgcgccggcgaagcttggcgtcgaccgggcgctggcgttcagcgaaatcaaccagcagttgtatcagctgctcaacggtctggacgcgatctactttgcccagggtgaatatgcctatgccgatgagattgtgttcaacgccctcgaaaaactgcgcaaaggctcgcgccagaatctgcaggcgccgaactcggttatcgactggcggcccattgtgcatgagatgcgcctgtttaaatccgcggaagagcttgccgtgatgcgccgcgccggggagatcaccgcgctggcccatacccgggcgatggaaaaatgccgccctggcatgttcgaatatcagctggaaggtgaaattctccatgaattcaaccgccacggggcacgtttcccctcctataacaccatcgttggcggcggcgaaaacggctgtattctgcactacaccgaaaacgaatctgaactgcgcgacggcgatttagtcctgattgacgccggctgcgagtatcgcggctatgccggggacattacccgcaccttcccggtaaacggtaaatttacccagccgcagcgcgagatctacgacattgtgctcgaatcgctggagaccgcgctgaaactctatcggccgggcacctcgatctgtcaggtcaaccaggaagtggtgcgcattatgattaccggcctggtgcggctggggatcctgaaaggcgagattgacgagcttatcgccaacaacgcccaccgcccgtactttatgcatggcctgagccactggctgggtctggatgtgcacgatgtcggtaattacgacaccaaccgttcgcgcgtcctggagccgggaatggtgctgaccgtcgagccgggactgtatatcgccaccgatgccgacgtgccggcgcagtatcgcggcatcggcatccgtattgaagatgacatcgtgattaccgaagacggtaacgaaaatctcactgccggcgtggtgaagaaggcggatgagatcgaggcgctgatggcggcggcgcgccagtcatga

SEQ ID NO: 4668 - DNA, 399 bp, Klebsiella pneumoniae
gaaattttgtcagcgatgccgaacaggtcgatcgctgccagggtgtcaccgccgccggcgatggagaaaccttcgctgtccgcgatagcgttagccacgatttcagtccctttacggaagttagggaattcgaatacgccaaccgggccgttccacaggatggttttggcgttcttcaggatttcagccagtttctgtgcggaaacgtcgccaaggtccagaatctgctcgtcatctttgatgtcgttaacagatttccgggttgccgttgcggtttcggagaactcggtcgctacgcgaacgtcggtcggaaccgggatatcgcaggtgcccagcaggcgcttggcttcatcaaccagatctgcttcgtacagggatttaccgacgttgtggccctga

SEQ ID NO: 4669 - DNA, 1383 bp, Klebsiella pneumoniae
atcgcaaagtctatttcacctttgatctcaacaagtgtcacatctttgacgccaaaaccgaacagaacctctctctgtgaaccctggagcataacaatgaaaaacgtgctgataagcgccaccctctccgccaccctgggccttagcgccttctcttcgctagcgcaggatgtcgacctgcgtatgtcctggtgggggggcaacggccgccatcaggtcaccctcaaggcgctggaggaattccacaaacaacatcccgacatcaacgtcaaagcagaatacaccggctgggacggccatctttcacgcctgaccacccagattgccggcggtaccgagcctgacgtgatgcagaccaactggaactggctgccgatcttttcgaaaaatggcgatggcttttacgatctgaataccctgaaagacgagatcgacctcagccagttcgacgccaaagaactgcagtccaccacggtcaacggcaagcttaacggtattccaatttccgtcaccgcccgcgtcttctactttaacgacgaagcatggaaaaaggcgggcatccccttcccgaaaacctgggatgaactcatggcggcgggaaaaactttcgaaagcaagctcgggaaacagtactacccggtggtgctcgaacaccaggacgtgctggccctgctcaactcttatatggtgcaaaaatacaatcagccggccatcgatgagaaagggcgaaaattctcctacagcaaagcgcagtgggcggatttcttcggtatgtataagaagcttatcgacagccatgtgatgccggacacccgctactatgcctccttcggcaagagcaacatgtacgaaatgaagccgtggatccagggcgaatggggcgggacctacatgtggaactccaccatcaacaaatattccgataacctgaagccgccggcgaagctggtgctgggggaatacccgatgctgccgggcgccaccgatgccggactgttcttcaagcccgcgcaaatgttgtcgattggcaaatcgacgaaaaacccgcaggcggcggcgaaagtgattaacttcctgctgaacagcaaagaaggggtggatattcttggactggagcgcggcgtgccgctgagtaaagcggcggtcacctacctgaccgaggatggggtaatcaaagccgacgatccggcggtgtccggcctgaagctggcgcaatccctgcccaccgctctgccggtctcaccgtacttcgacgatccgcagatcgtcgcccagttcggcaccaccctgcagtacatcgactacggtaaaaagtcggtggaagaagcggccgaggacttccagcgccagaccgaccgcattctgcgccgcgcgatgcgctaa

SEQ ID NO: 4670 - DNA, 1101 bp, Klebsiella pneumoniae
aaaatatggtcgacgaggcggaaacaacccatgagtgagtcagtacatactaactcttcgctgtactcgaaagggatggtggcggtgatctgcgcccagttcctgtcggccttcggcgacaatgcgcttctcttcgccaccctggcgctgatgaagcagctctattatccggagtggagccagccggtcctgcagatgttgtttgtgggcgcttacatcctctttgccccctttgtcggccagttcgccgatagctttgccaaaggccgggtgatgatggtggccaacggcctgaaactgctcggcgccggctgcatctgcttcggcgtcaatccgtttatcggctatacgctggtggggattggcgccgccgcctattcgccggccaagtatggcattctcggcgaactcaccaccggcgataagttagtgaaggctaacggactgatggagtcctcgaccatcgcggcgatcctgctgggctccatggccggcgggatcctcgccgactggcacgtgctggcggcgctgatcgtctgcgcgctggtctacggcggggcggtagtggctaacctgtggatacccaggctgccggcagcgcgtccggggcagtcgtggcgttttaagccaatgacgcacagcttcttcagcgcctgccggacgctgtggcgcaacggcgaaacccgcttttcgctgatgggcaccagcctgttctggggcgctggcgtgaccctgcgtttcctgctggtgatctgggtgccggtggcgctgggcattaccagcaacgccatgcccacctatcttaatgcgatggtggcggtggggattgtgctgggtgccggggcggcggcaaatctggtgaccctggagacggtgtcgcgctgtatgccggccgggattttgatcggtatcgcggtgatagcctttgcggtgcaacagtcgctgctgccggcgttcggtctgctgctgctgctcggggtgttcggcgggttctttatcgtaccgctgaacgcgctgctgcagaacgtgggaaacattcggtcggggcaggtaacgccattgcggtacagaacctcggtgagaacgtggcgatgctgctga

SEQ ID NO: 4671 - DNA, 1833 bp, Klebsiella pneumoniae
cgactccttccagttcatctggaacatttacgccaacaacgacgtggtggtccccaccggcggctgcgacgtctccgcccgcgatgtcaccgtcaccctccccgactacccgggatcgatggccgtgccgctcaccgtccactgcgcgcaaagccagcagctggggtattacctctccggcaccaccgcggacagcgccaacgcgatcttcaccaataccgcctccgcctcgccggcgcaggggataggcgttcagctgacgcgcaacggcagcgccgtcccggcgaacagcacggtctcgctgggcaccgtcggcacttcgccggtcaacctcggcctgacggccacctatgcccggaccacaggccaggttaccgccggcaacgtgcagtcgatcatcggcatcacctttgtctatcaatgatgaccgattatatcctctcgccctgctcgctggccgcccgcgggttgagccagctgatgctgaacgccgcgaggcggcccgttgagctgccggtcgagggcgtgtccctgcgcgaactggccgccgtgaagcggatcgtggtgtatctccctgacgatcccctgtggatgctcaccacgctgcgccaggcggcaaggctactcgacgaggccttgccgccgttaccgatgttgattctgagccgcagcccggccatctggctgtggcaaacgctgctctatcaggtgagtcatccggatcgtctgcgcaacgtccatactgcccccgccgatctgtcctgcgcggagctggcccatcggctggagaatgcgccgcggcttgagcggcttgccggcgaagccgccctgatccacggaaaacgggtcgtcgggttgacccacgccgagctcaaggtgatcctcgccctgctgcaagggcagacgataggcgagcaggcccaacgtctcggattgagccagaaaacgctctacacccagcggctggctggggtgaaaaagctggtggaatgtcatccgcatctggccccccgctttccgcgcacgctgctgccgcgctcacccgcaaacgcactgacggcgtttgaacaggaatgggtacaagcgatccacgatcgccaggtcttcccggtttttcaacctatcgtcgatagtcgctcacagctacagggggtggagatcctgatccgctggcgccaccgcggccaggtacttcacccccagacctttctgccgcacttccgcgccgactacacctggctgctgcttacggcctttgttctgcaggaggccgtgcagaatattaatgagtatccaggcaccttctatttttcggtcaacataccctcctcgctcgccgacagtgacagcatgctgcggatggtggaagccgctcgccagcagcttcggcagccagagggcgtggcaaggctggtgctggaatatgctgaaactttcgattttcgccatcagagccgctccgccgcccacgtggcgcagctgcaacgtgctggcgtgcgcgtgaagctggacgactgcttttctcaggggagcgttatctttccggcgcgtcgactgcacttcaatgcgtataaactggatatgagcatcgtcaacgacgcccagcacgatccaaaggcgcttgcgctaataaaaagcctggcctactactgccagttaagcgacagtcgctgtgtggcggaaggggtggattcactggcgaaatttacgcagttaaaatcgctggggattgatcgcttccagggctatctgttttcaccaccgatgcggcgcgaacatctcccggatctgatccgccgcttttcccaccagcgcgatccggcggatcgttga

SEQ ID NO: 4672 - DNA, 813 bp, Klebsiella pneumoniae
cggcaattgttaatttgcagccctgtgcttcccgcccgatggcgggaagctggcatctgcgcaacgaacggaatatcaagcatgcgcattcctcgcatccatcatccagaacgcctcattgtcggcagccagatcgcgctgagcgatgacgcggccaaccacgtcggccgcgtcctgcgcatgaccgccggtcagcacctacagctttttgacggcagtaaccaggtgtttgacgcggtcatcaccgaggccggtaagaaaaacgttacggttgaggtgctcagtggcgaacctgacgatcgggaatcgccgctgcatatccatttaggccaggtgatgtcccgcggcgaaaaaatggaattcaccatccagaaatcgatcgaactcggggtaagcctcataacgccactgttttccgagcgctgcggcgttaaactggatgccgaacgtttgcagaaaaagatccagcagtggcagaaaatcgctattgccgcctgcgaacagagcggtcgtaacgtggtaccggaaatacgtccggcgatgcagctggaggcgtggtgcgccgagcaggacagcgggctgaagctcaacctgcacccgcgcgccagcgccagcattaacacgctgccgctgccggttgaacgcgtccgtctgctgattggcccggaaggcgggctgtcggctgaagagatagcgatgaccgcgcaataccagtttactgatatcctgttgggaccgcgcgttctgcgtacagagactactgcgctcaccgccatcaccgccctacaggtgcgttttggcgacttaggttga

SEQ ID NO: 4673 - DNA, 1425 bp, Klebsiella pneumoniae
ttttgtcatccatacactcttctcagaggacaaatgatgacgctcttttccagtcaccccggcgacgaaggactacctggcccggcgcgcgcacgggtgatggccgcaataatgaccaccaccttaatgggcgtgtttgatggcaccatgatcaacattgccctgccctccatggctcaggagatgcaggtacctgccagtattgccgtctggttcgccaacgggtatctgctggcggctgcgatgacgctggcgatattcgcggcgcttgcggcccgtctgggttatcgccccgtatttctggcgggcctgacgacctttaccctgacatcactgggttgtgcgctggcgaataagcccgaagtgcttatcggtatgcgcgtgcttcagggtatcggcggcgcggcgacgctgagtattgcccccgcaatactcaggtccgtatttcccggacgcttacttggccgcattctggggttccatgccctgctcattgcctcgagctccgctatcggcccggtattgggcggtacgatccttcacacccttagctggcaatggctgtttgcgataaacgttcttcccggcaccctcgccttactgctggcggtcagagcgctgccgcgggatgcgatccgtatgcaggcgcccttcgacaccgtgggcgccatattgtcggcgctgctgttgggttcgacgatcatggcggcgaacagcctacagaacgctacttctcaattcggcagcctttgctggatggctctcgctgcgctgagcggcatggcttttatctggcaaatccgccgcacgggttctcccttactgccgccgagcatgtttaaaaatgaacgttttaccctcgcggccttcacgtcgatggttgcttttgtcagccaggggatcacctttattgcgctacccttcctgtttcagagcgaatacggctacagtccggtagtgtctgccctgctgtttacgccgtggccattagggatcgtgctgattgcgccgcatgcaggccgttgggcggacacgatatcagccccggcgatatccaccctggggctggtgatatttgtcgtcggtttgatcctgctggcgacgttacccgccagaccttcaatgtgggatatctgcctgcgaagtctggtatgcggaatagggtttggctgctttcagagtcccaataaccgggaaatgctctcaaacgttattcgtgagcacgcgagttatgcgtccggtgttttatccattatgcgcactttcgggcagtgcctgggagccgccgccgtagccgttctgctggcagcagatgaaaggtcaattcatgttgcgctgtggagcgccgccgcggcctctgcggtatcggtcgtcgtcagcgcgagccggttgcgtaaaatcgctcatcctgcggaaacaggataa

SEQ ID NO: 4674 - DNA, 642 bp, Klebsiella pneumoniae
atccttatgtttacttattactttcaggggcttgccctgggagcggctatgatattgccgcttggcccacaaaatgcctttgtgatgaatcaggggatccgtcgtcagtatcatctgatgattgccctgctatgcgcggtcagcgacttgctgttaatctgcgctggcatttttggcggtagcgcactgctgatgcaatccccgtggctgctggcgctagtgacctggggcggcgtggcctttttgctgtggtatggcttcggcgcattgaaaacggcgttcagtcagagtcttgaactcgccaatgcagaggtaatgcagcaggggcgctggaaaatcattatcaccatgctggcggtgacctggcttaatccgcacgtttatctggacacctttgtggtgttaggcagcctgggaggtcagctggcggtggagccgaagcgctggtttgcgctagggaccattagcgcctctttcctgtggttctttggcctggcgctgttagccgcctggctggcgccgcgactgcgtaccgccagagctcagcggatcatcaatattgtggtcggcgccgtcatgtggtttattgcgtttcagctggcaagagaaggcgtcagccatatccaggcgttgcttaactaa

SEQ ID NO: 4675 - DNA, 741 bp, Klebsiella pneumoniae
gtggttgtgttaagtgcaggatgcctgatgatgaaacgcttttatatgacactgatgctggcggcaagcctggtgctggccggctgctccagcacctccgattccggtggcacctacaccgttaaacgcggcgataccctgtacggcatctcccgcaccaccggcaccagcgttcgcgatctggcccgcctgaataacatctccccgccttacaccattgaggtggggcagaagctgaagcttaacggcagcagttcaacgaagacaacgaagaaaaaatcttcctctacgcgcaccgctgcggtcacgccttcgtccgcggtacctcagtcctcctggccgccggtgggacagcgctgctggcgctggccgaccagcggcaaagtggtcctgccttattccaccgccgatggcggcaataaaggtattgatatcgccggaacccgcggccagccggtgtatgccgccggggcgggcaaggtggtctacgtcggcaatcagctgcgcggctatggcaatctgatcatgattaagcacagcgaggattacatcaccgcctatgcccacaacgataagctaatggtgaataatggccagagcgtgaaggccggccagcaaattgccaccatgggcagtacggatgccgactcagtgcggctgcatttccagatccgctaccgggcgacagccatcgatccgctgcgttacctgccgccgcagggaagtaaacctaagtgctaa

SEQ ID NO: 4676 - DNA, 438 bp, Klebsiella pneumoniae
acccggtccccccggcggcctggaaaccccggggtcgacttgaaacttatgttagcaaactgcctgagaaaaatccggctttccggaaaaagtgggtgctcgcctccgaaatcaaccgggcccccggccaaaacagacaccagcaattgggcccaatcacgtcctggaccggcaaaaatttccccgagggcgtggccggccagcttgaagcggttgcagacggattatctcgatttatatcaggttcactggccgcagcggcccaaccaactgcttgggcaagttgggctatacctgggccgactccgcgcccgctgtgacgctgctggacaccctcgaagcgctgaccgagttccagcgcgccgggaagatccgttacatcggcgtgtcgaacgaaaccgccttcggcgtgatgcgttatctgcacctggcggataa

SEQ ID NO: 4677 - DNA, 1152 bp, Klebsiella pneumoniae
ttgaggtgccccaccattgccgccagggtggtcgacttgccgctgcccgtcgctccggtgaccaacagcaaaccactctcttccgccagcagttcgctcagcgcaggcggggcgccgagcatatccagacgcgggcactgttcaggaaggaggcgcagcaccagcgatatcccacgcgtatgggcgaaggcgctggcgcgcagccgcgcaccgcaggccaggttcagcgcaaagtcaatctggccgtgttcctgccagtgcagtaactgtgcggcatcgagccagtcgttgagtaaattcgcaatatccggcgcgggaaagggcgcgggctccagcctgccctgccgccgccagcgcggtgcggcggaattgcacaggtgtagatcggagacattatgctttacactaagggctacgatttcttccagcttcataactcatcctcggaatatgaacgatattgcgcataacctggcacaggtccgggacaaaatctccggtgctgccgcccgatgcgggcgtgcgccagaagaagtgacattgcttgcagtgagtaaaacgaaacctgcgagcgcgatcgaagaagccattgcggcaggccagcgggcatttggtgaaaactacgtccaggagggcgtggagaagattaaccatttccagcaggctggcgtcagcgggctgcagtggcactttattggccccctgcagtccaacaaaagccggttggtggcagagcattttgactggtgccacaccgtcgatcggctgaaaatcgccacccgcctgaacgagcagcgcccggcgcatttaccgccgctgaaggtgctgattcaaattaacatcagcgatgagcagagcaaatccggcatcccgctggaagcgctcgacggcttagcggcggagatcgctgagttacctcatctggaactgcgcggcctgatggccatccccgcgcctgagtcagaatatgtaaggcagtttgccgtcgcccggcaaatggcggtagcatttgcgcgattaaaaacgcggtaccccacggtcgatacgttgtctctgggaatgtcggacgatatggaagccgcaatcgcggcgggaagcacgatggtgcgcatcggtactgccatttttggtgcgcgcgactacagcaaataa

SEQ ID NO: 4678 - DNA, 1356 bp, Klebsiella pneumoniae
aagggtttaccgatgaataaaatctgggtcgggtgttttctgacgtctctgtatctgccatccgttatggcgcaggcgccgttatcgctggaggagcgactggcgcaaatggagcagcggctaaaggcgacggaggcgcgcgccgccagcgcagaggcggaaattaagacgctgaaaggccagcagcaggccgcgacggtcgcccgcgcggcgcctgcttcgccgcgtttgcagctaaatgacaatggcgaattaaaattttatggcgacgtcgaatttaacctcgatggcgccagtcgcaccggcagtctgacgtcggtcaaaaccagcgcgaataaaagctgggcgcccggcgataaagaacgctgggatattaacggtcgtattctgttgggtttcgatggcagacggaatggcgccgacgggcaatatgccggattcagcgtgcagcctctggcggatatggatggcaaaatgaatcttgatgatgcggcatttttcttcggccagcaggatgactggaaaataaaaataggccgctttgaagcctgggatatgttcccgctgaatcaggatacctttattgaatattcaggtaataccgccaacgatctctattccgatggctatggctatatttacatgatgaaagaggggcgcgggcgcagcagcagcggcggtaaccttctgtttagcaaaacggtggataactggtatttcgaagttaacaccctggtggaggacggcagttcgctgtttgtcgatcagaactatcatggtaacgcactggaaaaccgcaaaaatgtggtgtacgtgcggccggtggcggcgtggcagtccggcgcctggtcggcggccgcggcgatagagagcaatctcgtcaacaatgcttacggctatcagagccagagcggacgctgggtcgaccagtcaaaccgcaccggctacgggctgaccatgagctggaacaccctgaaaagcgatccgcaggatggggcggtggtcaatctgagtaccgccctgctggacgcggcggacgaaaccgacttcagcgccgggatcaacgccctttggcatcgcgtggagctgggctatatctacgcgcataacaaaatcgaccagttcaacatggccggggtgagcggcgagtgcgatgacgactgcgcaatcctcgcgccggggcgctatgacatccataccctgcacacctcctggcagttgccgaatattatggcgatgccgaacttcaatatttaccttggcgcctacgcctcgtggctcgattccacggcggcgaagagcgggaatcccgatgaacgctacggcgcccgggtgcgcttcaaatatttcttctga

SEQ ID NO: 4679 - DNA, 711 bp, Klebsiella pneumoniae
tcatcttcaccctgtaccgttttagcattacagaacatttctcgtcatggcgtatggtttcgctgtgacggtcattcatacccattttcaggagcaactattgtgaaccgacgtcgttttttaaccgccaaagaagttcaggccatgatgcaggctgctcgtcagggccctaccggcgaacgggactactgcctcattctgctggcctttcgccatggtatgcgcattagcgaactgctggatctgcattatcacgatctggatctccatgaagggcgggttaatgtgcggcgattaaagaatggtttttcgacgattcatccactgcgttttgatgagcgcgaggcgattgagcgctggagcctggtccgtgccggttggaaagcggcggacaaaacggacgcactgtttatctcccgccgcggtacagcgctctcccgccagcaggcgtatcgtattattcgctccgccggggaaaatgcgggtaccgtcacgcacactcacccccatatgctgcgtcacgcctgcggctatgaactggctgaaagagggacagatacgcgtttgatacaggattatctaggacatcgcaatattcgtcacacagtacgttacaccgccagtaatgcggcacgtttcgctggcatctgggaaagaaataatcttttagaggaaaaagttcagaagacgaaaaatgaaataactgattga

SEQ ID NO: 4680 - DNA, 222 bp, Klebsiella pneumoniae
tcgcgcgcaccaaaaatggcagtaccgatgcgcaccatcgtgcttcccgccgcgattgcggcttccatatcgtccgacattcccagagacaacgtatcgaccgtggggtaccgcgtttttaatcgcgcaaatgctaccgccatttgccgggcgacggcaaactgccttacatattctgactcaggcgcggggatggccatcaggccgcgcagttccagatga

SEQ ID NO: 4681 - DNA, 1485 bp, Klebsiella pneumoniae
ttgagcgcgttcgcgagcgcgggcttggcgtcatcatcatcagtcacaacatggaagacgttcgcgccgtcgccgaccgtatcgtggtgctgcgtctcgggcgcaacaaagggatcttcacgcccgatgcttctaatcaggatctggtcgccgcgatcaccggcgcgacggaaaacgccgtctcacgccgggttgaacgtaaatcacagccaacgacttccggagcgatgtaattttatgaacagtaagaccgcatcccacaccgcgctggatcgcagcgatgagcgcgttcgtcacgacgaggggctgttcggcgccctacgcgcgcagataacccgcatcaaaaccggcgatctcggcaccgcgccggtgatagccgggctgattgtgatttccctggttttcaccttcctcaacccggtctatatcgcgccgaataacctggtgaacctgctgtttgactgcgcgacggtcgggtttatctcgctcggcatcgtctgcgtgctaatgcttggtgagatagacctgtcggtcggctccatgagcggcctggcatcggctatcgtcggcgtgctgtgggtgaacgcaggatggccgctggcgggagccatcgccgtggcgctggcctgcggcgtggccgtcgggttggtctatgcgctgctgtatacccgcgtcggaatgccgagtttcgtcgccactctcgccggcctgctggcgctgctgggtatgcagctgtatatcctcgggccgagcggcagcatcaacctgccctatacttcgccgctggtgcgctttggccaactgctggtgatgcccggctggttctcacacctgatggcattgctgccagggctggcgatccttatttttggcctgaaaaaacgctcgcggcgcctggcggccaatctttccgccgagggagtcagctcgctagtggcgcgcgcgatcgcgctgacgattatcttcgaggccgcggtgctttacctcaatcaggggcgcggtattccatggattttcggtctctttgtcgcctgcgtgatgatcctcaactacgcgctgaaacggacaaaatggggtcgctcgatgttcgcggttggcggcaaccgtgaagcggcgcgccgttcgggcattaacgtgcgggcgatttatgtgagcgctttcgtcctgtgtaccacgcttgcgaccttcggcggcattctcgcggcgtcgcgactggcttccgccagccagcaggccggcaccggcgacgtcaacctcaacgccatcgccgcggcggtgatcggcggcaccagcctgttcggcggacgcggcagcgcctggtccgcgctattggggatcatcgtgattcagtcgatttcaaatgggctgacgctgttgaacctgccgtcttcgctgcgctatatcattaccggcgcggtactggcgattgcggtaatcattgattctctggctcgccgttcacgcgtgtcgcacggccgcgcctga

SEQ ID NO: 4682 - DNA, 1902 bp, Klebsiella pneumoniae
ctgtttcagccagcgtatatctcgcggcaccgccagctccggtacgccgtgctggcgagcgtagcgcagcagagcttcacgagtcagttcattatcggtggtaaacagcaccagcgcctcgcctttgctggcgtcctgtttaatcgccgtggcgtgcattttgtccggcgacgcgccgagggccacctgctccaccatctcgagggagatcatctcgccggcgattttggcgaagcgcttcgcgcggccctgaatgcggacatagccctgctcgtcgaaggtaacgatatccccggtgtcataccagcccgcttccatctcgccgtgctggttttccgccgcaggcgcttccagcacgccggggttttccacccgcaggtagcctttcatgatgttcggccctttcagctgcagccgccccccttgctcaatgcctggcatcgccagcaggcgggcgtccatccccggcaggatgcggcccacggtgccgaccttcgccgccatcggcacgttaatcgagaccacaggcgcgcactcggtcacgccatagccttcgagaatgcgcaggccgaatttatcctgccacagctgtttggtgctctcctgcagcttctccgccccggcgaccacgtagcgcaggcggtagaaatcgtacggattggcgaaacgggcatagttggcgaggaaggtcgaagtgccgaacagcaccgtacagttgcgatcgtagaccagctccggcaccacgcgatagtgcagcgggctgggatagagaaacacttccgccccggtaagcagcggcgtcagcaggccgacggtgaggccaaaagagtggaacagcggcagcgccgacataaagcggtcattggcggtaaagtcggcgatagttttgatctgctcgacgttggacagcagactcttatggctgtgcaccacccctttcggattgccctcggaaccggaggtgaagaggatcatcgccgcgtcttccggctgctgcttaacctgcgccagacgcggcgccagcagatgagcaaaaatccacagtttgtcagcgagggtgatatcgcctttaagatcttccaggaatacccagcgcacctgggtcagctgctccggcaggtgccagagtttgcctttatcgaggaaggtgcgcgaggtgaaaatggtgttgagctccgcggcggctatcgcgctgctgagccctttcaccccggcggtatggttcatcatcgccggaatacggccgcgggcgatagcgccgaaaatcaccgccgcgctgatgccggcgttaggcagcatcaggccgatcttctcgcccggctggctgtatttttccagaatgcgggcgacaaacagggttttggtcagcagcttgcgataggtatccggctggaagttgatatcctccacgcagggtttgcgcgcgccgaagcggtcctgcgccgccagcagcgactcatacagggtttcccgcgggcgcaccgccatccgggcttccatcatgatctgatgcagcatctccccggcgatcttccgccggtcgcgggcgcgcggcgcctcgggcatcggcagatgggtgggcggcaggagatgcagctgaatacgcgggaacaggcgacgtttcaccagccccttcaaccggctgaagggcgtcagttcggcgccttcaatacgcagcggcacaatggtcgcctgcgatttggcggcgacaaaggcggcgccgtcataaattttcatcagcgagccgctgaccgaaattcgcccttccgggaagataaccaccggccgcccctgctcaatcaggcgcaccagatgtttgatcgacatcggcttggtcgggtccagcggcacaaaatcgataatcggcgtcagcgcgcgcataaaccagcgctggctgattga

SEQ ID NO: 4683 - DNA, 1053 bp, Klebsiella pneumoniae
cagggacagccttgcaggagatctatgaccattcgcatcgcgattaatggcttcggtcgcattggacgcaacgtggttcgtgctctatatgaatccgggcgtcgtgcggaaatcaccgtggtggcaatcaatgagctggcggatgccgcgggcatcgcgcatttattgaaatatgacaccagccatggccgtttcgcctgggatgtccgtcaggagcgcgagcagctgtttgttggcgacgatgccatccgtctcctgcatgagccgaccattgcggcgctgccctggcgcgaactggcggtggacgtcgtgcttgactgtaccggcgtatacgggagccgtgaacacggtgaggcccatcttcaggcgggggcgaaaaaagtgctcttttcccaccccggcggcaacgacctcgacgcgacggtggtgtacggcgtaaatcaggatgaacttcgcgccgggcatcgcattgtctccaacgcctcctgcaccaccaactgcattattccgatcattaaactgctcgatgacgcctatggcattgagtccggcaccgtcaccaccattcactcggcgatgcatgaccagcaggtgattgacgcttatcatccggatctgcggcgtacccgcgcggccagccagtcgatcattccggtggataccaaactggcggcagggatcacccgtatttttccgcaatttaacgaccgttttgaagcgattgccgtgcgggtgccgacgattaacgtgacggcaattgacctgagcgtgacggtgaaaaaaccggtaaaagcatgtgaagtcaaccagttgctgcaaaaagcagcacaaggtgcatttcatggtatagttgactatacggaattaccgttggtctcgacagattttaaccacgatccgcacagcgccatcgtcgatggtacgcaaacccgggtcagtggcgcgcatctgatcaaaacgctggtctggtgcgataacgaatggggctttgctaaccgaatgctcgacacgacgttagcgatggcggctattggtttcaggttcgacgcgtaa

SEQ ID NO: 4684 - DNA, 387 bp, Klebsiella pneumoniae
acagcgtggccatcgtctcggccacggcgtatgggacttaatgttcgagagggtgaaataatggccaagaatcgtagccgtcgtctgcgtaaaaaaatgcatatcgatgagtttcaggagttaggcttctccgtcgcctggcgtttcccggaagggaccagcgaagagcagatcgaccagacggtcaacgatctgatcgaagaggtgatagagccgaacaagctggccttcgacggcagcggttatctctcctgggaagggctcatctgcatgcaggagattggtaagtgcactgaagagcatcaggctatcgtacgcaaatggctggaagcgcgtaagttagaggatgtgcgcaccagcgaactttttgacgtctggtgggactaa

SEQ ID NO: 4685 - DNA, 711 bp, Klebsiella pneumoniae
aacgttattaccacgctgtttcaaaataaaaaggcagtcaaatttaacaatgacctgacgcaggctcggaaaaccaaaaatatgcctgcaataaaagggaaaaccatgacgaataacgccgacataaaaaaaaggaacttcctgactcagaatgaaattgagtctttacttaaagcggccgataccggtccttatgctgcacgtaattattgcctgacgttactgtgcttcatccatggtctgcgcgccagcgagatctgtcgtctacgaatatcggatatcgaccttgctgcccgatgtgtttacatccatcggcttaaaaaagggttttcgactacccacccgttgctggataaagagatctacgccctaaagcgctggctggccattcgcagcagctggccgcaggccgccagcgaatggctgtttctctcccgcaaaggtaatcccctttcccgccaacagttttatcagattatcgcgtcctcagggggactggcggggctgtcactggagatccacccgcacatgctgcggcactcctgtggctttgcgttggcgaatatgggaatcgatacccgcttgatacaggattatctcgggcatcgcaatatccgccacaccgtctggtataccgccagcaatgcgggacgcttctatggcatctgggacaatccccgtgacaaacagcgatcgtcgctgatccaatag

SEQ ID NO: 4686 - DNA, 291 bp, Klebsiella pneumoniae
tcagccgccacggcgagggctatgcttagcctgaaagataaaaacgaccgaggcaatgtcatggataaggaattactggaagccggctaccgggcctacaccggggagaaaatcgacgtctactttaatacggcgatctgtcagcattccgggaactgcgtgcgcggcagcgcgaagctcttcaacctgaagcgtaagccgtggattatcccggatgaagtggatgtcgcgacggtggtaaacgtgattgatacctgcccgagcggcgctctgcaatatcgtcataaataa

SEQ ID NO: 4687 - DNA, 921 bp, Klebsiella pneumoniae
gcggattacacttacggcttagccaccgtgaggagagttcttatgtccagtgtcaccttatccggtcgcggcacgctcggcgatcgccaggtctatcgcttaggttacggcgcgatgcagctggccggccccggtgttttcggcccgcccaaagatcctgaagaagcggtgcgcgtactacaggccgccgtcgaggccgggataaaccatatcgatacctctgatttctacggtccacatgtcaccaatcagttgatccgcaaagcgctccacccctaccctgacgatctgtgcattgtcaccaaggtcagcgcccgccgtgacgagaaaggcaactggctaccggccatgtcgcccgccgaactgacccaggccgttgaagacaatttgcgtcacctggggcttgaggtactggaagtggttaatctgcgcagtatgctgagcccgcacggcccggtggagggttcgctggaggcgccactcgccaccctgctggaactgaaagagcgaggattaatccgccatatcggcctcagcaacgtgacggcaaagcaggtcgcggatgcgcagaaaatgacgcccatcgtctgcgtgcaaaatctttataacgttgcccatcgcgccgacgacgcgctggtggatgcgctggccgcccagcacatcgcctgggtgccctttttcccgctgggcggttttacgccgttgcaggcgcaggagttgaacgaggtcgcggcttcgcttgaggcgacgccgatgcaggtcgccctcgcctggctgctccagcgagcgccaaatattctgctgatccccggcacctcctcccgcacgcacctcgcggaaaatattgccgctgccgagctggtcctgcccgcggaagcgctgcgcaccctcgataatatcgccaccgccgcgcgccgctga

SEQ ID NO: 4688 - DNA, 660 bp, Klebsiella pneumoniae
accgcgaacaccttctcgccaccctgtccgccgctaaaggaaaataacatgagagctatcaccgccttattactgctgtgcgtatcggccttcagtttcgccgccccggcggaaggaccacaatcgaacggtaatgaccagttagcccagctgctgtttaacgatccgaatagcccgcgcaccggcgcgaaagagccaaaactcacaatcgtctcgtttaccgattacaactgcccttactgcaaacagtttgatccgctgctggaaaaaatcgtccacgataatccggacatccagctcatcgttaagctgctgccgtttaaagggcagagttcggtgaatgccgctaaaatcgcgctctccacctggcgtcagcagcccgataaattctgggcgctgcatcagcggctgatggcgaaaaaaggctatcacgatgatgccagtatcgccgccgcgcagaagaaaaccgctaccgatagcgtaaatatcgatgacaagaccatggattcgctgaagatgaacctgattttgtcgcaggtgctgaatattcagggcaccccggcaacgatcatcggcgatcagatggtggccggcgcgatccctgctgatgagctggaggggctggtgaaagagcagttggcgaaagcccgtggccagtaa

SEQ ID NO: 4689 - DNA, 315 bp, Klebsiella pneumoniae
tataaggacacacctatgccagcagtcattgataaagcattggatttcatcggtggtatgaatacgtctgagccagtaccacagtctatggatgaaagtaccgcgaagggaattctcaaatatttaaaagaactaggcgtacccgccaccccggccgacgtcgctgcgcgcggccaacagcagggctggagcgctgggtttaccgataaagtggcggagtgggctgaacgggtcgccgccggcgaacggctggtgataaagcatccggaattcttttccacctatatgcgggaagagctgcgcgccctggtgtaa

SEQ ID NO: 4690 - DNA, 1482 bp, Klebsiella pneumoniae
cctccctgcacgctgctggacttaacgctaatgactacggggcgtattcccgagcgtggtctgagagcaacgcagaggcacgtagagaagctgagcgtcagcgcattgagaacgagaaagaccgtcagcgcatcgccgctatgtatgcaacccctgaagaaatcgctaaagaggccgcagagcgtaaggaacgtaaggcagaccttgagcgtcgcttcagccgtaaaggcgctgcattcggtctgtaagttcaacggactaacggcattgtgggtcagaactcatggtgtcgcaccaacactagcaaggctggcaacatcaatctcatccaaattaaatacaaggaggcatcccatgccagaagtaaaacgtatcgactcgaacaattcaaagattaaacacaccgacgaactccgcgcccatctgctggataaagaaggtaacaagattccacatagcgtctttggcactgacaccacgcgcaccgagattatctctcaggttgacggtacaggcgagactatgaacgttggcttcactgaccgctcaggccgcccgcaggcattcggtaatgacgtgactgattacgttcaggcccttgagtctgcacttgatgagacgcttaatgatggtgattttatcgatgggttgaataccgaagtattcccctgtgagcagcgcccatttgctactctaccgactccgattaaccgtgagaccctgaccgatcgcaccgtccgcttcctgtctaacggcgtgtataacccagctaagaacgccccgaccactaaggtgaaaggcggtcagaccctgatggttaaccctgtgattgccgataaggacgctaaagaaactggtattctgtgttcagcgattacccatgtgtccgactttgcgatgatgggcggctggactggcgctggtctgatggctacggctaccgatatggttgaccagtatctgcgtaacatgacctctaaagttgtcgatgtgctgctggatgctccagaccttcagtcagccaaagtgggcgcattgtctggcaaagcgtcagcacaagccgatgacattctggatgctgtagcggtgaacctgccgttctaccttggctcctcactgaccgattacactctactggtcccagagaagtacgaagctatcctcaatcgtgcagcccagaaagcgggtatgaccgagattagcgaactggtaggcactgccgttgcgccttacagtggtgatgaccgtggcgttatcattctaccgaagaagtacgctatgttatctttccgctcaacccgcagcggcgacctcgttaacgtgttggtaactcgtgacgctaaccgtgcaggctatgacgtcgaactggtaggcgcactagatgtcatggcaacgggcaccgttaaggttaaggctggagcgttcgacactgaggcggctgctagttatccgctggtccacgtcctgaagtttgaagactaa

SEQ ID NO: 4691 - DNA, 1233 bp, Klebsiella pneumoniae
  unsure (345): Identity of nucleotide at the above locations are unknown.
acccggagcaccgcaaactgcttgagcaggagatggtgcagttcctgtttgaagggaaagacgtgcacatcgaaggctacacgccgccggaaaaacagtaagggccctgcggcctttaaaaaaacaaacacaacacgcacgcccggaatgatgaaaaaatacttagcgctcgcgctgattgcgccgttgctcgtttcgtgttccagctccaataaaaaaggcgccgaatacaacgaggcctgggtcaaggacacgaacggattcgatattttgatgggccagttcgcccacaacatcgagaacatttgggggtacaacgaagtcctgctcgccgggccaaaggantacgtcaagtacaccgaccagtatcaaacccgcagccacatcaacttcgatgaagggacgatcaccgtcgagaccattgccggcaccgaccctcgcggacgtctgcgccaggcgatcgtcaaaactctgttgatgggcgatgaccccaactccattgacctctattccgatgtcgatgacatccagatctccaaagagccgttcctctatggccaggtggtggataacaccggggcgtcgattcgctgggagtggcgcgccgcgcgctttgccgactatctgctgcaaacccgtctgaagagccgcaacaacggcctgcgcgtggtctatagcatcaccattaacctggtgccgaaccacctcgacaaacgtgcgcataaatacctcggcatggtgcgtcaggcctcgcgtaagtatggggttgatgagtcgctgatcctcgcgattatgcagaccgaatcctcctttaacccctatgcggtcagccatgccgacgccatggggctgatgcaggtggtccagcacagcgccggcagagacgtcttccgctcccagggtaaatccggcctgccaagccgcagctatctgtttgacccggcgaataatatcgacaccggtaccgcctacctggcgatgctgaacaatgtttacctcgccggcatcgataaccccacctcgcgtcgctacgcggtgatcactgcctataacggcggcgccggcagcgtactgcgggtcttctccagcgataaagtgcaggcggccaatattatcaacagcatggcgccaggggacgtctaccagacgctgaccacccgccatccgtcggcggaatcgcgccgctatctgtacaaagttaatacggcgcagaaaagctaccgccgtaaatag

SEQ ID NO: 4692 - DNA, 2046 bp, Klebsiella pneumoniae
cagttcaggttaattcatcacttacggagcaaacttatgtatatggtattcaggcgactactggtctgcctgctttggctatggctgcccgtcagccaggccgccgacagcggctggctgcgcgccgccgacaatcaacacgccagcgtgcgcctgcgggcgcaaaccgagagcaatggcgacactcgcctgcttttagacgtagcgctggaaaagggctggaaaacctactggcgctcgccaggggaaggcggcatcgcgccggctatcgcctggcacacgccgctggaggtgaactggcgctggccgacgccgcagcgcttcgacgtcgcgggcatttccactcagggctatcacggcgacgtcagctttccgatgacgctgcgcgggaagataccgccgacgcttagcggcgtcctgacgctctctacctgcagcaatgtctgtattctcactgactatcccttttcgctggatatgacgactccggcgggggagcgatttaattatgattttacccgcgcgatgggcacactgccgcagcgcgatggcctgacttcgcagctgaccgccagctacatcagcggcaaactgacggtgaccgcccgccgcaatgccggctggcagcagccagcgctgtttatcgacagcatggaggatgtcgatttcggtaagccgagctttaccagccgcggcgatacgctgaccgccaccataccggtcaccgatagctggggcgaagcggcgccggatctgcgcggtaaaaccttgtcgctggtgctggcggatagcggccaggcgcaggaaagccaaatcgccgtcgccgccggcagcgccgcgccggggctggcgttaggctgggtgctgctgatggctctggccggcgggcttattctcaacgtcatgccctgcgtgctgccggtgctggcgatgaagctcggctcgctggtgcaaaccgaaggtcgcgaacgcggcgcggtgcggcggcagttcctcgcctcggtatttgggatcgtcgtctcgttcctggcgctggcgctgatgatgaccgcgctacgcctggggaatcaggcgctcggctggggcatccagttccagaacccgtggtttatcggcgcgatggcgctggtgatggtgctgttcagcgccagtttattggggctgttcgaaatccgcctctcctccagcgccagcactttcctcgccaccaggggcggcaacggcttaatgggccatttctggcagggcgcctttgccaccctgctggcgacgccctgtaccgcgccgttcctcggcaccgccgtgtcggtggcgctggtggcgcccctgccgctgctgtggggcattttcttcgccatggggatcggcatgagcctgccgtggctgctgatcgtcgcctggccgggtctggcgcaacgactgccacgcccgggccgctggatgaatcatctgcgggtggtgctggggctaatgatgcttggttcagcgctatggctggtcagcctgctgacgatccacatcggccgtacgccggtgcttaccctgctggtgattctggccatcgccctgctagtggccaccgcctggcgctaccgctggcggacggcgctgcgcgcgggcgccctggccatcgtggtggcgggcgccgtcgcctttgtcgcccaacaggacggccagggcccgcgccgggaccgggttaactggcagccgctcagcgagcaggctatcgccagcgccctggcggagcataagcgggtatttattgatgtcaccgccgactggtgcgtgacctgtaaagccaacaaatacaacgtgctgctgcgcgacgacgtccagcaggcgctgttagcgccagacgtagtcgccctgcgcggcgactggagccgcccctccgctgacattagtcagtttttaaccgcacgcggcagcgccgcggtgccgtttaaccagatttacggaccggaattgccgcagggaaagattctgcctgcgctgttagaccgcgaacaccttctcgccaccctgtccgccgctaaaggaaaataa

SEQ ID NO: 4693 - DNA, 924 bp, Klebsiella pneumoniae
gagcgtttaacgaacaaagaggccgatgtgaaacaggatctggcactaatcgaacagtttctcgatgccctttggctggagcgcaacctggcggagaatacgctcagcgcctaccgtcgcgatttgacgatgttagttgagtggttgcaccatcgcggcctgtcgctggcaagcgttggcagcgacgatctgcaggcgctgctggctgagcggcagtccggcggctacaaagccaccagcaccgcgcgcctgctgagcgccgtgcgccgttttttccagcatctgtaccgggaaaaaattcgcccggacgatcccagcgcgctgctggcctcgccgaagctaccgcagcggctgccaaaagatctcagtgaggcgcaggttgagcgcctgctgcaggcgccgctggtggagcagccgctggaattgcgcgataaagcgatgctggaggtgctgtatgccaccggcctgcgcgtctcggagctggtggggctgacgatgagcgacatcagcctgcggcagggcgtgctgcgggtggtgggaaaaggcaacaaagagcggctggtgccgctgggggaagaggcggtactgtgggtggaaaattacctcgagtatggtcgcccctggctgctgaacggcgtggcgtcggatgtcttatttcccagccagcgcgcccagcagatgacgcgccagaccttctggcatcggattaaacactatgccgtactggcggggatcgacagcgaaaagctttccccgcacgtgttacgccatgcgttcgccacgcatttgctcaatcatggcgccgatctgcgcgtggtgcagatgctgttaggacacagcgatctctccaccacgcagatatacacccacgtggcgaccgagcgtctgcgacaacttcatcaacagcaccacccgcgggcgtga

SEQ ID NO: 4694 - DNA, 1992 bp, Klebsiella pneumoniae
aaattgaggttcgctatgtctgacgacatgtctatggtttcgccttcgtcagcaggcgaacacggtgtactacgttccatgcaggaggtagcgatgagctcccaggaagccagcaagatgctgcgtacttataatattgcctggtggggcaataactattatgacgtcaacgaactgggccacatcagcgtttgcccggatccggacgtcccggaagcgcgcgttgacctcgcggaattagtcaaagcgcgtgaagcgcaagggcagcgcttgccggcgctgttctgcttcccgcagatcctgcagcaccgcctgcgctcgatcaacgccgccttcaaacgcgcgcgtgaatcgtatggctataacggcgattacttcctcgtctacccgatcaaggttaaccagcaccgtcgcgtgattgaatcgctgatccattccggagagccgctgggcctggaagccggttcgaaagcggaactgatggccgtgctggcgcacgccgggatgacccgcagcgtcatcgtctgtaatggttataaagaccgcgaatatatccgtctggcgctggtgggcgagaagatgggccacaaggtctatctggtcattgagaagatgtccgagatcgctatcgtactggaagaggccgagcgcctgaacgtggtgccgcgccttggcgtacgtgcgcgtctggcctcgcagggctccggtaaatggcagtcctccggcggcgagaagtccaagttcggcctcgcagcgacccaggtgctgcaactggtcgaaattctgcgcgaggcaggccatcttgagagcctgcaactgctgcacttccacctcggttcgcagatggctaacattcgcgatatcgccaccggcgtgcgtgaatcggcgcgtttctacgtcgaactgcataagctgggcgtcaatattcagtgcttcgacgtcggcggcggcctgggcgtggactatgaaggcacccgctcgcagtccgattgctcggtgaactacggtctgaacgaatacgccaacaatatcatctgggcgatcggcgatgcctgcgaagagaatggcctgccgcacccgacggtgatcaccgagtccggccgcgcggtgaccgcgcaccataccgtgctggtttccaacatcatcggcgttgagcgtaacgaatacaccgaggcgaccccgccggcggaagacgctgcgcgtccgctgcagagcatgtgggaaacctggctggagatgcacgagaccggcaaccgccgctcgctgcgcgaatggctgcacgacagccagatggacctgcacgatatccacatcggctactcctcaggcaccttcaacctgcaggagcgcgcgtgggcggaacagctgtatctgaacatgtgccatgaggtgcagaagcagctcgacccgagcaaccgcgcccatcgtcccatcatcgatgagctgcaggagcgaatggcggataaaatctacgtcaacttctcgttgttccagtcgatgccggatgcctgggggatcgatcagctgttcccggtgatgccgctggaagggctgaacaagtcgccggagcgccgcgcggtgctgctggacatcacctgcgattccgatggcgccatcgatcactacgtggacggcgacgggatcgccaccaccatgccgatgccggaatacgacccggagaacccgccgatgctgggcttcttcatggttggcgcctatcaggagatcctcggcaacatgcataacctgttcggcgataccgaggcggtggacgtgttcgtcttccctgacggcagcgttgaggttgagctgtccgacgagggcgataccgtggcggatatgctgcagtatgtgcagctggatccgaatacgctgctgacccagttccgcgatcaggtgaaaaataccggtctggacgacgcgctgcagcagcagttcctcgaggagttcgaggcgggactgtacggctatacttatctggaagacgagtag

SEQ ID NO: 4695 - DNA, 252 bp, Klebsiella pneumoniae
gggtctgtaaccatgaagaccttaccagaagcgttaccagacctaccgcccacttacagtgtagacgtgaagattgacccacgtacacctgaaggccgtaaagctatgcgcctactggatgtgcctacagccatactcgtagccgcgctgggtctcccgccgaagcacacccggcccgacatgtattactcgaaaggtgcgctgtgtctcatggcgaccgctgaagggttgaccccgatggacttcaagtaa

SEQ ID NO: 4696 - DNA, 2919 bp, Klebsiella pneumoniae
gtagagacaaccacgattcaccgcacgtttcaggaaccatcgctcatgactcagactttaagtcagcttgaaaaccgcgacgcctttattgaacgtcacattggcccggacgctcagcaacagcaagagatgctgaagaccgtcggcgcggattcgcttaacgccctgatcggccagattgtgccgcaggatatccagctggcgaccccaccgcaggtgggcgacgcgactaccgaattcgccgcgctggcggagctgaaggcgattgccagtcgcaacaagcgcttcaagtcttacatcggcatgggctataccgccgtgcagctgccgccggtcattcagcgcaacatgctggaaaacccgggctggtataccgcctataccccttaccagccggaagtatcccagggccgtctggagtcgctgctcaacttccagcaggtcactctggatctgaccgggttggatatcgcttccgcttcgctgcttgatgaagccaccgccgccgccgaagcgatggcgatggccaaacgcgtcagtaaactgaagaacgccaaccgcttcttcgttgccgccgatgtccatccgcaaaccctggacgtggttcgcacccgcgcggaaactttcggcttcgacgtcatcgtcgatgacgccgacaaagtgctcgatcaccaggatgtctttggcgtgctgctgcagcaggtgggcaccaccggcgaaatccacgattacagtaaacttatcgccgagctgaaagcgcgcaaagtgattgtcagcgtcgccgccgactttatggcgctggtgctgctgacggcgccgggcaagcagggcgcggatatcgttttcggttccgcccaacgcttcggcgtgccgatgggctacggcggcccgcacgcggccttcttcgcggcgaaagatgaattcaaacgctccatgccgggccggattatcggcgtatcgaaagatgcggcggggaataccgcgctgcgcatggcgatgcagactcgcgagcagcacatccgccgtgagaaagcgaactccaacatttgtacttcgcaggttctgctggccaacatcgccagcctgtacgcggtattccacggcccggcgggcctgaaacgtatcgctggccgcattcatcgtctgaccgacattctggccgacggcctgcagaagaaagggctgaagctgcgccatgcccactacttcgacaccctgtgcgtcgaagtggcggataaagccgcggtgctggcgcgtgccgaagccctgcagattaacctgcgcagcgatattcacggcgcggtgggcattacgctcgatgaagcgaccacccgcgaagatgtgctgaacctgttccgcgccatcgtcggcgacgatcacggtctggatatcgataccctggataaagacgtggcgctggatagccgttcgatcccggcggcgatgctgcgcgacgatgcgatcctcacccatccggtgtttaaccgctaccatagcgaaaccgagatgatgcgctacatgcacgccctggagcgtaaagatctggcgctgaaccaggcgatgatcccgctgggctcctgcaccatgaaactgaacgccgcggcggagatgatcccgatcacctggccggaattcgctgagctgcatccgttctgcccggtcgagcaggcggaaggttatcatcagatgatcgcccagctttccgactggctggtgaaactgaccggctatgacgccgtctgtatgcagccgaactccggcgcgcagggcgagtatgctggcctgctggcgattcgccattatcacgagagccgcaacgaaggccatcgcgatatctgcctgatccctagctccgcgcacggcaccaacccggcttccgcgcagatggcgggtatgcaggtagtggtcgttgcctgtgataaaaacggcaacatcgatctcgccgatctgcgtgaaaaagcagagcaggcgggggccaatctctcctgcatcatggtcacctatccgtcgacccacggcgtgtatgaagagaccattcgcgaagtgtgcgagatcgtgcaccagtttggcggccaggtttatctcgacggcgccaacatgaacgcccaggtcgggatcacctctccgggctttatcggcgccgacgtttcgcacctcaacctgcataaaacgttctgcattccgcacggcggcggcggcccgggcatgggcccaatcggcgtaaaagcgcacctggcgccgttcgtgccgggccacagcgtggtacagattgaaggtatgctgacccgccagggcgcggtttccgccgcgccgttcggcagcgcgtccattttgccgatcagctggatgtatatccgcatgatgggcgcggaagggctgaagcaggcgagccagaacgcgatccttaacgccaactacatcgctacccgactgaaagacgcctacccggtgctctacaccggtcgcgatggtcgcgtagcgcacgaatgtattctcgatattcgtccgctgaaagaagagaccggcattagcgagctggatatcgccaagcgcctgatcgactttggcttccatgccccgaccatgtctttcccggtagcggggacgctgatggttgagccgacggaatcggaaagcaaggtcgagctggaccgctttatcgacgcgatgctggcgatccgcgcggaaatcgaccgcgtcaaagccggcgaatggccgttggaggataaccctctagtgaacgcgccgcacacccagggcgagctggtgggcgagtggaaccatccgtacagccgcgagctggcggtattcccggcagggttgcacaacaagtactggccgacggtgaaacgtctggatgatgtctacggcgaccgcaacctgttctgctcctgcgtgccgatgagcgaataccagtaa

SEQ ID NO: 4697 - DNA, 600 bp, Klebsiella pneumoniae
cccggcgggtttgtgccgggtcattttttattttcaggagtcgtcatggccggggaacacgtcattttgctggatgagcaggatcagcctgccggtatgctggagaagtatgccgcccatacgtttgatacccctttacatctcgcgttttcctgctggctgtttaaccagcagggtcagttgctggtcactcgccgttcgttgggcaaaaaagcctggcccggggtatggaccaactcggtctgcggacacccccagcagggcgagaccttcgagcaggccgtcacgcgccgctgtcgcttcgaactcggtgtggagatctctgatatcgcgccggttcacccggccttccgctaccgggcggtcgccccaaacggtatcgttgagaacgaagtgtgcccggtatatgccgcgcgcgtggtaagcgaagtgcagcctaacgacgatgaagtcatggactatcagtgggttgacctggcaaccatgttaagcgcgctggccgccacgccgtgggcgttcagcccgtggatggtgctggaagcggaaaatcgggacgcccgccaggcgctgaccgactttgttgcgcgtctgcgcgggtaa

SEQ ID NO: 4698 - DNA, 783 bp, Klebsiella pneumoniae
catggagaaacgacagtgaagttaaaagtcttagccctggcggcaacactcggattgaccacgatggcggcacaggccagcgaattgccggatggcccgcatattgtgacttcaggcacagcaagcgttgccgcggttccggacatcgccaccctggcgatcgaagtgaacgtgtcggcaaaagacgccgcgtcggcaaaaaaacaggctgacgatcgcgttgcgcaatatctctctttcctcgaaaagagcggtattgctaaaaaggacatcaactcggcgaatctgcgtacccaaccagattacgactatcagaacgggaaaagcattctgaaaggctatcgcgcggtgcgcacagtggaagtgaccttgcgccagctggataaactcaacggtctgctggatggcgccctgaaagcggggctcaacgaaattcgctccgtctcgctgggcgttgcgcaaccggacgcctacaaagataaagcgcgtaaagcggcgatcgacgacgccgtgcatcaggcgcaggagctggccgcaggcttccacagcaagctgggtccggtgtacagcgtgcgctaccatgtctccaactatcagccgagcccgatggttcgcatgatgaaggccgctgacgctgcgccggtttctgcccaggaaacctacgagcaggcgactatccagtttgacgaccaggtcgatgtagtctttgagctgcagccggcgcaagccgctgctccagccaccccggcgaaaccggcggaaacgccgaaaccggcccagtaa

SEQ ID NO: 4699 - DNA, 1347 bp, Klebsiella pneumoniae
tttcaaagaacacgctcacgttatgggacatcgcgcattgtgaaaaggggattttgttctgctggggcggggattggacaaaaaacaagccggccccgtagggccggcctgaggatcgcgtcaggcgttgctgagggatttttgcgcggcgctggaccggctgttctccagcatccggcggaccgggacaatcagcacggccagcacggcggcgcagatcagcaatgcgatggagcagcgggcgaagaggtccggcagcagcgacagctgatcggccttcacatgaccgccgatcaggcccgccgccaggttacccagcgcgctggcgcagaaccacagccccatcatctggccgcgcattctctccggcgccagcagagtcatggtcgccagcccaatcgggctgaggcacagttcaccgagcgtcagcatcaggatgctgcccaccagccacagcggcgacacaccggccccgccgttgctcaggacgttctgcgccgccagcatcatcaggccaaagcccgccgctgcgcacaggataccaatgacgaatttggtcatactgcccggacgaacgtttttacgcgccagcgcaggccacgcccagctgaataccggcgcgaggagaatgataaacaaggcgttaatcgactggaaccagaccgcggggatctcaaaatcgccgatcatccggttggtgtagtcgttagcaaacaggttgaaggaggtcggtttctgttcaaacgcggaccagaaaaaggccgccgagaccagcaaaataaagcataccagcaggcgcgcccgctctttacggttgagtccggcgaagacgaacagccagatgaaatagagcgccacggaggcggcaatcacatagaccagcacgctggccaccgccaccgggttaatcacgatcgtgcccaggctgataagcgtgaccagcaccgccactcccagagccagcgccagcagccacgctccaacgccattctttttcgccaccgggctgttccaggtggaatcgaggccaacctccgcgtcatagcgcttcatcgacggtacggcaaagacacggaaaatgatcagcgccaccagcatcccgatccccccgatgccgaagccccagtgccagccatgcgatttgataagccagccagagatcaatggcgcgataaacgagccgatgttgatccccatgtagaacagcgaaaaaccaccgtcgcggcgcgcgtcgccctttttatacagggtgccgaccatcaccgagatacaggttttaaacaacccggaacccaggacgataaacatcagaccgataaagaacagatcgttgcccagccatgctga

SEQ ID NO: 4700 - DNA, 963 bp, Klebsiella pneumoniae
cggagaagaaccatgatcaagctcggcatcgtgatggatcccatcgcaaccatcaacatcaagaaagacaccagcttcgctatgttgctggaggcgcagcgtcgcggctatgaactccattatatggagatgaacgacctctatttgatcaacggcgaagcccgcgcccggacgcgcacgctgagcgtcgaacagaactacgataaatggtatgactttaccggcgagcaggatctgccgctggcggaccttgacgtcatcctgatgcgtaaggatccgccgtttgataccgaatttatttatgccacctacatcctggagcgggcggaagagaaaggcacgcttatcgtcaacaagccgcagagtctgcgcgactgtaacgagaagctgttcaccgcctggttctctgaactgactccggaaacgttggtcacccgcaataaagcccagctgaaagccttctgggaaaagcacggcgatatcatcatgaaaccgctcgacggcatgggcggcgcctctattttccgtgttaaagccggcgatccaaaccttggggtgattgccgagacgctgaccgaactgggcagccgctactgcatggcgcagaactatctgccggccattaaagatggcgacaagcgcgtgttggtagtggatggagagcccgtgccttactgcctggcgcgaattccgcagggtggcgagacccgcggcaatctggccgccggcggccgcggcgaagcccgcccgttgaccgaaagcgactgggaaatcgcccgccgcgtcggcccgacgctgaaggccaaaggccttatcttcgtcggcctggatatcatcggcgaccgtctgacggaaattaacgtcaccagccccacctgcgtacgcgaaatcgaagccgccttcccggatatttcgatcaccggtatgctgatggacgctatcgaaagacgtatcgataaataa

SEQ ID NO: 4701 - DNA, 1032 bp, Klebsiella pneumoniae
tcgcttatgacaacttcccgcacttctctgttacgcaaaaagtggcctctgctggcgctggtccttgccgccatcctggcgctgatcctcgttatctggcagttgcaaacctcgccggagaccaatgacgcctatgtctatgccgataccatcgatgtagtgcccgaggtcagcggacgcatcgtggagatgcccattcgcgataaccagcgggtgagaaaaggcgatctgttgttccgcatcgacacccgcccctatcaggcaatgctcgatgacgcgaaagcccggctgacgaccctcgacgcgcagatcatgctgacccagcgcaccatcaaagcgcaggagtataacgcccagtcggtggcggccgccgtcgagcgcgccagagcgctggttaagcagaccacctccacgcgtatccgccttgagccgctggtgccgcaggggttcgcttcccaggaagatctcgatcaggcgcgcaccgctgagaaagcggcgcgggcggagctggaggccacgctgctgcaggccaaacaggcctcggcggccgtgaccggcgtggatgccatggtggcgcaacgcgccggggtcctggcgcaaatcgccctcgctgaactgcatctggaatttaccgaagtgcgcgcgccgttcaacggcgtggtggtggcgctgaaaaccaccgtcggccagtacgcctcggcgctgaagccggtcttcaccctgctggatgacgagcgctggtatgtgatcgcgaacttccgcgaaaccgacctggacaacgtgcgccctggcgtggcggcgcggatcaccgtgatgatcaaccacaaccggacctttaacggggtggtggattcggtcggctccggggtcctgcccgaaggtgggagcgtcatcgaagggctgccgctgatccagaaaagcattaactgggtccacgtctcgcagcgcttcccggtgaaaatcgccgtcagcgatcccgacccggaactgttccgcatgggcgcctcggccagcgccgtgctgcagccgtag

SEQ ID NO: 4702 - DNA, 297 bp, Klebsiella pneumoniae; identical to SEQ ID NO: 2022

SEQ ID NO: 4703 - DNA, 2220 bp, Klebsiella pneumoniae
atccgtcagacccggacacatcgttgggcaaggtctcccttgtctgaggtttttacactcccgatacgggcatttgcgcttatgaaatccatgcacattgccgccagctgcgagctggtcacccgcttgtccacccaccgtcgcgttgtggcgctggacagtaccgattttaccgatgtggcggcagtcgtcatctccgtggccgacagtcgcagcggcatccttactctcctcaggcgtagcggatttaacctgccggtctacctgctgagtgagacggcggtcgacaagccggagggggtgcaggcggtgatcgccggtaaagatcaggagtggctggagctggaggcggcggcctgtgattatgaagcgcgtctgctgccgccgtttttcaataccctgacccagtacgtcgagatggataacagcacctttgcctgtccggggcatcagcacggggcgtttttcaaaaagcaccctgcaggccgtcagttctatgacttttttggcgaaaatgtctttcgcgccgacatgtgcaacgccgatgtgaaattaggcgatctgctgatccacgaaggatcggccaagcacgcgcagaagttcgctgcgaaggtgttcaacgcggataaaacctacttcgtcctcaacggcacctcggcggccaacaaagtcgtgaccaacgcgctgttgacccgcggcgatctggtgctgttcgatcgcaacaaccacaagtcaaaccatcacggggcgctgatccaggcgggggcgacgcctgtttacctggaagccgcgcgcaatccgttcggctttatcggcggcattgacgagcgctgctttgatgagcattacctgcgggatctcatccgcgaagcggcgcctgagaaagccaatgcctcccgcccgtttcgtctggcggtgatccagctggggacctacgacggcacggtctataacgcccgccaggtggtggataagatcggccacctctgcgattacatcctgttcgactcggcgtgggtgggctatgagcagtttatcccgatgatggccgactgctcgccgctgctgctggagctgacccccgacgatccgggtatttttgtcacccagtccgtgcacaagcagcaggccggcttctcacagacgtcgcagatccataaaaaagataaccatctgcgcggccaggcgcgcttctgtccgcacaagcggctgaataacgcctttatgctgcatgcctccaccagcccgttctatccgctgttcgccgcgctggacgtcaacgctaaaatccacgaaggcgagagcggccgccgcctgtgggccgagtgcgtggcgctgggcatcgaggcgcgcaaagcgatcatcgctaactgcaagatgatccagccctttattccgccgacggtggcggggcgcccgtggcaggatcacccgaccgaggcgatcgcccgggagcgccgcttcttcagcttcgagccgggcgcgcgctggcatggttttgagggctatgcggacgaccagtattttgtcgacccgtgcaagctgttgctgaccaccccgggcatcgacgcggagagtggggagtacagtgagttcggcattccggcgactattctggcgcattatctgcgtgaaaacggcatcgtgccggagaagtgcgatctcaactcgattctgttcctgctgacgccggcggaaagtgccgaaaaaatggcgcagctggtagcgatgctcgggcagtttgaacagcatattgaagcggatacgccgctggccgatgtgttgccgaccatctataacaaatatccggtgcgttatcgcgactataccctgcgcgagctgtgccaggagatgcacgatctgtacgttagctttgacgtgaagagcctgcaaaaagagatgttccgtaaacggagcttcccaagggtggtgatgaatccccaggatgccaaccacgagtttattcgcggcaacgttgagctggtgcgtctgagcgaggcggaaggccgcgtcgcggcggagggggcgctgccgtatccgccgggcgtgctgtgcgtggtgcccggcgaggtctggggcggcgccgtgctgcgctatttcctcgcgctggaggaggggatcaatatgctgcctggcttctcgccggagctgcagggggtttacagcgagacggatccggacggcattaagcggctgtatggctacgtgctgaagggataa

SEQ ID NO: 4704 - DNA, 423 bp, Klebsiella pneumoniae
ggaggtaagactatcaaactgaacttcgcaggctgcacactggacgccatcgtgggccacccagagcacgagatactgttcgtagccaatcaggtgaacaaggccgcaggtctcgccaaccagaacatagcccactacatcgcaaaaggcgttgcaagtggtatccgactaagagacttaggggataatttatcctgtagtggcgaactaagggagccgtctggtcgcttaatgcgggacacaacgtggctcattgatgaaccgaacacttacaaggttttactgaggggtcactcgacccagtccgaaccgttccgcaaatgggtgacagaggaggtcctgcccaccatccgtaagaccggtaagtattatatcgctaagtccaacttgataattgacaatatgtcaggcacttggaattag

SEQ ID NO: 4705 - DNA, 321 bp, Klebsiella pneumoniae
tgtactgctgccggggctgtggatggcgctatgagtgccgttgaaacctgcgctgacgggctggtgttgaggctgtacattcagcctaaggccagccgcgatagcatcgtgggcgtacatggcgacgagcttaaagtcgccattaccgccccgcccgttgatggccaggccaatgcccacctggtgaaatttctcgccaaacagttccgcgtcgccaaaagccaggtactgattgaaaaaggcgagctgggccgccataagcaagttaaaatcatcgccccacaacagatcccgactgcggtcgcggcgctaactgaataa

SEQ ID NO: 4706 - DNA, 1212 bp, Klebsiella pneumoniae
  unsure (1030): Identity of nucleotide at the above locations are unknown.
tcccgttattttgatgcgattctatcattcactagcttaatgcttctgttaactgccgcagaaaaccgaaagatattacagagtatggcggagaataagcgcggcctcagcgcggggctgaggccggagtcgggaggagggctatttacggcggtagcttttctgcgccgtattaactttgtacagatagcggcgcgattccgccgacggatggcgggtggtcagcgtctggtagacgtcccctggcgccatgctgttgataatattggccgcctgcactttatcgctggagaagacccgcagtacgctgccggcgccgccgttataggcagtgatcaccgcgtagcgacgcgaggtggggttatcgatgccggcgaggtaaacattgttcagcatcgccaggtaggcggtaccggtgtcgatattattcgccgggtcaaacagatagctgcggcttggcaggccggatttaccctgggagcggaagacgtctctgccggcgctgtgctggaccacctgcatcagccccatggcgtcggcatggctgaccgcataggggttaaaggaggattcggtctgcataatcgcgaggatcagcgactcatcaaccccatacttacgcgaggcctgacgcaccatgccgaggtatttatgcgcacgtttgtcgaggtggttcggcaccaggttaatggtgatgctatagaccacgcgcaggccgttgttgcggctcttcagacgggtttgcagcagatagtcggcaaagcgcgcggcgcgccactcccagcgaatcgacgccccggtgttatccaccacctggccatagaggaacggctctttggagatctggatgtcatcgacatcggaatagaggtcaatggagttggggtcatcgcccatcaacagagttttgacgatcgcctggcgcagacgtccgcgagggtcggtgccggcaatggtctcgacggtgatcgtcccttcatcgaagttgatgtggctgcgggtttgatactggtcggtgtacttgacgtantcctttggcccggcgagcaggacttcgttgtacccccaaatgttctcgatgttgtgggcgaactggcccatcaaaatatcgaatccgttcgtgtccttgacccaggcctcgttgtattcggcgccttttttattggagctggaacacgaaacgagcaacggcgcaatcagcgcgagcgctaa

SEQ ID NO: 4707 - DNA, 1638 bp, Klebsiella pneumoniae
tccgcgctcgctgcgccaaaagcggacgttggtccgccgtcgtgcttatttatcgatacgtctttcgatagcgtccatcagcataccggtgatcgaaatatccgggaaggcggcttcgatttcgcgtacgcaggtggggctggtgacgttaatttccgtcagacggtcgccgatgatatccaggccgacgaagataaggcctttggccttcagcgtcgggccgacgcggcgggcgatttcccagtcgctttcggtcaacgggcgggcttcgccgcggccgccggcggccagattgccgcgggtctcgccaccctgcggaattcgcgccaggcagtaaggcacgggctctccatccactaccaacacgcgcttgtcgccatctttaatggccggcagatagttctgcgccatgcagtagcggctgcccagttcggtcagcgtctcggcaatcaccccaaggtttggatcgccggctttaacacggaaaatagaggcgccgcccatgccgtcgagcggtttcatgatgatatcgccgtgcttttcccagaaggctttcagctgggctttattgcgggtgaccaacgtttccggagtcagttcagagaaccaggcggtgaacagcttctcgttacagtcgcgcagactctgcggcttgttgacgataagcgtgcctttctcttccgcccgctccaggatgtaggtggcataaataaattcggtatcaaacggcggatccttacgcatcaggatgacgtcaaggtccgccagcggcagatcctgctcgccggtaaagtcataccatttatcgtagttctgttcgacgctcagcgtgcgcgtccgggcgcgggcttcgccgttgatcaaatagaggtcgttcatctccatataatggagttcatagccgcgacgctgcgcctccagcaacatagcgaagctggtgtctttcttgatgttgatggttgcgatgggatccatcacgatgccgagcttgatcatggttcttctccgttaacgcctcaacctaagtcgccaaaacgcacctgtagggcggtgatggcggtgagcgcagtagtctctgtacgcagaacgcgcggtcccaacaggatatcagtaaactggtattgcgcggtcatcgctatctcttcagccgacagcccgccttccgggccaatcagcagacggacgcgttcaaccggcagcggcagcgtgttaatgctggcgctggcgcgcgggtgcaggttgagcttcagcccgctgtcctgctcggcgcaccacgcctccagctgcatcgccggacgtatttccggtaccacgttacgaccgctctgttcgcaggcggcaatagcgattttctgccactgctggatctttttctgcaaacgttcggcatccagtttaacgccgcagcgctcggaaaacagtggcgttatgaggcttaccccgagttcgatcgatttctggatggtgaattccattttttcgccgcgggacatcacctggcctaaatggatatgcagcggcgattcccgatcgtcaggttcgccactgagcacctcaaccgtaacgtttttcttaccggcctcggtgatgaccgcgtcaaacacctggttactgccgtcaaaaagctgtaggtgctga

SEQ ID NO: 4708 - DNA, 321 bp, Klebsiella pneumoniae
acggtggtcgccggtttgccagattttttcaactgcttatgcagatcggaaatgcggatccgcatcgaggcgcgcagcttggcgtcaaggttggagagcggttcgtcgaacaggaagacgtccggttttttgacgatcgcccggcccaccgccacgcgctgcgcctggccgccggagagctggcgcggcaggcgatcgagcagttcttccagttcgagaattttcgccgcttcttccacctgtctgtcgatttgcgccttcggcagcttgctcagcttgaggccgaaggcgaggttttcgcgcaccgtcatatgcggatag

SEQ ID NO: 4709 - DNA, 1950 bp, Klebsiella pneumoniae
ccgggcgacgctatgtttcctctcgcccattttttacgccaggaactgcgcgacgcgccgggacgcgccagctacacgctgcgcctgacgctaagctgcgcggtgctcatcaccctgtttatgaccctgcagatccctttcctggccgttgcgctgatcgtcgtgttctacgtcagccagcctaatgtgttgatgattaagctggtcagcgtggtcttttttgtcaccgtcaccgtggcgctcggcggcgtgctgctgatcatcaagtggacctatgactacccgctgatccgcctggcggcctccgtggcgctctttttctgcgccctctatctgatgcgggtgctgggcaagctgggactggcctttttcgtggtggcgctggcggtgatttacgctcagaccttcccgtcgatgaccagccagagcgagatcctggtgcggctgctgctttggctgtgggtggcgattaacaccgcgatcctcgtcaccctgctggtcaacgcctgctttcagcaggcctttcccggtaaccagtttaaggcgcgtctggccgggatgctgcacgaggtcgcccggcggctggcggccccggacgctgaagcgccaccgaccttcggcgagaccgccgcgcagttcaatcagctgcagtcgctattcgcccaggccagccgggcgacaccggagatcgccgccgatccccaggcctggcgctcgcggctggccgccactttgcgctgctaccagctggcggccctgctgcaagcagacgaggcggatagtgacgatcgccagcagctgtcgcaggcggtacttcagctgaagaacgcccttagcgagaggccgtttgacggcgctattcctcccctgacgctcagcggtcgcggcgtcaatcgcgctgttctgcaggagatggctaccactctgcagcggctggcgcagggtgagccggttgccctgccgcagggtgaggtggagaaggcgcccctactggcgccggacgcctggcgcaacccggcatatctccattttgcgctcaagaccctgctggcgaccctaatctgctatgtcttctataccgctgccgactggcagggtctacataccattatgctgagctgcgtgatcgtcgcccagcccgggctgggcgccacgatgcaaaagacatggctgcgcatcggcggggcgctgctcgcctccctgctggcgctgctgttaatcgtctttgtccagccctggaccgattcgctgacgggcctgctggcgatgtccctgccggtgctggcgctggcggcgtggattgccgccggctcggagcgtatcgcctacgccgggatccagattggtttcacctttgcgctggcctttctcagctggtttgctccgctgacgaacctcaccgagctgcgggatcgggtgctgggcatcctgctcggggtgctggtctcctccattgttcatttgtatctctggccggacagcgaagcgccgcagctgaaaacccgccttgcggcactttatcgccggctggcggactgcctcgccgccccgaaggaggcggttccgctggctcccctgcttgtcgccttcaccgacagcgaagcgctgatccaccgggttcgcgccgaaccgctgggcacgtatgctcacccctggccccaggcgaaagactggccgatgcgcgccaccctcgcccaggccgaggagatcgcccgcctcagcgaaggctaccgactcaacgccgcgccgggagacccgaccctggcccgctgcgccgaacagctgcggcgctacgctgaacgtatcgaacaggaggcgacggcgcctggcgaacagctgaccgccgacctgactaacccctttggcccggcgctggccgccgcgctggccgccctgcccgactgggggccgacaccgatagcgactgagcaacaggctaaaacgtcatga

SEQ ID NO: 4710 - DNA, 1212 bp, Klebsiella pneumoniae
gatcgaggcgctgatggcggcggcgcgccagtcatgagcgtgctgatcgtcgggggcgggatgaccggggcgacgctcgcgctggccatctcccgtttgaccggcggcgcgctgccggtccacctcattgaagcgcaggatccgcattcgtcacgccaccctggctttgacgaccgggcgatcgccctggctgcgggcacctgccagcagctggcgcgtatcggtatctggcaacgcctcgccgaacgcgcgacgcccatccagcgagtacacgtcagcgaccgcggtcatgccgggtttgtgaatctggcggccgcggattatgggctgtcggcgctgggccaggtggttgaactccacgatgtcggccagcgcctgtttggtctgctgcgcgaggcgccgggcgtcacgctgcactgtccggcgaaagtggaagcggtcagtcgcagccaggagagcgtcagccttacgcttgagggcggcaaaatcattaacggtaagctgctggtggcggcggacggttcccgttcggcactgggcgcccgctgcggcatcagctggcagcagcagccgtatgagcagatagcgatcattgctaacgtcagcaccgcgttgccccacgaaggtcgcgccttcgagcgctttaccgagcatggcccgctggcgatgctgccgatgtcgcaagggcgctgctcgctggtgtggtgtcatccgcagtcgcgccgcgatgaggtgcagagctggtctgacgaacgcttttgtcaggagttgcagcaggcgttcggctggcggctggggcgtattacccacgccgggaagcgcagcgtctatccgctggccctcaccaccgccagccgcgcggtgtcgcaccgcctggcgctggtcggcaatgcggcgcagacgctgcacccgatcgccgggcagggctttaatctcggcctgcgcgatgtgatgagcctggcggaattactcgctgacgcccatctcagcggcgaagatgtcggtcattatccactgctgtgccgctatcaggcgcgcagggcaggggataaagccgccaccatcggcgtgaccgatgggctggtgcatctgtttgccaaccgttgggcgccgctggtggcggggcgcaacgtcggtctgatggcgatggaattatttaccccggcgcgcgatgcgctggcgcagcgtaccctcggttgggttccccgttaa

SEQ ID NO: 4711 - DNA, 432 bp, Klebsiella pneumoniae
attactcgagcaggccgtcgatattattctcgcctccgacgtattatttttgtcggcgccggcacctccggcgcgctggcgaaatatggcgcacgcttcttctccaacgtcggtaaattcagcaaccatattgacgacccctattttccggtaaccaacgatatggcccgcaacgcgctggcgatcgtactttccgtctctggcgagacggaagagatcctgcgctttgccagccagttcagcctacatcattgcaaggtgatgtcgattaccagccatgagcattcgcggctggccaaactggctgatttcaatctctcctggcacgtgccgcagacgcgcattggcggcgtctacgatattacaacgcaaattccagtgatctatattctcgaatccctcggacgtaaattagcgcgcaaaatcagctaa

SEQ ID NO: 4712 - DNA, 765 bp, Klebsiella pneumoniae
ttgcatccggcaccctcattcgctacgttgcgggctcgttttgacacggagttaacgatgtcccgtatgcatgttttagccgtagcggtattgagcgcggcagtcagtggtccgcttgcggccgctggtattaatagtttttcccaggccaaagccgctggcgtcaaagtgaatgccgacgttccgggcgatttttattgcggctgtaaaatcgactggcaggggaaaaaaggcgttatcgatttggaatcctgcggctataaagtgcgtaaaaatgagaaccgcgccagccgggttgaatgggagcacgtagtgccggcatggcagttcggccatcagcgtcagtgctggcaggagggtggacgtaaaaactgcgccaaagatccggaataccgcaagatggaaagcgatatgcacaacctgcagccggcggtgggagaagtgaatggcgatcgcggcaactttatgtacagccagtggaacggcggtgaaggccagtacggccagtgcaccatgaaggtcgattttaaagataaaatcgccgagccccctgcccgcgctcgcggcgccatcgcccgcacctacttctatatgcgcgaccgctatcagctgaatctttcccgccagcaaactcagctgtttaccgcctggaataaacagtacccggtcaccgcctgggaatgtgaacgtgatgagcgcatcgcgaaagtgcagggcaaccataatccgtatgtccagcaggcttgccaggcgcaaaagagctaa

SEQ ID NO: 4713 - DNA, 1722 bp, Klebsiella pneumoniae
tgcctggcggcgctacgcttgcacaggcctacggttctgcgccattgcgtagcccggataaggcgtttacgccgccatccgggatccccggcttgcgctgcgctgagccaggctacgccagccttaggacctcacatcagacataaaaaaacccggcaagccgggttttttgcttttcgcgaagggcgattatttctgcggacgcatcgccgggaacagaataacgtcgcggatggtgtggctgttggtgaacagcatgaccatacggtcgataccgatacccagaccagcggtcggcggcaggccgtgttccagcgcggtgacatagtcttcgtcatagaacattgcttcgtcgtcgcctgcggctttcgcatcaacctgatcctggaagcgctgcgcctggtcttcggcgtcgttcagctcgctaaagccgttaccgatctcacggccgccaatgaagaattcaaagcggtcggtgatttccgggttgacgtcgttacggcgcgccagcggagaaacttccgccgggtattcggtgatgaaggtcggctggatcaggtgcgcttccgccacttcttcgaagatctcggtcacgatacggcccagaccccagctcttctccactttgatgccgatagattcagcgatcgctttcgcggaatcaaagttatccagatccgccatctcggtttccggacggtatttcttgatcgcttcgcgcatggtcagtttttcaaaaggcttgccgaagtcgaacacctggtcgccgtaaggcacttcggtattgccgaggatgtcctgcgccagggtgcggaacagagattcggtcagctcgatcagatctttgtaatccgcataagccatgtagagttccatcatggtgaactctgggttatgacgaacggagatcccttcgttacggaagttacggttgatctcgaagacgcgttcgaagccgccaaccaccagacgcttgaggtacagttccggcgcgatacgcaggtacatgtccagatccagcgcgttatgatgggtgatgaacggacgcgcggaagcgccgcccgggatcacctgcatcatcggggtttctacttccataaagccgcggccaaccatgaactgacggatgcccgccaggatctgcgaacgcactttgaaggtcttacgagattcatcgttggaaatcaggtccaggtaacgctgacggtaacgcgcttcctgatcctgcaggccgtggaatttgtccggcagcgggcgcagagctttagtcaacagacgcagctcggtgcagtggatagagagctcaccggttttggtcttgaacaacttaccgcgggcggcgatgatgtcgccgaggtcccactttttgaactggtcgttataaacgccttccgccaggtcatcacgcgccacgtacagctggatgcggccgcctacgtcctgcagggtcacgaaggacgctttacccatgatacgacgggtcatcatgcggccagcaacggccacttcaacgttcagcgcttccagctcttcgttttctttgccatcgaagtcagcgtgcagttggtcagaggtatggtcacgacggaaatcgttcgggaatgcgacgccctgctcacgcagcgcagccagcttctcgcgacgggttttcagttcattattaaggtcaattgccgcgtcagcgccctgtgcttgttgttcagacatgttggttcctcataa

SEQ ID NO: 4714 - DNA, 375 bp, Klebsiella pneumoniae
atatttgaggcaatcatgattaagcgacaacgcaaagccattctttttgtcctcctggcctgtctggtggtgctaacctgcaccgctcaacggatggccgggatgcacgcgctggtcatgaacctcaccgccgacagcccgtcgctacagcaaaaccaggatcaggccgaggcgccggtcacgccgtgcgagctcagcgccaagtcgctgatggccgttccgccgatgctgtttgaaggggcgctgttggctatcaccctgctgctggcggtgctggcggcgatcccgccgcgtatcgaacgccagtggcctccccgcgttatctccccaccccgattgcgggtgcatctgcgattatgcatcttccgtgagtga

SEQ ID NO: 4715 - DNA, 654 bp, Klebsiella pneumoniae
gtgattaatttaaatggaaattcatcatcttctcgtcaggtaacctttattacccacccgtctattcaaagcaaagcctttgccagctatctgagcgaaaccctgatggcaccggtggttttacaaaatattaataaaccgctggcgcagcgtttggcaaaagattctgtaatattatttgatattgcagtgtcaaataagaaattaaacggggtgtggcgggatattattcgcctgcaggcagataatcctcgtttgttgattattaatagcgcacaaaagtatgagctatacgaaatggcgcagtggccggctttatatggcgtgttccggcatgacgatgatgaatcgcgcttaattgagggcgttaaggccgtgctgaacggcgagcagacggctgaattgagcgtgatgcacccggcgatgtacgctgcggaccatgcatcgactccagtagagaactcgccgctgaccgagcgggaatgcgagatcctcaacgaactgcgctgcggcgcgacgaacctggatatcgcccgcgcgctgtttatcagcgagaacacggtgcggacgcacctgtacaatgtgtttcgtaaactgagcgtgaaaaatcgcacccaggcggtgagctgggctaacgaacatctgcgccactaa

SEQ ID NO: 4716 - DNA, 231 bp, Klebsiella pneumoniae
tttcatacttactggtctttatcgttccctctgtcatatgcatcccttgtaaatagttgtcgtgaggcgtttgatttttcttatagcaatagcaacattctgattgggttaatcagatgtttttatgagcgtttgatgttattgactatctttgcagccagattgatatgtataaacttggaatttgatattgtatttcctgtaatcaagagtttcgaattttggtcatga

SEQ ID NO: 4717 - DNA, 885 bp, Klebsiella pneumoniae
acctgcaattactcaattttctctaaccatatctctgctgaaccggcgatccgtcgccaacgccatcgctattcctttcgcacctcctcccaccacaccagattatattaccataaaaatcaaatttggcagaatttaaaaccacagaataccaggttgacacaaaatacagatcatttatcccaacgagtcaaaatggccccaattgtctcatcggttgggcgaaaactgtgcagagccggcagctggaccactcggctgaaatctgaaatgcctggaaggcacaacggctgccaatccggttcgttatttcgacatcgttcaaaggaaaacagtatgaaaatcaaaacactggcaatgattgttgtgtcagccctgtcactgagctccacggcagctctggccgataccaccacggtcaacggcgggaccgtgcattttaaaggagaagtcgttaatgcggcctgtgcggtggatgccggctctatcgatcaaaccgttcagttaggccaggtgcgttccgcgaaactggccacggcggggagcaccagttcggccgtcggtttcaacatccagctggatgattgcgacactacggtagccaccaaagcgtccgtcgccttcgccggtacggccatcgacagcagcaataccaccgttctggccctgcaaaactctgccgccggcagcgcaaccaacgtcggcgtgcagatcctcgacaataccggtacgccactggcactggacggcgccaccttcagtgctgcgaccacgctgaatgacggccccaacatcatcccgttccaggcacgttactacgcgaccggcgcagcgacggctggtatagcgaacgcggatgccacgttcaaagtgcagtacgagtaa

SEQ ID NO: 4718 - DNA, 1404 bp, Klebsiella pneumoniae
ttacaggttctcaccgttgctggcgatgacctctttgtaccagttaaagctcttcttgcgcgagcgggacatgtcgccggtgccatcgtcgtgtttgttgacgtagatgaagccgtagcgtttgctgtactgcccggtggtgaaggagacgcagtcgatgcagccccatggggtatagcccagcagatcgacgccgtcataagtgaccgctttgatcatctcttcgatgtgggcgcgcaggtagtcgatgcggtagtcatcgttgatgctgccgtcggcttctactttgtcgtaggcgccaaagccgttttccacgataaacagcggcttctgataacgctcatacagttcacacagagaatagcgcaggccgaccgggtcaatctgccagccccagtcggaggctttgacgtgcgggttcggcacgctgccttcgaaaccggaaatggcgtcgccagtgccgccctcggctttcaccgcgttggtcatgtagtagctgaagccgagataggcgcaggtaccttcgcgcaggatctgcgcgtcgccgtcttccatcctgatgttgaagccgcggcgttcccattcattcaacacatagctcgggtagtaaccgcgcagctggacgtcggtaaagacgtagcgctcgcgcatcgactcctgggcgaacatgacatcttccggtttgcaggagtaagggtagagggcgaccatcgccagcatgcagccgacctgcatgtccgggttgatgcgccgcgccgctttcaccgccagcgcgctggccacgaactggtggtgcagcacctggtacatggtctcttccggattgtcatgctcggtatagaccaccccggagcagcagtagccgaacagcggcgcgcgccagttgcgctggttattgatctcgttaaaggtcatccagtatttcactttgtgcatatagcgctcgaagaccacttcggcgaagcgtacaaagaaatcgaccactttgcggttggtccagccgccgtactgctgcaccaggtgcaggggcatctcgaagtgggagagggtgatcaccggctcgatgttgtatttcagcagctcgtcgaacatgtcgtcgtagaacttcagtccctcttcattcggctgggtttcgtcaccctgcgggaagatgcgggtccaggcgatagaggtgcggaagcatttgaagcccatctcggcgaacagtttgatgtcttctttgtagcgaccgtagaagtcgacggcttcgtggttcgggtagtattttcccgcttcgacctgatgggtgatttcgcgcggcacgccgtgcgccccgccggtcaacacatcgcagatgctggggcctttgccgccctgatcccagccgccttcaacctgatgcgcggcgaccgcgccaccccataa

SEQ ID NO: 4719 - DNA, 945 bp, Klebsiella pneumoniae
cgtcacctatacctacgcctgagccaggagagcatcatgatgaaaaaaataatccccctgttcaccaccctgctgctgctgggctggtcgatgaacgcctggtcctttgcctgcaaaacggccaccggggcgacgattcccatcggcggcgggtcagccaacgtctacgttaacctgaccccggcggtgaacgtcgggcaaaacctggtggtcgacctctccacgcagattttttgccataacgactatccggaaacgatcaccgactacgtgaccctgcagcgcggatccgcctatggcggtgtgctgtcgagtttttcaggcaccgtgaaatataacggcacctcttacccgttcccgaccaccacggaaaccgcgcgggtgatttatgattcacggaccgataaaccctggccggccgtcctgtatctgacgccggtgagcactgccggtggagtggccatcaccgcaggatcgttaatcgcggtgctgatcctgcatcagaccaacaactacaatagcgactccttccagttcatctggaacatttacgccaacaacgacgtggtggtccccaccggcggctgcgacgtctccgcccgcgatgtcaccgtcaccctccccgactacccgggatcgatggccgtgccgctcaccgtccactgcgcgcaaagccagcagctggggtattacctctccggcaccaccgcggacagcgccaacgcgatcttcaccaataccgcctccgcctcgccggcgcaggggataggcgttcagctgacgcgcaacggcagcgccgtcccggcgaacagcacggtctcgctgggcaccgtcggcacttcgccggtcaacctcggcctgacggccacctatgcccggaccacaggccaggttaccgccggcaacgtgcagtcgatcatcggcatcacctttgtctatcaatga

SEQ ID NO: 4720 - DNA, 255 bp, Klebsiella pneumoniae
cggacagcatacggggccacaaagaaagatcaatatacatgcgcaaaaacatatatattaattcacgtctgcgatgagcatccgggattttgcgccccgccatccctgctaattagcacggaaaaatgccgcgttttcttttatccatcatcgaaatatgtcaggctggagatcccattggattgccagggctttcaggatgagtacgatttatgtggttgttttaacgtatataaaaccgctcgaagaggttga

SEQ ID NO: 4721 - DNA, 468 bp, Klebsiella pneumoniae
actgattggtatcgacattgtgacgatgccaggcgtcgcggggcatgcgtgatgagcggaacctttctcggctttgactttggcaccaaaagcatcggcgtggcggtgggacaacgcatcaccgcgaccgcacgaccattaccggcgctgaaggcgcaggacggtaaaccggactggaacgtcatcgaaaaactgcttaaagagtggcagcctgaggcggtaatcgtcggcctgccgctcaatatggacggcaccgagcaaccgctgacggcacgcgcgcgtaatttcgccaataaaattcatggccgctttggcgtcgcgatccttctccacgatgaacgactgagtacggttgaggcccgcgcgggcctgtttgaacacggcggctaccgggcgctgaataaaggcagcgtcgattcggcctctgccgtagtcatactggaaagctacttcgagcagagcttttaa

SEQ ID NO: 4722 - DNA, 1344 bp, Klebsiella pneumoniae
aaaatttatcttaacatatatgatttttcgaatgtgattggcggaggaacgatgttgctggcaggtacgatttttatcctgaccctggtgctggtgatctggcagccgcgggggttagggatcggctggagcgcggcctttggcgcggcgctggcgctggccaccggtggcgtacaggtagccgatatcccggtggtatggcatatcgtctggaatgcgaccgccacctttatcgccgttatcattatcagcctgctgcttgatgagtctggctttttcgaatgggccgcgctgcacgtttcccgctggggaagaggccggggtcgactgctgtttacctggattatcctgctcggcgcggcggtggcggcgctgtttgccaacgacggggcggcgctgatcctcacgccaatcgtgattgccatgctgcgagcgctggggttcagcaagggaacgatgctggcctttgtcatggccgccggatttattgccgataccgccagcctgccgctggtggtgtcgaatctggtgaatatcgtttcggcagatttctttgccatcggcttcagggagtacgcttcggtgatggtgccggtcgatctcgcggcgatcctcaccaccctggcgatgctgcacctgttctttcgcaaggatatcccgccggcctgggatatggcgttactgaaagcgccggccacggcgataaaagatccagcgacgttccgcaccggctggggcgtgctgctgctgttgctggctggctttttcgtccttgaaccgctggggatcccggtcagcgccatcgcggcgctcggcgccgggatcctgtttgctgtcgcgaagcgcgggcgggtaattaataccggcaaggtgctgcgcggcgccccgtggcagatagtgatcttctcgctgggaatgtatctggtggtgtatggtctgcgaaacgccgggttaacggattatctgaccacggtgctgaacatgctggcggagcgcgggctctgggccgcgacgctgggcactggtgttctgtcggccttcctctcttcaataatgaataatatgcccagcgtactggtcggcgccctgtcgattgatggcagcgcggcaacagggacgatcaaagaggccatgatttatgccaacgtcatcggctgcgatctggggcccaagatcacgccaattggtagcctggccacgctgctgtggctgcatgtgctggcgcagaagcacatcaccatcggttgggggtattatttccgctgcggcatcaccatgaccctgccggtgctgcttgtgacgctggccgcgctggcgctgcgtctctccttcaaccagccatga

SEQ ID NO: 4723 - DNA, 1023 bp, Klebsiella pneumoniae
gcgatttatctatcaaacccttcctcgtcgggcctaacgacgcggaggggtttttttatacttattttttacgttccacgactgtcaaaagaggtcatatccatgagcactttaggtcatcaatacgataactccctggtatccaatgcctttggctttctgcgtttgccaatgaactttatgccgtatgaaagcgatgcggactgggtcatcaccggcgtgccgttcgatatggcgacctccgggcgcgcgggcggccgtcatggcccggcggcgatccgtcaggtttccactaaccttgcctgggagcacaaccgtttcccgtggaacttcgatatgcgcgagcgcctgaacgtggtggactgtggggatctggtgtacgccttcggcgacgcgcgcgaaatgagcgagaagctgcaggctcacgccgagaagctgctggcggccggcaaacgtatgctctcctttggcggcgaccacttcgttaccctgccgctgctgcgcgcccatgccaagcactttggtaaaatggcgctggtgcacttcgatgctcacaccgatacctacgccaacggctgcgagttcgaccacggcaccatgttctataccgcgccgaacgaagggcttatcgatccgaaccactccgtacagatcgggatccgcaccgagttcgacaaagacaatggctttacggtgctcgacgccggccaggttaacgaccgcagcgttgatgacgtgattgcccaggtgaagcagatcgtcggcgacatgccggtgtacctgacctttgatatcgactgtctggatccggcgtttgcgccaggcaccggtaccccggttatcggtgggctgacctccgaccgcgcgatcaagctggtgcgcggcctgaaggacctgaacatcgtcgggatggacgtggtggaagtcgccccggcctacgatcagtccgaaattaccgctctggcggcggcgaccctggcgctggagatgctgtacatccaggcggcgaagaagggcgaataa

SEQ ID NO: 4724 - DNA, 858 bp, Klebsiella pneumoniae
atggaagatttgaacgttgtcgatagcatcaaccacgccgggacgtggctggcacgcaaccaggagctgctgctgagctatgccgtcaacatcgtcgcggctatcgctatcctgatcgtcgggatgatcgtggcgcgcgtcgtctctaataccgtcaaccgcctgatgctggcgcgtaaaattgacgctaccgtggccgattttctctctgcgctggtgcgctatgcggttatcgcctttacgctgattgccgccctggggcgggtaggcgtgcagaccgcctcggtgattgcggtgctgggtgctgccggtttggcggtgggtttagcgctgcagggatcgctgtcgaaccttgccgcaggcgtactgctggtgatgttccgcccgttccgcgctggcgagtatgtcgaccttggcggcgtggcaggtacggtgttgaacgtgcagattttctccaccaccctgcgtaccgcggacggtaaggtagtggtggtcccgaacgggaaaatcatcgccggcaatatcattaacttctcccgggaaccggcgcgtcgcaatgagtttattatcggcgtcgcttacgatgctgatatcgacaaggtaaagcagctgctgacctcgattatcgaatctgacgatcgaattctgcgcgatcgggaaatgaccgttcgtctgaacgaactcggcgcctcgtcggtgaacttcgtggtgcgcgtgtggagcaaaagcagcgatctgcaaaacgtctactgggatatcctcgagcgtatcaagcgtgaatttgacgccaatggcatcagcttcccttacccgcagatggatgttcatgtggtgcgcctgccggaaaaagcagagtaa

SEQ ID NO: 4725 - DNA, 426 bp, Klebsiella pneumoniae
ggcttgtatcttcgcaccagggtagctatagtgtcgccccttcgcagacccgggccagggtgtgaaggcagcgcagtcaatcagcaggaaggtggcatgtctgcacaacccgtagatctccaaattttcggccgttcactgcgagtgaattgcccgcctgaacaaagggatgccctgaatcaggcagctgaagaccttaatcagcggttgcaagatttaaaagaacgcactagagtcacaaatactgagcagctggtcttcatcgcggcgttgaacatcagctatgagttgactcaggaaaaagcgaagacccgcgactacgcttccagcatggagcagcgcattcgcatgcttcagcagaccatcgaacaagcattgcttgagcaaggtcgcataagcgaaaagccagggtcgaagtttgaataa

SEQ ID NO: 4726 - DNA, 759 bp, Klebsiella pneumoniae
cgacacattcaccttgaaccaagggttcaagggttacagcctgcggcggcatctcggagattcccttctttacttcgcatcatcccccatacgtgttttcggctgaagccgccctgtattacacttgctcctattgtttcgccagctcgtaacgagacctgcatgactatacagcccgataccctgctctcccgtcagcatattcgccagcagatccgcgatcgtcgacgcgcactcagcccggagcaacagcgcctgtttgcccaacaggccgccgagcggatgatggcctggccgccggtagttctcgcccacaacgtggcgctgtttctctcctttgacggcgagctggacacccagccgctgatcgaccagctctggcgcgccggcaagcgggtatatctcccggtgctgcatccctttagccccggcaatctgctgtttttacactaccatccgcagagccaactgatcgtgaatcgcctgaagatccgcgaaccgaagctcgatgtgcgggatgtgctgccgctggctgaactcgatgtgctggtgaccccgctggtggccttcgatgtcagtggccaacggctgggaatgggcggcggtttttacgaccggacgctgcaaaactggcagcagtatcgcctgcagccggtgggctacgcgcacgactgccagcaggtggatagcctgccgagcgaagagtgggatatcccgctgccggcggtcatcaccccgggaaaaacctggtgttggtag

SEQ ID NO: 4727 - DNA, 747 bp, Klebsiella pneumoniae
tgcggttatcagggatttttaacaggagtcagcgtggttacaggaccttttattaacgccagcgcggtgctggtcggcggtgtgctgggcgccttactcagccaacggttgccggaacggatccgcaccgcaatgacctctatttttggcctggcgtcattgggcatcggcattttactggtcattaagtgcgccaatctgccggtgatggtgctgtcgaccctggtggggacgctgctcggcgaaatatgcaatatggaaaaaggcatcaatacgctggtcagtaaactccagcagttgatgtcagcgaaaggcaagaaaaaggcttcggctcatgagtcttatattcagagctatgtggcgattatcgtcctgttctgcgccagcggcaccggcgtcttcggcgccatgcgcgaagggatgaccggcgacgccagcattctgattgccaaagcgtttctcgactttttcaccgccaccatcttcgcctgcaccctgggcattgccgtcgccgccatcagcgtaccgatgctgcttatccagctgactcttgcagcctgcgcggcgatcattatgccgcttaccacgccgatgatgctggcggatttcagcgccgtcggcggcatgctgctggtggccaccgggctgcgcatctgcgggataaaaatgtttgccgtagtgaatatgctgcctgcgctggtgctggcgatgccaatttcagcggcctggacgctgttttttgcctga

SEQ ID NO: 4728 - DNA, 207 bp, Klebsiella pneumoniae
cagggcaatcatcagatgatactgacgacggatcccctgattcatcacaaaggcattttgtgggccaagcggcaatatcatagccgctcccagggcaagcccctgaaagtaataagtaaacataaggatttatccgctgagttcgagagtggcgctgactatagcgcgaatgaattattagcggaaattgaaagaattaatcattaa

SEQ ID NO: 4729 - DNA, 477 bp, Klebsiella pneumoniae
agccggcgtcaatcagcacgaagtgacggctgcccatctctttcacgctgcgcacctgcgacaccagcacgccggactcggccaccaggaagcgtcctggctcaatctccagtttcaccgggtgccccagatgggccgcgatctgctcccgggcgcggttccacaggccataatagtgggcggtgtcgatggcctcttcaccttcgcggtaaggaatcgacagaccgccgccggcggagatggcctgcagatcctggccaaagtcgacgacctggcgcaccatcgcgccgcacacctgctccaggtgaccatagtcaacgccagagccgatatgcatatggatcccgaccagctgcagctgatagcgacgcatcacttccagcgccgccggcaggtggctgtaccagatgccatgcttgctattctcaccgccggtattggttttctggctgtggccgtggccaaagcccgggttga

SEQ ID NO: 4730 - DNA, 981 bp, Klebsiella pneumoniae
cggcgcggtcaacgctgtagcccttcaactgagcccggaagacatccgttatctggaagaagcctatcagccgcacttcctcacaggcgtgatggcgcaaaacacgccgcaagccaaagaccgtcctcaggtgtggacgcgctaacgatccgccctgcggatcggaaaggagcaaatatgaaaaacgtgattgccgcggcagccttgtcgcttgtgctgtctgattttacttatgcccacgaacaaagagatgaagctatgatgaaaattaccccttccacccttgcggacgctgatattcaagcggtctccccggcgctggcgcgcttcggccgcgaggccatcagcaacgacctctggcaacgtgacaccctctccgcccgcgaccgtagcatcgtgaccgtagcgatgctgattgcccgcaaccagccaggcgagctgaagcactatattgccgttgcgctcgatagcggcgtgacgccagcggaagtgtcagagatcattactcacctcgccttctacgctggctggcccaatgcgatgtcagccgtcagcgtcgctaaagccatctttgaagccaggggcgtgacggcagaggccctgcccgccgcctcgccaacgctgctgccactcaatgaacaggtagagaaacagcgtgcagacaccgtggaaaaaaatgtcggccccatttcgcctggcctggttaaatttaccgccgacccgctgtttctcgacctctggcaacggcccgcgcttacgccccgcgacagaagtctggtgacggtcagcgcgttaatcgccgccggacagagcgcgcagattggctaccacctaaacagagctatggataatgggctttcggctgaagaggccggagaagtggtcgcccaggcggcgttctacgcgggatggccaaatgcgtttaccgccgccccggtggtcggtgaggtattacgatcgcgcgagagcaaaactgaataa

SEQ ID NO: 4731 - DNA, 1545 bp, Klebsiella pneumoniae
tgtccatcacaaaacccatcctgccagcaatatagtccatatctttggcttatcctgcctgacccattcatccaccagtcacgtactttcgtcttatgtcttactctgtgtggcaggaaaaaaatgacttcaatcagtaacgactctacattatcgccgcggacgcaacgtgatacccggcggatgaactggtttgtttccatcgccgcggcggtggctggcttgctctttggcctggatatcggcgtgatatccggagcgttgccctttataaccgaccatttcaccttatccagccagcttcaggagtgggtggttagcagcatgatgttgggggcggcgataggcgcgctgtttaacggctggctgtctttccgccttggccgtaaatacagcctgatggcgggggccgtactctttgtggccggctctatcggatccgcttttgccgccagcgtggaggtgctgctggtggcccgcgtggtgttgggcgtggcagtcgggattgcctcttataccgcgccgctgtacctctccgagatggccagcgagaacgtgcgcgggaaaatgatcagtatgtatcagctgatggtcacccttggcattgtgctggcgtttctttccgataccgcctttagctacagcggtaactggcgcgccatgctgggcgtgctggcgctgccggcggtgatcctgatcattctggtcgtctttttgccgaacagcccgcgctggctggcggagaagggacgccatatcgaagcggaagaagtgctgcggatgctgcgcgatacctcggaaaaggcgcgcgacgagcttaacgagatccgtgagagcctcaagctgaagcagggcggttgggcgttgtttaagatcaatcgtaacgtgcgccgggcggtgttcctgggcatgctgctgcaggcgatgcagcaattcaccggcatgaacatcatcatgtactatgcgccgcgtatctttaaaatggcgggctttaccactactgaacagcagatgatcgccaccctggtggtgggcctgacctttatgtttgccacctttattgcggtgttcacagtggataaagcgggccgcaagccagcgctgaaaatcggctttagcgtgatggcgctgggcactctggtgctgggctactgcctgatgcagttcgacaatggcaccgcatccagcggcctctcctggctctccgtcggcatgaccatgatgtgtattgccgggtatgcgatgagcgcggcgccggtggtgtggatcctctgctccgagatccagccgctaaaatgccgcgacttcggtatcacctgctcgaccaccaccaactgggtgtcgaacatgatcatcggcgccactttcctgacgctgcttgacgcgattggcgccgccggcaccttctggctctacacggcgctcaacgtggcctttatcggcatcaccttctggctgatcccggaaaccaagaatgtcaccctcgagcacattgagcgcaacctgatggcgggcgagaagctgcgcaacatcggtaatcgttaa

SEQ ID NO: 4732 - DNA, 240 bp, Klebsiella pneumoniae
ggagacggtctgaataccacttcgctagcgcagctagtgctgctagtgctgctgtcaacacatggttctctttctgtacaaccgtcagcaacgctatgcttgcgcccagcagtccccacccgaagcctactctgggcatggctccttgccgatacgctgatgtacctcattgtgaaatctttaggtagtaatcaacgccagacaactggcaacatcgtgtgtatcagctttgggccatga

SEQ ID NO: 4733 - DNA, 468 bp, Klebsiella pneumoniae
ctcgccatgcaacagaccccacatcagcgcaagacgctcaccgaacgcgttatccacgccatcaccttcgaaggactggcgacgctgatcctcgcccctaccgccgcctggctgatgcagcgctcggtagtggagatgggcggactgagcattctgctcgccaccctggcgatggtatggaacattatctataacgcggcgttcgatcgcctgtggccggtctcccgcttcccccgccagctgaaagtacgcgccctgcacgcgctcggtttcgaaaccggattcgtcatcattggcgtcaccatggtggcgatcgtgctgggcgtctcgctgctgcaggcgtttatgctggagatcggttttatgcttttcttcctgccctacaccatggcctttaactgggtatgggacaccctgcgcgagcgcgttattcgtcaccgccgcccgcgccagacggcgcgcggttaa

SEQ ID NO: 4734 - DNA, 201 bp, Klebsiella pneumoniae
aatagcgcgcagaatggcgccggctgtagcagccggcatgccgtgttaaacctgctgtatggtaggctctccaggtatgtagcgcctggattgctgacaatattctcgcttagcgctatttctccactatccagtctgtttcccttacttttcctgccgttatacaccgcctctgcgccggtggtttatgtctctcgataa

SEQ ID NO: 4735 - DNA, 915 bp, Klebsiella pneumoniae
ttatgggggcacgccagaataatgaaacgaccggactacaggacactacaagcgctggatgcggtgattagggaacgaggatttgagcgcgccgcgcagaagctatgtattacccagtccgccgtctcacagcgtattaagcagctggaaaatatgttcggccagccgctgctggtgcgtaccgtgccgccgcgccccaccgagcaaggacagaaactgctggctctgttgcgccaggttgaactgctggaggaagagtggctgggcgatgaacaaaccggctctacgccgttgctgctgtcgctggcggtgaacgccgacagtctggcgacctggctgctgccggcgctggccaacgttctgtcagactcccctattcgtctcaacctgcaggtggaagatgaaacccgcacccaggagcgcctgcgccgtggcgaagtagtgggcgcagtgagtatccagccgcaggcgctgccaagctgcctggtggatcagctgggggcgctcgattacctgtttgtcgcatcaaaagagtttgcgcaacgctatttcccgaatggcgtgacgcgttcggcgctgcttaaggcgccggtcgtcgccttcgaccatctggacgatatgcatcaggcgttcctgcagcaaaacttcgacctgccgccgggcagcgtcccctgccacatcgtcaactcgtcggaagctttcgtgcagctggcgcgccagggcaccacctgctgtatgatcccgcatctgcagatcgaaaaagagctcaacagcggcgaacttatcgatctcaccccgggcctgttccagcgccgcatgctctactggcaccgcttcgccccggaaagccgcatgatgcgccgggtgaccgatgcgctcattgactacggacacaaggtgctgcgtcaggattaa

SEQ ID NO: 4736 - DNA, 660 bp, Klebsiella pneumoniae
cgtacgattaatacgggagggggaatgaagggattgccgaaaaacactatcgcgtggctgctattttgcggcagcctcgccgccccctcggcgtggggttttgagaccaattacgatcgcggacgggtcgattttgccgggcgggtgacggatatttcctgtagcgtcgcgctaaacggcggccagcatgccggcagcggtaatgtctggctggcgccggtcagcctggcggaagtccacgatcgcggggccggggcgtttatgaaaccgcagccgtttaccctggcactgtcaaactgccagctgcgccatgatggtggggcagcctcgcaggatgaggtgcgtcgggtcagcgtgcgctgggtcgatggttttttactgacggcggtcggtaacgaaaacgccgggtatctggccaataccttgccggatggagcgcagaatatttatctggccctatcgactaacgataataatacgctggataagagtaataaaattgtcccggcggacccgcagcaaaatcaggtgcgtttgcaggaaagcgcggtcagcggcggcctgttcacctattacgttggctatgtttcgccaacgccgaaaagcgccaccagcgggccgattaccagctgggcaatgtgggaattagtttataattaa

SEQ ID NO: 4737 - DNA, 1005 bp, Klebsiella pneumoniae
cagacgaataaaaaatatcgttttatcgcgactctatgcaaaaatgatatggttccagccgagcctcacggagaccgcatgccagccgtcaatttgcgtcatattgaaatctttcacgcggtgatgaccaccggcaacctgaccgaagcggcgcgaatgctgcacacctcgcaacccaccgtcagtcgcgagctggcgcgctttgagaaggtgctcggcctgcagctgtttgagcggacccgcggtcgcctgcagccgacggtgcagggcctgcgtttgtttgaggaggttcagcgctcctggtatggcctggaccgtatcgtcagcgccgccgagagcctgcgcgagttccgccagggcgagctgtcgatcgcctgtctgccggtgttttcccagtcctttctgccgctgctgttgccgccgtttctctctcgctatccggaggtcagcctgcagatcgtccctcaggagtcgccgctgctggaggagtggctctccgcccagcgccatgaccttggcctgacggagaccctgcatacccccgcgggcaccgaacgcaccccgctgctgacgctgaatgaagtctgcgtgctgcccgccggccatccgctggcggcgcaggcgacgctgacccccgccgattttcatggcgaaaactacatcagcctgtcgcgcaccgacagctatcgccagctgctcgacgccctgttccttgagcatcaggttaaacggcggatggtggtcgaaacccacagcgcggcctcgatctgcgccatggtgcgcgccggcgccgggatctcggtggtgaatccgttaaccgccctggactatgccgatagcggcgtggtggtgcgccgcttcagcgtcgaggtgccgtttaccgtcagcctgatccgccctctccaccgcccgcgctcggcgctggtcgacgcctttgttgcccacctgcagcagagtctgccgcagatcctcacgccgctggcgtcggtcctgcagagagcataa

SEQ ID NO: 4738 - DNA, 2676 bp, Klebsiella pneumoniae
agggttatcctccaacggccattcgccggctttgacgcggtcgatttccgcgcggatcgccagcatcgcgtcgataaagcggtccagctcgaccttgctttccgattccgtcggctcaaccatcagcgtccccgctaccgggaaagacatggtcggggcatggaagccaaagtcgatcaggcgcttggcgatatccagctcgctaatgccggtctcttctttcagcggacgaatatcgagaatacattcgtgcgctacgcgaccatcgcgaccggtgtagagcaccgggtaggcgtctttcagtcgggtagcgatgtagttggcgttaaggatcgcgttctggctcgcctgcttcagcccttccgcgcccatcatgcggatatacatccagctgatcggcaaaatggacgcgctgccgaacggcgcggcggaaaccgcgccctggcgggtcagcataccttcaatctgtaccacgctgtggcccggcacgaacggcgccaggtgcgcttttacgccgattgggcccatgcccgggccgccgccgccgtgcggaatgcagaacgttttatgcaggttgaggtgcgaaacgtcggcgccgataaagcccggagaggtgatcccgacctgggcgttcatgttggcgccgtcgagataaacctggccgccaaactggtgcacgatctcgcacacttcgcgaatggtctcttcatacacgccgtgggtcgacggataggtgaccatgatgcaggagagattggcccccgcctgctctgctttttcacgcagatcggcgagatcgatgttgccgtttttatcacaggcaacgaccactacctgcatacccgccatctgcgcggaagccgggttggtgccgtgcgcggagctagggatcaggcagatatcgcgatggccttcgttgcggctctcgtgataatggcgaatcgccagcaggccagcatactcgccctgcgcgccggagttcggctgcatacagacggcgtcatagccggtcagtttcaccagccagtcggaaagctgggcgatcatctgatgataaccttccgcctgctcgaccgggcagaacggatgcagctcagcgaattccggccaggtgatcgggatcatctccgccgcggcgttcagtttcatggtgcaggagcccagcgggatcatcgcctggttcagcgccagatctttacgctccagggcgtgcatgtagcgcatcatctcggtttcgctatggtagcggttaaacaccggatgggtgaggatcgcatcgtcgcgcagcatcgccgccgggatcgaacggctatccagcgccacgtctttatccagggtatcgatatccagaccgtgatcgtcgccgacgatggcgcggaacaggttcagcacatcttcgcgggtggtcgcttcatcgagcgtaatgcccaccgcgccgtgaatatcgctgcgcaggttaatctgcagggcttcggcacgcgccagcaccgcggctttatccgccacttcgacgcacagggtgtcgaagtagtgggcatggcgcagcttcagccctttcttctgcaggccgtcggccagaatgtcggtcagacgatgaatgcggccagcgatacgtttcaggcccgccgggccgtggaataccgcgtacaggctggcgatgttggccagcagaacctgcgaagtacaaatgttggagttcgctttctcacggcggatgtgctgctcgcgagtctgcatcgccatgcgcagcgcggtattccccgccgcatctttcgatacgccgataatccggcccggcatggagcgtttgaattcatctttcgccgcgaagaaggccgcgtgcgggccgccgtagcccatcggcacgccgaagcgttgggcggaaccgaaaacgatatccgcgccctgcttgcccggcgccgtcagcagcaccagcgccataaagtcggcggcgacgctgacaatcactttgcgcgctttcagctcggcgataagtttactgtaatcgtggatttcgccggtggtgcccacctgctgcagcagcacgccaaagacatcctggtgatcgagcactttgtcggcgtcatcgacgatgacgtcgaagccgaaagtttccgcgcgggtgcgaaccacgtccagggtttgcggatggacatcggcggcaacgaagaagcggttggcgttcttcagtttactgacgcgtttggccatcgccatcgcttcggcggcggcggtggcttcatcaagcagcgaagcggaagcgatatccaacccggtcagatccagagtgacctgctggaagttgagcagcgactccagacggccctgggatacttccggctggtaaggggtataggcggtataccagcccgggttttccagcatgttgcgctgaatgaccggcggcagctgcacggcggtatagcccatgccgatgtaagacttgaagcgcttgttgcgactggcaatcgccttcagctccgccagcgcggcgaattcggtagtcgcgtcgcccacctgcggtggggtcgccagctggatatcctgcggcacaatctggccgatcagggcgttaagcgaatccgcgccgacggtcttcagcatctcttgctgttgctgagcgtccgggccaatgtgacgttcaataaaggcgtcgcggttttcaagctgacttaa

SEQ ID NO: 4739 - DNA, 1212 bp, Klebsiella pneumoniae
gttcaggccaaagagaacgtttgcgtcggcgtccgtcagcgatgccgacgccgaatttcatggcgcaaaatcgccgacaatttcgtggctggttccgttttattcgatgaggaaaagatggctcaacagactccgttgtatgaacaacacacgctgtgcggcgcgcgcatggtggatttccatggctggatgatgccgctgcattacgggtcccagattgatgagcaccatgcggtgcgcggcgatgcagggatgttcgatgtgtcgcatatgaccatcgtcgatttccacggcagccggatccgcgagttcttgcgctatttgctggccaacgatgtggcgaagctcaccaccccgggcaaagcgctctacaccggcatgctgaccgcctccgccggcgtcatcgacgacctgattgtctatttcctttctgaagattatttccgcctcgttgttaactccgccacccgcgaaaaagacctcgcctggatctccgaacaagctgaaccttacggccttgaaattaccgttcgcgacgatctgtcgctgatcgcggtccagggcccccaggcgaaagcgaaggcggcgacgctgtttaccgacgctcaacgtcaggccgtggaaggcatgaagccgttcttcggcgtgcaggccggcgacctgtttatcgccaccaccggctataccggcgaagcgggttatgaacttgcgatgccgaacgagcaggcggctgatttctggcgcggtctgctggacgctggcgttaagccgtgcggtcttggcgcgcgcgacaccctgcgcctggaggccgggatgaacctgtacggccaggagatggacgaaggcgtttccccgctggcggcgaacatgggctggactatcgcctgggagcccgccgatcgtaacttcatcggccgcgaagcgctggagatgcagcgcgaaaaaggcaccgagcagctggttggcctggtgatgaccgagaaaggcgtcctgcgcggtggtctgccggtccgttttaccgatagcgacggtaatcaaaaagaaggcattatcaccagcggcaccttctcgccgacgctgggctacagcatcgcgctggctcgcgtgccggccgggattggcgacaccgcggtggtgcaaatccgtaaccgtgaaatgccggtaaaagtgactaaacctggttttgtacgcaatggcaaagccattgtgtga

SEQ ID NO: 4740 - DNA, 1464 bp, Klebsiella pneumoniae
acaatcaacaaaccgccaaccctgtctgaggagcctatgactaccgtacggatgaccattcccgatgattttatccttggcgcggcggcttccgcctggcagaccgaaggctggagcgggaaaaaaccagggcaggactcctggcccgatctctggtacaaaaacgatcgccacgtctggcataacggctatggcccggcggtggccaccgattttatcaaccgctttcaggaagatgtgcagctgatgaagctggccgggctgacccactaccgcacctcaatcaactggtcgcgctttctgaccgactatgaaaacgtcacggtggatgaggagtatgcggcctattacgaccagctgttcgatgcgctgctggccaacggcatcacgccgatgatctgccttgagcattatgaattgcccggctatctgctggaaaagtatggcggctgggggtcgaaaacggtggttgagctgtttgtgcgctacgcggagaaggtgtttgcccgctaccacccgaaggtgacgcgctggtttacctttaatgagccaattgtggtacagacccgggtctatctggatgctctgcgctggccctatgagcagaacaccagcacctggatgcagtggaactatcataaggtgctggcgaccgccagcgtcgtgaagcggtttcgcgagctcggctatcccgggaccgtcggctgcatcctcaatccggaggtgacctacccacgctcacgcgccccccatgacctgcgcgcggcggagatctacgatctgttctacaaccgcatgttcctcgacccgctggtgcacggcgtctggccgccggagcttctcgcgctgcttgagcagcatcaggtgacgtgggagaccagcgaggaggatctggcggttatccgcgagcacaccgtcgatgagctggggattaatctttactacccgcaccgggtcaaagccccgtcgcgggcctggcatccgcataccccgttccatccggcctggtattatgagccgtttgagctgcccggccggcggatgaacgcctcccgcggctgggaaatctacccgcaaatcatctttgatatggcgatgcggataaaaaatgactatcgcaacatcccctggttcgtggcggagagcgggatgggggtggaaaacgaaggccagttccgtaaccgcgaaggcgtcatcgatgacagctaccgcattcgttttatcagcgaacatctgtggcacaccctgcgcgcccgcgaggcaggggccaattgccagggctatatgctgtgggcgtttaccgacaacgtatcgccgatgaacgcctttaaaaaccgctacgggcttatcgaaatcgatctgcaaaaccatcgcgcccggcgagccaaagcctcggcgcactggtttcgtcaactgggcgaacggcgtgaactggtgctggatatcgatgatgaataccgctag

SEQ ID NO: 4741 - DNA, 750 bp, Klebsiella pneumoniae
tccgcagacaaacaggacaacacggtgagcagacaaggagataatgtgagaaaaacggcaacgatggcgcatggcttactggcaggatgtgtgcttttcgccgccagtatctttagcgccagcgcgcaggcgggcgttgcgcttggcgcgacccgggttatctacccggcgggacagaagcaggtccagctcgcggtgactaataatgatgacaacagtacctggcttattcagtcatgggtggaaaatgccgatggtcagcgagacggccggtttgtcatcactcctccgctgtttgccatgcagggtaaaaaagagaacaccctgcgcattatcgacgccaccaataaccagctgccgcaggatcgggaaagtctgttctggatgaacgtgaaggcgatcccttcgatggataaatcaaagctcagcgacaataccctgcagctggcgattatcagccgcatcaagctctactaccgtccgggaaaactggccctgcctccggatcaagcggcggaaaagctgacctttagccgtagcggatcgtcgctgacgctgacgaaccccaccccctattacctgacggtgaccgaactgaacgccgggacacgcattctggagaacgccctcgtaccaccgatgggcaaaaccagcgtcaagctacccgcggatgccgggaacaccatcacctatcgcacgattaatgattacggcgcgctgacgccgaaaatgaatggcgtgctgcgctaa

SEQ ID NO: 4742 - DNA, 186 bp, Klebsiella pneumoniae
cctttcttaaagtattccaacttactgaatcctaagggatacggctttaagccttccgatagttttactcactgtaaccaacattgtaaccctgtagcgaccaagctacgtccttatgttgacaaagtgagcggacctagggtctcagtacatgctcaattcctacacctacctttaccagcgtaa

SEQ ID NO: 4743 - DNA, 360 bp, Klebsiella pneumoniae
ttggtctcaaaaccccacgccgagggggcggcgaggctgccgcaaaatagcagccacgcgatagtgtttttcggcaatcccttcattccccctcccgtattaatcgtacgtcaggttaaagatcatatgcgactccacctcgccggtgctggtcgtcgggccatactgataaaaacgcgcgtgcagcggtatggtgatgtagcgggtctcctgattattcaagcggccgacggtgtatttcttattaaactgcagcggggagccatccttcagcacctgggtaatgactccaacttattgatagtgttttatgttcagataatgcccgatgactttgtcatgcagctccaccgattttga

SEQ ID NO: 4744 - DNA, 426 bp, Klebsiella pneumoniae
ggagaatcaaattatatggctatttcataccgtaaactcgacatcaacctgagctccgacaaagagaccgtgctggtcttcggtcaagagatgtccaccaagtatttcaccgagattgtagtgacctcaatgctgaatggtctacccgccctgagcgcaggagcacacgccatcctgacctccctgcacgctgctggacttaacgctaatgactacggggcgtattcccgagcgtggtctgagagcaacgcagaggcacgtagagaagctgagcgtcagcgcattgagaacgagaaagaccgtcagcgcatcgccgctatgtatgcaacccctgaagaaatcgctaaagaggccgcagagcgtaaggaacgtaaggcagaccttgagcgtcgcttcagccgtaaaggcgctgcattcggtctgtaa

SEQ ID NO: 4745 - DNA, 1203 bp, Klebsiella pneumoniae
acgtcgacaaaactttatgaatcaacgagaggattcaccatgtctgtaattaagatgaccgatctggatctggctggtaaacgcgtttttatccgtgcggatctgaacgtaccagttaaagacgggaaagtaaccagcgacgcacgtatccgtgcatctctgccgaccattgaactggcgctgaagcagggcgcgaaagtcatggttacttctcacctgggtcgtccgaccgaaggcgagtacaacgaagaattctctctgctgccggttgttaattacctgaaagacaaactgtccaacccggtacgcctggttaaagactacctggacggcgtggaagtggctgccggtgaactggtggtgctggaaaacgttcgcttcaacaaaggcgagaaaaaagacgacgaagaactgtctaaaaaatacgctgcgctgtgcgacgtgttcgtgatggacgctttcggtactgcgcaccgcgcgcaggcttccacccacggcatcggcaaatttgctgacgtggcgtgcgcaggcccgctgctggccgctgaactggacgcgctgggtaaagcgctgaaagagccagctcgtccgatggtcgctatcgttggtggttctaaagtgtccaccaaactgaccgttctggattccctgtctaaaatcgctgaccagctgatcgtgggcggcggtatcgctaacaccttcgttgccgctcagggccacaacgtcggtaaatccctgtacgaagcagatctggttgatgaagccaagcgcctgctgggcacctgcgatatcccggttccgaccgacgttcgcgtagcgaccgagttctccgaaaccgcaacggcaacccggaaatctgttaacgacatcaaagatgacgagcagattctggaccttggcgacgtttccgcacagaaactggctgaaatcctgaagaacgccaaaaccatcctgtggaacggcccggttggcgtattcgaattccctaacttccgtaaagggactgaaatcgtggctaacgctatcgcggacagcgaaggtttctccatcgccggcggcggtgacaccctggcagcgatcgacctgttcggcatcgctgacaaaatttcctacatctccactggcggcggcgcattccttgaattcgtcgaaggcaaagtcctgccggcagtagcgatgctcgaagagcgcgctaagcagtaa

SEQ ID NO: 4746 - DNA, 1158 bp, Klebsiella pneumoniae
aatatggcaaaacacctttttacgtctgagtccgtatcagaagggcatcctgacaaaattgctgaccaaatctccgatgccgtgctggatgcgatcctcgagcaggatccgaaagcgcgtgtcgcatgtgaaacctatgtcaaaaccggcatggtgctggtaggcggcgaaatcaccaccagcgcatgggttgatatcgaagagatcacccgcaacaccgtccgcgaaattggctacgtgcattccgatatgggctttgacgccaactcgtgcgccgtactgagcgccattggcaaacagtctccggacattaaccagggcgttgaccgtgccgatccgctggaacagggcgccggcgaccaggggctgatgtttggctacgccactaacgaaaccgacgtgctgatgccggcgccggtgacttacgctcaccgtctggtgcagcgtcaggctgaagtgcgtaaaaacggcaccctgccgtggctgcgcccggatgcgaaaagccaggtgaccttccagtatgacgacggcaaaatcgtcggcatcgacgcggtcgttctgtcgactcagcacgcggaagatatcgatcagaaatccctgcaggaagcagtgatggaagagatcatcaagccgattctgccgaccgaatggctcaacgcgtccaccaaattcttcatcaacccgaccggccgtttcgttattggcggcccgatgggcgactgcggtctgaccggtcgtaagatcatcgttgatacctacggcggcatggctcgccacggcggcggcgcgttctccggtaaagatccatctaaagttgaccgttccgcagcctacgcggcgcgctatgtggcgaagaacatcgttgccgcaggcttggccgatcgttgcgaaattcaggtttcctacgctatcggcgttgcagaaccgacgtccatcatggtggaaacctttggcaccgagaaagtgccttctgaacagctgaccctgctggtgcgtgagttcttcgacctgcgtccatacggtctgattcagatgctggatctgctgcacccgatctacaaagaaaccgcagcctacggtcactttggtcgcgaacatttcccatgggaaaaaaccgacaaagcggcgctgctgcgggaagcggccggtctgaaataa

SEQ ID NO: 4747 - DNA, 1071 bp, Klebsiella pneumoniae
gcctataaaaaagagggtaacacaatgaattaccgtaatatttttatcacactcgccgcactatccggcaccgtcacggcttcagcctggtctgcagagtccgccaccgtggcctttttaatgcccgatcaggcctctacccgctatgaacagcacgacttccccggttttaaggcggaaatgagcaagctttgcgcggattgtaaggtcatctatcagaatgccaacgccaacgcgtcgctccagcagcagcagttcaactcggttatcgcccagggggcgaaagtgatcgtcctggatccggttgactcttccgccgccgccgcgctggtcgaaaacgcccaagcgcagggggtcaaggtcattgcctatgatcgcccggtaccagacaaaccggctgatttctacgtctcatttgataacgagggcattggctacgccatcgcaaaatctcttaccgaccatctgaaagcgagcggcgtgccgcaggatgccggcgtgctgcaaattaacggttcgccaaccgatgccgccgcagggctgatccgcgacggtatccatcgcggattgaaagagtccggttacaaaacgttggccgaattcgacaccccggagtgggcgccgccgaaagcccaggagtggaccgccgggcaggttacccgctttggcgacaaaattaagggcgtggtcgcggcaaacgacggtaccggcggcggcgcaattgccgcctttaaggctgccggcgtccagccgctgccgccggtcaccggcaatgacgccactatcgccgcgctgcagctgatcatcgctggcgatcagtacaacaccatctccaagccatcggagatcgtcgccgcggcggcggccaaagtggcggttgattttatccagggcaaaaaaccgcaggccagcaccaccctgtacaacaccccttcccagctatttaccccggaagtggtgacggccaaaaacatcaaagcggaaatcttcgataaaaaaatccagacctgggatcaggtgtgtagcggcgagtacgccgccgcctgccagaagttaggcatcagcaagtaa

SEQ ID NO: 4748 - DNA, 603 bp, Klebsiella pneumoniae
ccctgtctgaaagcatatcccggaggaaaaatgcagccgtactttcactggatcaatgaacctgccgagtggcgccgcgattccgacggcctgacggtggtcactaataagcataccgacttctggcgccatacctggtatggcttcgagcgcttctctggccatctctatgccgcagaagtggcgggcgattttaccctgcaggcaaaaatctgtgcggatttcaccacgctttacgaccaggctgggctgatgatgatggccgacgagcagacctggctgaaggcgggaattgaattcaatgacgatgccccggccatcggcagcgtactgacgctaacccactccgactgggccaccgggcttttccccggcgacccgcgcaccttctggctgcggctgacccgcaagggcgatgcgttaaggctgcagtattcaaccgacggcgagcgctggccgctgctgcgtctcggctactttccgccaggcccggtgaaagcgggcgtcatgtgctgctcaccggagcgtggcggactggcggttgcgtttcaggatattcagctttccccgccgctggacaaagcgctgcacgatctgagctga

SEQ ID NO: 4749 - DNA, 897 bp, Klebsiella pneumoniae
gtatgtatgaatgaaaacaagctgctgggattggcatggatatcgccctatatcatcgggctgatcgtctttaccgcttttccctttgtttcatctttctttctcagttttaccgagtacgacttgatgagcccgccggtatttaacggcatcgaaaactatcgctatatgttgaccgaggatagcctgttctggaaatcgatgggggtgacctttgcctacgtctttttaaccatccccttaaaactggctttcgccctcggcattgcttttgtgctcaatttcaaactgcgcggcatcggctttttccgcaccgcctattacatcccgtcgatccttggcagctcggtggcgattgccgtgctgtggcgcgccctgttcgccattgacggcctgctgaacagttttctcgccgtctttggcatcgatgccatcaactggctgggggaaccctccctggcgctgatgtcggtcaccctgctgcgcgtctggcagtttggctccgcgatggtcatcttcctcgccgcgctgcagaacgttccgcagtcgcagtatgaggcggcaatgattgacggcgcctcaaagtggcagatgttcatgaaggtcaccgtgccgctgatcaccccggtgattttcttcaactttattatgcagaccacccaggcgttccaggagtttaccggcccgtacgtgataaccggcggcggtccgacctattacacctacctgttctcactctatatctacgataccgcctttaagtacttcgacatgggctatggcgccgcgctgggcgtgggtgctgtcctcgtcgtggcggtctttgcgtcgatcgcctttaagtcatcgaaatactgggtcttctactccgccgataagggaggcaaaaatggctga

SEQ ID NO: 4750 - DNA, 1206 bp, Klebsiella pneumoniae
cgatgctcgaagagcgcgctaagcagtaattcagttcaggcggggaaacccgcctgtttttcagcgcgcttaagggctcgcgaaccttcttcaacggtcgaagatacagatacaggactaagtaacatgtctaaaatttttgatttcgtaaaaccgggcgtcatcactggcgacgacgttcagaaagtgttccaggtagcgaaagaaaacaactttgcactgccggcagtaaactgcgtaggtactgattccatcaacgccgttctggaagctgcagcgaaagttcgctctccggttatcgttcagttctctaacggcggcgctgcgttcatcgcaggtaaaggcgtgaaaactgacgttcctcagggtgctgctatcctcggcgctatctctggcgcccaccacgtgcaccagatggctgaacactacggcgtgccggttatcctgcacactgaccactgcgcgaagaaactgctgccgtggatcgacggcctgctggacgccggtgaaaaacacttcgccgctactggcaaaccgctgttctcttcccacatgatcgacctgtctgaagagtccctgcacgaaaacatcgagatctgctctaagtacctggctcgcatggccaaaatgggcatgaccctggaaatcgaactgggctgcaccggcggtgaagaagacggcgtggataacagccacatggacgcttccgccctgtacacccagccggaagacgtggattacgcttacaccgagctgagcaaaatcagcccgcgtttcaccatcgccgcttccttcggtaacgtacacggcgtgtacaaaccaggtaacgtagttctgaccccgaccatcctgcgcgactctcaggaatatgtttccaagaaacacaacctgccgcacaacagcctgaacttcgtgttccacggcggttccggttcttccgctcaggaaatcaaagactccgtcagctacggcgtggtgaaaatgaacattgataccgacacccaatgggcaacctgggacggtatcctgcagtattacaaagcgaacgaagcttacctgcagggccagctgggcaacccgaaaggcgaagaccagccgaacaagaaatactacgacccgcgcgtatggctgcgtgctgcccagacttccatggtgactcgtctggagcaggcatttaaagagctgaacgcgatcgacgttctgtaa

SEQ ID NO: 4751 - DNA, 657 bp, Klebsiella pneumoniae
ccagcgcagaatagagaagatactgctggacctgatcttagaagccaagcgcaaaaagagaatctgacaaccttggacagtatattgctgtacaccaatgacaatctcattggtcactcaatctatcactaccttattgatagccatgaaaatgccacccgtctgagttatgccgatgtcatccatgagaaacatctgccactggcccagacgattattttcaatttaattaataaggatatttctgccatcaggatcgtcgatctgctgaatgcgctccgcctttccctgctgcgctgccagcagccggtgctaatggtgaaaagtgacattgtcgggctgtgcagagagttgataaactttgacaacgctatgattattagtgagaaatctccgctaactcttttttcatctatcgtccaacgcgccaaaggcgtcagcgaactgccgccgcgaggattgcgcaaacagctttcaccacgggagtgtcagatcctcgaactgctcattgccaacaataataataagcgtattgccgccctgctcggcattgctcataaaacggttcatagccaccgcatccatatcatgcaaaaactgggtattgataattcccgcactatgaatcagcgtattgccgctctccatcaatgctaa

SEQ ID NO: 4752 - DNA, 381 bp, Klebsiella pneumoniae
ttagcacggaaaaatgccgcgttttcttttatccatcatcgaaatatgtcaggctggagatcccattggattgccagggctttcaggatgagtacgatttatgtggttgttttaacgtatataaaaccgctcgaagaggttgaccgtgcgatccccgcccacatcgaatggctcaaaaaaggctatgccgacggcctctttctcgcctccggccgccgtattccccgcaccggcggcgtcattctggcaaaatgcgatagccgggaaactctgcaagcgcgtctgagccaggatcccttccagcagctgggtctcgcccgtacagagattattccctttgaggccagcatggcgtcacccgcgctgcagtcgctgttataa

SEQ ID NO: 4753 - DNA, 330 bp, Klebsiella pneumoniae
ccaggacggaattatatcatgcaggccaatgacattaccttttttcagcgttttcaggacgacatcctcgccgggcgcaaaaccatcaccattcgcgatgcagcggagtcgcactttaagcccggcgatgtgctgcgcgttgggcgctatgaagatgacggctatttttgcaccattgctgtgaccgcgacctcgacggtgacgctcgatacgctgaccgaacagcatgcgcaacaggagaatatgactctcgggcagctgcggcaggtcatcagcgacatctatcctggcgagagccagttttatgtcattgaattcaaaacgctttaa

SEQ ID NO: 4754 - DNA, 513 bp, Klebsiella pneumoniae
gcggaggctgaaatgaaatggactcatgtgggctggctgctggccggcctgttaaccgcgagcgcttccctgcgggcggccgacgtcactctcaccgtcaacggcaaggtggtggccagaccctgcacggtttccaccgtcaatgccaccgtagagctgggcgatctctatacctttagcctgatcggtgcgggctcggcatcggcctggcacagcgtggcgctggatctgagcaactgccccgtgggtacttcacgggtgaaagccaccttcagcggaacggcggacagcaccggctattacaaaaaccagggaacggcgggcaatattcagctcgaactgcagaacgaggacggcaccacgctgaacaatggcagcagccagtcggtacaggtggatgaggccagccagtccgctcgcttcccgctgcaggtcagggcgctgtccgtcaacggcggcgccacgcaaggcaccattcaggcggtgattaacgtcacctatacctacgcctga

SEQ ID NO: 4755 - DNA, 525 bp, Klebsiella pneumoniae; identical to SEQ ID NO: 2057

SEQ ID NO: 4756 - DNA, 699 bp, Klebsiella pneumoniae
gtgggcaatgaaagcgttcttgttttcacggagtccagtatggttcgcaaaccattaatcactcagggatattctctggcagaggaagttgccaacagcatcagccacgggatcgggctggtgttcggtatcgtcggccttgtgttgctgctggtgcaggcggcggacacgaacgccagcgcgacggcgatcgccagctacagcctgtacggcggcagcatgattatgctgttcctcgcttccacgctctatcacgcaatcccgcatcagcgggcgaaacagtggctgaagaaattcgaccactgcgccatctatttgctgattgccggaacctacacgccgtttttgctggtggggctcaattcaccgctggcgaaggggctgatgatcgtcatctggagcctggcgctgctggggatcctgtttaagctgacgattgcgcaccgctttaaaattttgtcgctggtgacctatctgaccatggggtggctgtcgcttatcgtggtctatcagctggcggtgaagctggcggtgggcggggtaacgttgctggcggttggcggggtggtgtactcgctgggggtcatcttctacgtctgcaaacgtattccttataaccacgctatctggcacggcttcgtgctcggcggcagcgtgtgtcacttcctggcgatttatctttacatcggccagtcctga

SEQ ID NO: 4757 - DNA, 789 bp, Klebsiella pneumoniae
cgcacaggtgattttgtggaaaaagcgatagttccgccggaaaagaagccctatcaggagattggtgatgacctgcgcgcccagatcgcgcaggggcgctacccggtcgggtcgcgtttgccgccggaacgccatattgccgaaacctatggcgtcagccggaccatcgtgcgcgaagcgctgctgatgctggagctgcaggggacggtggatattcgtcagggatccggggtgtatgtcatgcgtattccccacgagaacgacagcgaagaggagcagctgctcagcagcgacgtcggcccgtttgaaattctccaggcgcgccagctgctggagagcaacatcgccgcctttgccgcgaaaatggccacccgcgccgatatcgacaatctaaagcggattattgaacaggagcagcgggcaatcgctctcaacgacaccgcgcaggataacgctcgtctgttccatctggtgctcgccggggcgacgcagaaccagatgctgttggcgacggtagagcggatctggctgcagatggacagcagcccgctgtggcagcagttcaatgtgcatattgccagccgcgcctggcggctgaaatggctcggcgaccggcagactctgctcgccgcgctgcggcgtcgcgatgtgatgggcgcctggcaggcgatgtggcagcatctggaaaacgtcaaaaacagcctgctggagctgtccgatgaggacgcccccgactttgacggctatctgttcgactcagtgccgatttttcaggggaagctggtatga

SEQ ID NO: 4758 - DNA, 585 bp, Klebsiella pneumoniae
accaggaacgaacctctgacaatgaatttacagcatcactttctgattgccatgcccgcgcttcaggaccccattttccgccgctccgtagtctatatctgcgagtacaacgacgagggtgccatgggcattattatcaataagccgctggaaaatctgcaggtggaagggatccttgagaagctcaaaattgtcccggagccgcgcaatccagagatccgtctggataaaccggtgatgctgggaggcccgctggcggaagaccgcggcttcattttgcataccccgccctctgacttttcctcgagcattcgcatctcggataacacggtgattaccacctcgcgggatgttcttgaaaccttaggtaccgatcggcagccgggcaacgtgctggttgcgttgggctactcttcgtgggagaaagggcagctggagcaggagattttagataatgcctggctcaccgccccggcggatcagaatattcttttccgtacgccgatcgccgatcgctggcgcgaggcggctaaactgattggtatcgacattgtgacgatgccaggcgtcgcggggcatgcgtga

SEQ ID NO: 4759 - DNA, 204 bp, Klebsiella pneumoniae
atgaatcgcgaaagggattgggttgctatcttcgccgacagcatgaaatcgattactgctgatctgccccagattgaccgtcatctgccgatcgccggcttcgacgcggcaggagctcgccattatcaggccctgaaaacgcatgctgccccccggcagcgtgacgttccaatgattaccggccagcgccagcggaggcagtag

SEQ ID NO: 4760 - DNA, 1488 bp, Klebsiella pneumoniae
accggtggcgatgaagatcagctccggctggccggcgcaatctttcagcacataaccgccgcgggccacgttcgccagctgctctgcggtacgctcctgctgcgccaggttctgacgggagaggatcagcgcggtcgggccgtcctgacgctccacgccatatttccacgcaatcgcggattccacctggtcacacggacgccaggtggacatgttcggggtcacgcgcagggaagccacctgctctaccggctggtgagtcgggccgtcttcgcccagaccgatggagtcgtgggtgtagaccatcacctgacgctgtttcatcagcgcggccatacgtaccgcgttacgcgcgtattccacgaacatcaggaaggtggaggtgtacggcaggaagccgccgtgcagcgcgataccgttggcgatagcggtcataccgaactcgcgcacgccgtagtggatgtagttcccggcagcgtcttcgttgatcggcttagagccagaccacagggtcaggttggacggcgcgagatctgcggagccgccgaggaattccggcagcagcgggccgaaagcttcgatggcgttctgcgaggctttacggctggcgattttcgccgggttggcctgcagcttcgcgatgaactcgttagctttcgcgtcgaagtcagacggcatctcgcctttcatacggcgggtgaattcggctgcttcctgcgggaaggctttggcgtaagccgcaaacttctcgttccatgcggcttctttcgcctggccggcttctttggcatcccactgggcatagatgtcagacgggatgtcaaacggcgcgtgtttccagcccagcgcttcgcgggtcagggcgatttcggcgtcgcccagcggcgcgccgtgggagtcgtgggtaccggctttgttcggcgaaccgaaaccgatgatggttttgcacatcagcagggacggtttgtcggtgaccgcccgtgcttcttctaccgcgcgtttgatggcgtcagcgtcgtgaccgtccacgccgcgcaccacgtgccagccgtaggcttcaaagcgtttggcggtgtcgtcggtgaaccagccttcaacgtggccgtcgatggagatgccgttgtcatcatagaacgccaccagtttacccagtttcagggtaccggccagggagcacacttcgtgagaaatgccttccatcatgcagccgtcgcccatgaaggcgtaggtgtagtggtcgacgatatcgtgtcccggacggttgaactgcgccgccagggttttctcggcgatagccatcccgaccgcgttagcgataccctggcccagcggaccggtggtggtttccacgcctgcggtgtagccgacttccgggtgacccggggttttggagtgcagctggcggaagtttttcagctcttcaatcggcagatcgtagccagtgaggtgcagcaggctgtaaatcagcatcgaaccatggccatttga

SEQ ID NO: 4761 - DNA, 1035 bp, Klebsiella pneumoniae
ttgtatagcctgtactctgcggcaatggcggaggaaaaaatggcgtccctgaaagatgtagcaaaactggcgaatgtatctctgatgaccgtctcacgggcgctgaacaccccggagcggctgaagcctgagacactggcccgcgtgcaggccgccatcgccgaaaccaactacgtccccgacctgtcggcgaagaagatccgcggggcgcgcgccacccccagcaccatcggcgtgctggcgctggataccgtgaccacgcccttttcggtggagatcaccttatcgatcgaagagacggcccgcgcccacggctggaacagctttgtggtcaatatgttttctgacgatcgtccggaagcggtggtcgacctgctcctctcccaccgtccggacggcattatctttaccaccatgggcctgcgccaggtaccactgccggaaaaactgctgactctgccctgcgtgctggccaactgcgaaagcctcagccagccggtggcctgctatatcccggacgatgaacaggggcagtacgacgcggtgaaagccctgcttgccgctggctatcgtcgtccgctgtgcctgcacttacccgccagccagccggcgacgatccgccgccgccgggggctggagcgcgcctgccgggaggccggtatcgaaccggaccatctgagccattcgtatatgggccagggcgatgagcattaccacgatatcccggcggtggtgctggcgcatatccgcgagggcaaacctggctttgactcagtgatctgcggcaacgatcgcatcgcgtttatggtctatcagacgctgctgggccaggggttacgcattccacaggacgtggcggtcgtgggatacgacaacatggtgggcattggcgatctgtttctaccgccgctctccacagtgcaattgccgcattatgacatcgggcgcctgagcgccctgcatatcattcacggcgacaaccatcgggagacgcgcaaagtcgccagcccgtggttgccgcgcgcctcacattaa

SEQ ID NO: 4762 - DNA, 1431 bp, Klebsiella pneumoniae
ccatcgacagaatcaataactcaactggagggcgttatgcctgacaacaaaaaacaagggcgttcgaacaagactatgacgttcttcgtctgtttcctcgccgcgctggctggcctgctgttcggccttgatatcggtgttattgcgggtgccttaccctttattgccaatgagttccagatttccgcccacacccaggagtgggtggtcagctccatgatgttcggggctgccgtcggcgcggtcggcagcggctggctctctttcaaactgggccggaaaaagagcctgatgatcggcgccatcctcttcgtcgccggttcgctgttctctgccgccgcgccaaacgtcgagatcctgctggtttcccgtgtgctgctcggcctggcggtgggcgtcgcctcatatacggctccgctgtatctgtcggaaatcgccccagaaaaaattcgcggcagtatgatttccatgtaccagctgatgatcaccatcgggatccttggcgcctatctctctgacaccgctttcagctacagcggcgcatggcgctggatgctcggggttatcatcattccggcggttttgctgctgatcggcgttatcttcctgccggacagcccgcgctggttcgccgccaaacgtcgctttgtcgatgcggaacgcgtgctgctgcgcctgcgcgataccagcgccgaagcgaaacgcgagctcgatgaaatccgtgaaagcctgaaggtaaaacagtccggctggtcgctgtttaaagacaacagcaacttccgccgcgcggtgttcctcggcatcctgctgcaggtgatgcaacagttcaccgggatgaacgtcatcatgtactacgcgccgaagatctttgagctggcgggttatgccaacaccactgagcaaatgtgggggacagtgatcgtcggtctgactaacgtgctggccacctttatcgccatcggtctggtcgaccgctggggccgtaaaccgacgctgatccttggctttatcgtgatggccgcgggaatgggcgtcctgggtaccatgatgcacatcggcattcactcctctaccgcccagtacatcgccgtcctgatgctgctgatgttcatcgtcggtttcgccatgagcgccggcccactgatttgggtactgtgctccgaaatccagccgctgaaaggccgcgacttcggtatcacctgctccacagcgaccaactggattgccaacatgattgtcggcgccaccttcctgaccatgctcaactcgctgggcagcgccaataccttctgggtgtacggcggtctgaacgtgctgtttatcctgctgacgctgtggctgatcccggaaaccaaaaacgtctcgctggaacatattgaacgtaacctgatgcagggtcgtccactgcgcgagatcggtgcccgcgattaa

SEQ ID NO: 4763 - DNA, 252 bp, Klebsiella pneumoniae
ataaaaaaagatacaaacagtcgtgaatttataaatcaccaaggtaatttacaaactgaaacgttattccatgagaatcatcctattcccacaaacagcataaatcgaatgactcaaagctgtcaaaagataatcaaacttttttcctggaaatgcgtattcactgtcgacatatctaatctgaatgtgttatttgaatttataatcaaaagttatttgtattaccaaataatattaataaacaacaaataa

SEQ ID NO: 4764 - DNA, 1002 bp, Klebsiella pneumoniae
gcgattcaggatatgactatggcttttacaccttttcctccgcgtcagccttcctcttccgctcgtctgccgttaacgctgatgaccctggatgactgggcgctggcgacaattagcgggccggacagcgaaaaatatctgcaggggcagattaccgccgatgtgagtcatctcaccgatgcccagcatctgcttgccgcccactgtgatgccaaaggcaagatgtggagcaacctgcgcgtattccgtcgcgagggcggcttcgcgtggattgagcgccgcagcctgcgcgacgcgcagctgaccgagctgaaaaaatatgccgtcttctccaaagtcaccattgccgccaacgacgatctggttctgctgggagtagccggcttccaggcgcgcgccgcgctggcgccgctgttcgccgccttgcccgacgctgccaccccggtggtcagcgaaggcgccaccagcctgctgtggtttgaacacccgggcgagcgcttcctgctggtgaccgatgtcgacaccgccaaccgcgtcaccgacgcgttgcgcggcgaagcgcagtttaacaacagccaacagtggctggcgctgaatattgaagccggcctgccggttatcgacagcgctaacagcgggcagttcattccgcaggccaccaacctgcaggcgctgggcggcatcagcttcaaaaaaggctgctacaccggccaggaaatggtcgcgagggcgaaattccgcggcgccaataagcgcgcgctgtggacgctgtcagggaccgccagccgggtgccggaagccggggaagacctggagctgaagatgggcgacaactggcgccgcaccggtacggtgctggcagccgtacagctggatgacggaagcctgatggtccaggtagtgatgaataacgacatggaaccggacagcgtgttccgtgtacgcgacgatgccggcagcctgagcatcaaaccattgccgtattcgctggaagaaaattaa

SEQ ID NO: 4765 - DNA, 780 bp, Klebsiella pneumoniae
acgactaaggaacataatatgattcttgatgcattctccctgcagggaaaagtggccgtcgtgagcggatgcgataccggtttaggtcaggggatggccctcgggctggcggaagcgggctgcgatattgtcggtatcaatatcgtcgaaccggtggagactatcgagcgggtaaccgcgctgggacgccgttttctcagcctgaccgccgacctgcgccagatcgacggtattcctcagcttctggagcgggcggtggcggagttcggccatattgatattctggtcaacaatgccggcctgattcgccgcgaggacgcgctggcgttcagcgaaaaagactgggacgacgtgatgaacctcaacatcaagagcgtattttttatgtcccaggcggcggcgaaacactttatcgcccagggcagcggcgggaagatcattaacatcgcctccatgctgtcgttccagggggggatccgcgtgccgtcgtataccgcatccaaaagcgcggtgatgggcgtcacccgcctgctggccaacgagtgggccaaacacaacatcaacgtcaacgccatcgccccggggtatatggcgaccaacaacacccagcagctgcgcgccgacgagcagcgtagcagcgaaatcctcgatcgcattcccgccgggcgctgggggctaccggccgatctgatggggccagtcgtgttccttgcctcctcagcctccgattacatcaatggctacacggtggcggtggacggcggctggctggcgcgctaa

SEQ ID NO: 4766 - DNA, 1182 bp, Klebsiella pneumoniae
aggatgaaggatgtcgtgatcgtcggcgcgctgcgaacgccgattggctgctttcagggcgcattatcgcgccattcagccgtcgagctggggagcgtggtggtgaaggcgctggtggagaagacgggaatcgatccgcacagcgtggatgaggtgatcctcggccaggtgctgaccgcggggaccggacaaaatccggcgcgtcagtccgctattcgcggtgggctgcctaacaccgtatcggctatcaccattaacgatgtctgcggttccggcctgaaggctctgcacctcgctacccaggcgatccagtgcggggaagcggacgtggtgatcgctggcggccaggagaatatgagccgcgctccgcatgtgcttaccgacagccgcaccggcgcccagctgggcaacagccagctgattgacagtctggtgcatgatgggctgtgggatgctttcaacgattatcatatgggcgtcacggcggaaaacctggcccgggaatttggcatcagtcgcgagctgcaggacgcctgggcgctcagctcacagcataaggcgcgcaaggcgattgattccggtcgctttcgcgatgagatagtcccggttgtcaccgagcataacggcgcggcgcgcaccgtggataccgatgaacaaccgcgggtggatgccagcgcggaagggctggccagcctgcagcccaccttcgatcgccttggatcggtgaccgccggtaacgcctcaagcatcaatgacggcgcggcggcggtaatgatgatgagcgaggctaaagcgctggagctggggctgccgatccttgcgcggatccgcgccttcgccagcgtcggcgtcgatccggcgctgatgggcattgccccggtgcatgccacccgtcgctgtctggagcgggccggctggcggctggacgacgtcgatctgattgaagccaatgaggcctttgccgctcaggcgatctcggttggccgggtactggagtgggatgagcgccgggtcaacgtcaacggcggcgcgatcgccctcggccaccccatcggcgcctccggctgccggattctggtgtcgctggtgcatgaaatgatcaagcgcgatgcccgcaaaggtctggcgacgctgtgcattggcggcggtcagggcgtggcgctggcggtagaacgcgcatag

SEQ ID NO: 4767 - DNA, 288 bp, Klebsiella pneumoniae
ataagcgaggagaagatggaaatactggaagggcataacaaattttatgttaacgacgcgcagggaaaccaggtggcggagattgtttttgttcccaccggcgaacacctcagcattatcgaacataccgatgttgatcccagcctgaaaggccagggcgtggggaaacagctggtggcgaaggtagtggaaaaaatgcgccaggagcagcggaagattatccctctctgcccgtttgccaaacatgaattcgataacacccgcgaatacgacgatattcgcgcatga

SEQ ID NO: 4768 - DNA, 291 bp, Klebsiella pneumoniae
tcactcagggatgttccattgaatcatattgccaccatcgcccgcccggcgcggttactgctcgtcttgccgctttccggctgctcactttcgccagagatcccggtattgggcgctgcttttcccggctggtttttctgcttactgggcggtgcgtttttactgatcccctgccatatcctgattacccgtaaaggctggcagccgcgcttttctcccctggtcttcagctacgtcgcgctgatgttcctgttcgccacgttgctgtggtttctgttttttgttcactga

SEQ ID NO: 4769 - DNA, 1017 bp, Klebsiella pneumoniae
agatggcttttaccaggcggaaggcgcactattttcactttattgttgcatcaaacgccttatcttaatgtgctgggaggaagggtaatgtctgatcccgattttaatttgctggtagctctcgacgtattgctgagtgaagcgagtgtcgcaggtgcggctcgtcgtctgaacctcagcacttcggccatgagccggacattaagcaggttacgcgatgtcacaggagacccgatcctggtacgcgccgggcgtaacatggtactgaccccgtgggccgaagcgacccgggatcgcgccaggcgtgcagtgcacgatgccagggcggtattacagccctcaactgaaacgttcagcgcgcaaaatctggcgcgtctttttaccatcagggcaaacgatggttttgtggtggcgtttgggcctgcgcttatagcagcggttgccgacgccgcgccggacgtctgtatacgcttcgcgcctaagccggaaaaaacgtcgcgctatcttcgggaagggctggttgatctggagattggcgttcagagtaatatggggccagaaatacggctgcaacgactgtttgaggatcggtttgttggcgtcgtccgtaaagggcacccgctggctaagcaggctgaaataggcgtgagtgattatgtcgcctggggccatgtggtagcgtcacccgagggcgcgttgcacggatccgttgacgatgcgctggccgaactggggacaaaacgtaaaattgcgagcgtcgtaccgggatttccgacagcactttccgtggcgctggaatcggatcttattgccatgatacccgcactctatttactcaatcagcaggtaacggaccaggtacaccttttcgagctgccgttcaaaagccgtcgtattacggtatcgcagatgtggcacccaagaatggaacgcgaccccggtcaccgctggctgagagagcaaattcttgcgatatgcggtgtggcccggtcagtcatgactaaggagcctgtatag

SEQ ID NO: 4770 - DNA, 213 bp, Klebsiella pneumoniae
catcatttactcaacatgaggaaaagatactttgaggtgagcattcagtgccgaacaacttctcaagttgagaacccaaaagttatccccaatccggtcatcgcagaccgttatcaaaaccagtctttatgcaacgcctttatgctgccgtcagctccctttacgtggggtctggttggctggcgcaggtgcgaacatagaggcgttacataa

SEQ ID NO: 4771 - DNA, 234 bp, Klebsiella pneumoniae; identical to SEQ ID NO: 2064

SEQ ID NO: 4772 - DNA, 294 bp, Klebsiella pneumoniae
cctatattttgctgctggaaggtcaacatggacattaacaataaagcacgtatccactgggcatgccgccgcgggatgcgcgaactcgacatctccatcatgccgttctttgagtatgagtacgataccctcagcgacgctgacaaacagctgttcattcgcctgctggaaaatgacgatccggatctgttcaactggctgatgaaccacggcaaaccggccgatgcggagctgcagcggatggtaaccttaattcagacacggaatcgggaacgtggtcctgtggcaatctga

SEQ ID NO: 4773 - DNA, 525 bp, Klebsiella pneumoniae
aagagcagttggcgaaagcccgtggccagtaaaatcaggcgctggctgcgcgagctggcggtgtggctgctgattggcgcggcggtgagcctggcggtggattattttcgccagcccgcgctgccgcaaaacgtcagcgccacatcgctgcagacactcgacggcaggacgctggatctgaacgccatgagccagcaaaagccgctgctgctgtacgtctgggcgacctggtgcggagtttgtcgctataccacgccgtcggtggcatcgcttgccgccgacggcggcaatgtgctgacggtagccctgcgttccggcgataacgccgcgctggagaagtggctgagcaggaagaaaatggcgctgccgacggtaaatgatccgagcggccagctggcgcggcagtgggatatccaggtaacgccaacgctggtggtcatttctcaaggcgaggtaaagtcggttaccaccggctggaccagcagttggggaatgcgcctgcggctgtggctggcctcctggtag

SEQ ID NO: 4774 - DNA, 951 bp, Klebsiella pneumoniae
ttaaccccctgtaccgtacggcacagggggttaccggggttattcgcccttcttcgccgcctggatgtacagcatctccagcgccagggtcgccgccgccagagcggtaatttcggactgatcgtaggccggggcgacttccaccacgtccatcccgacgatgttcaggtccttcaggccgcgcaccagcttgatcgcgcggtcggaggtcagcccaccgataaccggggtaccggtgcctggcgcaaacgccggatccagacagtcgatatcaaaggtcaggtacaccggcatgtcgccgacgatctgcttcacctgggcaatcacgtcatcaacgctgcggtcgttaacctggccggcgtcgagcaccgtaaagccattgtctttgtcgaactcggtgcggatcccgatctgtacggagtggttcggatcgataagcccttcgttcggcgcggtatagaacatggtgccgtggtcgaactcgcagccgttggcgtaggtatcggtgtgagcatcgaagtgcaccagcgccattttaccaaagtgcttggcatgggcgcgcagcagcggcagggtaacgaagtggtcgccgccaaaggagagcatacgtttgccggccgccagcagcttctcggcgtgagcctgcagcttctcgctcatttcgcgcgcgtcgccgaaggcgtacaccagatccccacagtccaccacgttcaggcgctcgcgcatatcgaagttccacgggaaacggttgtgctcccaggcaaggttagtggaaacctgacggatcgccgccgggccatgacggccgcccgcgcgcccggaggtcgccatatcgaacggcacgccggtgatgacccagtccgcatcgctttcatacggcataaagttcattggcaaacgcagaaagccaaaggcattggataccagggagttatcgtattgatgacctaa

SEQ ID NO: 4775 - DNA, 1257 bp, Klebsiella pneumoniae
attaacacctgtcttttaaaacatatcactcagcgacacgcctctggtccagcggcatcgcaggaaagaaaggagcactacatggctaaaggcatgcgggtcaaactgaattatcacgtcagccacgatccggataccggggcggaagtcacccgcttaacccccccggaggtcacctgtcatcgcaactacttctatcagaagtgcttttttaacgatggcagccatttactgttcgccggcgagtttgacggccactggaactactatctgctgaatatcgccagcgccgaggccgtccagctaaccgaaggcgccggggataacaccttcggcggcttcctctccccggacgataagtcgctttattacgtgaaaaatgaccgtattctgctggaagtcaacctgaccaccctcgccgagcgcgaagtttatcgcgttagcgatgactgggtagggtatggcacctgggtggcaaacagcgattgcagcaaactggtgggcattgagattgccaaaagcgactggacgccactcaacgactggcagattttccatgatttcttccataaaggaccgcactgccgcctgctgcgcgtcgacctgcgcagcggtgagagccaggtgatccatgaggaaaaaatctggctgggacacccgatctatcgtcccttcgacgaccataccgtcgccttctgccatgaagggccgcacgatctggtggacgcccgcatgtggctggtcaacgaggatggcagccatgttcgcaaagtcaaagcgcatgctccaggcgaaagctgtactcatgaattttgggtgccggacggttcggcgctgatctacgtctcctatctgaaaggccagcaggggcggacgatctatcgctttgatcctgaaagcggcgtcaacgaggccctgatgacgatgccggcctgctcgcatctgatgagcaatttcgatggcacgctgctggtaggcgatggctcaggtacaccggtggatgtcaaggataccggcggctactccattgataacgatccctggctgtatgtctttaacgtggcggaaaagcgctacttccgcgtcgcgcgtcatgatacctcgtgggcgacggtggccaacagccgccaggtaacgcacccgcacccctcatttaccccggacgatagcgccattctgttcagctccgataaagacggtaaaccggccatctatatcgcgaaattacccgcgcacccgtcaatgctgagcgcctga

SEQ ID NO: 4776 - DNA, 1557 bp, Klebsiella pneumoniae
tcatgggcctgctggtgttctgcaccacctttatttccatcttcttgttgcgctccggcaaatcctccgccgatccgctggtgtcgcaacctaccgctatctgaatcaaaaagagtgaaaatgatgacttacacaatctcccgggctgaacaggtactccagacacaacgccaggcgctcaatctgcgctggtatccgcactatcacctggcggcccgcgccgggtggatcaacgacccaaacggtctggtgtggttcgacggctggtaccatgccttttatcaacatcacccgtactccacccagtggggaccgatgcactgggggcacgcgcgcagtaaggatctggtgcactgggagcatttgccggtagccctggcgccggagggcccggaggataaagacggctgcttctccggctcggcggtggtcgatggcgataccctggcgctgatttacaccgggcataagttccacggcgatcctggcgacgaagccaatctgtatcaggtgcagtgtctggccaccagccgcgacgggatccactttgagcgccaggggatggtggtcgacaccccgccgggtatgcaccacttccgtgacccgaaggtctggcgtgagggagatagctggtacatgatcgtcggcgcgcgcgaaggcgataccggccaggtgcggctgtaccgttcagccgatctgcgccagtggcaggacgcgggggtgctggatgaagcggaaagcaccatgggctatatgtgggagtgcccggacttcttcaccctcaacggcaaacgcgttctgatgttttccccacaggggatgcaggccgcggggttcagcaaccgcaatctgttccagagcggctatctgatcggcgagtggcagccaggccagcgttttattcgccatggcgaattccgggagatggataacggccacgatttctatgccccgcaaagcttcgccacccccgatggccggcggatcgtgattggctggctggatatgtgggaatcgccgctgccggagcagcaggacggctgggcgggcatgctctccctgccgcgcgagctgagcctgagcgcggatgaccgcctgcagatgcgcccggcgaaagaagtggagagcctgcgcggcgcctggttcccgtggccggtcagcaccctgaacaaccagcagacgacgatggtcgacaactgcgaggcgatggaggtgaatctgcgctgggactgcgcccgcagcagcgccgagcagtatggtctgcgctttggcgatggcctgcgcatctacgtggatgcccaacagcagcgtctggtgctggagcggcattatccgcagtatggcctgtgcgggacgcgcagcgtgccgttgaccgccggggcggatctcaacctgcgaatatttttcgatagctcttcggtggaggtttttgtcaatgacggcgaagcctgcctgagcagccgtatctatccgcaggctccccaccgtgaattagcgttatttgcctggagcggctcggcggcattaaccgaagccggcgcctggcagctcgaataa

SEQ ID NO: 4777 - DNA, 1164 bp, Klebsiella pneumoniae
aactgttactggaagcattacgtaatggctaatttgccgccgctgagtctctatatccatattccctggtgcgtgcagaaatgcccgtactgcgattttaattcgcatgcgctgaaaggcgaggtgccgcatgatgactacgtccagcatctgctgaacgatctgcaggctgatgcgcactatgcccagggacgggaaataggcactatttttatcggcggcggtacgccgagcctgctgtccggcccggccatgcaaaccctgctcgatggcgtccgcgcctgcctgccgctggccgccggggcggaaatcaccatggaagccaacccgggtaccgtggaggccgatcgcttcgttgattatcagcgcgccggggtgaaccgcatctccatcggcgtacaaagctttagcgaaccgaagctgcagcgcctggggcggatccacggcccggaggaggccaagcgcgcagcacgtctcgccagcggcctcggcttgcgcagcttcaacctcgacctgatgcacggtctgccggaccagtcgctggaggaggcactggacgatctgcgtcaggcgattgccctcaacccgccgcacctgtcgtggtaccagctgaccattgagccgaacaccttgttcggctcccggccgccggtgctgccggatgacgacgcgctatgggatattttcgagcaggggcatcagctgctgagcgccgccggctatcagcagtacgagacgtccgcctatgctaagccaggcttccagtgtcagcataatctcaactactggcgctttggcgactacctcggcatcggctgcggcgcgcacggcaagatcaccttccctgacggacgcattctgcggaccgccaaaacacgccacccgcgcgggtatatggaaggccgttaccttgagcgtcagcatgatgtggaagaagcggataaaccgtttgagttctttatgaaccgttttcgcctgctggaggccgcgccgcgcgcggagttcagcttgtataccggccttgatgagcaggttatccgtcagcaaatcgatgccgctatcgccgaaggctatctgctggaagatgcgcaaaactggcaaattaccgagcacggtaaactgtttttaaattcgctgctggagctgttcctcagcgaagagtaa

SEQ ID NO: 4778 - DNA, 780 bp, Klebsiella pneumoniae
gtcagaatatgtaaggcagtttgccgtcgcccggcaaatggcggtagcatttgcgcgattaaaaacgcggtaccccacggtcgatacgttgtctctgggaatgtcggacgatatggaagccgcaatcgcggcgggaagcacgatggtgcgcatcggtactgccatttttggtgcgcgcgactacagcaaataataaggaatctgaggaacgccatgaagacgttgactttcctgctttcaacggtcattgagctttacacgatggtcgtgttgttacgcgtctggatgcagtgggcgcgctgcgacttttacaacccgttttcgcagtttgtggtgaaagccacgcagccgattgtcggaccgctgcgccggattatcccggcaatggggccgattgacagcgcctcgctgctggtggcatttattctatgcgtcatcaaagcgatcgtgctgtttatggtgatcaccttccagccgatcatctggatctccgctctgcttattctgctgaaaaccatcggctcgttgatcttctgggtactgctgttgatggcgatcatgagctgggtcagccagggccgtagcccggtggagtatgtgctgatgcagctggcggacccgctgctgcgccctatccgcaacctgctgccgtcgatgggcggtatcgatttctcgccgatggtgctggtactgctgttgtacgtaatcaatatgggcatcgccgaagtgctgcaggccaccggtaatgtactgctgccggggctgtggatggcgctatga

SEQ ID NO: 4779 - DNA, 729 bp, Klebsiella pneumoniae
acaaaaggactgagtatgaaaaaaggtttattgatgttcaccctgctggcggcctccctttcaggagcggcgcacgccgatagcgcggcaattaaacagtcgctggcgaagctgggtgtgcagagcaccgatattcaaccatcgccggtttccgggatgagcacggtgctgaccgacagcggcgtgctgtacgtgaccgacgacggcaaacatatcatccaggggccgatgtacgacgtgagcggcgcgcagccggtcaacgtcaccaaccagctgctgctgggtaagctgaacgcgctgagcaatgagatgattgtctacaaagcgccgaaggagcagcacgtcatcaccgtcttcaccgatattacctgcggctactgtcataaactgcacgagcagatgagcgactacaacgcgctggggatcaccgtgcgctatctggctttcccgcgccagggtctgcaaagccaggcggagcaggacatgaaggccatctggtgcgcgaaagatcgcaacaaagcgctggatgacgccatgaatggtaaaggcgtgcagccggcgagctgcagcgtagatatcgccaaacattacaccctcggcgtgcagatgggcgtcaacggtacgccggcgatggtcctcagtaacggcatggtgctgccgggctatcaggggccgaaagagctgaaggcgttcctcgatgagcacaaaaaacagacaagcggtaactga

SEQ ID NO: 4780 - DNA, 360 bp, Klebsiella pneumoniae
ccagaagctcgtatagcgcaactctcccgccctgacgtgcaggtaacaatttttgcgccagcaccgcgcacaggcttccggcaagctggctacgaacctgatctttctcctccgccggaaagacatcgatcaatctctccaccgccggcgccgcgccgcgggtatgtaatgtcgccattaccaggtgcccggtctccgccgcggttaacgccaggcgaatggtttcgctgtcgcgtagctccccgagcaggatcacatccggatcctggcgcagcgccacgcggagcgccgcggcgaacgaagggcagtgacggccaacttcccgctgctggatcagacagcgctcgctgtgatgaataa

SEQ ID NO: 4781 - DNA, 342 bp, Klebsiella pneumoniae
caacaggatcgcccgatgtttatttttcataaagacaccacccttgaagacctcggcaatggcgtaacccgccgcattctggcccacgacggcaaaatgatggccgtggaggtgaattttgccgccggcgccgtcggcccgatgcataaccatcctcacgaacagctcacctatgtgctttccggcgagttcgagttcaccatcggcgaggagacgcgcgtcgtcagcgccggcgatacgttgtataagcggccggggattatgcacggctgcgtctgcctgcagcccggcacgctgctcgatacctttactcccattcgcgaagattttcttgaaggctaa

SEQ ID NO: 4782 - DNA, 435 bp, Klebsiella pneumoniae
aggcgataccgtccagcagcggcccgccgtcaaccggttcgaccatcaccttcaggtgacgctcgcccaccagccgctgctgcagcaggcgaaaacgaccgtcaaacagcggttccgggaacatctgcccccacggcccggcgtcgcgcagcatctgcgccacttccatgctcatctccgccgccgccagcgggccatcggaaaccacctcgccctgcaacagcgcaggatccagccattcggtcaccagctcgccgaagcgctgttgaaactcttcaaaacgcgcctcctccagcgataagcccgccgccatcgcgtggccgccgaacttcaggattagcccgggataaagcgtatcaaggcgctccagcgcatcgcgcatatgcaacccctgaatggaacggccggagcctttcagcgtgccgtcgccggtag

SEQ ID NO: 4783 - DNA, 2187 bp, Klebsiella pneumoniae
ctcatcaaccggtcacatggagttgttatgcttttgggatttttcagactgctgttcaaggggttataccgggtcagactgaccggcgacacgcaggctttataccagcaaaaggtcttaatcaccccgaaccacgtctctttcctcgacggcattctgctggcgctgtttttgccggtccgaccggtttttgcggtttatacctcaatcagccagcgctggtttatgcgcgcgctgacgccgattatcgattttgtgccgctggacccgaccaagccgatgtcgatcaaacatctggtgcgcctgattgagcaggggcggccggtggttatcttcccggaagggcgaatttcggtcagcggctcgctgatgaaaatttatgacggcgccgcctttgtcgccgccaaatcgcaggcgaccattgtgccgctgcgtattgaaggcgccgaactgacgcccttcagccggttgaaggggctggtgaaacgtcgcctgttcccgcgtattcagctgcatctcctgccgcccacccatctgccgatgcccgaggcgccgcgcgcccgcgaccggcggaagatcgccggggagatgctgcatcagatcatgatggaagcccggatggcggtgcgcccgcgggaaaccctgtatgagtcgctgctggcggcgcaggaccgcttcggcgcgcgcaaaccctgcgtggaggatatcaacttccagccggatacctatcgcaagctgctgaccaaaaccctgtttgtcgcccgcattctggaaaaatacagccagccgggcgagaagatcggcctgatgctgcctaacgccggcatcagcgcggcggtgattttcggcgctatcgcccgcggccgtattccggcgatgatgaaccataccgccggggtgaaagggctcagcagcgcgatagccgccgcggagctcaacaccattttcacctcgcgcaccttcctcgataaaggcaaactctggcacctgccggagcagctgacccaggtgcgctgggtattcctggaagatcttaaaggcgatatcaccctcgctgacaaactgtggatttttgctcatctgctggcgccgcgtctggcgcaggttaagcagcagccggaagacgcggcgatgatcctcttcacctccggttccgagggcaatccgaaaggggtggtgcacagccataagagtctgctgtccaacgtcgagcagatcaaaactatcgccgactttaccgccaatgaccgctttatgtcggcgctgccgctgttccactcttttggcctcaccgtcggcctgctgacgccgctgcttaccggggcggaagtgtttctctatcccagcccgctgcactatcgcgtggtgccggagctggtctacgatcgcaactgtacggtgctgttcggcacttcgaccttcctcgccaactatgcccgtttcgccaatccgtacgatttctaccgcctgcgctacgtggtcgccggggcggagaagctgcaggagagcaccaaacagctgtggcaggataaattcggcctgcgcattctcgaaggctatggcgtgaccgagtgcgcgcctgtggtctcgattaacgtgccgatggcggcgaaggtcggcaccgtgggccgcatcctgccggggatggacgcccgcctgctggcgatgccaggcattgagcaaggggggcggctgcagctgaaagggccgaacatcatgaaaggctacctgcgggtggaaaaccccggcgtgctggaagcgcctgcggcggaaaaccagcacggcgagatggaagcgggctggtatgacaccggggatatcgttaccttcgacgagcagggctatgtccgcattcagggccgcgcgaagcgcttcgccaaaatcgccggcgagatgatctccctcgagatggtggagcaggtggccctcggcgcgtcgccggacaaaatgcacgccacggcgattaaacaggacgccagcaaaggcgaggcgctggtgctgtttaccaccgataatgaactgactcgtgaagctctgctgcgctacgctcgccagcacggcgtaccggagctggcggtgccgcgagatatacgctggctgaaacagctaccggtgctcggcagcggcaagccagactatgtcaccctgaaaaatatggtcgacgaggcggaaacaacccatgagtga

SEQ ID NO: 4784 - DNA, 1509 bp, Klebsiella pneumoniae
agcttcatacgcggcggcatccagcagcgcggcaacctgcgcttcgtcgctggctttgatcttgaagatccagccgtcggtatacgggtcgctgttgaccagttccggagagtcgttcagctcttcgttgacggcaacgatttcaccgctaatcggcgcgtagatatcggaggccgccttcacggattcggcaaccgcgcaatcggcgcccgcttcaacggtggcgcccacttccggcaggtcaacgaaaaccatatcgccaagcagctcctgcgcgtgctcggtgatccctacggtataggtgccgtccgcttctttacgcagccactcgtgttctttgctgtatttcagttctgctggtacgttgctcatcaattcatctccaaaaaagggaaatcacacaatggctttgccattgcgtacaaaaccaggtttagtcacttttaccggcatttcacggttacggatttgcaccaccgcggtgtcgccaatcccggccggcacgcgagccagcgcgatgctgtagcccagcgtcggcgagaaggtgccgctggtgataatgccttctttttgattaccgtcgctatcggtaaaacggaccggcagaccaccgcgcaggacgcctttctcggtcatcaccaggccaaccagctgctcggtgcctttttcgcgctgcatctccagcgcttcgcggccgatgaagttacgatcggcgggctcccaggcgatagtccagcccatgttcgccgccagcggggaaacgccttcgtccatctcctggccgtacaggttcatcccggcctccaggcgcagggtgtcgcgcgcgccaagaccgcacggcttaacgccagcgtccagcagaccgcgccagaaatcagccgcctgctcgttcggcatcgcaagttcataacccgcttcgccggtatagccggtggtggcgataaacaggtcgccggcctgcacgccgaagaacggcttcatgccttccacggcctgacgttgagcgtcggtaaacagcgtcgccgccttcgctttcgcctgggggccctggaccgcgatcagcgacagatcgtcgcgaacggtaatttcaaggccgtaaggttcagcttgttcggagatccaggcgaggtctttttcgcgggtggcggagttaacaacgaggcggaaataatcttcagaaaggaaatagacaatcaggtcgtcgatgacgccggcggaggcggtcagcatgccggtgtagagcgctttgcccggggtggtgagcttcgccacatcgttggccagcaaatagcgcaagaactcgcggatccggctgccgtggaaatcgacgatggtcatatgcgacacatcgaacatccctgcatcgccgcgcaccgcatggtgctcatcaatctgggacccgtaatgcagcggcatcatccagccatggaaatccaccatgcgcgcgccgcacagcgtgtgttgttcatacaacggagtctgttgagccatcttttcctcatcgaataa

SEQ ID NO: 4785 - DNA, 915 bp, Klebsiella pneumoniae
cggcgagtacgccgccgcctgccagaagttaggcatcagcaagtaacttttgcccctgcgcccgccgcggcgggcgcgatttcgccattattgaggtcgttttgtatgccgcaacaacaacacaactccgccgccgggcggccaatactgcaactgcgcaacgtctctaaacattttggcgcggtgtccgcgctgacggatatcgaattagaagtccacgccggcgaggtggtcgcgctggtcggcgacaacggcgcgggcaaatccacgctggtgaagatcctcgccggcgtccaccagccgacctccggcaccattgagtttgacggcaaccccgtcaccctcgatagccccggcaaggcgctggaatacggtattgccacggtgtttcaggatctggcgctgtgtgaaaaccttgatgtggtggcaaacctgtttctgggtcatgaaatttcgccgttccagctcgatgaagtggcgatggaagtgaaagcctggacgctgctgcaggagctggcggcacgtattccgtcggtacgcgaaccggtggcatcgctttccggcggccagcggcagaccgtcgccatcgcccgttcgctgctgctgaaccctaaaatcattatgctcgatgaacccaccgcggcgctgggcgtcgcgcagaccgcggaagtgctcaacctgattgagcgcgttcgcgagcgcgggcttggcgtcatcatcatcagtcacaacatggaagacgttcgcgccgtcgccgaccgtatcgtggtgctgcgtctcgggcgcaacaaagggatcttcacgcccgatgcttctaatcaggatctggtcgccgcgatcaccggcgcgacggaaaacgccgtctcacgccgggttgaacgtaaatcacagccaacgacttccggagcgatgtaa

SEQ ID NO: 4786 - DNA, 279 bp, Klebsiella pneumoniae
agtggtcaacgtgacgttgactccacctatcaatacctctgggatagccagaatatcaaccggatccgcgaacaaaccagcgaacattcgcaacagcgcatcgcaaagtgtaagcaaaggtttgtattttcctgcgccggtttcaattaccgatcgcgtcaatgtaaacaggtcaccgataagcccgcgctgaatcacatttgcgccattccttcgccgccgcgccttgaatctgccgctctttcccgtaacatagcagtatgtaaacgcttaccctag

SEQ ID NO: 4787 - DNA, 1587 bp, Klebsiella pneumoniae
cttgcgctgcggcgcaccttacctggagaatttatgcattcctctgttaataaaaacgaaagccgtacctttttcggccatccttatccgctgggctccctgttcttcactgaaatgtgggagcgcttctcgttttacggcatccgtcctttactgatcctgtttatggcggcgacggtgtacgacggcggcatgggcctggcgcgagagaacgcctcggcgatcgttgggatttttgccggcagtatgtatctggccgcgctgccgggcggctggctggcggataactggcttggccaacaacgcgccgtctggtacggctctatcctgatcgccctggggcacctgtcgatcgctctgtcagcatggctgggcaacgatctgttctttatcggtctgatgtttatcgtcctgggttccgggttgtttaaaacctgtatctcggtgatggtcggcaccctgtataaaaagggcgacgcgcgccgcgacggtggtttttcgctgttctacatggggatcaacatcggctcgtttatcgcgccattgatctctggctggcttatcaaatcgcatggctggcactggggcttcggcatcggggggatcgggatgctggtggcgctgatcattttccgtgtctttgccgtaccgtcgatgaagcgctatgacgcggaggttggcctcgattccacctggaacagcccggtggcgaaaaagaatggcgttggagcgtggctgctggcgctggctctgggagtggcggtgctggtcacgcttatcagcctgggcacgatcgtgattaacccggtggcggtggccagcgtgctggtctatgtgattgccgcctccgtggcgctctatttcatctggctgttcgtcttcgccggactcaaccgtaaagagcgggcgcgcctgctggtatgctttattttgctggtctcggcggcctttttctggtccgcgtttgaacagaaaccgacctccttcaacctgtttgctaacgactacaccaaccggatgatcggcgattttgagatccccgcggtctggttccagtcgattaacgccttgtttatcattctcctcgcgccggtattcagctgggcgtggcctgcgctggcgcgtaaaaacgttcgtccgggcagtatgaccaaattcgtcattggtatcctgtgcgcagcggcgggctttggcctgatgatgctggcggcgcagaacgtcctgagcaacggcggggccggtgtgtcgccgctgtggctggtgggcagcatcctgatgctgacgctcggtgaactgtgcctcagcccgattgggctggcgaccatgactctgctggcgccggagagaatgcgcggccagatgatggggctgtggttctgcgccagcgcgctgggtaacctggcggcgggcctgatcggcggtcatgtgaaggccgatcagctgtcgctgctgccggacctcttcgcccgctgctccatcgcattgctgatctgcgccgccgtgctggccgtgctgattgtcccggtccgccggatgctggagaacagccggtccagcgccgcgcaaaaatccctcagcaacgcctga

SEQ ID NO: 4788 - DNA, 1551 bp, Klebsiella pneumoniae
cacattacgcgcaggttttgtacgccttcttcttccgcagaagccagacaagcgccaacgcccggggagtgtacttcaatgccgaggaaattctgttccggtttggctttcgccatcgccaccagcgaggcgcccatcccgaagccaatttctaaggtgaccggcgcgtcacggccaaacagggcggcgaaatcgagcggcgcatcgttgaattcaacgcccatcaccggccaaatgttatccagcgcatgctgctgccctttcgtcaggcggccctggcgacggacgaagctacgaatacggcgcagcgggcgaccgttttcatcgaattccggagagatgacgtcgtttttcataaaagtttggtctgcttgtgaatgtgttcggaaaacgggcattatccaaagttacccggcggatgcaagggtttacagccactcgcccttatgctgcaatctgcccccctgtaatcgcgatcccggagccgtagctttgacttttctcgccacgcaattttcagcccaggttctggactggtacgacaaatacgggcgtaaaaccctgccctggcaaatcgccaagacgccctacaaagtatggctctccgaagtgatgttgcaacaaacccaggtgaccacggtaatcccctattttgaacgctttatggcgcgtttccccacggtggtggatctcgccaacgcgccgctggatgaagtgctgcatctgtggaccggtctgggctactacgcgcgggcgcgcaacttacataaagccgcgcagcaagtcgccacactgcacggcggggaattcccccggacctttgacgaagtggcggcgctacccggcgtcgggcgctcaacggcgggggcgattttatccctttcgctcggtcagcattatccgattctcgacggcaacgtgaagcgcgtgctcgcccgctgctatgctgtcagcggctggccggggaaaaaagaggtggaaaaacggctgtgggacatcagcgaagaggtcaccccggcagagggcgtcgagcgcttcaaccaggcgatgatggatctcggggcaatggtttgcacccgctcgaagccgaagtgcgagctgtgtccgctgagcaacggctgcgtggcctacgcgaaccattcatgggcggaatatccgggcaaaaaaccgaagcagaccctcccggaacgcaccggctacttcctgctgatgcagcacggcgacgaggtgtttctttcccagcgtccgccggtgggtctgtggggcgggttgttctgttttccgcagtttgcagacgaagcggagctacgcgagtggctggcgcagcgccagataaaggccgataatctgacgcaattaaccgcttttcgccacactttcagccatttccacctggatattgtgccgatgtggcttacagtgcactcatctggcgcatacatggatgaaggcaacgcactctggtataacttagcgcagccgccgtcggtcggtctggcggcccccgtggagcgcttgttgcaacagctaaaagccggagcgccggtataa

SEQ ID NO: 4789 - DNA, 204 bp, Klebsiella pneumoniae
aacgccgcgcgcggctcattaaaaaagcgcacggggcatggccctgtggtgccacttccagccgggttaagcagtctgtatttacagaatctcgcagcggcgtatcgcctgttgcccggtatgtatagctttggcttgtcgccgaccctgtcgcagggcggtgtggaggtgataccagataatgaaccaatgtttttcgtttga

SEQ ID NO: 4790 - DNA, 216 bp, Klebsiella pneumoniae
acaagggcgctcttgcctggcaagagttttctcgtggtttctccggactgtcatactctgttcggctacgtgttttacgatgatatgaataagaaaccggtcgcgcagtcgcaaaaccagcagatagtgctgggctttaggactgttcatgggttgttatcgcatctttggactgcgatagtagttaactgtcttacacttattattaaaaattga

SEQ ID NO: 4791 - DNA, 324 bp, Klebsiella pneumoniae
aagccggagcgccggtataaatttttcggctatcaaagaggattaattatgagcagaaccattttttgtaccttcctgcagcgtgaagcggacggccaggatttccagctgtatccgggcgagctcggaaagcgtatttacaacgaaatctccaaagaagcctgggcgcagtggcagcacaagcagaccatgctgatcaacgagaaaaagctcagcatgatgaacccggagcaccgcaaactgcttgagcaggagatggtgcagttcctgtttgaagggaaagacgtgcacatcgaaggctacacgccgccggaaaaacagtaa

SEQ ID NO: 4792 - DNA, 984 bp, Klebsiella pneumoniae
gttatgaagctggaagaaatcgtagcccttagtgtaaagcataatgtctccgatctacacctgtgcaattccgccgcaccgcgctggcggcggcagggcaggctggagcccgcgccctttcccgcgccggatattgcgaatttactcaacgactggctcgatgccgcacagttactgcactggcaggaacacggccagattgactttgcgctgaacctggcctgcggtgcgcggctgcgcgccagcgccttcgcccatacgcgtgggatatcgctggtgctgcgcctccttcctgaacagtgcccgcgtctggatatgctcggcgccccgcctgcgctgagcgaactgctggcggaagagagtggtttgctgttggtcaccggagcgacgggcagcggcaagtcgaccaccctggcggcaatggtggggcacctcaatcagcatcttgatggccatattctgacgcttgaagatccggtggaatttattcatcacagcgagcgctgtctgatccagcagcgggaagttggccgtcactgcccttcgttcgccgcggcgctccgcgtggcgctgcgccaggatccggatgtgatcctgctcggggagctacgcgacagcgaaaccattcgcctggcgttaaccgcggcggagaccgggcacctggtaatggcgacattacatacccgcggcgcggcgccggcggtggagagattgatcgatgtctttccggcggaggagaaagatcaggttcgtagccagcttgccggaagcctgtgcgcggtgctggcgcaaaaattgttacctgcacgtcagggcgggagagttgcgctatacgagcttctggtcaacacgccagcggtggcgaatttgatccgtgaaggaaaagtacatcaattgcctggtgtgatgcagaccgggatgcaggccggaatgttgacctttacccagagttttcagcaacgtgtcgctgcaggcgcgctataa

SEQ ID NO: 4793 - DNA, 906 bp, Klebsiella pneumoniae
acaaaagataggacccatcgatattgtagatacatcatgcgttattcaccggaagccttaaccgcctttgtcgaggcggtcgacagcggatcgttctccgccgccgcccgccgcctgcggaaaagtcagtcgacgatcagtaccgccatcgccaatctggaggccgatctcggcgtaaccctctttgacagggcaacgcggcaaccgacgctgaccccgcagggggagcaggtgctgagctatgtcaaagcgattcttgccgccagcgagcggctggacgaactggctgtgtcgctgtccggcgagacggagccgcggctgaccttcgtgctctccgatactctgcacccggacgtgctggaagatctgctggtgcagtttgaccgccgctttcctcataccgagtttgagtgtttgattggcgaagacgaggatgtgatcgatctcctgcaaaaatcccgcgcccaggtggggctgattgaggcgagggagcgctaccccaccgatatcggcagcacccgcctgccgctgcagacggcgatgggcatttatgtagcccctggccatccgctggcggcgcagggtaaggtcgcctgggatgagctgcgcagctggcgcgagctgcgtttgagcacttttctggccagcgccaccgaacctgccgcaggccaggtctggtcggcgccaaactacctgctgctgctcagcatggcggcgcaggggttcggctggtgcattctgcccagcgcgctggtggcggagtttgcgccgcagggcgggctggtggcgctcgatatccccggctggccgcgggcgatttcagtcgatctgctgtggaataagaaagcgccgccgggagcggccggcagctggctgcgtcagcatctgcagcggcgtgaacgttaa

SEQ ID NO: 4794 - DNA, 276 bp, Klebsiella pneumoniae
tcctgcatcagaccaacaactacaatagcgactccttccagttcatctggaacatttacgccaacaacgacgtggtggtccccaccggcggctgcgacgtctccgcccgcgatgtcaccgtcaccctccccgactacccgggatcgatggccgtgccgctcaccgtccactgcgcgcaaagccagcagctggggtattacctctccggcaccaccgcggacagcgccaacgcgatcttcaccaataccgcctccgcctcgccggcgcaggggatag

SEQ ID NO: 4795 - DNA, 1515 bp, Klebsiella pneumoniae
cgagccgacagactctggtatgccaatgtcgattttatcggatatttgggataccactgtgcgcgttgcgagcgctgtcacagaactatttttgcctggcgactatgttttggtatgccaaaagtctctggctgttcacctggccgcaataagccctttactctgaggtactcttttatggcattacaggacaaactgatcgacgcgctggggcgtttcgcgacgacattcaacagctatcgctacattatggcgatcaaatcggcgtttattaccctgatgccggtgatcatcgtcggggccttttcggtgctgatctccaatatggtgctggatccgaagaatgggctcgccagcttttcctcgctctcctttcttgcggcgctgaagccgatcaccagcgcgctaaactacgctacgctcaacttcctcaatatcggcgccgtgtttctgatcggtattgagctggggcggatcaacggcatcaaaagcctgtttcccggcctgttggcggtgatctgctttatctgcgtcacgccgaccacggtagagatgatggtcgatggccagatgcacgtggtgaaagatgtcctgctgcgccagttttccgatacccgcagtctgttccttgggatgttcatcgccattctgtcagtggagatttactgctggctggaggggcgcaagggactgaagatcaaaatgccggataccgtgccgccgaacgtctctgcctctttttccgcgctgatcccggcgatcatcaccaccaccgcgatcgccacctttggttttctctttcaccagctgacgggaatgtatctctacgatgcggtctaccaggtggtgcagcagccgctggagcgggtggtgcagagcctgccggggatcctgctgctgatgttcgtcgcccagctgttctgggtgatcggcattcacggcaaccagatgatcaagccgatccgcgagccgctgctgctgggagcgatcactgtcaatatgagcgcttttgagcaggggaaagaggtaccgaacatcatcacgatgcccttctgggatgtctacatgagcatcggcggctcggggctgaccatcggcctgctgattgcggtgatgatcgccaccaggcgcaaagagatgaaagagatcgccaagctgtcgataggcccggggctgttcaatattaacgagccggtgatcttcgggatgccgatcatgctcaacccgatcctcgccatcccgtttatcatcaccccgctggtgaccggcagcatcggctatttcgccaccctgaccggcttcgccggcaaggcggtggtgatggtgccctggaccacaccgccgctgatcaacgcctggctctccaccgccggctcgatgggggcggtggtgacccagcttatctgcatcgtcgtcgcagtgcttatctatctgcctttcgtcaaaatcgcctcccgccgtgccgatgccgcgcagcgtcaggtagacaatcaacaaaccgccaaccctgtctga

SEQ ID NO: 4796 - DNA, 687 bp, Klebsiella pneumoniae
agcggttgcagacggattatctcgatttatatcaggttcactggccgcagcggcccaaccaactgcttgggcaagttgggctatacctgggccgactccgcgcccgctgtgacgctgctggacaccctcgaagcgctgaccgagttccagcgcgccgggaagatccgttacatcggcgtgtcgaacgaaaccgccttcggcgtgatgcgttatctgcacctggcggataagcacgacctcccgcggatcgtgactattcagaatccttacagcctgctgaaccgcagctttgaagtcggcctcgcggaagtgagtcagttcgaaggcgtggagctgctggcctactcttgcctggctttcggcacactgaccggcaagtatctcaccggtgcgaagccggcgggggcgcgcaatacgcttttcagccgctttacgcgctacagcagcgagcagtcgcagaaagcggtagcggcctatgtggatatcgccaaacgccacggcctcgatccggcgcaaatggcgctggcctttgtgcgtcggcagccgtttgtcgccagcaccctgctgggggcgacgaccatgacgcagctgcaggccaacgtggaaagtttgcagcttgagctgagcgaagaggtattagcggagattgaggcggtgcatcaggtttatacctacccggcgccgtaa

SEQ ID NO: 4797 - DNA, 786 bp, Klebsiella pneumoniae
acaaccataagattgtggaagataaaaatgaaaattcgctcaaccgtacttgctcttgggatcgcagcaaccctcaccggatgtcagaacatggactccaacggtctgctcagctcaggcgccgaagccttccaggcatactctctcagcgacgcgcaggtgaaaaccttaagcgaccaggcctgtaaagagatggacgccaaagcgaaaatcgccccggccaacagtgaatacagccagcggctgaacaaaatcgcggctgcgctgggcgataacatcaatggtcagcccgtgaactacaaggtctatgagaccaaggatgtcaacgccttcgccatggccaacggctgcatccgcgtctacagcgggctgatggatctgatgaacgataatgaagtcgaggcggtgatcggccacgaaatgggccacgtcgcgctgggccacgtgaagaaaggcatgcaggtcgccctgggtaccaacgccgtgcgtgcggcggcggcctccgcgggcggtatcgtcggtagcctgtcgcagtctcagttgggcgatctgggcgaaaaactggtgaactcgcagttctcccagcgtcaggaatcggaagcggatgactactcttacgacctgctgcgtaagcgcggtatcaatccgtcgggactggccaccagcttcgagaaactggccaagctggaagccggtcgtcagagttcgatgtttgacgatcacccggcctcagaagcgcgcgcccagcatattcgcgatcgcatgaaggccgacggcattaaataa

SEQ ID NO: 4798 - DNA, 1206 bp, Klebsiella pneumoniae
aacgtgcaaagtgttgatgttgccattgttggcggtggaatggtggggctggcggtagcctgcggtctacagggtagcggcctgcgcgtcgcagtgctggagaaagcagagccgcgaccgctggccgccgatgcgccgccggcgctgcgcgtttcggcaattaatgccgccagcgaaaagctgctgacaaagctggacgtctggcgcgagatcgtcgcccagcgggccagctgctatcacggtatggaagtgtgggataaagacagctttggccacattagcttcgatgaccagagcatgggctttagccaccttggctatattatcgaaaatgccgtagtgcatcatgcattgtggcagaaggcgcagcgttgcgctgacgttaccctgctggctccggcggaacttcagcaggtggcgtggggcgagaatgaagcctttctcagcctgcaggacggcagcatgctgaccgcgcggctggtgatcggcgccgatggtgccaattcatggctgcgcaataaagccgatattccgctgaccttctgggattaccatcatcatgcgctggtggcgaccatccgtaccgctgagccgcatcaggcggtggcccgccaggcgttccatggcgacgggatcctcgccttcctgccgctcagcgatccgcacctgtgctcgatcgtctggtcgctatcgccgggggaagcgcagcggatgcagcaggctgatgaaaccaccttcaaccaggcgctgaatatcgcgttcgataatcgccttggcctctgccagctggcaagtgaacgtgaagttttcccgctgaccggccgctatgcccgtcagtttgccgcccaccgactggcgctggtcggcgatgccgcgcataccatccatccgctggccgggcagggggtcaacctcggttttatggatgccgccgagcttattgacgagctgaagcgcctgcacgtccagggcaaagatatcggccagcatctttatctgcgccgctacgagcgcagccgcaagcacagcgcggcgctgatgctggcgggcatgcagggcttccgcgaaatgttctccgggagccatccggcgaagaaacttcttcgcgatgtgggactcaaactggccgatacgctgccgggcgtgaaaccgcagctgattcgccaggcgatgggcctcaacgatctgcctgcctggttacgttaa

SEQ ID NO: 4799 - DNA, 348 bp, Klebsiella pneumoniae
tcagcgcaaagccgcgcaggtagcgacacgagcagtctgagtgttaatcagtatagacggattaacttctggacggccattttaggtcaaatcttgagcccatttccagccttttttgatggcggtcgcatttatgggaaaacccgcctggcaaaatttcctgacaaccgcgcaaacaggcacatttttattttgctttttaccccgcttctcggtataaaacgccgcgcgcggctcattaaaaaagcgcacggggcatggccctgtggtgccacttccagccgggttaagcagtctgtatttacagaatctcgcagcggcgtatcgcctgttgcccggtatgtatag

SEQ ID NO: 4800 - DNA, 1455 bp, Klebsiella pneumoniae
ttattagagagattagccaggatgaaaaaattaacccttccgaaagattttttatggggtggcgcggtcgccgcgcatcaggttgaaggcggctgggatcagggcggcaaaggccccagcatctgcgatgtgttgaccggcggggcgcacggcgtgccgcgcgaaatcacccatcaggtcgaagcgggaaaatactacccgaaccacgaagccgtcgacttctacggtcgctacaaagaagacatcaaactgttcgccgagatgggcttcaaatgcttccgcacctctatcgcctggacccgcatcttcccgcagggtgacgaaacccagccgaatgaagagggactgaagttctacgacgacatgttcgacgagctgctgaaatacaacatcgagccggtgatcaccctctcccacttcgagatgcccctgcacctggtgcagcagtacggcggctggaccaaccgcaaagtggtcgatttctttgtacgcttcgccgaagtggtcttcgagcgctatatgcacaaagtgaaatactggatgacctttaacgagatcaataaccagcgcaactggcgcgcgccgctgttcggctactgctgctccggggtggtctataccgagcatgacaatccggaagagaccatgtaccaggtgctgcaccaccagttcgtggccagcgcgctggcggtgaaagcggcgcggcgcatcaacccggacatgcaggtcggctgcatgctggcgatggtcgccctctacccttactcctgcaaaccggaagatgtcatgttcgcccaggagtcgatgcgcgagcgctacgtctttaccgacgtccagctgcgcggttactacccgagctatgtgttgaatgaatgggaacgccgcggcttcaacatcaggatggaagacggcgacgcgcagatcctgcgcgaaggtacctgcgcctatctcggcttcagctactacatgaccaacgcggtgaaagccgagggcggcactggcgacgccatttccggtttcgaaggcagcgtgccgaacccgcacgtcaaagcctccgactggggctggcagattgacccggtcggcctgcgctattctctgtgtgaactgtatgagcgttatcagaagccgctgtttatcgtggaaaacggctttggcgcctacgacaaagtagaagccgacggcagcatcaacgatgactaccgcatcgactacctgcgcgcccacatcgaagagatgatcaaagcggtcacttatgacggcgtcgatctgctgggctataccccatggggctgcatcgactgcgtctccttcaccaccgggcagtacagcaaacgctacggcttcatctacgtcaacaaacacgacgatggcaccggcgacatgtcccgctcgcgcaagaagagctttaactggtacaaagaggtcatcgccagcaacggtgagaacctgtaa

SEQ ID NO: 4801 - DNA, 417 bp, Klebsiella pneumoniae
atctttcctgggggtttccacgtcctgtacatccctgatcctcttgatgatacccgcatgatgatgaaggcttgggcttccggccacggcaaggcggctatcaatgccgtcatgattgattgcctgtttactgggcaatgtcaccccagtaaaccagcctccctcgccgacaaccttcgggaatggcatgagaaatttctcagacaaaatacaaccttaagtcgtctggatagcattcactgcaaaactacaacagtgattaaaccatactgcaaaaagcctggtgataatagcattgtctgtaatagagcacattacgccgtatttcaacgggtaagcttaatctggtacatgcggttgaatgagatgaaaactcgtcacggtcaacgtatacaggaagatatcaatgggaggtag

SEQ ID NO: 4802 - DNA, 1386 bp, Klebsiella pneumoniae
ggctcggctggaaccatatcatttttgcatagagtcgcgataaaacgatattttttattcgtctgtcactgtggcgtaatcagaaaaaacagcgaccaacacacgcactgcaccggagttcttatgccacactcgctttacgccaccgatactgacttgaccgcggacaacctgctgcgcctgccggcggaatttggctgcccggtctgggtctatgatgcgcagattattcgccgccagatagcccagctcagccagttcgacgtggtgcgttttgcgcaaaaagcctgctctaacattcatattctgcgtctgatgcgtgagcagggggtgaaggtggactcggtgtcgctgggggagatcgagcgggcgctggcggcaggctacgatccgcagcagaatcccgaggatatcgtcttcaccgccgatctgatcgacgacgccaccctcgatcgggtgaaggcgttacagatcccggtgaacgccggctcgatcgacatgctgagccagctgggcgaggtgtcgccgggccatcgcgtctggctgcgcgtcaacccgggctttggccacggccacagccagaaaaccaataccggcggtgagaatagcaagcatggcatctggtacagccacctgccggcggcgctggaagtgatgcgtcgctatcagctgcagctggtcgggatccatatgcatatcggctctggcgttgactatggtcacctggagcaggtgtgcggcgcgatggtgcgccaggtcgtcgactttggccaggatctgcaggccatctccgccggcggcggtctgtcgattccttaccgcgaaggtgaagaggccatcgacaccgcccactattatggcctgtggaaccgcgcccgggagcagatcgcggcccatctggggcacccggtgaaactggagattgagccaggacgcttcctggtggccgagtccggcgtgctggtgtcgcaggtgcgcagcgtgaaagagatgggcagccgtcacttcgtgctgattgacgccggctttaacgacctgatgcgcccggcaatgtacggtagctatcaccatatcaccgctctggcgggggatggccgggatctcagcgccgcgccgcaggtcgaaaccgtggtggccgggccgctgtgcgaatccggggatgtgtttacccagcaggaggggggcaaagtcgagacccgcctgctgccggcggtagcgcctggggattatctggtgctccatgacaccggcgcctacggggcttcgatgtcatccaactataacagccgtccgctgctgccggaggtgctgtttgatggcggcaaggcgcggctgatccgccgtcgccagaccatccaggagctgctggccttagagcttatttaa

SEQ ID NO: 4803 - DNA, 363 bp, Klebsiella pneumoniae
acatcggctggtttgcatgagagagatgcaggttgcggagtgctgacgcgcgacagaacgacgcgacgaatcaaacgaaaaacattggttcattatctggtatcacctccacaccgccctgcgacagggtcggcgacaagccaaagctatacataccgggcaacaggcgatacgccgctgcgagattctgtaaatacagactgcttaacccggctggaagtggcaccacagggccatgccccgtgcgcttttttaatgagccgcgcgcggcgttttataccgagaagcggggtaaaaagcaaaataaaaatgtgcctgtttgcgcggttgtcaggaaattttgccaggcgggttttcccataa

SEQ ID NO: 4804 - DNA, 1029 bp, Klebsiella pneumoniae
aaaaggcatggtatggcgactattaaggatgtagcccgactcgcaggagtctccgtcgctaccgtctcccgcgtcatcaacaactctcccaaagccagcgaagcttcgcgtcagtccgtgggcgcggcgatggaaaccctgaactatcaccccaacgcgaacgcccgggcgctagcccagcagtcaacggaaaccgtcggtctggtggtgggcgatgtctccgaccccttcttcggcgcgatggtcaaagccgtcgaacaggtggcctaccgcaccggcaattttttgctgattggcaatggctaccacaacgtgcagaaggagcgccaggcgatagagcagctgatccgccatcgctgcgcggcgttggtggtgcacgccaaaatgatccccgatgaggaactcgccgggctgatgaaacagatcccgggtatggtgctgatcaaccgcatcctgcccggatatgaaacccgctgcgtcgcgctggacgaccgctacggcgcctggctggcgacccgccatttgatccagcaggggcacacgcgtatcggctatctgtgctcaaaccatgatatctccgatgcggaagatcggctgcaggggtactacgcggcgctggaggagagcggcctgccgtgcaacgaccggctggtcacgtttgccgagccggatgaaagcggcggcgaacaggcgatgaccgaactgcttggccgcggccgccactttagcgccgtcgcctgctataacgactcgatggccgccggcgcgatgggggtgctgaatgacaatggcatcgacgttccgcgggagatttcgctgattggcttcgacgatgtcctgatttcgcgctatgtccgcccgcggttgactaccgtccgctatccgatcgtcacgatggcgacccaggcggccgagctggctttagccctggcggagcagcggccggcgccggagatcacccatctgttcagcccgacgctggtccgtcgtcactcggtggtcgccccgcaggaaggcgataagtcatag

SEQ ID NO: 4805 - DNA, 1056 bp, Klebsiella pneumoniae
tactctggtggaataacccaaagggagaaaataacgatgcagtatacccggctcgggaagagtgacttactggtctcccgtatctgcctgggatgtatggggtttggcgatccgtcaacgggtcagcatcgctggacgctggacgaaacagccagccgggacatcatccgccacgctctggaacagggcatcaatttttacgataccgccatcgcctatcagaacggctccagcgaacggtacgttggccgggcgctgcgggagatggcaaaacgcgaggaggtggtgctggccaccaagtttctgccacgaaccgccgcgcagattgccgaggggatcagcggaaaacaggcgatagcccgctcgcttgaccagagtctgcgaaacctcgggatggactacatcgacctctacatctaccacatctgggattacaacaccccggttatcgacgtgctggaggcgctgcacaccgcagtgaccgccggcaaggtgcgcgcgattggcatttccaattgctatgcctggcagctggcgaaggcgaacgcccttgccgaacgcgaagggctgacatcctttgtttctgtgcagagccactacaacctgattatgcgtgaagatgaacgagagctgttcgggctgtgcgcagaagagggtatcgccatgactccctatagcgcgctggccagcggccgtctctcccgcttagaaggccacacgcggcgagaggtggaagatgattatgcccggggcaaatacgacggcacggcagagcaggaccggctcattattgcccgcgtcgccgaacttgccgaacggcatcaggtctccatgaccgaaatttcgctggcctggctgctgactaaagtcaccgccccggtgatcggcgccacgcaaaagcatcatgttgacggcgcggtcaacgctgtagcccttcaactgagcccggaagacatccgttatctggaagaagcctatcagccgcacttcctcacaggcgtgatggcgcaaaacacgccgcaagccaaagaccgtcctcaggtgtggacgcgctaa

SEQ ID NO: 4806 - DNA, 417 bp, Klebsiella pneumoniae
tgcgatggtggcggtggggattgtgctgggtgccggggcggcggcaaatctggtgaccctggagacggtgtcgcgctgtatgccggccgggattttgatcggtatcgcggtgatagcctttgcggtgcaacagtcgctgctgccggcgttcggtctgctgctgctgctcggggtgttcggcgggttctttatcgtaccgctgaacgcgctgctgcagaacgtgggaaacattcggtcggggcaggtaacgccattgcggtacagaacctcggtgagaacgtggcgatgctgctgatgctggggctctattccctggcggtgagcgtgggcgttccaccggtcgccgtggggataggctttggcgcggtattcgccgtggccattgccgcgctgtgggtctgggggcggcgtaaataa

SEQ ID NO: 4807 - DNA, 285 bp, Klebsiella pneumoniae
agatccggtggaatttattcatcacagcgagcgctgtctgatccagcagcgggaagttggccgtcactgcccttcgttcgccgcggcgctccgcgtggcgctgcgccaggatccggatgtgatcctgctcggggagctacgcgacagcgaaaccattcgcctggcgttaaccgcggcggagaccgggcacctggtaatggcgacattacatacccgcggcgcggcgccggcggtggagagattgatcgatgtctttccggcggaggagaaagatcaggttcgtag

SEQ ID NO: 4808 - DNA, 432 bp, Klebsiella pneumoniae
ttcagacacggaatcgggaacgtggtcctgtggcaatctgatctccgtatctcctggcgcgcgcagtggttttccctgctgcttcacggcgtggtggcggccctggtgctgttggttccctggccgctgagctataccccgatctggctgctgctgctgtcgctggtggtcttcgactgcgtgcgcagccagcggcggatccatgcccgtcgcggggagataaaactgctcaccgattcccgtcttcgctggcaaaacgccgaatgggagatcctcgggacgccgtgggttatcaatagcggtatgctgctgcgtttgcgccatgtcgatacccggcgcggacagcatctttggctggcggcggacagcatggacgccggagagtggcgcgatctgcgccggctggtgctgcaaaaaccggcgcaggagtaa

SEQ ID NO: 4809 - DNA, 1638 bp, Klebsiella pneumoniae
gcggacctagggtctcagtacatgctcaattcctacacctacctttaccagcgtaacggcgtctactattttcgccttcgagttagacaatcaaacaatgatagaatgacctcagtttcattaaggaccaaggatagacgcaccgctatggctcactcccggcacattaaggcagcactcaaggcaatccatgcggataaccctacagcctcttacgaggatatgaggaaacacttacgggatatcgcggagtgggaactttcagcgggacgctctgacctcttcgagccggacatgagggacatctatcgggaccagtacagtgaacttggtgagaaccttaccgatgctctggctagtgaaccgctgagtattgaccagcatcgctacatcaatgaggccctgaaggtactcaaggcttgcatgaagcgtatcgaagcgggagacagtcagtcactgatagattacgtcgatcgttttgatggtattgatcggcaggatgaccaagcctctgtgtccctatctgttagtgctcctgaggtaaaaccagcagcgctagctgcactagcagtcacaccaagcgtcactgtagcgagcctctttgagcaatacgaagcggagaacgcccagaactggaagccagccaccttaagggaaaaccaatcgtcccacgctgcgttaatcgaaatctttgactatctgggtcttggtgctgacgccaatacggtaacacgcgctgatgtgcttagagtccgtgatgttctccagcagttaccgaagaaccgcaagcagcgcttcaaggatgccccgttggttgacttgctgggccgtgaagagaaaacagattgtctggacgtagtcaccatcaacaataaatatctcattaagatggcggctgtctttaagtgggctgtgcgtaatgacctgattaaaaagaatatgactgaggggctggaactcaaggttccccagcgtaaagcctcagaggcccgtaacgctttctctacggagcaggtaaggcaactgctggtcgccgctaaggcatactctcagaagacctctggcaagccttaccactattacgttacggtgctggcggctatcactggtgcgcgactcaatgaagtagctcaacttcaggtaaaagacgtcaggaccaccgaggccgggactgtttatattcatatcaatgaagatgacagtagcctgccgggtaagagcatcaagaacgctcacagtgatcgctgtgtccctctggttgatggtgcctacggttttgtattggctgactttatggacctgttagaagcccgtaggaacgctgggagtgaagatgctatggtattcgatggtctgcgtctcatgaaaaacggctacggtgagcaggtgagcaagtggtttaacagaacgttgttacctaaggtcctcgctgaccgtgacggcttggcgttccactcgtttagacatacggtcgccactcagttaaaacagcatggcgtcgagttggcttacgctcaggctattatggggcatagctcagggtctattacttatgaccgctacgctaaagaggttgaggtagaccgattggttaacgttctggctgatgtttataaggaggtaagactatcaaactga

SEQ ID NO: 4810 - DNA, 624 bp, Klebsiella pneumoniae
cctgatgcagggtcgtccactgcgcgagatcggtgcccgcgattaaccttcctgagcttcctcccatcccgggaggaagcttcctcttgctctcccccctccgccgcactatcctctggcgctatgaaaacgccccgtattcccatcgctattcagcaggccgtcatgcgcagcctgcgggagcatctcgccaatgcgaatcgcaagctggaacgccgctatgcggaaccgacgctggtctaccagcagcgtggtacttccgccggcaccgcctggctggagaaaaacgaaattcgtttaaacccggtgctactgctggaaaatcagcgggagtttatcgatgaagtggtgccgcatgagctggcgcacctgctggtctggcagcatttcggccgcgtcgcgccgcacgggaaagagtggaaatggatgatggagagcgtccttggcgttcccgcgcgtcgcacccaccgctttgaactcgcttcggtccgccagaacaccttcccctatcgctgtcgctgtcagcagcaccagctcaccgtccgtcgccataaccgggtggttcgcggcgaggccacctaccgctgcgttcgctgcggcgatctgctggtggctgaaaaataa

SEQ ID NO: 4811 - DNA, 459 bp, Klebsiella pneumoniae
gcagcagcaggtagtttggcgccgaccagacctggcctgcggcaggttcggtggcgctggccagaaaagtgctcaaacgcagctcgcgccagctgcgcagctcatcccaggcgaccttaccctgcgccgccagcggatggccaggggctacataaatgcccatcgccgtctgcagcggcaggcgggtgctgccgatatcggtggggtagcgctccctcgcctcaatcagccccacctgggcgcgggatttttgcaggagatcgatcacatcctcgtcttcgccaatcaaacactcaaactcggtatgaggaaagcggcggtcaaactgcaccagcagatcttccagcacgtccgggtgcagagtatcggagagcacgaaggtcagccgcggctccgtctcgccggacagcgacacagccagttcgtccagccgctcgctggcggcaagaatcgctttga

SEQ ID NO: 4812 - DNA, 789 bp, Klebsiella pneumoniae
acttttaaaggcgctgcggcgcctttatttttttggagggaaggtatgggaatagctcttattagcggcgcgagccgcggcataggccgggcgacggcgctgctgctggcgcaggaaggatataccgtggcggtcaattaccatcacaacattaacgccgccaccgaggtggtgaataccattgtggcgtctggcggcaaagccacggcgctgcgggcggacatcagcgatgaagcgcaggtgatggcgatgtttgaggcagttgaccgcatgggcgagccgctgacggcgctggtcaacaacgccgggatcctgtttacccagtgtacggtggagagcctgagcgccgagcgtattaaccgcgtgctggccaccaacgtcaccggttatttcctctgctgtcgcgaggcggtaaagcgcatgtcacatcgacatggcggtaagggcggggcgatagttaacgtgtcgtcggcggcgtcgcgccttggcgcgccgggggagtacgttgactatgccgcgtcgaaaggggcggtagataccctgactaccgggctggcgctggaggtggcggcgcaggggatccgggtcaacggcgtgcgtccggggctgatttataccgagatgcatgcttccggcggtgaaccgggacgcgtggatcgagtgaaaggttcgctaccgatgcagcgcggcggccagccggaagaggtcgctcaggccattgcctggctgctgagcgacaaagcgtcgtatgtgacgggtagcttccttgaactggcgggcgggaaataa

SEQ ID NO: 4813 - DNA, 2127 bp, Klebsiella pneumoniae
agggcaaaaggatgctccatgtacatgacttgtcgcttgggttacattgttcacacttttttccggcgtagcccaaaacgcgctctcgtcaagtcgttaagggcatggccttcaacagtccgaactggagtcaaaatgtcctcacgtaaagagcttgctaacgctattcgtgcgctgagcatggacgctgtacagaaagccaaatccggccacccgggggccccgatgggtatggctgacattgccgaagtgctgtggcgtgatttcctgaaccataacccgaacaatccggcctgggctgaccgtgaccgttttgtgttgtcaaatggccatggttcgatgctgatttacagcctgctgcacctcactggctacgatctgccgattgaagagctgaaaaacttccgccagctgcactccaaaaccccgggtcacccggaagtcggctacaccgcaggcgtggaaaccaccaccggtccgctgggccagggtatcgctaacgcggtcgggatggctatcgccgagaaaaccctggcggcgcagttcaaccgtccgggacacgatatcgtcgaccactacacctacgccttcatgggcgacggctgcatgatggaaggcatttctcacgaagtgtgctccctggccggtaccctgaaactgggtaaactggtggcgttctatgatgacaacggcatctccatcgacggccacgttgaaggctggttcaccgacgacaccgccaaacgctttgaagcctacggctggcacgtggtgcgcggcgtggacggtcacgacgctgacgccatcaaacgcgcggtagaagaagcacgggcggtcaccgacaaaccgtccctgctgatgtgcaaaaccatcatcggtttcggttcgccgaacaaagccggtacccacgactcccacggcgcgccgctgggcgacgccgaaatcgccctgacccgcgaagcgctgggctggaaacacgcgccgtttgacatcccgtctgacatctatgcccagtgggatgccaaagaagccggccaggcgaaagaagccgcatggaacgagaagtttgcggcttacgccaaagccttcccgcaggaagcagccgaattcacccgccgtatgaaaggcgagatgccgtctgacttcgacgcgaaagctaacgagttcatcgcgaagctgcaggccaacccggcgaaaatcgccagccgtaaagcctcgcagaacgccatcgaagctttcggcccgctgctgccggaattcctcggcggctccgcagatctcgcgccgtccaacctgaccctgtggtctggctctaagccgatcaacgaagacgctgccgggaactacatccactacggcgtgcgcgagttcggtatgaccgctatcgccaacggtatcgcgctgcacggcggcttcctgccgtacacctccaccttcctgatgttcgtggaatacgcgcgtaacgcggtacgtatggccgcgctgatgaaacagcgtcaggtgatggtctacacccacgactccatcggtctgggcgaagacggcccgactcaccagccggtagagcaggtggcttccctgcgcgtgaccccgaacatgtccacctggcgtccgtgtgaccaggtggaatccgcgattgcgtggaaatatggcgtggagcgtcaggacggcccgaccgcgctgatcctctcccgtcagaacctggcgcagcaggagcgtaccgcagagcagctggcgaacgtggcccgcggcggttatgtgctgaaagattgcgccggccagccggagctgatcttcatcgccaccggttcagaagtggagctggcggttgccgcatgggacaaactgactgccgaaggcgtgaaggcgcgcgtggtttccatgccgtccaccgacgcgttcgacaagcaggatgcggcttatcgcgaatccgtactgccgaaagacgtgaccgcgcgcgttgccgtggaagcgggtatcgctgactactggttcaaatacgttggcctgaacggcgctatcgttggcatgaccaccttcggtgagtctgcgccggctgagcagctgttcgaggagttcggcttcaccgttgataacgtggtcgctaaagcgaaagcgctgctgtaa

SEQ ID NO: 4814 - DNA, 531 bp, Klebsiella pneumoniae
gcgacagcgggaggcgctagcgcctcctcaccaatctttgccagccaacaatcaaatagccagggctttattgaagacagccacttggaactctttttacgtaacgcttatacccgtcatacttcaagctgcatgtgcgttggcaataactcggcctatccctgggcctcgcccctacggggccagcgcaagcgctgttcaaaacggctagccgttttgtccggcaactcgaattatttagggtatataccaaacgtgattatcgcgatgggttgccggataaagccgaatggggccaggggattatcgccaccttcgaatccggctttacccagggaccggtcggcttcggtgtggactgtatcgcccagtatgcggtgcgccttaacggcggtcgcgggcccagcggcctgcgccttgattaaccccctgtaccgtacggcacagggggttaccggggttattcgcccttcttcgccgcctggatgtacagcatctccagcgccagggtcgccgccgccagagcggtaa

SEQ ID NO: 4815 - DNA, 414 bp, Klebsiella pneumoniae
tttcccttttttggagatgaattgatgagcaacgtaccagcagaactgaaatacagcaaagaacacgagtggctgcgtaaagaagcggacggcacctataccgtagggatcaccgagcacgcgcaggagctgcttggcgatatggttttcgttgacctgccggaagtgggcgccaccgttgaagcgggcgccgattgcgcggttgccgaatccgtgaaggcggcctccgatatctacgcgccgattagcggtgaaatcgttgccgtcaacgaagagctgaacgactctccggaactggtcaacagcgacccgtataccgacggctggatcttcaagatcaaagccagcgacgaagcgcaggttgccgcgctgctggatgccgccgcgtatgaagctttattggaagacgaataa

SEQ ID NO: 4816 - DNA, 729 bp, Klebsiella pneumoniae
gggagttttatgatgcgtaaaacgctgctggcggtggcgctctccgtcaccgctttgtctgcccatgcggactaccagtgtagcgtcacgccgcgtgacgatgtgatcctcagcccgcagcaggtgcaggtgaaaggggaaaacggcgatctggtgataaagccggacggcaatctgacctttaacggcaaggcctatgcgctcagcgccgcccagcgcgaacaggcgcaggattatcaggccagcctgcgcagcagcctgccgtggattgacgaaggcgcgcgttcgcgagtcgaaaaaagccgcaaggcgctggataaaatcattaccgaacaggttggcgccaacagcagcatgcacggtcgcctgaccaaactggacgcgcagctgaaagaacagatgaaccgcattatcgaacgtcgcagcgatggcctgaccttccactataaagctatcgaccaggtacgcgccgatggccagcagctggtgaatcaggcgatgggcggcattctgcaggacagcattaacgagatgggcgccaaagcggtgctcaaaggcggcggtaatccgctacagggcattctcggcagcctcggcggcctgcaaacggcgattcaggaggaatggaaaaaccaggaggccgatttccagcagtttggtaaggacgtctgcagccgggtggtatcgctggaggacagccgcaaagcgctggttggctcgttaaaataa

SEQ ID NO: 4817 - DNA, 705 bp, Klebsiella pneumoniae
gggtaccttatgttaaaacgctctctggttctcgccgccctctgcggtatgtcttttgcagcaaccgcggtaacgatagatttacgtcatgaatttattgatggcggaaagagtgataaaagtaatgctgaccgcgtctccgtttctcaccgctttgccaacggcttaggctttaccgtcgaggccaaatggcgctcaggcggcgacaacggttcgcaaccctattcggacgtggtgggcaatggtcatgaagacaccatcagctggcgctggaaagcgacgtcgaacttgttcctcacccccgggtttaccattgagagcaacgacagccgctccatctacaagccgcacctgcacgcgcagtacagtttcgacaacggcttctatgtcgccgctcgctatcgctatgaatacacccgctatccgaacaacgccggcaaagatgatgacaaagttaaccgcggcgacgcgtgggccggatttgtcctcggcgactggcgtacagagctgaactatgtctatgcccgcagctcggaaggggtcagccgcaacgacaataaaccctactcgcaggaatataacgtgaaggtggcctataagctggataataactggtcgccgtatggcgaaattggcaacgtcggggtcaatgaccgcagcgatcgccagacccgcttccgcgttggggtggcctactcgttctga

SEQ ID NO: 4818 - DNA, 432 bp, Klebsiella pneumoniae
gaacgtactatgagcatcaccatttaccataaccctgactgcggcacctcgcgtaatacgctggcgctgatccgtaacagcggcgccgagcccaccattatctattatctggagacgccgccgtcgggtgatgagctgcgccagctgctcgccgcgatggggatcccggtgcgcgcgctgctgcggaaaaacgtcgaaccctacgacgcgctgggcctggcggaagaccggtttactgacgaccagataatcgactttatgcttcagcatccgatcctgattaaccgtccgatcgtaacgacgccgcagggcacccgactctgccgcccgtcagaggtggtgctggagatcctgacggcgccgcaacaaggcgcattcgtgaaggaggacggtgagccagtcattgatgccgcagggcagcgtgtgaaatag

SEQ ID NO: 4819 - DNA, 936 bp, Klebsiella pneumoniae
ggagatgctatgaataacgcgctttataatcagatacgcatctttcagagcattgcgcgcgagggcaatatctcggccgccgcgcgcaagctcgaaatcacgccgccgtcggtcagcaatgcgctcaggctgctggaggagcatattggccaccccctttttgtgcgcactacccggcgtatcgagctgacggaaaccgggcaacagctgctggagcagaccgccgcggcggtggagacactggaaaagtcgctggaaatcatccgcgaccagaatcaagagccctccggggcagtgagaataaccctctcgcgctttgcctacctgcttattctcaaaccggcgatggcggcattttgtcagcaatatccggggatccagctggaaatatcggtctatgacggtaccgtcaatattattgaagaacgtttcgaccttgggatccgctttggcgatattctcgaaggcggcgtggtcgcccgcccgttaatgaagccgtttcgtgaagggctatacgcctcctctgcctatcttgccgaatatggcgtgcccgcgatgcctgccgatctccatcatcaccggctgattggctatcgctttattaccaacaaccgcatcctgccgctgatcctcaatgaccacggcgagcagctcaccgtcgagatgcccggacagttaatcagcaatgatattgacgtcatggccgacggtattcgccacggaatggggattggccgtttatttgaaccaatcctgcaattacagcccgatcgtgagcagtttattcccgtgatggaggactactggaaaacctatccgccggtttatctctattacccaaaaaacgcgggcagaacgaaaagggtgaaagccctgattgatttcctgataatgcatgccgcggatgatgcagagaaagtcgggtcttcccgctag

SEQ ID NO: 4820 - DNA, 1140 bp, Klebsiella pneumoniae
gagggaaatatcatggctgaagtaattttcaacaaactggaaaaagtttactccaacgggtttaaagcggtgcatggtatcgacctgaagattgccgatggcgaatttatggtgatcgtcggcccctccggctgcgccaaatcgaccaccctgcgcatgctggcgggtctggaaaccatcagcggcggcgaggtgcggattggggacaaaatcgtcaacaacctggcgccaaaatcacgtggcatcgcgatggtgttccagaactacgccctctatccgcatatgacggtgcgcgaaaacctcgccttcggcctcaagctgagcaagctgccgaaggcgcaaatcgacagacaggtggaagaagcggcgaaaattctcgaactggaagaactgctcgatcgcctgccgcgccagctctccggcggccaggcgcagcgcgtggcggtgggccgggcgatcgtcaaaaaaccggacgtcttcctgttcgacgaaccgctctccaaccttgacgccaagctgcgcgcctcgatgcggatccgcatttccgatctgcataagcagttgaaaaaatctggcaaaccggcgaccaccgtctacgtcacccacgatcagacggaagcgatgaccatgggcgaccgcatctgcgtgatgaagctcggccacattatgcaggttgataccccggacaatctctaccaccagccgaaaaatatgtttgtcgccgggtttatcggcgcgccggagatgaatattcgtcccagccagctggttgagcacggtggtcgcctgcatttgacgctgggcgatcagcggctgccgctcaacgatcggctgcaaagcaaagttgaaacccataagaatcagcaggtgttctttggcgtgcgcccggagtttgtctctctctccgatgaaccgtttgccgaaggttcctgcgcgggtgaaatggtacgcgtagaaaacatgggacatgaattctttgtttatctcagggttgctgattatgagctgaccgcccgcgtgccgtcggacgatgcgaagccgatgattgccaggggactgaatcgcaaagtctatttcacctttgatctcaacaagtgtcacatctttgacgccaaaaccgaacagaacctctctctgtga

SEQ ID NO: 4821 - DNA, 606 bp, Klebsiella pneumoniae
acaggattcatcatgcaaaaagtcgtcctcgctaccggtaacgccggcaaagtgcgcgaactggcctcgctgctggaagattttggtctcgatatcgtcgctcagaccgagctgggcgtggactctgcggaagagaccggcctgacctttattgaaaacgcgattctgaaagcgcgccacgcggcgcagatcaccggcctgccggccatcgccgacgattccggtctggccgtcgatgctcttggcggcgcgccgggtatttactccgcccgctattccggcgtcgatgccagcgaccagcagaatcttgagaagctgctcgacgcgttaaaagacgtgccggacgaccagcgtcaggcccagttccactgcgtgctggtctatctgcgccatgccgaggatcccacgccgctggtgtgccacggcagctggcctggggtaatcacccgacaagccgccggtcatggcggcttcggttacgacccgatcttcttcgtcccgtcagaagggaaaaccgcggccgaactgagccgtgaagaaaagagcgccatttcccatcgcgggcaggcgctgaaactgttactggaagcattacgtaatggctaa

SEQ ID NO: 4822 - DNA, 339 bp, Klebsiella pneumoniae
ggagaaatcatgtctttattgcccctgcaactgttcaaaaacctcgccgatgaaactcggctggggatcgtattgctgctcaaggcgcgtggagagctgtgcgtgtgcgatctctgtacggcgctcgcccagtcccagcccaagatctcccgccatctggcgatgctccgtgagagcggattgctgctggatcgtaaacagggtaagtgggtccattaccgcctctctccgcagatgccggcctgggcggcgcaggtgattgagcaggcctggctcagtcagcaggaggatgtgcggctgatgatcagcagactggctggcgggccggggtgccggtaa

SEQ ID NO: 4823 - DNA, 195 bp, Klebsiella pneumoniae
gttggagtcattacccaggtgctgaaggatggctccccgctgcagtttaataagaaatacaccgtcggccgcttgaataatcaggagacccgctacatcaccataccgctgcacgcgcgtttttatcagtatggcccgacgaccagcaccggcgaggtggagtcgcatatgatctttaacctgacgtacgattaa

SEQ ID NO: 4824 - DNA, 1281 bp, Klebsiella pneumoniae
caagcccacattcgtgaggataactacatgaatcttaagctgcagctcaaaatactgtcgttcctgcagttctgcctttgggggagctggctcaccacgcttggctcgtacatgtttgtcacgctgaagtttgacggcgcggcaatcggcgcagtgtatagctcgctcggtatcgccgcggtgttgatgccgacgctgctcggcatcgtcgccgataagtggatcagcgccaaatgggtatacgccatctgccacctggtcggcgcgttaacgctgtacctcgcggcgcaggtcaccacgccgggcgagatgttcctcgtgatcctgcttaactcgctggcctacatgccgacgcttggcttgatcaataccatctcctactaccgcctgcagtcggcggggctggatattgtcaccgatttcccgccaattcgtatctggggcaccatcggctttatcctcgccatgtggggcgtgagcttctccggctttgaactgagccatatgcagctgtacattggcgcgacgctgtcggtcctgctgactctgttcaccctgacgctgccgcatattccggtcgccaacgcccagcgcaatcaaagctgggcggagatgctcggcctgaacgcttttgcgctgtttaaaaacaagcgtatggctatcttctttatcttctcgatgatgctcggcgccgagctgcaaatcactaacatgttcggtaacaccttcctgcacagcttcgataaagatccgctgtttgccggcagctttatcgtcgagcacgcgtcagtgctgatgtcgatttcgcagatttccgaaacgctgtttatcctgaccatcccattcttccttagccgctacggcattaagaatgtgatgcttatcagtattgtggcgtggatgctgcgcttcggcctgttcgcctttggcgacccgacgccgttcggcactgtactgctggtgctgtcgatgatcgtctacggctgcgccttcgacttctttaacatctccggttcggtgttcgttgagaaagaggtgcgcccggaaatccgcgccagcgctcaggggatgttcctgatgatgaccaacggcttcggctgtattctcggcgggatggtgagcggcaaagtcgtcgaacactttaccgtcgaggggatcactgactggcagagcgtgtggctgattttcgccggctattcgctggtgctggcctttgccttcgtggcgctgttcaaatacaaacacgtcagacaaccgaccgccgcccagcagagcgtgtga

SEQ ID NO: 4825 - DNA, 1527 bp, Klebsiella pneumoniae
ggaaccaacatgtctgaacaacaagcacagggcgctgacgcggcaattgaccttaataatgaactgaaaacccgtcgcgagaagctggctgcgctgcgtgagcagggcgtcgcattcccgaacgatttccgtcgtgaccatacctctgaccaactgcacgctgacttcgatggcaaagaaaacgaagagctggaagcgctgaacgttgaagtggccgttgctggccgcatgatgacccgtcgtatcatgggtaaagcgtccttcgtgaccctgcaggacgtaggcggccgcatccagctgtacgtggcgcgtgatgacctggcggaaggcgtttataacgaccagttcaaaaagtgggacctcggcgacatcatcgccgcccgcggtaagttgttcaagaccaaaaccggtgagctctctatccactgcaccgagctgcgtctgttgactaaagctctgcgcccgctgccggacaaattccacggcctgcaggatcaggaagcgcgttaccgtcagcgttacctggacctgatttccaacgatgaatctcgtaagaccttcaaagtgcgttcgcagatcctggcgggcatccgtcagttcatggttggccgcggctttatggaagtagaaaccccgatgatgcaggtgatcccgggcggcgcttccgcgcgtccgttcatcacccatcataacgcgctggatctggacatgtacctgcgtatcgcgccggaactgtacctcaagcgtctggtggttggcggcttcgaacgcgtcttcgagatcaaccgtaacttccgtaacgaagggatctccgttcgtcataacccagagttcaccatgatggaactctacatggcttatgcggattacaaagatctgatcgagctgaccgaatctctgttccgcaccctggcgcaggacatcctcggcaataccgaagtgccttacggcgaccaggtgttcgacttcggcaagccttttgaaaaactgaccatgcgcgaagcgatcaagaaataccgtccggaaaccgagatggcggatctggataactttgattccgcgaaagcgatcgctgaatctatcggcatcaaagtggagaagagctggggtctgggccgtatcgtgaccgagatcttcgaagaagtggcggaagcgcacctgatccagccgaccttcatcaccgaatacccggcggaagtttctccgctggcgcgccgtaacgacgtcaacccggaaatcaccgaccgctttgaattcttcattggcggccgtgagatcggtaacggctttagcgagctgaacgacgccgaagaccaggcgcagcgcttccaggatcaggttgatgcgaaagccgcaggcgacgacgaagcaatgttctatgacgaagactatgtcaccgcgctggaacacggcctgccgccgaccgctggtctgggtatcggtatcgaccgtatggtcatgctgttcaccaacagccacaccatccgcgacgttattctgttcccggcgatgcgtccgcagaaataa

SEQ ID NO: 4826 - DNA, 588 bp, Klebsiella pneumoniae
cgaatgcgcatgtctatacagaacgaaatgcctggttacaacgatgtagaccagttactgaaccaacaaggggtaggtctcaccccggccgaaatgcacggtttgatcagcggattgctgtgcggcggcaacacggacagcagctggcagccgctggtgcacgacctgaccaacgaaggtctcgcctttggccatgaactggctcaggcgctgcgtaacatgcattccgccatcagcgattcactggatgacgacggtttcctctttcaactgtatctgccggaaggcgatgcggtgagcgtctttgaccgtgccgacgccctcgccggttgggtcaaccacttcctgcttggtcttggcgttagccagccgaagctggataaagtgaaggatgaaaccggggaagcgattgacgatctgcgtaatattgcccagctgggctacgatgaagacgaagatcaggaagagctggagatgtctctggaggagattatcgagtatgtccgcgttgccgcactgctgtgccacgacacctttgcccgtcagcagccaaccgcaccggaagtccgcaaaccgacattacactaa

SEQ ID NO: 4827 - DNA, 276 bp, Klebsiella pneumoniae
gttggcagcatcaccaaaaaatcacagataaaaataaataagttatttcttggcgagcattttttgtcagttattatgctgcgcttccggcaagaatattctttaactgctatttattgcactcttcagcaggatcacttccatgaaaagaggcttacttaccctggttactgctgccatcgctttccgtacaggccacctggcgcagcgacaagcgccaggaggcacgtgacgaaaagtggtgaaccggcaggattcggcgtatcctggatgtga

SEQ ID NO: 4828 - DNA, 1239 bp, Klebsiella pneumoniae
agtcgcataatgtctaaaatttggtctaaagaagaaactctatggagttttgccttatatggcactgcagtaggcgctgggacgctatttctaccgatccagctgggttcggctggcgccattgtgctgttcatcaccgcgctggtcgcctggccgctcacttactggccccacaaagcgctgagccagtttattctctcggccaatatcgcgccgggaaccgggatcaccggcgcagttaatcactactatggtaagaaaattggcaacctgatcaccggcctctatttccttgccttctttgtggtggtgctcatatacgccgtggccatcaccaactcgctggccgaacaggtggcgcatcgcacgccgatgaccccagggctgcgtgcgctgctgagtctgggggtcgtgctggtcctcaacctgatctttctcatgggacggcaggtcaccatcaaggtgatgggctttctggtcttcccgcttatcgcctgtttcctgtttctctccctctatttaatccgcgactggcatccggagcatctcaccagccagatgcagttcagcccgcagacgctccaccaggtctggatctctattcccgtgatggttttcgcttttagccatacgccgatcatctcgacttttgctatcgatcagcaggagaaacacggcgacctggccatgggtaaatgcaaaaaaatcatgaaggtggcctacaccatcatctgcgccagcgtgctgttttttgtcttcagttgtctgctggcgatcccggcaacctatatagagaccgcccgcgatcagggggtgactatcctctccgccctgtcgatggtgccaggcgcgccgggatggctggcggtgaccggcatcatcgtcgccgtcgtcgctatgtcgaaatcgtttctcggaacctacttcggagtgattgaaggcgccagcgaaatcgtcaaaagctcgctgggcctgctgggcgtgcgtaagagccgcgctttcaaccgcgcgatgtcgatcctgctggtctccgccttcacttttgcggtgtgctttatcaacccgaatgcgatctcaatgatctacgctatcagcggaccgcttatcgccatgatcctgtttattatgcccacgctgtcgacatggctcattccggcgctgaagccgtaccgctcggtgggtaacgccattacgctggtggttggcctgctctgcgtgtcggtgatgttcttcggctaa

SEQ ID NO: 4829 - DNA, 771 bp, Klebsiella pneumoniae
ctttggataatgcccgttttccgaacacattcacaagcagaccaaacttttatgaaaaacgacgtcatctctccggaattcgatgaaaacggtcgcccgctgcgccgtattcgtagcttcgtccgtcgccagggccgcctgacgaaagggcagcagcatgcgctggataacatttggccggtgatgggcgttgaattcaacgatgcgccgctcgatttcgccgccctgtttggccgtgacgcgccggtcaccttagaaattggcttcgggatgggcgcctcgctggtggcgatggcgaaagccaaaccggaacagaatttcctcggcattgaagtacactccccgggcgttggcgcttgtctggcttctgcggaagaagaaggcgtacaaaacctgcgcgtaatgtgtcacgatgcggtggaagtgctgcataccatgatcccggataactcgctgaatatggtgcaactgtttttccctgatccgtggcataaagcgcgtcataataaacgtcgtatcgtgcagccgcctttcgctgagctggtgaaaagcaagttgaagctcggcggcgtcttccatatggcgaccgactgggaagcctatgccgtgcatatgctggaagttatgtcctcgctggaaggctatcgtaaccagtcggcaagcaacgattacgtaccgcgcccggaatcgcgcccggtaaccaaatttgaacagcgtggccatcgtctcggccacggcgtatgggacttaatgttcgagagggtgaaataa

SEQ ID NO: 4830 - DNA, 726 bp, Klebsiella pneumoniae
agagggataatgaacactaaaatattcgaagacaacattttatctcgtaatgatatcgctgtacgctacgtctttcagaaaatgttttccccacaaggtactctggtcgcggtggaatgcttaagccgctttgataatctttctatttcccccgaagattttttccgccatgctaccgccgccgttcgtgaacgtatttttctcgaacaactggcactgattgaaaagcataaagcctggtttttacgtaaccatatttccgcaacaattaacgttgatgaccatatcctgaacctgttgcgccagaaggatataaaagccaaaatcgccgccctgacctgcgtccatttcgaggtaaccgaaaacgccgagaatctgctgcataattctcttgccgcctggcagagcccacaggatacctcactgtggctcgacgacttcggctccggctacgcgggaattaacgctattcgcggttatcactttgactatgtgaaaattgataaggattttttctggcacctgatgcgcaaagagtccggccgccagctgatggatgcgctggtgacctttttatcgcgcaaccatcataatgtgattattgaaggtgtcgaaagcgaagcccataaagaatggctgcagggaatggagtggtttgctatccagggacattactggcgggaagtcagtattgaacaactggtcgccgatgatattgccatgtaa

SEQ ID NO: 4831 - DNA, 1011 bp, Klebsiella pneumoniae
atggctacaatgctggatgtctcaattcgcgcaggcgtctcgaaagcgacggtttcccgcgtgttgaacggcacaggtcaggtgaaagagagcacccgccaacaggtctttaaagcgatggaagagctgggctaccggcccaatttccttgcccgctcgctggccaatcagaccagcaatagtatcgggctggtcgtctccacctttgacggcttttactttggccgtctgctgcagcaggcgtcacgccagaccgaagcctggggaaagcagcttatcgtcaccgacggccatgatacgccggagcgcgaagaggaagcggtgcagatgctcgccgaccggcagtgcgatgcgatcatcctctatacccggcacatgagcgagaaggcgatcatgtcgctgattaactcgatcgccatgccgctggtggtgattaaccgcgatgtggcgcaggcccgcgaacgctgcgtgttcttcgaacagcaggaagccgccttccaggccgtggagtatctgattacccagggccaccgcgatatcgcctgcatcaccgtcccgatgcatacccctaccggccaggctcgcctgcagggctaccgcaacgcgctgataaaacatgatattgagtgggatccgagccgggtgaagtatggggactcgacgatgactcgcggctacgaactgtgccgggaactgctggacgagaaagcccgcttcagcgcgctgttttcctgtaacgatgatatggcgctgggggcgtcaaaggcactgcatcaggcggggctgcgtattccacaggatgtgtcgctgtttggcttcgacgatgcgccaagcgcgaaatggctggagccggggctgtcgacggtttatctgccgatcgacaacatgatcactacggctatcgaccaggcgatcaagcttgccaatcagcagccgatagaaacgatcccgccgtttaccggcacgctggtgcttcgcgagtcggtgacgacgggacctttttttaaataa

SEQ ID NO: 4832 - DNA, 2646 bp, Klebsiella pneumoniae
ccagaagcaatgacagccgggcaacgtcggaccggagggataatgtcacatcggaaatatggactggatcatttaggctgccgaactgcccggcgcctggtatctccggcgctggcgctgtggctctgctcacagccgtttgccgcgcgggcggacctctattttaacccccgctttttagctgacgatccggcggcggtggctgacctgtcgggatttgaaaaaggccaggaggttccgccaggcacctatcgcgtcgatatttatctcaacaatggttttatgaccacccgggacgtcaccttccaggccgatgcccagggtcacggtctgtcaccctgcctgacgcgcggccagctggcgagcatgggtgtggataccggtcgggtgccgggcatggcgacgctggacagcacggcctgcgtgccgctgaccacgcttatcagcgaagctaccacgcgcttcgacgtcggacagcagcgcctgtacctcaccgtcccccaggcatttatgggtaaccatgcgcgcggctatattccgccggagctgtgggataacggtatcaccgccgggctgattaactataacttcacgggcaataacgcccataacaccacaggtggcagcagccgttacgcctatctgaatctacagagcggcctgaacattggcgcctggcgtctgcgcgataacagcacctggagctacagcagcggcggtagcacctcatccaacgagaatcgctggcagcacgttaacagctggcttgagcgggacatcacgcctctgcgttcgcgactcaccctaggggacagctacaccaacggcgatgtcttcgacgggatcaacttccgcggcgcccagctggcctccgactacaatatgctaccggacagccagaaaggctttgcgccggtgatccacgggatcgcccgcggcacggcgcaggtgtcaatcaggcaaaacggctacgaaatctaccagagcacagtgccgccgggaccatttaccatcgacgatctctacgccgcgggcaatggcggcgatctgcaggtcacgatcaaagaagcggatggctcccgccaggtcttcagcgtgccctggtcaacggtgccggttctccagcgtgaaggccatacccgcttcgccctcaccgccggggagtaccgcagcggcaacagtcagcaggaaacgcccgattttttccagggcacggtcatgcatggcctgccggcaggctggacgctctacggcggcacccaactggcagaccgctatcgcgcctttaaccttggggtggggaaaaacatgggctatttcggcgccctgtcgctggatatcactcaggccaacgccaccctggctgacgacagcgaacatcaggggcagtcggtgcgttttctctataacaaatccctggatgagaccggcaccaacctgcagctggtgggctaccgctactctacccgcggctattataactttgccgataccacttaccgccggatgagcggctacagtgtggaaacccaggacggcgttatccaggtaaaaccgaaatttaccgactactacaatctggcttacagcaagcgcggcaaggtgcagctgagcgtgactcagcagttggggcgcaccgccaccctctatctcagcggtagccaccagacctactggggcaccgacgatgccgatgagcagctgcaggccggcctcaacgccgccgtggacgatatcaactggtcgctaagctacagcctgacaaaaaacgcctggcagcaggggcgcgatcaaatgctggcgatcaatatcaatatccccttcagccactggctgcgttccgacagccgctcggtctggcggcacgccagcgccagctacagcctgtcgcacgatctcaatggccgcatgaccaatctggcgggcctgtacggcaccctgctggaagacaacaacctcagctatagcgtgcagaccggctatgccggcggcgacaacgggagcacaggctacaccgccctcaactaccgcggcggctacggcaacgccaacgtcggctacagccgcagcgatggctttaaacagctctactacggggtcagcggcggcgtgctggcgcacgccaacggcatcaccctgagccaaccgttaaacgataccgtggtgctggtgaaagcccccggcgccggcggcgtgaaagtggaaaaccagaccggggtacgcaccgactggcgcgggtatgccgtcctgccttatgccactgagtatcgtgaaaaccggatcgcgctggataccaacaccctggcggacaatgtcgaccttgacgatgcggtggtcagcgtggtgcccacccatggggcgattgtccgcgccaactttaacgcccaggtggggatgaagatcctgatgacgctgacccatcgcggcaaaccggtgccgtttggcgccctcgccaccggcgacagcaaccagagcggcagcatcgtcgcggacaacggccaggtctacctgagcgggatgccgctggcgggcaaagtgcgggtgaaatggggcgatggcccggacgctcagtgcgtggccgattaccgtctgccgccggagagccagcagcaggcgctcagtcagctttcggtcgcgtgccgctaa

SEQ ID NO: 4833 - DNA, 210 bp, Klebsiella pneumoniae
atcagcaccttcagcggcggtaaatgcgccgggcgctgctcgttcaggcgggtggcgattttcagccgatcgacggtgtggcaccagtcaaaatgctctgccaccaaccggcttttgttggactgcagggggccaataaagtgccactgcagcccgctgacgccagcctgctggaaatggttaatcttctccacgccctcctggacgtag

SEQ ID NO: 4834 - DNA, 1455 bp, Klebsiella pneumoniae
aacgtcatgatgatccttcctttctccgcgcgcctgcgcggcactctttttaccctgacgctgacgctgctcagcggctgcgcgctgatccaggatgagcctgcccaggtcgccatcgtcaatccgcagcaggcccagctggcgcaggtgatccacctggcgaacagcgactggccggccgcccgctggtgggaggcctatgatgatcctcagctcaatatgctgatcaaccgggcgctgcagaactcgccgaccatgcaggccgcccggctgcgcatctcccagtcgcagtccacggtggaactcgcccggtcggcgatgggcctgcaggccaccgccgtcgcggcgcaaaaccgcctgcggatcaccgacaaatcctttagctggccctactcatactccctgccggtggataaaaacggcccctggtatacgctgaataccgttggcgtcggggcgcagctgaatatcgatctctggggggccgatcgcgcacgggtcgccgccgctattggcgagaaaaacgcccggctggcggagaccgccggcattgagctcgacatcgccagcagcgtggcgcagctctatttcgccatgcaggcgacgttccagaaaatcgcgctgctgcaggagctggagggcattgcccgattctcggtggaagcccacgagcaccggacccggcgcggcctggaagacagtgtggatgtggccaacgcccaggccgaacagctcgccgctcgccagcagatcattagcgccgaggggatgctgacccagtatcgtgaaaccctgcgggcgcttatcggcgccgatgcgcagagcatgccggccatccatccggtggcgctgccggcgctccaggagaagctgccgccgtcgctctctttcgagctgctggcccgccgtccggacctgcaggcgctgcgcggctacgtcaccgcctccctgagccaggtcgatgcggcgaaagcggctttctacccccattttgatatcaaagcgttctggggctataacgccctgagcgtcggggatctgtttaagtcctctttccagcagatcaacctgctgcccgggctgtatctgccgatcttcgacggcggtcgtctgaacgctaatctgcagtcggtacgcaccgccagcaacatcctgatcaaacagtacaaccaggcggtgctggatgcggttcgcgatgtcgccatcagttccagccagcttaacgacctgaatcagcagcgcgcgctgcagcagctaaaagtcaccgcggcgcagaccaccaccgatagcgctcgcgctcattatcagcgcggcctcctcagccgctacgccgccgaagaagcccgccgggcggtcctcgcccagcagctgttgctgctggacattgaggcccagcggctaagcaccgacattaccctgatcaaagccctgggcggcggctatcgagggcagtaa

SEQ ID NO: 4835 - DNA, 420 bp, Klebsiella pneumoniae
aataaaacgatgtatatttgtaaatactttaaaatcataaagttacatttttatttcaactcacagctgttcctgattatcttaaagcgttttgaattcaatgacataaaactggctctcgccaggatagatgtcgctgatgacctgccgcagctgcccgagagtcatattctcctgttgcgcatgctgttcggtcagcgtatcgagcgtcaccgtcgaggtcgcggtcacagcaatggtgcaaaaatagccgtcatcttcatagcgcccaacgcgcagcacatcgccgggcttaaagtgcgactccgctgcatcgcgaatggtgatggttttgcgcccggcgaggatgtcgtcctgaaaacgctgaaaaaaggtaatgtcattggcctgcatgatataattccgtcctggtcattatga

SEQ ID NO: 4836 - DNA, 639 bp, Klebsiella pneumoniae
aatggggcgatggcccggacgctcagtgcgtggccgattaccgtctgccgccggagagccagcagcaggcgctcagtcagctttcggtcgcgtgccgctaaggagatcatgatgagaacactgcagtatctgctgggcgccctgttcaccctgggcgcaccggctgcgcttgccgccgatagcacgatcgccatcagcggctatgtccgcgataacgcctgcgcggtagccggcgaatcgaaggattttactgtcgatttacaggataacgccgcgaagcagttttatgccgttggggcaacgacgccgccggtgccgttccgcatcgtgctgtcgccctgcggcacttccgtcaccgcggtgaaggtcggtttcaccggcgtggcggacagcatcaacaccagcctgttaaaactcgatgccggggcctcggcggcggcaggaatgggggtggaaattctcgatcagcagcagtcccggctgccggtcaatgcgccgtcatccaccatgacctggaccacgctgaccccgggccagaccaatattctcaacttttacgcccggctgatggccactcaggtgcccgtcaccgccgggcatgtcaatgcgacagcgacattcaccctggaatttcagtaa

SEQ ID NO: 4837 - DNA, 645 bp, Klebsiella pneumoniae
cgaacgcggatgccacgttcaaagtgcagtacgagtaagacccgagtcaggcagggaagctattcgggccaggagggcccgctctctattttcaaccggagtgaaacgatgcagggaatgaaatctggtctgctgctgctactgcctccgctggcgctggccggtaatcattggaacgtcacgctgccggggggcagcatgcgttttcagggcctgataatggcgagctcctgccgcgtcgaagccggcgatcggcagatgacggtcaatctggggcagatcagcagtaatcgatttcatgctgtcggcgaagatagcaacccaatccctttcgcgattcatttacaggattgcagtacggcggtcagccagcatgtgggtgtgacctttcacggcgtggctgatggaaaaaaccccgacgtgctgtcggtgggtgaaggtccggggatcgccagtgggatcggtattgcgctattcgacagccagggccagcagctcccgctcaatcgtccagcggatcgctggatatcactctaccgcggaccgacgacgctaaatttcgtcgccaaatatcgggcgaccggacgccaggtcaccggcggtgcagccaatgcccaggcctggttctcattgacctatcagtaa

SEQ ID NO: 4838 - DNA, 525 bp, Klebsiella pneumoniae
cggctatctgttcgactcagtgccgatttttcaggggaagctggtatgacgatcctgccgctgtacgctgcgccgcagttcgccccgcaggtgaccgactggctgtggcaggcctttggcggcgagacgctgccgcggcaattcttcgccagcatcgtgcagcatagccagacggcggaggcgctgccgttgacctttattgccgtggaaggcgagcagttgctcggcacgattggcctctggcgctgcgatttgatcagccgccaggatctgtttccctggctggcggcgctgtacgtcgcgcccgccgcccgcggtcaggggctggccggaaaactgcagcggcatgtgatcgattatgcccgccgcgcgggctttcgggagctctatctctactccgcctgccgggatttctatgaacgcttcggctggcgctacattggcgaggggctggattacccggccaccgccgtgcacctctatcgctatgacttatcgccttcctgcggggcgaccaccgagtga

SEQ ID NO: 4839 - DNA, 465 bp, Klebsiella pneumoniae
gttcgccctgtgagtatgttctcccacgccgctgtcgccagtctcaataatcttgagatgatggtctaccactacgtcattaaaaatcgtgacaaagtgatgtacatgaccatccgcgaactggccgaggccgccggggtctccacgaccaccgtgttacgcttctgccgcaaactgcagtgcgagggctactctgaatttcgcgtgcgctttaaattatatctcgagcagaatgagcctcaacaggcaaatatcggcgccagcgaaataatgagcttttttaaaagcgtcaataatgacgagttcgatgaattactcgagcaggccgtcgatattattctcgcctccgacgtattatttttgtcggcgccggcacctccggcgcgctggcgaaatatggcgcacgcttcttctccaacgtcggtaaattcagcaaccatattgacgacccctattttccggtaa

SEQ ID NO: 4840 - DNA, 1254 bp, Klebsiella pneumoniae
cacgagaatgtcatgatgaaagcgcctcactcacacagctacccgttgctcagtgccttactatttttcttttttgtgacctggtcgtcatccggctccttgctctctatctggcttcaccaggaggttgggctgaaggcaggcgataccggtattatctatgccgtactgtcggtttccgcgctgtttgcgcaagtttgctatggatttatccaggacaagctggggctgcgcaaacatctgctctggtatatcaccgcgctgctgatcctctctggtccggcgtatctgttgttcggccacctgctgaaaatcaacgtcctgttgggcagcatttttggcgggatctatatcggtttgacctttaacggcggcatcggcgtgctggaatcttacaccgagagggtggcgcgtcagagccagtttgaattcggcagggcgcggatgtggggctcgctgggctgggcggtggccaccttcttcgccggcctgctgtttaacatcaatccgcagctaaacttcctcgtcgccagctgttccgggctggtgttctttatcctgttggcgcggctgcgggtctcctcggcgccgcatgcgatgcaggaggcggtatcgggcggtaaggtgaccctcgaagatgcgctgcgcctgctgacgctgccgcgcttttgggcgctggtcttcttcgtcattggcacctgcatttacggcgtctatgaccagcagttcccggtctatttctcatcgcagttcgcgaccctgcaggaaggcaatgagatgtatggctacctcaactccttccaggtgttcctcgaggcggccggcatgttctgcgcgccgtggctggtgaaccgcatcggcgccaaaaacggtctgattttcgccggcatggtgatggcgatgcgcatggtggcctccggtctggtggaggggccgctgctgatctccatcaccaaactgctgcacgcggtggagttgccgatactgctggtggctatctttaagtacaacagcctcaacttcgataaacgtctctcctccaccctctatctggtgggcttcgcctgcaccagctcgattatcgccagcgtattgtcgccgctggcgggctacagctatgaaaaatatggcttcgcccagtcctacctgatcatgggcctgctggtgttctgcaccacctttatttccatcttcttgttgcgctccggcaaatcctccgccgatccgctggtgtcgcaacctaccgctatctga

SEQ ID NO: 4841 - DNA, 708 bp, Klebsiella pneumoniae
ggagtacacgtaaatatgaacattatcaatcttgaccagcttatctcgatgacctcaaaagaaatcgcggagttgacgggtaagcgacacgacaacgttattcgcgatgttcgtaagatgcttgatgaaatatatccggacgggggtctcctcagttttgaggacacctacgttaatacccagaatggcgaaacatatagcatgtaccgactcgaccggaagcatacctttattctggtcgctgggtattccgtccaactccgcgctaaatgctacgaccacattcagatgcttgaacaaaaagtcctccgattggaagaccagcagaaacgcgcagccgtacagtcggctaaccgccgtggtgtaacatggggcgattactgcaagacgcatggtctacctgctcagaagttgatgaacatcctcaagcgggaacgcaagctctttcaggtccaccccgtcagtggtgaatggtcagtcaatccaaaatatgcggaatacttccgggtcatcaagccaactgaccagcgattcaacccgagcggcattaacattcggttcaacgccaagggactggaattctttggtcaacctgagcatgtcctaaagatgcgcggaaaggttatcgaaattcacggtacagacgccgagaagcagaagcacctacaggatgtcgctagcatatcttctcaaaatgagggtctgtaa

SEQ ID NO: 4842 - DNA, 1743 bp, Klebsiella pneumoniae
ctgattcgcgtgaaacaacagatacaactacgccgccgcgaggcggttgacggcgtcgaactccccgccgacctgccgccgctgctgcagcggctatatgccagccgcggggtgcgcagcgcgcaggagctggagcgcagcgtcaaaggcatgctcccctggacgcagctcaccggcgttgaaaaagcggtcgagatgctgcatgacgcgttccagaaagggttgcacatcgtggtggtcggtgattttgacgccgacggcgccaccagcaccgcgctcagcgtgttggccctgcgcgcgctgggttacggcaacgtctcctatctggtgccgaaccgctttgaagacggctacggtttaagcccggaagtggtcgatcaggcccatgctcgcggcgcgcagatgatcatgaccgtcgacaacgggatctcgtcccatgccggcgtcgatcatgcccatgcgctggggatcccggtgctggtgaccgatcaccatctgccgggcgagacgctgccggcggcggaagctatcgttaatcccaacctgcgcgattgcgacttcccgtcaaaatcactggccggggtgggggtggcgttttatctgatgctggcgctgcgcacttttctgcgtgataaaggctggttcgacgctcgcggcatccccgcgccgaaccttgccgagctgctggatctggtggcgctaggcaccgtcgcggacgtcgtgccgctggatgctaacaaccgtatcctcacctggcaggggttaagccgcattcgcgccggcaaatgtcggcccggtattaaggcgctgttggaaattgccaaccgcgatccgcaaaagctggcagccagcgacctcggtttcgccctcgggccgcgcctgaacgcggcgggacggctggacgacatgtcggtcggcgtcgcgctgctgctgtgcgacaacatcggcgaagcgcgggtgctggccaacgagctcgatgcgcttaatcagacgcgcaaagagattgagcaggggatgcaggcggaagcgctaacgctctgtcagcagctggagcgcagcgccgataccctgcccggcgggctggcgatgtaccatccgcaatggcatcagggggtagtcggcattctcgcctcgcggattaaggagcgcttccatcgcccggttatcgcttttgcgcctaccggcgacggcacgctgaaaggctccggccgttccattcaggggttgcatatgcgcgatgcgctggagcgccttgatacgctttatcccgggctaatcctgaagttcggcggccacgcgatggcggcgggcttatcgctggaggaggcgcgttttgaagagtttcaacagcgcttcggcgagctggtgaccgaatggctggatcctgcgctgttgcagggcgaggtggtttccgatggcccgctggcggcggcggagatgagcatggaagtggcgcagatgctgcgcgacgccgggccgtgggggcagatgttcccggaaccgctgtttgacggtcgttttcgcctgctgcagcagcggctggtgggcgagcgtcacctgaaggtgatggtcgaaccggttgacggcgggccgctgctggacggtatcgccttcaacgttgatacttccatctggccggataacggcgtgcgtgaagtccagttagcctacaagctcgacatcaacgagttccgcggcaaccgtagcctgcagctgatcatcgatcacctctggccaaattga

SEQ ID NO: 4843 - DNA, 705 bp, Klebsiella pneumoniae
gcgctgagcgtattctccgccaggttgcgctccagccaaagggcatcgagaaactgttcgattagtgccagatcctgtttcacatcggcctctttgttcgttaaacgctctcattatgccttaagaggacgcctttctggtacactgcccgccattcacggcaagaatcgagatgtttacgcgatgaatataggtctgttttacggctccagtacctgctacaccgaaatggccgcggagaaaatccgcgatatcatcggccccgaactggtgacgctgcacaatctgaaagatgactcccccgcgctgatgagccagtacgacgtactgatccttggcatcccgacctgggatttcggcgaaattcaggaagactgggaagcggtctgggatcagctggacaccctgaacctcgagggaaagatcgtcgcgctgtacggcatgggcgatcagctgggctacggcgaatggttccttgacgcgctcggcatgctgcatgacaaactggcgaccaagggcgtgaagtttgtcggctactggccaaccgaaggctatgagttcaccagcccgaaaccggtgatcgccgatggccaactgttcgttggcctggcgctggatgaaaccaaccagtacgacctgagcgacgagcgcatccagagctggtgcgagcagatcctcggcgaaatggccgaacacttttcctga

SEQ ID NO: 4844 - DNA, 285 bp, Klebsiella pneumoniae; identical to SEQ ID NO: 2106

SEQ ID NO: 4845 - DNA, 579 bp, Klebsiella pneumoniae
acatcaggagtaacgttgggaatggctcatattcttgtcgtttccgggcatccggatcttaaccattccatcgccaacgccaccatcctcgatgagctggcgaccgccctgcctgatgcgcaaatccgtcgtctggactggctctatccggacggcaaattcaacatcgccgctgagcaggaaagcctgctgcaggcggatgtgattgtctggcagtttccctttagctggtatgggctgcccgggttaatgaaacagtggctggacgaggtatttgtccacggcttcgcccatggctcaacggcgaaactgggtggtaaaaagctgatcctctccttcaccacgggagcgccacaggcgctctataccgctgacggtttctttggccatgccattgaggagtatctccttcccttcgagaccacggccaggctgtgcaatcttgcgctgctggcgccggtttatacctgcggtattagctacgccgaccgggatgccgacaaaatcgctcagcaaaaaacgcttgcccgggaacacgcggccagactgatcgcgcggcttaatactctggtggaataa

SEQ ID NO: 4846 - DNA, 1095 bp, Klebsiella pneumoniae
ccggcggcggtccgacctattacacctacctgttctcactctatatctacgataccgcctttaagtacttcgacatgggctatggcgccgcgctgggcgtgggtgctgtcctcgtcgtggcggtctttgcgtcgatcgcctttaagtcatcgaaatactgggtcttctactccgccgataagggaggcaaaaatggctgatattcaacagatggcgccggtgatgagcgacgccgatcgtgaggtcgcccgtacgctacgccgggaaaaggtgagccgggtggtgcgctacgtcgtgctgatattcgtcggcctgctgatgctctacccgctggcgtggatgttctccgcctcgttcaagccgaaccatgagatcttcaccaccctcgggctgtggcctgcccacgccacctgggacgggtttatcaacggctggaagaccggcaccgaataccatttcggccactatatgctgaacacctttaagtatgtgatcccgaaagtggtgttaacgatcatttcctccaccatcgtggcgtacggcttcgcacgctttgagatcccgtggaagaagttctggttcgcaacgcttatcaccaccatgctgctgccgagcaccgtcctgctgatcccgcagtacctgatgttccgcgaaatggggatgctgaacagctatctgccgctgtacctgccgctggccttcgccacccagggattcttcgtcttcatgctgatccagtttctgcgcggcgtgccgcgcgatatggaagaggcggcgcagatcgacggctgcaactccatccaggtgctgtggtatgtggtggtgccgatcctcaagccggccattatctcggtggcgctgttccagtttatgtggtcgatgaacgactttatcggtccgctgatctacgtctacagcgtcgataagtatcccatcgcgctggcgctaaaaatgtctatcgacgtcacggaaggcgcgccgtggaacgaaattctggcaatggcgagcatctccattctgccgtccatcattgtcttcttcctggctcaacgctacttcgtgcagggcgtgaccagcagcggaatcaaaggttaa

SEQ ID NO: 4847 - DNA, 195 bp, Klebsiella pneumoniae
gcggtgcaggttagcaccaccagacaggccaggaggacaaaaagaatggctttgcgttgtcgcttaatcatgattgcctcaaatattcacgaggcttatcttaacgggcgaacgggttttggcaatggtaaagctgtaaagaagtgtctggcggataagcaattagccctcccccggccgggagagggcggttag

SEQ ID NO: 4848 - DNA, 783 bp, Klebsiella pneumoniae
cataaatttttatttgatacagacgaaattggtctgttcagttgtgtgatctgcatcgcagggacatttccactatcgatgttctataatgcgccacaggcattcacatctcggaccagaattatgacgcaggatgaactgaaaaaagcggtaggttgggcagcactgcaatatgtacagccagggactattgtcggcgtaggcaccggctcgacggcggcccattttattgacgcgctgggcaccatgaaggggcagatcgaaggggcggtttccagctccgacgcctccaccgagaagctgaaaagcctcgggatcaccgtcttcgatcttaacagcgtcgatcgcctggggatctatgttgacggcgcggatgagatcaacggccatatgcagatgatcaaaggcggcggcgcggcgctgacccgtgaaaagatcatcgcctcggtcgcggataaatttatctgcatcgccgacgcctccaagcaggtcgatattctgggcaagttcccgctgccggtggaagtcattccgatggcgcgcagcgccgtggcgcgtcagctggtcaagctgggcggccgtccagagtaccgtcagggcgtggtgaccgataacggcaatgtgatccttgacgtgcacggcctggaaattctcgatgcgatcgcgctggaaaacgcgatcaacggtattcctggcgtcgtcaccgtggggctgttcgccaaccgtggcgccgacgtggcgctgattggcactgccgacggcgtgaagaccatcgtaaaatag

SEQ ID NO: 4849 - DNA, 834 bp, Klebsiella pneumoniae
agtgaaacattgtttcatttaacttatcccactcttcatgaaaaagaaatacgcggccagagaagtggaaagttgatcacaagtttgcttcactggcagaaacgacataaggagcagaagatgaaaaccattggcctgttaggcggcatgagctgggagtccacgatcccctattatcggttgatcaatgagggcgttaaggcgcgactgggcggcctgcactctgccagcctggtgctgcacagcgtcgattttcacgacatcgaagcctgccagtccgccggcgactgggatcgcgccggggagatccttgctgaggccgcggtcgggctgcagcaggcgggggccgaaggcattgtcctgtgcaccaacactatgcataaagtcgcagatgtcatcgccgcccgctgccaggttcccttcctgcatattgccgatgccaccggacgggcgattgccgccaaaggtcagcgccgggtcgcgctgctgggcacccgctataccatggagcagaccttttaccgcggtcgtctgcaggagcagtttgccatcgagacgctgatccctgaggctgacgatcgggcgcagatcaatcagatcatcttcgacgaactttgtctcggcaccttcagcgaggcgtcgcgggattattatctgcagacgatcgccgccctggcggagcagggggcggaaggggttattttcggctgtacggagattggcctgctggtgcctgccgagctcagcccgctgccggtctttgacaccgcggcgatccacgcggaagacgcggtcaactttatgctctctgcaggaccgacgccagcggcgtga

SEQ ID NO: 4850 - DNA, 1077 bp, Klebsiella pneumoniae
aaaaccgcattcaggacctcacggagcgctccgacgttcttagggggtatctttgactacgatgccaagaaagagcgtctcgaagaagtaaacgccgagctggaacagccggacgtgtggaacgaacccgaacgcgcccaggcgctgggtaaagagcgttcttccctggaagccatcgtagataccctggatcagatgtcccaggggctggaagacgttgccggcctgctggatctggccgtggaagcggacgacgaagagacctttaacgaagccgtcgccgagctggataccctggaagagaagctggcgcagcttgagttccgccgcatgttctccggcgaatacgacagcgccgattgctaccttgacattcaggccggttccggcggcaccgaagcccaggactgggccagcatgctgatgcgcatgtacctgcgctgggcggaagcgcgcggctttaagaccgaaatcatcgaagaatccgaaggtgaagtcgcggggattaaatccgtgaccattaagatcattggcgattacgcctacggctggctgcgtacggaaaccggcgttcatcgtctggtacgtaagagcccgttcgattccggcggccgccgtcatacctccttcagctctgcgttcgtttacccggaagtggaagacgatatcgatatcgaaattaacccggccgacctgcgcattgacgtataccgcgcctccggcgccggtggtcagcacgttaaccgtacggaatccgcggtgcgtattacccatatcccgaccgggttggtgacgcagtgccagaacgaccgttcgcagcacaagaacaaagaccaggccatgaagcagatgaaagcaaagctttatgaactggagatgcagaagaaaaatgccgagaagcaggcgatggaagacaacaagtccgatatcggctggggcagccagatccgctcttacgtgctggatgactcgcgtattaaagatctgcgtaccggggtggaaacccgcaacactcaggcggtgctcgatggcagcctggaccaatttatcgaagcaagtttgaaagcagggttatga

SEQ ID NO: 4851 - DNA, 1284 bp, Klebsiella pneumoniae
gacgaactttcgttcagcacgacatcagttaagacaaaacaggacggggaaatggctaaggtatcactggaaaaagacaagattaaatttctgctggttgaaggtgtgcatcaaaaggcaatcgatagccttcgcgcagcgggttacaccaacattgaatttcataaaggcgcgctggattcagaacagctgaaagcgtcgatccgtgatgcccatttcatcggcctgcgttcccgtacccatctgactgaagagattttcgccgcagcggaaaaactggttgccgtcggttgcttctgcatcgggaccaaccaggtcgatctgaacgccgctgcgaagcgcggtattccggtgtttaacgcgccgttctctaacacccgctcggtggccgagttggtgatcggcgaactgctgctgatgctgcgcggcgtgccggaagccaacgccaaagcgcaccgcggggtgtggaacaagcaggcgatcggcagcttcgaagcgcgtggtaaaaagctgggcatcatcggttacggccacatcggtacccagcttggcattctggcggaatcgctgggaatgcacgtcttcttctatgatattgaaaacaaactgccgctcggcaacgccactcaggtacagcatctctccgacctgctgaacatgagcgatgtggtcagcctgcacgtgccggaaaacgcctctaccaaaaatatgatgggcgcggaagaactggcgctgatgaagccgggcgcgctgctgatcaacgcctcccgcggtaccgtggtggacattccggcgctatgcgatgcgctggccagtaagcatctggccggggcggctatcgacgtcttcccgactgaacctgcgaccaacagcgaccccttcacttcgccgctgtgcgagtttgataacgtgatcctcacaccgcatatcggtggctccactcaggaagcgcaggagaacatcggtctggaagtagctggcaagctggcgaaatactctgacaacgggtcaaccctgtcggcagttaacttcccggaagtttctctaccgctgcacggcggccgccgtctgctgcatatccatgagaaccggccgggcgtcctgaccgcaatcaaccaaatcttcgccgcgcagagcatcaacattgccgcccagtatctgcaaacgtcgccgcagatgggctacgtggtgattgatattgaagcggaagaagatgttgcccagcaggcgctgcaggcaatgaaagcgatcccggggactatccgcgcccgtctgctgttctaa

SEQ ID NO: 4852 - DNA, 228 bp, Klebsiella pneumoniae
tgcacaccttcaaccagcagaaatttaatcttgtctttttccagtgataccttagccatttccccgtcctgttttgtcttaactgatgtcgtgctgaacgaaagttcgtctcagcaacatatcaaaaaaaactatcgcggcaatatgaacgtttgcgtcgccgtcctgaagaaatgtcatccagagggaaatcgcaggacaaaacaccagaaagagaagaaatggtag

SEQ ID NO: 4853 - DNA, 1728 bp, Klebsiella pneumoniae
gaaataccttttcacccgttgccgcgcggcataaccttaaacatgtatatcaaatataactttaaaggtgtgaccatgttttgtgtgcaatgtgaacaaaccattcgtaccccagccggcaacggctgctcttacgcgcaggggatgtgcggtaaaacagcggaaacctcggacctgcaggatctgctgattgcgtcactgcaaggcctgtccgcctgggcgcttaaagcgcgcgaatatggcattatcgatcatcaggtcgacagctttgccccccgcgccttcttctccaccctgactaacgttaacttcgattccccgcgcatcgtcggctacgcccgccaggcaattgccttgcgtgaggcgctgaaagcgcaatgcctggcgatcgatgccagcgccgcggtcgacagcccggtcgccgacctgcagctggtcagcgacgatctgggcgacctgcagcgtcaggcggcggactataccccgaataaagataaagccgccatcggcgaaaatattctcggtctgcgcctgctgtgcctgtacggtctgaagggtgcggcggcctatatggagcacgcccacgtgctcggccagtacgacaacgctatctatgcccagtaccataaaatcatggcatggctgggcacctggcctgcggatatgaatgcgctgctcgaatgttcgatggaaatcggccagatgaacttcaaagtgatgagcatcctcgacgccggtgaaacgaccaaatacggccatccgacgccgactcaggtcaacgttaaagccaccgaagggaagtgcatcctgatctccggccacgatctgaaggatctgtataacctgctggagcagacggaaggcaccggcgtcaacgtctatactcatggcgaaatgctgccggctcacggctatccggagctgcgtaaattcaaacatctgattggcaactacggcagcggctggcaaaaccagcaggtggagttcgcccgcttcccgggccccatcgtgatgacctctaactgcatcatcgacccgaccgtcggcgcctacgacgatcgcatctggactcgcagcatcgtcggctggccgggtgtgaaccatctggaaggcgaagacttctccccggtcattgcccaggcgcagcagatggcgggcttcccgtacagcgaaatcccgcatctgatcaccgtcggctttggccgtcagaccctgcttggcgcggcggatacgctgatcgatctggtcagtcgtgaaaaactgcgccatatcttcctcgtcggcggctgcgacggcgcccgcggggagcgtaactacttcaccgatttcgccaccagcgtgccggatgactgcctgatcctgaccctggcctgtggtaaataccgcttcaacaaactggactttggcgatatcgaagggctgccgcgcctggtcgacgccgggcagtgtaatgacgcttactcggcgattattctggcggtcacgctggcggagaaactgggctgtggcgtcaacgatctgccactgtcgctggtgctctcctggttcgaacagaaagcgatcgtcatcctgctgacgctgctgtcgctgggtgtgaaaaacatcgtcaccggtccgacggcgccaggtttcttcacaccggatctgctggcggtcctcaatgagaagtttggtctgcgttccgtgaccaccgtggaacaagatatgcagcagctgcttagcgcttaa

SEQ ID NO: 4854 - DNA, 924 bp, Klebsiella pneumoniae
ttgccacctttcaggatgccggggatccgcacccgacgacggttggcggtaactttctttactaacgaggagggggtgcgatttcagcccgatatgatgggcagcgtggtgtttgccggcgagtatccgttggcgcaggcgctcgcggcaaaagatctcgacggtatcacgctcgatgaagcgctgcgtaacattggttataaaggcgaacgtcagccgggagatatggcggtagatagctacgttgagctgcatatcgaacagggaccaattcttgataaagagcagattgatattggcgtggttaccggcgtacagggtatttcgtggcaggaatttaccctgagaggcgtatcgaatcatgcgggtactaccccaatgtccatgagacgtgatgccgggctggcggctgcgaaaatcgctgtttttgcccgtgagctggcgctaagccttggtggtaatcaggtagctaccgttggacatttcagcgtgaagcctaatctgatcaacgtcattcccaaccatgtcgtcatgtcagtggatctccgcaataccgataatgcgatcttatgtctggcggagcagcaattggccgaatttgtcgcgaaaacgtcgcaggaagagggcgtggagataaccagccgctcactggtgcgctttaatccggtcatctttgccgatgagatcgtcaatgcggtggaagccgaggcggagcgtcaggcgctcagttaccgacgtttgccaagcggcgccggacacgatgcacaatttatggcgtcggtatgtcccgccgggatgatttttgtcccctgcgtcgatggcattagccataacgtcaaagaacatagcgcagccaaagatctgattgctggcgccaatgtgctgctgcaggtagttttacagcgcgcccagcgtatggactaa

SEQ ID NO: 4855 - DNA, 672 bp, Klebsiella pneumoniae
cgcgaacgctctcctttgccgggcaacatctcggtcgtggcgagcgatagcgagctgatcctggcatcgcgcaaagcggaaaaagtatataacgattcattgactgtagacctgattatcatggacaaatttgacgctaatcgccgcagattgctggcgttgggtggcgctgcgctgggtgctgccgccattctccctgcgccggcatttgccaccctctcgaccccccgtccgcgtattttgacgctgaataacctgcataccggtgaatcgctcagggcggagtttttcgatggcagaggctatattcaggatgaattagcaagacttaaccattttttccgtgactatcgcgcgaataaaattaagtccatcgatccaaatctgttcgatcatctttatcggttgcagggactacttggcaccaacaaacctgtccagcttatctctggctatcgttccctcgataccaacgatgagcttcgcgcacgaagccgtggtgtagcgaaacacagctatcacaccaaggggcaggcgatggatttccatattgaaggtatttcgttaagcaatattcgcaaagcggcgttatctatgcgcgcaggtggtgtaggatattacccacgtagtaactttgtgcatattgataccggtcccgtaaggcactggtaa

SEQ ID NO: 4856 - DNA, 1494 bp, Klebsiella pneumoniae
gcgaggtggtcgcccactggcaggcttttttacaacgctaaggagtcaggcgtgtcgcaatcagttctggtgctcggcgccagcggctatattggccagcatttagtgcgcgagttaagcgcgcggggctatccggtgctggcggcggcacgccatatcgaccgattgcaaaaactcgctttgcccggcgttacctgccggtcagtcgatctcaatcaaccgcaggacctgcctgcgctactcaccggtattgataccctttattatctggtccacggcatgggcgaaggcggtgattttatcgcccatgagcggcgggtggcgacgtatgtgcgcgatgccctgcgtcagtcatcagtgcgccaggtgatatttctcagttcgctgcaggccccggcgcaggagcaatccgaccatctgcgcgctcgtcagattaccggcgatctcctgcgtgagtcgggcgtgccggtgaccgagctgcgggccgggattatcgtcggcgccggctccgccgccttcgaggtgatgcgcgacatggtttataacctgccggtgctaacccctccgcgctgggtacgttcgcgtactacccctgtcgtgctggaaaacctgctcgttgacctggttgagctgctgaatcatccctccgatgcgcaccgcgtcttcgaagccgccggtccggaggtgttaagctatcagcagcagttcattcgctttatggccgtcagcggtaaacatcgcccgctcattcccattcccctgccgacgcgctggatctcggtgtggttcctcaatgtcatcacctcggtgccgccgaccatcgccaaggcgctgattcaggggctgaagcacgatctaatcgctgacgatcgggcgctgcgggcgctgatcccgcaaacgctgatccccttcgatcaggcggttcgccgcacgctgaaagaagaagagcagttagtaaactccagcgactggggctacgacgctcaggctttcgcccgctggcgaccagagtacggctactatccgaagcaggcaggttgcaccgtcgccactcaggcaagccgccaggccctgtggcaggtcgttaaccaaatcggcggtgaagaggagtattttttcggcaatctgctgtggaaaacccgcggcgcgatggatctgctggtcggccaccggctggccaaagggcggccgcagcgcgcttatctgcaaaccggcgatacggtcgacagctggaaggtaattatcgtggaggaagaaaaacagctcaccctgctattcggtatgaaagcgcccgggctgggccgattaagctttaccattaacgataaaggcgatcgtcgtgaactggacgtgcgcgcctggtggcacccgcacggtatgccaggcctgatctactggctgctgatgatcccggcgcacctgtttattttccgcggtatggcgcaacgcatcgcccggctggccgaacaaatctcaggcagagtcgaaggataa

SEQ ID NO: 4857 - DNA, 588 bp, Klebsiella pneumoniae
tcggacttgttcagcttacacgtgttagctatcctgcgtcccgaacttaaaataaggcttactgaaaacatggtagataaacgcgaatcctatacaaaagaagatcttcttgcctctggtcgtggtgaactgttcggcgcgaaaggcccgcagttaccggcaccaaacatgctgatgatggaccgcgtcatcaaaatgaccgaaaccggtggtaactacgataaaggttatgttgaggcagaactcgacatcaatcctgacctgtggttcttcggttgccactttatcggcgatccggtgatgccgggctgcctgggcctggatgctatgtggcagctggtcgggttctatcttggctggctgggcggcgaaggcaaaggccgcgcgctgggcgttggcgaagtgaaattcaccggtcaggttctgccgaccgcgaaaaaagtcacctaccgcatccacttcaagcgcattgttaaccgtcgtctgattatgggacttgcggatggtgaagtgctggttgacgatcgtctgatctacaccgcgaacgatctgaaagtgggtctgttccaggatacttccgctttctga

SEQ ID NO: 4858 - DNA, 525 bp, Klebsiella pneumoniae
ccgattactcctgattttttgctggttttattcctctccggctgcgcatactctggaagtacacaggatgcaaaaaaggatgcacatcaaatggttaaaggattgttaaacacagtaaatcgcaggctgtcgcatgatgacgccggtaaactcttgttacgacttgccgtcggcggcttaatgcttttccatggaatccataagctgatagatggtgtggatggcattagcgggatgctggcggcgcagggattgcccgggtttatcgcctacggtgtgctggtgggggaagtggtcgctccctgcttgttaattctcggcgtcctgacccgcccggcggcgttggtgctggcgttcaccatggtggtggcgtggctgatggtcggcttagataagacgtttgcgcttgatacggtgggagcgtgggccattgagaatctggtctatttctttgttggcgcactggcgattgcgctactcggcgcggggcgttattcgctggccggtcagtcggcctggcggtaa

SEQ ID NO: 4859 - DNA, 1275 bp, Klebsiella pneumoniae
aggtatactccgcctccattttccgcgttggtttcgatggaacgctccagtgagaggatgctactgcgcaccatgacacaattcacttctcctgtactgcactcgctgcttgatacggatgcctataagctgcacatgcagcaggctgtcttccaccgctacggcgatgtgcatgtagcggcggagtttcgctgccgcggagacgacctgctcggcatctatgccgacgcgatccgcgagcaggtggagtccatgcgcgacctgaggctgcgggatgatgaatatcgctggctgtccacccttcccttttttcgccaggattacctcaactggctgcgcgattttcgctatgacccgagccaggtcacggtcagcaatgacaatggtaagctgaacattcgccttaccggcccatggcgggaagccatcatgtgggaagtcccgctgctggcggtgataagcgagttggtccatcgctatcgttcaccagagatgggcgtcgatcaggcgctcaacacgctggaacataagctaggcgacttcgccaccatgaccgctgacctcgacatgagcgccttccgtctgatggacttcggcacccgccgtcgtttctcacgcgaggtgcaggaaggtattgtgcggcgtctgcagcaggaaccatggtttgtcggcaccagcaattacgatctggcgcgccgtctgaatttaaccccgatgggtacccaggcccatgagtggttccaggcccaccagcagatcagccccagccttgccagcagccagcgggcggcccttgccgcctggctggaagagtatcccgaccagctgggcatcgcgctgaccgactgcatcactatggatgcgttcctgcgcgattttggtccggaattcgccacccgctatcaggggttgcgccacgattccggcgacccggtggaatggggagaaaaagctatcgcccattatcagaagctgggtatcgatccgctgagcaaagtgctggtcttctccgataatctcgacctggcgaaagccgtcgatctgtatcgccacttcgcctcgcgggtgaagctcagctttgggatcggcacccgtttaacctgcgatctgccgcaggttaaaccgctcaatatcgtgattaagctggtggaatgtaacggcaagccggtggcgaaactctcccgacagcccgggaaaaccatctgccacgataaggccttcgtccgcgccctgcgcgaagcgttcgacctgccgccgattaaaaaggcaagctaa

SEQ ID NO: 4860 - DNA, 1464 bp, Klebsiella pneumoniae
catagatatccccccgctgttgggggaagagacttttttattggactacatagagagattattatgagcgttgtgcctgtagccgacgtactccagggccgcgttgccgttgacagcgaagtcacggtccgcggatgggtgcgtacccgccgagattctaaagctggcttttctttcctcgccgtctatgacggttcctgctttgatcctgtacaggccgttattaataattctctgcccaattacaatcaggaagtgctgcgtctgaccaccggctgctcggtgattgtcaccggtaaagtcgtggcttctcagggtcagggtcaaagctttgagatccaggcgaccagcgtggaagtgaccggctgggtggaagacccggacacctacccgatggcggccaagcgccacagcatcgagtatctgcgtgaagtagcgcacctgcgtccgcgcaccaacctgattggcgcggtagcccgcgtgcgtcacaccctggcgcaggcgctgcaccgcttcttcaacgaacagggcttcttctgggtttccaccccgctgatcaccgcctccgataccgaaggcgccggcgaaatgttccgcgtgtcgacgctggatctggaaaacctgccgcgtaacgatcagggcaaagtcgatttcgacaaagacttcttcggtaaagagtcgttcctgaccgtttccgggcagctgaacggcgaaacctacgcctgtgcgctgtcgaagatttataccttcggcccgaccttccgcgccgagaactccaacaccagccgccacctggcggaattctggatgctggagccggaagtggccttcgccaacctgaacgacgttgccggcctggcggaagcgatgctcaagtacgtcttcaaagcggtactggaagagcgtgcggacgacatgcagttcttcgccgagcgcgtggataaagacgctatcgaccgtctgcagcgctttatcaccgctgattttgcccaggtggattacaccgacgccgtcaccattctggaaaactgcggcaaacagttcgagaacccggtgtactggggcgtggatctctcctctgagcacgaacgttacctggccgaagagcacttcaaagcgccggtggtggtgaaaaactacccgaaagacattaaagcgttctatatgcgccttaacgaagacggtaaaaccgtcgcggcaatggacgttctggcgccgggcatcggcgagattatcggcggttcccagcgtgaagagcgtctcgacgtgcttgacgcgcgtatggcagagatgggtcttaacaaagaagactactggtggtatcgcgacctgcgtcgctacggcaccgtgccgcattccggcttcggtctgggcttcgaacgcctcatcgcttacgtgaccggcgtgcagaacgtccgcgatgttattccgttcccgcggacgccgcgcaacgcgacattctaa

SEQ ID NO: 4861 - DNA, 1704 bp, Klebsiella pneumoniae
catttgatccccgtttactgtgggatcgtgagccagattcaagccatgaggaaatacaacaacatggaaaataagagcggagaagcgaaagtgcagaaggtgaagaactggtcaccggtgtggatcttccctatcgtcactgcgctaatcggggcatggatcctgttttatcattacagccatcaggggcctgaggtcacgctgatcaccaccaatgcggaagggattgaagggggaaaaacccggatcaagagccgcagcgtagacgttggggtggtggagagcgcgacgctgaccgacgatctcacccacgtggaaatcaaagcccgcctcaattccgggatgcagaagctgctgcacaacgattccgtcttctgggtggtaaaaccgcaggttgggcgcgaggggatcagcggtcttgggacattgttgtccggggcctatattgaactgcagccgggaacgaaaggttcggtgccagctcagtatccgctactggattctccgccgctggcctcgccggatgccaaggggatccgtattctgctggaaagcagcaaggcgggccagctgtcgccgggcgatccggtgttgttccgcggctatcgcgtggggtcagtggaaaccagcaccttcgacacgcagaaacgtcgtataacttaccagctgttcatcaatgcgccgaacgatcgcctggtgaccaccaacgttcgtttctggaaagacagcgggatcgctgtagatttgacctcggcggggatgcgcgtcgagatgggctcgctgtcgacgctgtttggcggcggggtgagcttcgatattcctgaaggactggacctcggcgagccggtggcgaataaaacggaataccatctgtttgacgatcagaagagcatccaggattcagtctttaccgagcatatcgattacgtcatgttcttcaaagactcggttcgcggcctgcagccgggcgcgccggtggagttccgcggtatccgtctgggcaccgtcggcaaagtgccgttctttattccggggctgaagcagcgtttgaacgatgactatcgtattccagtggaagtgcgggttgaaccgcaacggctgattaatcagcttggcggcgatccgaatattcgcgcccacattgacgatctgatcaaccgcggactgcgcggctcgctgaaaaccggtaacctggtgaccggcgcgctgtatatcgatctcgacttctatccgaaggcgcccccgcgcgggaaaatacaggagtttaacggctatccgattatcccgaccatcagcggtggactggcacagatccagcagcgtctgatggatgcgctggataagattaataacctgccgattaatccgctgctggagcaggcgaccagcaccctggcgcagagcgagaagacgatgcagcacgtgcagaccacgctggataatctgaataagatcacctccagccagtcaatgcagcagctgcccgccgatatgcagacgacgctgcgtgagctgaaccgtagcatgcagggcttccagccgggctctgcggcctacaataagatggtggccgatatgcagcgtctggatcaggtgctgcgtgagctgcagccggttctgaaaacgctaaatgataagagcaatgcgctggtatttgaggcgaaggataaaaaagatccacagccgaagggagcgaaacaatga

SEQ ID NO: 4862 - DNA, 1194 bp, Klebsiella pneumoniae
tatccgggcccgcatctggcagcccaccgccacacaaggagcgaaatcatgagtctgaatatgttctggtttttaccgacccatggtgatggtcgttatctgggtaccgaagagggtgcccgtccggtcgattatggctatctgcagcaaatcgcgcagacggcggatcggctgggcttcaccggcgtgctgatcccgaccggacgctcttgtgaggatgcgtggctggtcgcggcctcaatgatcccggtgacgcagcggctgaagttccttgtcgccctcaggccaagcgtggtatcgccgacggtggccgcgcgtcaggcggcgaccctggaccggctgtcaaacggccgggcgctgttcaatctggtcaccggcagcgatcctgccgaactggcaggcgacggcgtcttcctcgaccacaccgagcgctatgaggcctcggctgaatttacccacatctggcgcaagctgatggagggagaaaccgtcacctttaacggcaagcatcagcgcgttcgcgacgccaaactgctgtttccgccactgcagcagccgcgtccaccgctctatttcggcggctcgtctgaggtggcgcaggagctggccgctgagcaggtcgatctttatcttacctggggagaaccgccggcccaggtggcagagaaaatagctcaggtgcgagagaaagccgcccggcatggtcgccaggtgcgttttggcatccgtctgcacgtgatcgtcagggaaaccaacgaggaagcgtggcaggcggcggacagccttatctcccatcttgacgacgagacgatcgcccgcgcccaggcggctttcgccagaaccgactccgtcggccagcaaaggatggcggccctgcacaacgggcgacgcgataagctggaaatcagccccaacctgtgggctggcgtgggtttagcgcgcggcggcgccgggaccgcgctggtgggcgatgccgccaccgttgccgaacggatcaatgaatacgccgcgctgggtatcgatagctttatcttttccggctatccgcatctggaagaggcgtaccgggtcggagagctgctgttccccctgcttgacgtcgcggtgccgtccatcccgcagccgcaaaacctgcgcgtgcagggggaagcggtcgccaacgagtttattccgcgtaaagtagcgcaaagctga

SEQ ID NO: 4863 - DNA, 567 bp, Klebsiella pneumoniae
tcgccgccaccaactggtaagcctgttcaaactggctgtgcgcggtttgcgccacgcttattttctgttccagcgacagcattttctccgtcgcttcctgctctttcgcctggaaggtttccagccactcgtcggcgctctccggggtcagatccggcagatggcacagcgccttcgcgcgctccagcgcctgcagcgcctggttatactgaatggcgcgggtctgctgcacatcgagcgcctgctgatagtcggcgagctggcttttcagctcatccacttccagctcggcggcctcagcgcgggcttcgttctcttcctgacgatcgacggcttccgccaccacttcattctgctcttccagacggatctgcagctcgtcgagatccgcttcgtagcgctcgattttttcctgctgacgcagcgcagtctgcaccaggttcaggtgatcgctggcggcctggtaatcggcttccagatcgccctccgcgccgttatgctcctgcagttcgcgcgccatgtcgacgtgcttatactgctcagccgccagctgcgaacgcgaggtga

SEQ ID NO: 4864 - DNA, 1293 bp, Klebsiella pneumoniae
ccgatgaatactgaaaatataattatcaataaaggatattccgatcccgcaaagtggcatagcgaagataccgtttgggtccttggcctgttcggtaccgccattggcgccggggtgctgtttctgccgattaatgccggaattggcggcttctggccgctgctgattgtttttgtcctcgcttttcctattacttatctggctcaccgcggtctggcgagattcatttactcttccaatacgccggaaagcagtattaccgatgttattggcgagcattttggcgcgctggcgggaaaagtatttaccgtcatctatttcttcgccgtctataccattctgattatgtatgcggtggctatcaccaacaccgcgcagagctttatcacccaccagttggcaatggccgagcctccccggtcgctggtggccatcgttctgatcctcgggctgatgtttatcgtccgtttcggacagcgtttgataatgcgggtgatgagcaccctggtttatcccttcatcatctcgcttatttttatggcactttttctgattccgcactggaacggcgcaattttgcaaaccgtaagcttcagcgccacgggcgatgggcaggggatcatgttatccctgtggatgaccttcccggtactggtgatgtcgtttaaccactatcccatcatttcgccgatggtggtgcgccagaagcagcgttacggtctggcgctcgctgagggtaaatgtgcgcagatccagcgctacggtatcctgctcatgacggtggtggtgctgttttttgttctcagctgcgtgttaagcctgtcgccgcagcaactggcggaagccaaagcccagaatctgtcgattttgtcctatctggccaatcagtacgatacaccgattattgcctggctatcgccgattatcgcctttgtcgctattactaaatcatttcttggccactacatcggcgcctatgaatcgctgcgcgacctgattctggaggccgccgccgcacgcgggaaaaaacctggtattcgcctcgtcgacgcggtcatcctggtgtttatggtgcttacctgctggttcgccgcgtacaagaaccccagtatcctcggtattatcgaatgcatcagcggtcccaccggggcggcaattctgctgctgttgcctatgtacgccattcataaattaccggtgcttgccccctggcgcggtaaagcgagcaacgttttcgtcaccctgatcggtcttatcaccgtatctgccattttttacggcatgttccaataa

SEQ ID NO: 4865 - DNA, 1863 bp, Klebsiella pneumoniae
cagcgattcacgctcggcatgcagggtttcaatgcggttttcacgtgccgcgcggccaaacagcggcagcgacgggaagcgcgaataacgccactggcgatcggcaatcttcaccaccaccgctttttccagctcgtcgacgctgaatacgctgtcgtcaaaggattgcggatcgccttcgatcagatagagatcttccgggcaatcttccagtccctcaagctgctcggctacccgcgacagatccggtaccacgatcgcatggcgcgacggaccgtacagcgcggagaagtacggcgcatcgtccaggctaacatcatcgtagatctcggacagcagaacgccgccgaaccgttccgccagggcgttgaggcgcggatcttccgaaccgcccggctggctgagacgctcgatttcttcgtcgatggcgcgcttgcgggcgccgacctcgtcacgttcaacgatagcctctcgttcacgctccagcagctgctgcaggtattcggtgacctcctggccggactcaaactgctcgccgctttgctcgcacagctggttaaggctgttctgcgccgccagccagaccggcgcccggcgcatcagcgtctgggtacgcgactgcagttgctccagctcctgacgcagcgccatgcgctgctcctgagcattggagacgctgtcggccagcgacgcgatgcgcgcttccagctcctgatgcagcgtttccagatcgtcgatatcgtaacgtttaccctggcgtttgcagaactcggccagctgacgctcagcgtcctgctgctcgcgcaggcgctgttcaagctcgttgaggcggctgcgcagcccctgcgcctgctcggcctggtggcgctggttcacgccgtcgcgcagcaattcgcgcgccacgtcccaggcttcattgcgcgccagcgggccgttaatcgccgccaccaactggtaagcctgttcaaactggctgtgcgcggtttgcgccacgcttattttctgttccagcgacagcattttctccgtcgcttcctgctctttcgcctggaaggtttccagccactcgtcggcgctctccggggtcagatccggcagatggcacagcgccttcgcgcgctccagcgcctgcagcgcctggttatactgaatggcgcgggtctgctgcacatcgagcgcctgctgatagtcggcgagctggcttttcagctcatccacttccagctcggcggcctcagcgcgggcttcgttctcttcctgacgatcgacggcttccgccaccacttcattctgctcttccagacggatctgcagctcgtcgagatccgcttcgtagcgctcgattttttcctgctgacgcagcgcagtctgcaccaggttcaggtgatcgctggcggcctggtaatcggcttccagatcgccctccgcgccgttatgctcctgcagttcgcgcgccatgtcgacgtgcttatactgctcagccgccagctgcgaacgcgaggtgaagagatcgcggcgatactccagcgccttatccaggtgaatgcgcctctcgttggcgtgacgcatatagtccgccgccacgtagttggtggcttcgctgatcaggtgtttaaacagatcgcggtcggactgggtaacgcgaatggcttccagcgtcatgcggttttcccgcagcgccgcttccatatcctggaacgctttacgcacgccgctgttttccggcaacaggtagtcgcgcagcgagcgggtaatggtgctggagatcccgccgtacagcgaggcctcaatcaggcggtagtacttgctacgatcggaggcggaacgcaggcgacgcgccaccacgcccagatcgaacattag

SEQ ID NO: 4866 - DNA, 594 bp, Klebsiella pneumoniae
aaaagatccacagccgaagggagcgaaacaatgaaaaaatggttactggcggcagccgtatgcgtactgacggcgtgcagtagcggcggggaaagcaagacatactatcagctaccggttgtgcagggcggcgcgcagagcgccgccagtcagggggcacgtttgctgtgggtagagcaggtcagcatcccggattatctggcgggtaacggggtggtctatcagaccaccgacgtgcagtatgtgatcgccaataataatctgtgggccagtccgctggatcagcagctgcgcactacgctggtggcaaatctcagccagcagttgcccggctgggtagtgtcgtcccagccgctggggagcgagcaggataccctcaacgttgcggtcaatggctttcatggtcgctatgacgggcgggttatcgttagcggtgagtggctgctgaagcatcagggacagctgattaagcgcccgtttaacatcgtcctcaggcaggaacaggatggttatgacgcgatggtcaagaccctggcgcaggcgtggagccaggaggcggctgccattgccagcgagcttaatcgtctgccataa

SEQ ID NO: 4867 - DNA, 777 bp, Klebsiella pneumoniae
cgcatgaacactgcccgtctcaacccaggtatcccgctgctgctgaacggggtgacgaaacgctatggcgacaacaccattcttaacgagctggatctgcatattcccagcggccagtttgtggcggtggtgggtcgcagcggcggcggcaaaagtaccctgttgcgcctgctggcaggtctggaaaaaccaaacgccggcgagctgctggcgggcgcgacgcccctggcggcgatccaggacgacacccggatgatgtttcaggatgcgcgcctgctgccgtggaaaacagtgattgataacgtggggctggggctaaaaggcgcctggcgcgacgccgccctgcaggcgttggccagcgtcggacttgaaagccgcgcacaggagtggccggccgcgctgtcgggtgggcagaagcagcgcgttgcgctggcccgcgccctgatccatcgcccgcgcctgctgctgctggacgaaccgctgggggcgctggatgccctcacccgtctggagatgcaagagctgatcgtctccctgtggcaggagcatggctttacggtcctgctggtcacgcacgacgtcagtgaagcggtggccatggccgatcgggtgctgttaattgaagagaagaagattggcctcgatttaagcgtggatatcccgcgaccgcggcgcaccggttcggcgaagctggccgagctggaggctgaagtactggatcgggtgatgaaacgcggcgacagcgagcgtgcgccgcgtttgtttagtcatggctga

SEQ ID NO: 4868 - DNA, 1215 bp, Klebsiella pneumoniae
atagtggacacaattaaatatcaacttaacgcccggcggcagccctatggccagggagcagacttgagtctgctgaatgaaagcgtggggaacgaagtgctggcattccatcaaaaatttcctgattaccgggtcacgccgctgcgtaagctggaatttttaagccagcggctggggctgggatcgatccatataaaagatgaagcgcagcgattcggtttgaatgcgtttaaaggattaggcggatcttatgcgatggggaaatatctcgccgctctgcttgagcgagatattaatacgttgagctttgccgagcttaattcaccagtgattaaggcgcgtatcaaggacatcgtatttgtgactgctaccgacggtaaccacggacgtggcgtggcgtgggcggctgagcagcttgggctgcgtgcggtggtgtatatgccaaagggctcgtcgccggtacgcgcgcagaatattcgccggcatggcgccgaatgcacgattactgaactgaactacgacgacacagttcggctggcggccaaaaccgcgcgcgagcagggatgggttctactccaggataccgcctggcagggctacgagcagatccccacatggatcatgcaaggctatatgaccctcgctgttgaaatctggcagcagctggcagaaagcggagcgccgatgccgacgcatctgtttttacaagccggggtcgggtcgtttgccggtagcatcatgggatatttcatcgaaaagatgcagcagcaggctcccaccatcatcatcgttgagccgcacaaggcgaactgcctgtatcgctcggcaaccattaatgacggactgccgcacagcgtcggcggggatatgtcaactctgatggccgggcttgcctgtggtgaacctaacatcaccagctggccaatgctccgcgaccatgccacctgttttatttccgccgacgattgtctggccgccaatggcatgcgcctgttggccgctccgcgaccaggtactgacgaaccttttgtctccggggaatccggcgctattggcacaggagtgctttatgcgctgatgactcaaccggcgtatcgcgagcttgccgaatcgctgcgcctgaatgccgatgcacaggttctgttaatcagcacggaaggagatacatcacccgatgtctatgaagacatcgtctggtttggccgtaatggttga

SEQ ID NO: 4869 - DNA, 621 bp, Klebsiella pneumoniae
ccgatgacaactcagtatggattttttattgattccgcccgttgcaccggttgcaaaacctgcgaactggcctgtaaggactacaagaacctgaccccggaggtcagcttccgccgcatctatgaatatgccggcggcgactggcaggaggacaacggcgtctggcagcagaacgtgtttgcctattacctctccatcgcctgtaaccactgtgaagatccggcctgcaccaaggtctgtccgagcggcgcgatgcataagcgcgaagacggttttgtggtggtcaacgaagaggtatgcattggctgccgctactgccatatggcctgcccgtacggcgccccacagtacaacgccgacaaaggccatatgaccaagtgcgatggctgtcacgagcgcgtcgccgaggggaaaaagccgatctgcgtcgagtcctgcccgctgcgggcgttggatttcgggccgattgccgaactgcgcgctaagcacggccagctggccgcggtagcgccgctgccgtcggcgcactttacccggccgagtatcgttatcaaacctaacgccaatgcccggccgtgtggcgataccaccggttacctggcgaacccgaaggaggtgtga

SEQ ID NO: 4870 - DNA, 1077 bp, Klebsiella pneumoniae
ggtcatcgaactggcgaaaaccaactggctcaggtaaaacagaagcaatacgttgaaccagaccaaggaaaagccgtgatcgatttacgcagtgataccgttacccgtcccgggcgcgccatgctggaggccatgatggccgccccggtcggggacgatgtgtatggcgacgaccctaccgtcaatgaactgcagcgctatgccgccgacctggccggcaaagaagcggcgctatttctacccaccggcacccaggccaacctcgttggcctgctcagccattgccagcgcggcgaagagtatatcgtcggccagggggcgcataactatctgtacgaagccggcggcgcggcggtcctcggcagtattcagccgcagccgatcgacgccgcggcggatggttcgctgccgctggataaagtggcggcgaaaatcaaacccgacgatatccattttgcccccacccgcctgctgagcctggaaaacacccataacggtaaggtggtgccgcgcgactatctgcaggaagcctgggcgtttacccgccagcgcaatctggcgctgcacgtcgacggcgcacgcatctttaacgccgtggtggcctacggctgcgagttacgcgatatcgcccaatactgcgactccttcaccatctgcctgtcaaaggggcttggcgctccggtaggctcgttgctgctcggcagcgaggcgtacattcgccgcgccgtccgctggcggaaaatggtcggcggcgggatgcgccaggcgggcatcctggccgccgccgggctgtacgcgctgaaaaataacgtgcagcgcctgcaggaggatcatgacaacgccgcgtggatggcggagcagctgcgcgctatcggcgccgacgtcacccgtcacgataccaacatgctgttcgttcgcgtcggcgaagagcaggccccggcgctcggcaagtttatgcaggcgcagggggtattgattaacgcctcgcctgttgtccgtctggtcactcacctggatgtcaaccgtcagcagctgagcgaggtggtcgcccactggcaggcttttttacaacgctaa

SEQ ID NO: 4871 - DNA, 297 bp, Klebsiella pneumoniae; identical to SEQ ID NO: 2022

SEQ ID NO: 4872 - DNA, 321 bp, Klebsiella pneumoniae
ctaatttttgccttgaaggaaaccggaggaataatgaccaagtcagaattgattgaaagacttgccagccagcaatctcacattccggcgaaagcggtggaagatgctgttaaagaaatgctggaacatatggcctcaacgcttgctcaaggtgagcgcattgaaatccgcggtttcggcagcttttctctgcactatcgagcacctcgcaccggacgtaacccgaaaactggtgataaagtcgaactggaaggtaagtacgttccgcactttaagcccgggaaagaattacgtgaccgcgccaatatttatgaagggtga

SEQ ID NO: 4873 - DNA, 207 bp, Klebsiella pneumoniae
cgcatcgttgctcagaatggtggcgaccacggaggcgccatgcgcaggcgggttcgagtagttggcgcggatcaccgacttcatctgactgaaggcgcggtctacagtctcctgatccgcggcgaccagagtgcaggcgccgacgcgctcgttgtacaggccaaagtttttcgagtaggagctggcgaccagcagctctttatgtag

SEQ ID NO: 4874 - DNA, 363 bp, Klebsiella pneumoniae
ccagcaggtgctgctggagcaactggaacaacagggcattcgcgtaccctattcgtgtcgggcggggatctgcggcagctgccgcatccggctggaagagggagaagtgagtccgttaaagaaaaacgcggttgccggagatgggactattctcgcctgcagctgtgtaccgaaaacagcgctacgcctggcgccttaaaccgcctgccccagactgtagctgaccgcgctctgcgccggctgcagtctgtcattcatgatttttatgacatcgcccagctgcatgacgcggccggcaagggtgagacccggctgagccaacagacagagcgcggcgttatcgcccggctccaccaccagtaa

SEQ ID NO: 4875 - DNA, 894 bp, Klebsiella pneumoniae
tatctcaccgccaacttatataaagagagagttagtgtgaaagctgacaacccttttgatcttttgctccctgccgcgatggcgaaagtcgccgaagaagcaggtgtctataaagcaacgaagcatccgatgaagacgttttatctggcgatcaccgctggcgttttcatctccatcgctttcgtattctatatcaccgcgaccaccggcactgccgcgatgccttatgggattgccaaacttatcggtgggatctgtttttctctgggtctgattctgtgcgttatctgcggcgctgacctctttacctctacggtactgatcgtggtggccaaagccagcggtcgaattacctgggggcaactggcaaaaaactggctcaacgtctattttggtaacctggtgggcgcgctgctgtttgtgctgctgatgtggttatcaggcgaatatatgactgccaacggcggctgggggctaaacgttctgcagaccgccgaccacaaaatgcaccatacttttgtggaggccgtgagcctgggtatcctcgctaacctgatggtttgtctcgccgtatggatgagctattccggtcgtagcctgatggataaagcgatgatcatggtcctgccggtagcgatgttcgttgccagcggctttgagcacagcatcgccaacatgtttatgatcccgatgggtatcgtaatccgcaactttgcaagcccggaattctggaccgccatcggttcgactccggaaagtttctctcacttgaccgttatgaacttcatcactgataacctgattccggtaactatcgggaacattatcggcgggggtctgctggtcgggttgacatactgggtcatttacctgcgtggcaacgaccatcactaa

SEQ ID NO: 4876 - DNA, 792 bp, Klebsiella pneumoniae
aataacgccgctttatttttatcgtcatcccttatcacgataaataaagaccggcacggtccgctcgtgcgcgtaaacaatttaattgaggtggttatgttcagaaaattagcagccgaatgcttcggcaccttctggcttgtatttggcggctgcggtagcgccgtgctcgccgcggctttccccgagctgggtattggttttgccggcgtcgcgctggcatttggcttaacggtattaaccatggcgtttgcggtcggccatatttccggggggcatttcaacccggcggtcaccttaggcctgtgggccggcggccgttttccggcaaaagaggtcattggctatattatcgctcaggtggtcggcggaattattgccgcggcggtgctgtacgtggttgccagcggtaaagccggctttgatgccgccgccagcggcttcgcctccaacggctatggcgaacactccccgggcggcttctccatgctgtcggctatcgtcattgaaattgtcctgacctgcggcttcctgctggttattcatggcgcgaccgataaacacgcgccggcgggctttgcccccatcgccatcggcctggcgctgaccctcatccatttgatcagcattccagtcaccaacacctcggtcaacccggcgcgcagcaccgcggtggcaattttccagggcggctgggcgctgcagcagctgtggctgttctgggtcatgccaatcgtcggcgggatcctcggcggcgtgctgtatcgcaccctgctggaaaaacgcgattaa

SEQ ID NO: 4877 - DNA, 303 bp, Klebsiella pneumoniae
tttttaaacgcgtcagtttgcggatgcgtgaagcaggaggcatccccttgctcgacgatatggccattttccatatacaccacccggctggccgtcttgcgcgccacttcaacttcgtgggtgacgataacctgggtaatgccggtttcagccagctcgcggatgatgctgacgatctgggcagtgatttccgggtcgagcgccgcggtaggctcatcgaacagcagaacctgcggctccatcatcagcgcgcgggcgatggccacccgctgttgttggccgccggataaatgcagcgggtaa

SEQ ID NO: 4878 - DNA, 306 bp, Klebsiella pneumoniae
gcagatccagcgacggcagtggcgtggtcggcttttgcagcggtcgactatcgccattacgcatcagcagcgggtggatcaggctctcctgcggcgcaggggcggcaggctgatgcccctgcggggcaaccggttgttgcggctgtacgggctgcgacgcagtcggataggactgcggctgcggcggcacaggctgatggtgtatcggctgatgctgcgcaggttgataaccctgctgcggagcggccgccggttgttgatagcgctgggccggctgctgcggctggacttccggcgtgggcgtaa

SEQ ID NO: 4879 - DNA, 546 bp, Klebsiella pneumoniae
aggctcagagccggaacaggagtagggaaggaatacagagagacaataataatggtagatagcaagaagcgccctggcaaagatctcgaccgcattgatcgtaacatcctgaatgaattgcaaaaagatgggcgaatttctaacgtcgagctttctaaacgggtgggactttctccgacgccttgccttgagcgtgtgcgtcgtcttgaaagacagggttttattcagggctatacggcgctgctcaacccgcattatctggatgcatcacttctggtatttgttgagattactctgaatcgtggcgcaccggatgtgtttgagcaatttaacgccgcagtacaaaaacttgaagaaattcaagagtgtcatctggtttccggtgatttcgactatctgttgaaaacccgtgtaccggatatgtcagcgtatcgtaaattactgggcgagaccttgctgcgcctgccgggcgttaacgacacccgtacctacgtggtaatggaagaagtcaagcaaagtaatcgtctggttattaagacgcgctaa

SEQ ID NO: 4880 - DNA, 1095 bp, Klebsiella pneumoniae
ggggaaatggctcaggtctataacttcagttcgggcccggcaatgctgccggcggaagtactcaaactggcgcagcaggaactgtgcgactggcacggtctggggacgtcggtcatggagatcagtcaccgtggtaaggagtttatccaggtggcagaagaggcagaacaggacttccgcgctctgctgaacatcccttccaactataaagttttattctgccacggcggcggccgcggccagttcgccgggatcccgctgaacatcctcggcgataaaaaggtcgctgactatgtggacgccggttactgggcggccagcgcggtcaaagaggcgaagaaatactgcacgccgaacgttatcgacgcgaaaatcaccgtcgacggcaagcgcgctgtgaagccgatgagcgagtggcagctgaccccgggagcggcctacctgcactactgcccgaacgaaaccattgacggtatcgcgattgatgagacgccgaacttcggcgacgacgtcatcgtgaccgccgatttctcctccaccattctttcccgcgaaattgacgtcaaccgcttcggcgtaatctacgccggcgcgcagaaaaatatcggtccggctgggctgacgctggtcatcgtgcgtgaagatctgctgggcaaagccagcgtggcctgcccgtcaattcttgactacaccgtgttaagcgagaatgactcgatgtttaacacaccgccgacgttcgcatggtatctggctggactggtgtttaagtggctgaaacagcagggcggggttgccgcgatggataaaatcaaccagcagaaagccgaactgctctacggcgtgatcgataacagcggcttctatcgtaacgatgtggcgcaggccaaccgttcgcgtatgaacgtaccgttccagctggcggacagcgccctggacaaactgttcctcgaagagtcgtttgctgccgggctgcacgcgctgaagggccaccgggtggtgggcggcatgcgtgcttccatctacaacgccatgccgctggacggcgtgaaggcgttaaccgactttatgctggacttcgaacgccgccacggttaa

SEQ ID NO: 4881 - DNA, 777 bp, Klebsiella pneumoniae
tccgtaatttacaagcaatgctcactttccggcgtattgatgcgtataatgcgcggcgtttatattccatgcgccttgctgaaggagaaaaagatgacggcgaatattccggtaatcaccattgatgggcctggcggtgcgggtaaaggtacgttgtgcaaggcaatggcggaagcgctgggctggcatctgttagattcaggcgcgatctaccgcgttctggcgctggcggcgctgcatcatcatgtcgacgtggagtccgaagaggcgctggtgcccctggctgcccatcttgacgtgcgttttatttctactgacggcaacctggaagtggtgctggaaggggaagatgtcagtagcgaaattcgcactcaggaggtcgcgaacgcggcctcgaaagtggcggcttttccgcgcgttcgcgaagcgctgctgcgccgccagcgcgccttccgcgaactgccggggcttatcgccgacggtcgcgatatgggaacggtagttttcccggacgcgccggtgaaaattttcctcgatgcctcggccgacgagcgggcgcatcgccgcatgcggcagttgcaggaaaagggctttgatgttaactttgaacgtcttttgtccgagataaaagagcgtgacgatcgcgaccgaaatcgcgccgtggcgccgcttgtcccggctgccgatgcattagttctcgattcaaccgaactaaacattgagcaagtgattgaaaaagcgctacaatatgcgcgcgaaaaattggccgttgcgtag

SEQ ID NO: 4882 - DNA, 342 bp, Klebsiella pneumoniae
atcgttatatactttttccgctttgcgcgatgccaggatcagctcgctatcgctcgccacgaccgagatgttgcccggcaaaggagagcgttcgcgctaaccgcgctacgcattgagcggaatgatatgtatatgcacttctggcgcacgaaaggcaccttaccgggcattattgccaacgtcaaggcagcctcaccccaggaaaatcgggcgctgcagaggtgcagcgcccttttttacccagtgctaggacaacaaaatccattgaactacttcatttacctgattaattgttccgctttcgtcagaatttgtgcgctggatcgcgcggtgatatcgtaa

SEQ ID NO: 4883 - DNA, 291 bp, Klebsiella pneumoniae
gcgttgattcaggctctggtatggacacatttctttcgatcttcccgcgatacccgcctgatatccgcgttggtgtgcccgttccaggcgatctcgtttttgtctcttcatgcctcgtttccctcattctttgatctggtggaaaagaaaacagtggtcgcaaattgtgcagccacgggttacgaataccgcgaaaagaaggcaacgtcaatgcgcaaaattcacgccagtgtcatatttgtgacctatataagagttcattttttgttcgctcggcgcagccgccggtaa

SEQ ID NO: 4884 - DNA, 1749 bp, Klebsiella pneumoniae
aggcgttatcaaaaaaaggagatggagatcatgaaacagaccgtggcggcatacattgccaaaacgctggaacaggccggcgtgaaacgtatctggggcgtcaccggagattccctcaatggattgagcgatagccttaaccgcatgggcaccatcgactggatgcccacccggcacgaagaggtcgccgctttcgccgctggcgcggaagcgcagctgaccggcgagctggcggtctgcgccggctcctgcggaccgggcaacctgcacctgattaacggtttgtttgactgtcatcgcaaccatgtcccggtgctggccatcgccgcccacatcccatccagcgaaatcggcagcggctattttcaggaaacccatcctcaggagctgttccgcgagtgcagccattactgcgaactggtctccacgccggagcagatcccgcaggtgctggcagtggcgatgcgtaaggcagtgattaaccgcggcgtctcggtggtggtgttgcccggcgatgtggcgctgaaggccgccccggaaagcgccagcagccactggtatcatgcgccgctgccgacggtcaccccggcggaagaagagctgcgcaagctggcgcagcttattcgctactccagcaatatcgcgctcatgtgcggcagcggttgcgccggcgcccaccaggaactggtggagttcgcagccaaaattaaagcccccatcgtccacgccctgcgcggcaaagagcacgtggagtacgacaacccgtacgatgtgggcatgaccgggctgattggcttctcttctggcttccacaccatgatgaacgccgataccctgatcctgctgggcacccagttcccctatcgcgccttctacccaaccgacgcgaaaattatccagatcgacatcaaccccggcagcatcggcgcacacagtaaggtcgacatggcgctggtgggcgatattaaatcgacgctgaaggcgctgctgccgctgctggaagagaaaaccgatcgccacttcctcgataaggcgctggagcactatcgcgacgcgcgaaaagggctcgacgatctggctaaacccagcgataaagccattcacccgcaatatctggcgcagcagatcagtcattttgccgatgaagatgccattttcacctgtgatgtcggcaccccgaccgtctgggcggcacgctatctcaaaatgaatggtaaacgccgcctgctgggctcgttcaaccacggctcaatggccaacgccatgccgcaggccatcggcgccaaggccactgcgccggagcggcaggtagtggccatgtgcggcgacggcgggttcagcatgctgatgggcgattttctgtcgctggcgcagatgaagctgccggtgaagattgtcatctttaacaacagcgtgctgggcttcgtggcgatggaaatgaaggccgggggctatctcaccgacggtacggagctccacgataccaacttcgcccgcatcgctgaggcctgcggtatcaaaggtatacgcgttgaaaaagcctccgaggtggatgaagcgctgcagaccgccttccgcaccgacggtccggtgctggtcgacgtcgtcgtcgccaaagaggaactggcgatcccgccgcagatcaagctggagcaggccaaaggctttagcctgtatatgctgcgggcgatcatcagcgggcgcggcgatgaggtcatcgaactggcgaaaaccaactggctcaggtaa

SEQ ID NO: 4885 - DNA, 1734 bp, Klebsiella pneumoniae
gcagagtgtcatcttgcctccgccctcgctatactgttgattactgaaggagagtggtggtgtagcggaggggatatgcttcttgagcgcgtagaaatcgtcggttttcgcggtatcaatcgtttgtcgttgatgctggagcaaaataacgtcttgatcggggagaacgcgtgggggaagtccagtctgcttgatgcgctgaccctgcttttgtcgccggagttcgatctttatcactttgttcgcgatgatttctggtttcccccgggcgacatccaggggcgcgaacaccatttgcatattatcctgaccttccgcgaaacggagccaggccgccatcgggtacggcgtttccgtccgcttcagcgctgctgggtgccttgcgatgacgggtatcaccgggtgttctatcgcctggagggcgagctcgccgaagatgacagcgtgatgaccctgcggagctttatcgatggtgaaggcgaagcgttggtgctggaggagattgatgagctggcccgacacctggtgcgtttgatgccggtgctgcgcctgcgcgatgcgcgctttatgcgccgcatccataacgggacggtaccgcactcgccgcagatagagatcaccgcccgtcagctggattttctctcccgcgaactggtcagccatccgcaaaatttatcggacggtcagatccgtcaggggctatcggccatggtgcaactgcttgagcattactttgccgagcaaagcagcgctcagacgcggcatcgcctgatgcggcggcgctcccatgatgaacagcgcagttggcgttatctggatattatcaaccggatgatcgacaagcccggcgggcgtagccatcgggtgatcctgctggggctgtttgccaccctcctgcaggcgaaagggacggtgcgcctcgatcgcgacgcgcgaccgctgctgttgattgaagatcccgagacccgtctgcatccgatcatgctttccgtcgcctggcacctgctgaatttgttgccgctgcagcgtgtgaccaccaccaactccggagagctgctgtccctgacgccggtagagcaggtctgccggctggtgcgtgagtcgacgcgggtatcggcgtggcggttggggccgggcggaatgaatgccgaagagagccggcgcattgcttttcacatccgcttcaatcgcgcctcatcgcttttcgcccgctgctggctgctggtggagggagagacggaaacctgggttatcaacgaactggcccggcagtgcggtcatcattttgatgctgaaggggttaaggtgatcgagttcgcccagtccggcctgaagccattgatcaaatttgcccgccggatggggatccagtggcacgtgctggtggacggcgatgaggcggggaaaaaatatgccgcgacggtacgaggtctgcttaataacgatcgcgagctggagcgcgaccatctgaccagtctgccggcgctggatatggaacactttatgtatcgtcagggatttgatgacgtttatcatcgggtggcgcagatcccggataatgtcccgatgaatatgcggcgggtgatcaccaaagccatccatcgctcatccaagccggacctggcgattgaggtggcgatggaggccggccgccgtggcgtggacgctgtgccgacgctgctgaagaaaatgttctcacgggtgctgtggctagcccgcggtcgtgccgattaa

SEQ ID NO: 4886 - DNA, 1248 bp, Klebsiella pneumoniae; identical to SEQ ID NO: 4163

SEQ ID NO: 4887 - DNA, 408 bp, Klebsiella pneumoniae
acttgccaccatccgcagctcagttcagcaggcctccgccctggtgccggattacgggttgcttatggcctggcgcgtagtgctgctggcgctggccctggcctgctggtgcgtgccgcagattcgcggtcgcaaaccggcggtctcgctgctcggcctggcctttgttctgatactggcgggagagatgatcggccgcggcgtattctatggcctgcatatgaccgttgggatggctgtcgccagttaaccacctccatcatgccggtgcctaaccaccggcatgatgaaaacgtgctgtcgatagatgaaatttttcaactgaaattaacttcggcatttattaataaaccagcaaaaacaatagtgtattatctgctgtctcacctttttccatcctctggataa

SEQ ID NO: 4888 - DNA, 792 bp, Klebsiella pneumoniae
gctgcgcaccaacacggccccggatgggccacatctggagaaaacaccgcaatgtcagttattggtcgcattcactcctttgaatcctgtggcaccgttgatggcccgggcatccgctttattacctttttccagggctgcctgatgcgctgcctgtactgccataaccgtgacacctgggatacccacggcggcaaagaaatcaccgttgaagaattaatgaaagaggtggtgacctatcgtcactttatgaatgcttccggcggcggcgtcaccgcctcgggcggtgaggcgatcctgcaggcggagtttgttcgcgactggttccgcgcgtgtaagaaagaaggcatccacacctgcctggataccaacggcttcgtacgtcgctacgatccggttatcgacgagctgctggaggtaacagacctggtgatgctggatctcaagcagatgaacgatgagattcaccagaacctggtcggcgtctctaaccatcgtacgctggaattcgcccagtatctggcgaagaagaatatcaatgtctggatccgctacgtggtggttcccggctggtcagacgatgatgattccgcgcaccgcctgggcgaatttacccgcgatatgggcaatgtcgaaaaaatcgagctgctgccctaccatgagctgggtaaacacaaatgggtagcgatgggcgaagagtacaagctggacggcgtccatccgccgaagaaagagaccatggagcgggtaaaaggcatccttgagcagtatggtcacaaagtaatgtactaa

SEQ ID NO: 4889 - DNA, 183 bp, Klebsiella pneumoniae
aatagcctacagacgctgtttaaactggaagtaccggccctgtttagcgagcagctccgcgtgactaccttgctcaattatctggccgttgtccatgactattatctgattaaaacccgccaggtcccgcaggcgatgggtcaccatcagcacggttttgtcgcgcatgacatctgccagtag

SEQ ID NO: 4890 - DNA, 2163 bp, Klebsiella pneumoniae
catagggcacatattggctataatgcgcaccaattttctttaagtaaaagtgacgatatgaattctctgtttgccagtacggctcgtgggctggaagagctgttaaaaactgaactggaagggcttggcgcgacggactgccaggtagtccagggcggggtccattttcagggggatacgcgcctgctgtatcaaagcctgatgtggagccggctggcttcgcgcatcatgctgccgctgggcgaatgtcgcgtatacagcgatctggatctgtacctcggcgtacaggccattccgtggacggagatgttcaaccctggcgccaccttcgcggtgcattttagcggcctcaatgacgagatccgtaacagccagtacggcgcgctgaaggttaaagacgccattgtcgacagcttcacccgtaagaatctgccgcgcccgaacgtcgatcgtgagtcgcccgatctgcggatcaacgtctggctgaacaaagagacggcgcacatctcgctggatctgagcggcgaaggcctgcacctgcgcggctatcgcgatggtaccggaatggcgccgatcaaagaaaatctcgcggcggcgatcgtcatgcgctctggctgggtaccgggtacgccgctgctcgatccgatgtgcggctccggtaccctgctgattgaagcggcgatgctggcgaccgaccgcgcgccgggcctgcaccgcggccactggggctttggcggctgggcgcagcacgatgacgccatctggaaagaggtgaaggcggaagcgcaaacccgcgctcgtcagggattggcagcgtatgagtcacgcttctacggctcagacgtcgacgtgcgcgtaatcgagcgcgcgcgccgcaacgcccgccgcgccggcattggcgagctggtcgattttgacgtgaaagacgtcgcccaactgaacaacccgctgccgaaaggcccgtacgggacggtgatcagtaacccgccgtacggcgaacgtctggaaagcgagccagcgctgatcgctctgcacagcctgcttggccggataatgaaaagtcagttcggcggctggaacctgtcggtattcagcgcttcgccggagctgctgagttgcctgcagctgcgtgccgacaagcagtttaaagccaagaacggcccgctggactgcgtgcagaagaattatcacctggcggagagcgaaggcggcaagccggcgatgctggcggaggattttgctaaccgtctgcgtaagaacctgaagaagtttgaaaaatgggcccgccaggaaggaatcgaatgctatcgcctgtacgatgctgatctaccggaatacaacgtggccattgaccgctatgccgactgggtggtggtccaggagtatgccccgccgaaaaccgtcgacgcgcataaggcgcgccagcgtctgttcgacatcatcgctgcgactatcgccgtactggacatggcgcctaacaagctggtgctgaaaacccgtgaacggcagaaggggaaaaaccagtatcagaagatggcggagaagggcgactttattgaggtacaggagtataacgcgcgcctgtgggtcaacctcaccgactacctggataccggtctgttcctcgaccaccgtatcgcacgtcgcatgctcggccagatgagtaaaggtaaggacttcctgaacctgttctcctataccggcagcgccagcgtccacgcaggcctcggcggtgcgcgatccaccaccacggtggatatgtcacgcacctacctggagtgggcggaacgcaacctgcgtctcaatggcctgaccggccgcgcgcatcgcctgatgcaggcggacgtgctgggttggctgcgggagagcaccgagcagttcgatctgatctttatcgatccgccgaccttttccaactccaaacgaatggaagatgcgtttgacgtccagcgcgatcacattcgcctgatgaccgatctaaaacgtctgctgcgtaaaggcggcaccattatgttctcgaataacaaacgcggtttccgtatggatcatgacgggctggcggcgcttggcctgaaggcgcaagagatttcgcaaaaaacgctgtcgcaggattttgcccgcaaccgtcagatccacaactgctggctgattaccgcagcctga

SEQ ID NO: 4891 - DNA, 207 bp, Klebsiella pneumoniae
ccatgggcgcagcccatgcctttctatatgataaaccatgttaccgggaatgtctgtcagcgccctatcccctcagctccggcctctcagggtgattttcagctaacgaccgaagaaaatagcctggtccgctcccgatgggtaaccggctcaaaaaacaagcatcagcactgcgaaatacgtcatcttttcgctaaaaagcgttaa

SEQ ID NO: 4892 - DNA, 1314 bp, Klebsiella pneumoniae
ttcgataagcacaggataagcatgctcgatcccaatctgctgcgtaccgagccagacgcagtcgcagaaaaactggcacgccggggctttaagctggatgtagataaacttcgcgcgcttgaagagcgtcgtaaagttctgcaggtgcaaacggaaaacctgcaggcggagcgtaactcccgatcgaaatccattggccaggcgaaagcgcgcggggaagacatcgagccattacgcctggaagttaacaagcttggcgaacaactggatgctgcaaaatccgagctggaaacgctgctggcggaaattcgcgatatcgcgctggcgatcccgaatattcctcatgatgatgtgccggttggtcgcgacgaaaacgacaacgttgaagttagccgctggggtacgccgcgtcagttcgatttcgaggtgcgcgatcatgtgacgctgggtgaaatgcacggggggctggattttgccgccgccgttaagctcaccggctcgcgcttcgtggtgatgaaagggcagctggcccgtctgcaccgcgccctggcgcagttcatgctggatctgcacaccgaacagcatggctacagcgaaaactatgtcccgtacctggtaaaccaggacaccctgtatggcactggccagctgccgaaattcgccggcgacctgttccatacccgtccgctggaagaagaggctgacagcagcaactacgcgctgatcccgacggcggaagtgccgctgaccaacctggtgcgcgatgaaatcatcgacgaagacgatctgccgatcaaaatgaccgcccatacgccgtgcttccgctctgaagccggttcctatggccgcgacacccgcggtctgatccgtatgcaccagttcgataaagttgaaatggtgcagatcgtccgcccggaagactctatggccgcgctggaagagatgaccggtcacgccgagaaagtgctgcagctgctgggcctgccgtaccgtaaggtcgcgctgtgcaccggcgatatgggcttcagcgcctgcaaaacctatgacctcgaagtatgggttccggcgcaaaacacttatcgtgagatctcctcctgctccaacgtctgggatttccaggcgcgtcgtatgcaggctcgctgccgcagcaagtccgataagaagacccgtctcgttcataccctgaatggttctggcctggcagtaggtcgtaccctggtggcgctgatggaaaactatcagcaggctgatggccgtatcgagatcccggaagtgctgcgcccgtatatgcgcggcctcgaatatatcggctaa

SEQ ID NO: 4893 - DNA, 537 bp, Klebsiella pneumoniae
ttcgcttataaggaaatcatcatgcgctacaaactttttgctgtacttctcccttgcgcgctggcgctcagcgcctgtacgaccgtcaccccggcctataaagataatggcacccgcagcggcccctgcgtcgaaggcggccctgacgacgtagcgcaaaaattctacgacacccagatccagaatcgtactcaggatccggcggcgctgcgcccctatctgagcgacggcctggcgcagttactcaatgacgcccgccaggatcccgccaacagcaaattactgcaggctaatccgttctccagcagcagcaccccggcagacagcgccgtggtcgccagcgcctccaccatcccgaaccgcgatgcgcgcaatattccgctgcgcgtcgatctgaaacagggcacccagagctggaaagatgaagtgctgatgatccaggaaggccagtgctgggccgtcgatgacgttcgctatctcggcaacaacagccatgcgccagccgggacgctgcgacagagtctggagaaacgctga

SEQ ID NO: 4894 - DNA, 798 bp, Klebsiella pneumoniae
atattgcataactattctgccaaaggtagtatttgcggcctcaatagctattcgtatcagactgcccagatgagtattaaactaaacggcattaattgcttctacggcgcacaccaggcgctgttcgacatcacgctggattgcccgcagggggaaacgctggtgctgctcggccccagcggtgccgggaagagctcgctgctgcgcgtactcaacctgctggagatgccgcggtccggttcgttatccatcgccggcaaccaattcgacttcaccagagcgccgtccgataaagcgattcgcgaactgcgtcagaacgtcggcatggtcttccagcaatacaacctgtggccgcacctgacggtacagcagaacctgatcgaggccccctgtcgcgtactggggttaagcaaggatcaggcgctggctcgcgcagagaagctgctggagcgcctgcgtctgaagccgtacagcgatcgttacccgctgcatttatccggcggccaacaacagcgggtggccatcgcccgcgcgctgatgatggagccgcaggttctgctgttcgatgagcctaccgcggcgctcgacccggaaatcactgcccagatcgtcagcatcatccgcgagctggctgaaaccggcattacccaggttatcgtcacccacgaagttgaagtggcgcgcaagacggccagccgggtggtgtatatggaaaatggccatatcgtcgagcaaggggatgcctcctgcttcacgcatccgcaaactgacgcgtttaaaaactatctttcacattga

SEQ ID NO: 4895 - DNA, 672 bp, Klebsiella pneumoniae
ggcactggtaacgaaaggagcgtcatgaactatcgtattattccggttaccgcgttcgcgcagaactgttctcttatctggtgcgggcaaacccggctggcggcgctggtcgatcctggcggcgatgctgaacgtatcaaagcggtggtggcggaggctggcgtcacgctgatgcagatcctgctgacgcatggccacctcgatcacgttggcgccgcggctgaactggcgcagcattatggcgtaccggttattggtccggaaaaagaggatgagttctggctggaaggattaccggcgcaaagccggatgttcggcctggaggattgccaaccgctgcgtccggatcgctggctcaatgaaggcgatgtggtcaatgtggggaatgtggcgctgcaggtgctgcactgcccgggccatacgccgggccatgtggtcttttttgatgacgcctcccgactgctgatctccggagacgtgattttcaaaggcggggtgggacgcagcgattttccgcgcggcgaccatgggcagctgattgcggctatcaaggaaaagctgttgccgctgggcgatgatgtgacctttattcccggccatggtccgctgtcgacgctgggtgaggaacgccgtaataacccgtttctgcaggatgagatgccggtctggtaa

SEQ ID NO: 4896 - DNA, 1323 bp, Klebsiella pneumoniae
accagcaaaaacaatagtgtattatctgctgtctcacctttttccatcctctggataaaaaacttctatcgtagccgacaaaaccgcgtcacgcctgatttcaggtggattgacaatgtttttagcagtggcatgatgcgctcgcgatctgaacattcctcacggtttttacccatgaccatctacacccggccagtgcaaatgctgctctgtggcctgcttttattgaccctggcgatagcggtgctgaatacgctcgtcccgctctggctcgcccatgaaaacatgccaacctggcaggtcggcatggtggggtcatcctattttaccggcaacctggccggtacgttgctggccggctgggtgatcaagcgcctggggtttaaccgtagctattatctcgcatcgttaattttcgccgtcggctgcgtagggctggggatcaccgttggcttctggacatggctgagctggcgttttatcgccggtgtaggttgcgcgatgatctgggtggtggtggaaagcgcgctggtttgcagcggcacttcccgcagtcgcggtcgtctgctggcggcgtacatgatggtctattacgtcggtaccgtactgggccagctgatggtcagtaaattacccaccgatttaatgagcgtcctgccgtgggtgaccggcctggcgctggcggcgatcctgccgttgctgtttacccgcattatggggcaggcagaagagccgcatgaaacggtacgtatctggccgatgctgaagctacgccaggcgcgccacggggtcaatggctgtattatttcggggattgtcctcggctcgctgtatggcctgatgccgctgtggctgaaccatcagggcgtcagcgactccggcatcggcttctggatggcggtgatggtgagtgcggggatcctcggccagtggccggtagggcgcctggcagaccgctacggtcgcctgctggtgctacgggtacaggtctttgtggtcattctgggatgtctggcgatgcttagtcaggcggcaatggccccggcgctgtttgtgcttggggcatctggtttcacgctgtatccggtggcgatggcctgggcctgtgaaaaagtggagcaccatcagctggtggcgatgaatcaggcgctgctgatgagctataccatcggcagcctgctgggcccgaccctgacggcgatgctgatgcagaacttctcagacaacctgctgtttatcatgatcgccagcgtgtcgtttatctatctgctgaccctgctgcgcaaagccgggcatcatccgacgccagtggcgcacgcctga

SEQ ID NO: 4897 - DNA, 1431 bp, Klebsiella pneumoniae
tgtcagaaaaatttagaatgtcgcgttgcgcggcgtccgcgggaacggaataacatcgcggacgttctgcacgccggtcacgtaagcgatgaggcgttcgaagcccagaccgaagccggaatgcggcacggtgccgtagcgacgcaggtcgcgataccaccagtagtcttctttgttaagacccatctctgccatacgcgcgtcaagcacgtcgagacgctcttcacgctgggaaccgccgataatctcgccgatgcccggcgccagaacgtccattgccgcgacggttttaccgtcttcgttaaggcgcatatagaacgctttaatgtctttcgggtagtttttcaccaccaccggcgctttgaagtgctcttcggccaggtaacgttcgtgctcagaggagagatccacgccccagtacaccgggttctcgaactgtttgccgcagttttccagaatggtgacggcgtcggtgtaatccacctgggcaaaatcagcggtgataaagcgctgcagacggtcgatagcgtctttatccacgcgctcggcgaagaactgcatgtcgtccgcacgctcttccagtaccgctttgaagacgtacttgagcatcgcttccgccaggccggcaacgtcgttcaggttggcgaaggccacttccggctccagcatccagaattccgccaggtggcggctggtgttggagttctcggcgcggaaggtcgggccgaaggtataaatcttcgacagcgcacaggcgtaggtttcgccgttcagctgcccggaaacggtcaggaacgactctttaccgaagaagtctttgtcgaaatcgactttgccctgatcgttacgcggcaggttttccagatccagcgtcgacacgcggaacatttcgccggcgccttcggtatcggaggcggtgatcagcggggtggaaacccagaagaagccctgttcgttgaagaagcggtgcagcgcctgcgccagggtgtgacgcacgcgggctaccgcgccaatcaggttggtgcgcggacgcaggtgcgctacttcacgcagatactcgatgctgtggcgcttggccgccatcgggtaggtgtccgggtcttccacccagccggtcacttccacgctggtcgcctggatctcaaagctttgaccctgaccctgagaagccacgactttaccggtgacaatcaccgagcagccggtggtcagacgcagcacttcctgattgtaattgggcagagaattattaataacggcctgtacaggatcaaagcaggaaccgtcatagacggcgaggaaagaaaagccagctttagaatctcggcgggtacgcacccatccgcggaccgtgacttcgctgtcaacggcaacgcggccctggagtacgtcggctacaggcacaacgctcataataatctctctatgtag

SEQ ID NO: 4898 - DNA, 1026 bp, Klebsiella pneumoniae
aagcggctgaaccataacagcgcgatcccgataccgatcagcaacagtaaggcgggtagcggcaacagcaggccgccgacgattttttttagcgtgaaaagcatgccagatggttccttttttaaccatataaccaaagttatgttcggatcttataacagatcgcttcattctcggcgcgggtatgacaaaatagcggttttgtgttggcttgtggagtcactcgtgcaggatcgcaatttcgatgacattgctgaaaagttttcgcgcaatatttacggcaccacaaaaggccagttgcgtcaggcgatcctctggcaggatctggaaccgctgttggcgcagctggggccgggaccgctgagggtgctggatgccggcggcggcgaagggcaaacggccatcaaagtcgcgcaactgggccatcacgtgacgctctgcgatctctccgctgagatggtggctcgcgcccgccaggcggccgccgataaaggtgtgatcgacaacatgcattttgtacaatgcgcggctcaggatattgcgcagcatttggaaagcccggtcgatctggtactgtttcatgcggtgctggagtgggtggcggagccccaggaaatactgcataccctgtggtcgacgctgcgtgctggcggtggactgtcattgatgttctacaatgctaacggcctgttgatgcacaatatggttgccggtaattttgattacgttcaactgggcatgccaaaaaagaaaaaacgcacgctgtcgccggattatccgcgtgaaccacagcaggtttatcactggctggaagagattggctggcagatcgtcagcaaaaccggcgtgcgggtgtttcatgattatctgcgtgaaaaacgccaacagcatgacagctatgcggcgctgctggcgctggagacgcgctactgtcgtcaggagccgtatctcagcctgggccgttatattcatgtcaccgcgcttaagagccaggctcatagccgcagatgcaaggataaagtatga

SEQ ID NO: 4899 - DNA, 1020 bp, Klebsiella pneumoniae
agtgatatgaaggtactggttaccggtgcgaccagcggattaggccgcaacgcagtggaatatctgcgcaacaagggcatcagcgtgcgagcgaccgggcgcaacgaagcgatgggcaagcttctgagcaaaatgggggcggaattcatcccggcagatttaaccgagctggtctcttcgcaggctaaagtgatgctcgccggtatcgataccctatggcactgctccagctttacctcgccatggggcactcagcaggctttcgatctcgctaacgtccgcgccacccgtcgtctgggcgaatggtcagtggcatggggagtgcgcaatttcgtccatatctcttcgccatcgctctattttgattatcaccatcatcgtgatatccaggaagatttccgtccacaccgcttcgccaacgagtttgcccgcagcaaggcggccagcgaggaggtgatcaacctgctggcgcaggctaacccgcatacccgttttaccattctgcggccgcagagcctgtttgggccgcacgacaaagtctttatcccccggctggcgcaaatgatgcagcattatggcagcgtcctgctcccgcgcggcggcagcgcgctggtcgacatgacctattatgaaaacgccgtacatgcgatgtggctggcgagccagccggcctgcgatcatcttccctccgcccgcgcgtggaatatcagcaacggcgaaccgcgcaccttgcgaagcatcgtgcagaaattgatcgacgagctcggcatcaaatgccggatccgctcagttccctatccgatgctggatattatcgcccgcagcatggagcgctttggcgataaaaccgccaaagaacccgcgtttacccactacggcgtctccaagcttaactttgattttacgctcgatatcacccgcgcgcaggacgagctgggctatcagccggtggtgacgcttgacgacggcatcgtgcgcaccgccgcctggcttcgcgaccacggtaaactacaccgctaa

SEQ ID NO: 4900 - DNA, 285 bp, Klebsiella pneumoniae
ataatgatgaagcgcaatattctggcagtggtgatccctgccctgctggtagccggtgcagccaacgctgcagaaatctataacaaaaacggcaacaaactggacttctatggaaaaatggtcggcgagcacgtctggaccaccaatggcgacaccagcagcgacgataccacctatgcccgtatcggcctgaaaggcgaaactcagatcaacgatcagctgatcggctacggccagtgggaatacaacaggttcttcgcgggatcttggggaagtggaagttga

SEQ ID NO: 4901 - DNA, 1356 bp, Klebsiella pneumoniae
gtagaggcgaaagtgagcaatctgtcgctcgatttttccgacaacgcgtttcaacctctggccgctcgcatgcggccagaaaatttagcgcagtatattggccagcagcacctgctggcgccgggtaaacccctgccgcgggccattgaggccgggcacctgcattcgatgatcctctgggggccgccgggtaccggcaagaccactctggcggaagtgattgcccgctacgccagcgccgatgtcgaacggatctcagcggtaacctccggggtgaaagagattcgcgaggctattgagcgcgcgcggcaaaatcgcaacgccggccggcggaccatcctgtttgttgacgaagtgcatcgctttaataaaagccagcaggatgcctttctgccgcatattgaagacggcaccattacttttattggcgcgaccaccgaaaacccctcctttgagcttaactcggcgctgctctcccgcgctcgcgtctacttactgaaatcgctcaccaccgacgatatcgagcgggtgcttgaccaggcgatgaacgataaaacccgcggctacggcggccaggatatcattttgccggatgagacccgcagggccattgccgagctagtgaacggcgacgcgcggcgagcgctgaataccctggaaatgatggccgatatggccgaaagcgatgactcgggcaagcgggtgctgaaggcggaactgctgaccgagatcgccggcgagcgcagcgcgcgctttgataacaaaggcgaccggttctacgatttgatttctgctctgcataagtcggtgcgcggtagcgcgccggatgcggcactttactggtatgcgcggatcatcaccgccggcggcgatccgctgtacgttgcccgccgctgcctggcgattgcctcggaagatgtcggcaacgccgacccacgggcgatgcaggtcgctatttcggcgtgggattgctttacccgcgtcgggccggcggaaggcgaacgggcgattgcccaggccattgtctatctggcctgcgcgccgaaaagcaacgcggtgtacaccgccttcaaagcggcgctggccgacgcgcgggaccgcccagactatgacgttccggtgcatctgcgcaatgcgccgacgaagctgatgaaagagatgggctacggccaggagtatcgttacgctcatgacgaacctaacgcctatgccgccggcgagcagtatttcccgcaggaaatggcgcaaacgcgctattatcacccgacaaaccgggggcttgagggtaaaattggcgaaaagctcgcctggctcgctgaacaggatcaaaatagcccgataaaacgctaccgctaa

SEQ ID NO: 4902 - DNA, 1209 bp, Klebsiella pneumoniae
tcacaatggaacctcgtcatgtttgagaacattaccgccgccccagccgacccgattttaggtctggccgatctgtttcgtgccgatgaccgccctgaaaaaattaacctcggaattggtgtttacaaggatgaaaccggtaaaacgcccgttctgaccagcgtcaaaaaagcagagcagtatctgctggaaaatgaaacgactaaaaactatctgggcatcgatggtattcctgaatttggtcgctgcacccaggagctgctgttcggtaaaggcaatgcgattatcgctgataaacgcgcccgcaccgcgcagacacccggcggtaccggtgcgctgcgtgtcgccgcagacttcctcgccaaaaacaccgacgtgaaacgtgtgtgggtaagtaatccgagctggccgaaccataaaagcgtattcacctctgccgggctggaagtgcgcgaatacgcatactacgacgcggctaaccacgcgctggactttgatggtctgctggccagcctgaacgaagcccaggcgggcgacgtggtactgttccacggctgctgccacaacccgaccggtatcgatccgacgctcgatcagtggcagcagctggcgcagctgtcggtggaaaaaggctggctaccgctgttcgatttcgcctaccagggcttcgcccgcggtctggaagaagatgctgaagggctacgcgcttttgctgctctacataaagagctgctggtcgccagctcctactcgaaaaactttggcctgtacaacgagcgcgtcggcgcctgcactctggtcgccgcggatcaggagactgtagaccgcgccttcagtcagatgaagtcggtgatccgcgccaactactcgaacccgcctgcgcatggcgcctccgtggtcgccaccattctgagcaacgatgcgctacgggcaatctgggagcaggaactgaccgatatgcgccagcgcatccagcgtatgcgtctgctgttcgtcaataccctgcaggagaaaggcgcgagccgcgacttcagctttatcagccagcagaacggcatgttctcattcagcggcctgactaaagagcaggtgctgcgcctgcgtgaagagttcgccatctatgcggtagcttccggacgtatcaacgtggccgggatgacgcctgacaatatggcgccgctgtgcgaagccatcgtcgccgtactgtaa

SEQ ID NO: 4903 - DNA, 1020 bp, Klebsiella pneumoniae
ccaccgtggaacaagatatgcagcagctgcttagcgcttaaggagtccctgatgactatgccaacctcccagtgcccgtggcggatgcaggttcaccacattcaccaggaaaccccggacgtgtggaccctttcgctgctgtgccacgattactatccgtaccgcgctggccagtacgctctggttagcgtgcgtaactcggcggaaacgctgcgcgcatataccctctcctcgacgccgggggtcagcgaatacattacgctgaccgttcgccgtattgacgagggtacgggttcgcagtggttgacccgcgaggtcaaacgcggcgattacctttggctgtccgatgcgatgggcgagtttacctgcgacgataaagcggaagataaattcctgctgctggccgccggttgcggcgtgacaccgatcatggcgatgcgccgctggctggctaagtatcgaccgcaggccgacgtacaggtgatttataacgtgcgttcgccggaagatgtaatctttgccgaagagtggcgcaactacccggtcaccctggtagcggagcaaaatgcgacgcacggttttgtcgccggccgtctgacccgggagctgctgcagagcgtgccggatttagccagccgcaccgtgatgacctgcggcccggcgccttatatggagaaggtcgagcaggatgttgccgccctgggcgtcacccgcttctttaaggaaaaattcttcaccccggtggctgaggccgccaccagcgggctgaaatttactaaactgcagccggcgcgcgagttttacgcgccggtgggcaccacgctgctcgacgcgctggagagcaataaagtgccggtgaccgtcgcctgccgcgccggcgtctgcggctgctgcaaaaccaaagtggtttccgggaagtacagcgtcaccagcaccatgacgctgaccgacgccgaaatcgccgacggctatgtgctggcctgctcctgtcatccgcagagcgatctggttctcgcctga

SEQ ID NO: 4904 - DNA, 2439 bp, Klebsiella pneumoniae
agaaagcaccttcgggtgctttttttgtgcccgccatttacggccatcctcacaaaaaaagcgtgcctggctgcaagcgaggcgattgtctggaatgcgccgcgcaagcctgaattcgcctccaggacgccagcaccgctttgcgtaacactgcccactcacagggaggtgtttatgcgtctaccatggcttgccggatgcgccatcattgcaatgctgccgcttctctggctacccgttttgccgggcccgtgcagtctggcgggcgcgagcgcactggcgctggcgctgattcgtctgcatggaagggccgtcgccggagtggcgatgacgcttctgctggtggtctggggagtattgagcgcgcatcaggcgctgtggccgacccggcaccttaccggcgccatccggcaagcggaagtgatccttagcgagacggatggccagaccttgcaccgtggacagatggtgcgcctgcggggccgctatctgtttcccccggtaggcgtaacgctgtacggggaacttgcacctgcgccagcctgtgcgggtcaacactggctgatgacgctgcgcctgcgcccggtgcacgggcagctcaatgacgggggcttcgacagccagcgctatgcgctggcgcagcaccgaccgctgagcggagggatcgtcgccgcttccgcgctggatgcccgctgcagtctgcgcgcccgctatctgacgtcgctgacccggcgactgcagacttatccccggcgcgcggtgatgttgggattaggaatgggggagcggctgtctttgccgacggagataaaggtcctgatgcagaacacgggcacttcccatctgatggctatctcgggtctgcatatcgctctcgcggcttctcttatcatgctgttgctgcgcggtgtgcagtatattctcccgggccgctggatcggctggcggttgccccttgtcgccgggctggcgggcgccgtcggctatgcctggctgaccggtatgcagccgccggccctgcgcacttgcttagggcttgcggtctgttgtgctttacgtttgtcgggtcaacgctggacgtcgtggcaggtgtggctctgctgtctgggagcgatactggttgccgacccgctggcggtcctgtcgcaaagcctgtggctatctgccttcgccgtggcggggctgatcttctggttccagtggctcccgctgcctgccggccgctggcgctggccgtggaagaccgtaattgctcttgttcatttgcaggctggcgtgacgctgctgctgctgccgctgcagttgttgctattccatggagtcagcctgacgtcgatggcggctaatttgctggcggtaccgttagtcaccctgttggcggtgccgcttattctgaccgcgatgctggtgcatctctcggggccggagatagtggagtcgctactctggctggcggccgatcgcgtgctggccgtattgttctggggattaagacgtttaccggacggctggttgacgctggatgctcgctggctgtggatcagtatcctgccgtggctgttggtgatgggctggcgttttcagagctggcggcattcaccggcgttgtgtctcagcgtgctgtttttgctgacgcggccattcagccgacaaccgcctgcggacgaatggcgggtgacgatgctggatgtcggacaggggctggcgatggtgatcgagcgtcacggtaaggcattgctttacgataccgggccggcttggccgcagggtgatagcggtcaacaggtgattatcccgtggctgcgctggcaccatctgcagctgcaagggattatgctgagccatgaacatctggatcatcgcggcggccttgattcagtgctgcaggcatggccgcaggcctgggtgcgcagcccgttaggctgggcgcatcatctgccgtgtcatcgcggtgagcgctggcaatggcagggactcaacttccaggccctgtggccgctgccgggcagcacggcaaagggtaacaatcattcctgtgtggtgcggatcgatgatggtcgctccagcatcctgctcaccggcgatatagaacgtcaggcggagcaggcgatgatcagccgttactggcggcatctgacgtctacacttattcaggttccccaccacggcagcaatacctcctccagcgcgctgctgatccgccgggtggatggcgcggccgcgctggcctccgcttcgcgctacaatgcgtggcggatgccctcgtacaaggtggttcagcgctaccgccagcggggttatcgctggttcgccacgccgcagcaggggcagataacggtggttttttccgcagaagggtggcaaatccatagcttacgggatcaagttttaccgcgttggtatcatcagtggtttggcgcgcccgccgataacgggtag

SEQ ID NO: 4905 - DNA, 1293 bp, Klebsiella pneumoniae
gccgtggttgaacgagcccagcaggcggcgtttaccattcattttgagatagcgtgccgcccagacggtcggggtgccgacatcacaggtgaaaatggcatcttcatcggcaaaatgactgatctgctgcgccagatattgcgggtgaatggctttatcgctgggtttagccagatcgtcgagcccttttcgcgcgtcgcgatagtgctccagcgccttatcgaggaagtggcgatcggttttctcttccagcagcggcagcagcgccttcagcgtcgatttaatatcgcccaccagcgccatgtcgaccttactgtgtgcgccgatgctgccggggttgatgtcgatctggataattttcgcgtcggttgggtagaaggcgcgataggggaactgggtgcccagcaggatcagggtatcggcgttcatcatggtgtggaagccagaagagaagccaatcagcccggtcatgcccacatcgtacgggttgtcgtactccacgtgctctttgccgcgcagggcgtggacgatgggggctttaattttggctgcgaactccaccagttcctggtgggcgccggcgcaaccgctgccgcacatgagcgcgatattgctggagtagcgaataagctgcgccagcttgcgcagctcttcttccgccggggtgaccgtcggcagcggcgcatgataccagtggctgctggcgctttccggggcggccttcagcgccacatcgccgggcaacaccaccaccgagacgccgcggttaatcactgccttacgcatcgccactgccagcacctgcgggatctgctccggcgtggagaccagttcgcagtaatggctgcactcgcggaacagctcctgaggatgggtttcctgaaaatagccgctgccgatttcgctggatgggatgtgggcggcgatggccagcaccgggacatggttgcgatgacagtcaaacaaaccgttaatcaggtgcaggttgcccggtccgcaggagccggcgcagaccgccagctcgccggtcagctgcgcttccgcgccagcggcgaaagcggcgacctcttcgtgccgggtgggcatccagtcgatggtgcccatgcggttaaggctatcgctcaatccattgagggaatctccggtgacgccccagatacgtttcacgccggcctgttccagcgttttggcaatgtatgccgccacggtctgtttcatgatctccatctcctttttttgataacgccttcaagcttagatgaaactgaccgcaatgtaaccgattactcctga

SEQ ID NO: 4906 - DNA, 813 bp, Klebsiella pneumoniae
cgcaaagctgaggagaccgtgatggcaaaatcaacccatcccctgttgttacgcctcgccccatggctgctgccggtagggacggtcattgtctggcagctggcctcgtccgtcggctggctgtcgacgcgggtgctgccctcgccggagggggtattgaaagcgttctggaccctctcggccagcggtgagctgtggcagcatctggccatcagctcatggcgggcgctggtcggcttcgccatcggcggctcgatcgggctaatactcggcctgatcagcggcctgtctcgctggggcgagcgtctgctggatacctcgatccagatgctgcgcaatgtcccgcatctggcgctgatcccgctggtgatcttgtggttcggcatcgatgagaccgccaagatcttccttgtctcgctgggcaccctgttcccgatctatatcaacacctggcacgggatccgcaatattgaccgtgggctggttgagatggcgcgcagctatggcttatccggcttcgccctgttccgtcacgtgatattacccggcgccctgccctcagttatggtcggcgtgcgttttgcccttggtctgatgtggctgacgcttattgtcgccgaaactatctcggcgaatgccggcatcggttatctggcgatgaacgcgcgtgaatttctgcaaaccgacgtggtggtagtggcgatcattctttacgccatccttggcaaactggccgacgtctgcgcccagctgctggaacggctctggctgcgctggaatccggcgtatcatcttcaggaggctaacgcatga

SEQ ID NO: 4907 - DNA, 525 bp, Klebsiella pneumoniae; identical to SEQ ID NO: 2057

SEQ ID NO: 4908 - DNA, 1326 bp, Klebsiella pneumoniae
agtatgagtgaattttcccagacagtccccgaactggttgcctgggccagaaaaaatgatttttcaatctcgctaccggtcgacagactctctttcctgctggcgatcgccactctgaatggtgaacgactggaaggggaaatgagcgagggtgaactggtggatgcgttccgccacgtcagtgatgcgtttgagcagaccagcgaaaccatcagccagcgcgccaataacgcgatcaacgatttggtgcgccagcgtctgctgaaccgctttaccagcgaaattaccgaaggcaatgcgatctatcgcctgacgccgttggggattgggatcaccgattattatatccgtcagcgcgaattctcgacgctgcgtctctcgatgcagctgtcgatcgtcgccggcgagctgaagcgcgcggcggacgccgcggaagagggcggtgatgaattccactggcatcgcaacgtttttgcgccgctgaagtactccgtagcggaaattttcgacagcatcgacctgacgcagcgcattatggatgagcagcagcagctggtgaaagacgatatcgcgcagttgttgaataaagactggcgcgcggcgatttccagctgtgaactgctgctgtcggaaacctccggcaccctgcgcgaactgcaggatacgctggatgcggcaggggataagctgcaggcgaacctgctgcgcattcaggactcgaccatggcgcgcgacgatctccattttgtcgatcggctggtgttcgatctgcaaagcaagctcgaccgcatcgtcagctggggtcagcaggcgattgacctgtggatcggctacgaccgccatgtgcacaagtttatccgtaccgctatcgatatggataagaaccgcgtcttcgcccagcgtctgcgccagtcggtacagacctattttgatgaaccgtgggcgctaacttacgccaacgccgaccgcctgctggatatgcgcgatgaagagatggccctgcgcgatgaagaggtcaccggcgagctgccggcggacctcgaatttgaagagtttaacgaaattcgcgagcagctggcggcgctgatcgaagcgcagctggcggtctataaagagaaaggaataccgctggatctcggcctggtggcgcgggagttcctggcgcagtatccgcgcgggcgtcacttcgacgtggcgcggatcgtcgtggatcaggcggtacagctgggcgtcgcccaggcagatttcaccggactgccggcaaaatggcagccgattaatgattacggagccaaggtacaggcgcatgtcattgacaaatattga

SEQ ID NO: 4909 - DNA, 1749 bp, Klebsiella pneumoniae
atgcagaacgataaagatctctccacgtggcagaccttccgccgactttggccgattatcgcgccgtttaaagccgggctaatcgtagcggcggtggcgttggtgcttaacgcgggcagtgacaccttcatgttatcgcttcttaaaccgttattggatgatggttttggtaaaacggatcgctcagtgctgctatggatgccgctggtggttatcggcctgatggtgctgcgtgggatcaccagctacatctcgagctattgtatttcctgggtttccggcaaagtggtgatgaccatgcgtcgtcgcctgttcggccacatgatgggtatgccggtggccttctttgacaagcagtctaccggaacgctgctgtcacgcatcacctatgattctgagcaggtcgcctcctcctcttccagcgcgctgatcaccgtggtccgcgaaggggcatcgattatcggtctgttcgtgatgatgttctattacagctggcagctgtcgctgatcctgatcgtactggcgccgattgtgtcggtggcgatccgcgtggtctccaagcgttttcgcaatatcagtaagaatatgcagaacacgatggggcaggtcaccaccagcgccgagcagatgctgaaagggcacaaagaggtgctgatgtttggcggccaggaagtggaaaccaaacgttttgataaagtcagcaataaaatgcgtctgcaggggatgaagatggtttccgcctcgtctatctccgacccgatcattcagcttatcgcctccctggcgctggcctttgtcctgtatgccgccagcttcccgagcgtgatggacaccctgaccgccgggaccattaccgtggtcttctcctcgatgattgcgctgatgcgtccgctgaagtcgctgaccaacgtcaatgcccagttccagcgcgggatggcggcgtgccagacgctgtttgcgatcctcgattccgagcaggaaaaagacgaaggtacgcgggtcattgagcgggcgaaaggcaatctcaagttcgagaacgtcacctttacctacccgggtcgcgaagtggccgcgctgcgcaatatcaatctcgatatcccggaagggaaaaccgtggcgctggtggggcgctcagggtcgggtaaatcgaccattgccagcctgatcacccgcttctacgatgtcgacgaggggcagatcctgctggatggccacgacctgcgcgagtacaagctgagctcgctgcgcgaccaggtggcgctggtttcacaaaacgtgcatctgttcaacgataccgtcgccaacaatatcgcctatgcccgtaccgaagagtacagccgcgagcagattgaagaggccgcgcgcatggcctacgccatggatttcattaacaagatggataatggtctggataccatcatcggcgagaatggcgtgatgctgtccggcggccagcgccagcgtattgctattgcccgcgcgctgctgcgtaacagcccgatcctgatcctcgatgaagctacctcggcgctggataccgagtccgagcgtgccattcaggcggcgctggatgagctgcagaaaaaccgtacctcgctggttattgctcaccgtctgtcgaccattgagcaggctgatgaaatcgtggtggttgaagacgggcggatcgtggagcgcggaacgcaccatgacctgctggagcataagggcgtgtatgcccagttgcataagatgcaattcggcgaatga

SEQ ID NO: 4910 - DNA, 1158 bp, Klebsiella pneumoniae
aatcaccgcctggagcggcagggaaacagcaggaatcggaatatgaaagtgaagggaaaacgcaggaccgtctggtggctgttggcgatcgttgtgctggggctggctatctggggatggcggatcctcaatgcgccgctgccgagctaccagacgctggtagttcgcaaaggggatctccagcagagcgtgctggccaccggcaaactggatgccctgcgaaaagttgacgtcggcgcccaggtcagcggacagctgaaaacgctgcacgtcaatattggcgataaggttaaaaaggatcagttgctgggggttatcgatccggagcaggcgcaaaaccagattaaagaggtggaagcgacgctcatggagctgcgcgcccagctcaatcaggcgcgcgcggagagcaaactggcgcaagtgactctggcccgtcagcagcagctggcgcagcgccagctggtctcgcggcaggaccttgataccgcggccaccgatttggcggtgaaacaggcgcagatcggcactattgaagcgcaaataaagcgtaaccaggcgacgctcgatacggcgaagaccaacctcgattacacgcggatcctggcgccgatggccggcgaagtgacgcaaattaccaccctgcagggacagacagtgatcgccgcccagcaggcgcctaacattctgacgctggcggatctcagcaccatgctggttaaagcgcaggtctctgaagcggatgtcatccacctcagaccggggcaaaaagcgtggtttaccgtgctgggcgacccgcttacccgttatgaaggtaaactgaaagacattctgccgacgccggaaaaagtgaatgacgccatcttctattatgcccgcttcgaggtaccgaacccgcaggggatcctgcgcctcgacatgaccgcgcaggtgcacattcagctggctgaggtgaagaacgtgattactatcccgctgagcgccctgggcgacgcggtaggcgataaccgctaccatgttcgactgttgcgcaccggtgaggtcaaagagcgtgaggttatcattggcgcccgcaatgataccgacgtcgcagtggtgcaaggtctggaagagggcgacgaagtgatcgtcggcgagagcgcgagcggggcggcaaaatga

SEQ ID NO: 4911 - DNA, 705 bp, Klebsiella pneumoniae
ccagcgtgcgacgcgcttcgaacggagaccaggctgatgctcgactatttacccgaactgctgaaaggactgcataccagcctgacgctgaccgtggcgtcgattatcgtggcgctgatcctgtcgctgatcctcaccattatcctgaccctgaagacgccggggctggtatggatagttcgcggctatatcaccttgtttaccggtacgccgctgctggtgcagatattcctgatctactacggcccgggacagtttccttcgctgcaggattatccgtggctgtggcatcttatctccgagccgtggctgtgcgccctgatcgctctgtcgctcaacagcgccgcctacaccactcagctgttttatggcgccatccgggcgatccccgacgggcaatggcagtcctgcagcgcgctggggatgagtaaaaaggatacactggcgatcctgctgccgtacgcctttaagcgtgcgctatcgtcctattccaacgaagtggtgctggttttcaagagtacctctctggcctacaccatcacgctgatggaagtgatgggccacggccagctgctgtacggacgcacctacgacgtgatggtgttcggcgccgccgggattatctatctcatcgttaatggactgctgacgctgctgatgcgcctggtggaacgcaaagcgctggccttcgagcgacgtagctag

SEQ ID NO: 4912 - DNA, 246 bp, Klebsiella pneumoniae
tcccggcgcctgccttcctgtgatatgctgctgagaaatctatccggtccatcaggaggaaacatggatcaccgtttacttgaaatcatcgcctgcccggtctgtaacggcaagctgtattacagtcaggataagcaagaacttatttgcaaacttgatagcctggcgtttccgctgcgcgacggtatcccggtgctgctggagacagaggcgcgtccgctggcgctagaagagagtcactcatga

SEQ ID NO: 4913 - DNA, 219 bp, Klebsiella pneumoniae
atggccaaagaagacaatattgaaatgcagggcaccgtacttgaaacgttgcctaacactatgttccgcgtagaactggaaaacggtcacgtggtaaccgcgcatatctccggtaaaatgcgtaaaaactacatccgcattctgacgggcgacaaagtgactgttgagctgaccccgtacgacctgagcaaaggccgcattgtcttccgtagtcgctga

SEQ ID NO: 4914 - DNA, 900 bp, Klebsiella pneumoniae
tcgacaatggaacagttgcgaaccgaactcagtcatcttcttggcgaaaagctaagccgggtggagtgtgtcagtgaacaagccgctacggcgctgtggttcctgtacgatgcgcagggaaacccgatgccgctgctggcgcgaagtttcaccacgcccggcgtggcgcggcagctggcatggaagatctcgaccctggcgcgtaatggtacggtgcgtatgccggtggtttatggcgtcatgacgcacgaagaacatcccggaccagatgtgctgctgcttgagcgcctgcgcggcgtaccggtggaggcgccgacgcgcaccccggcgcgctgggagcaactgcaggagcaaatcgtcgaggggctgctggcgtggcatcggcaggacagtggcggctgcgtgggaatggtcgacaatacccaggaaaacctgtggccgaactggtaccgccagcgggtagagatattgtggagcaccctgaacctgtatcaggacaccggtctcaccatgcaggataagcgccttttgttccgctcccgcgagtgtcttccggagctattccgcgatttcaatgataatgctgtgctggtgcatggcaacttcactctgcgcagcatgctaaaagatccgcgcagcgatcagctgctggcgatggtggggccggggatgatgctgtgggcgccacgcgagtatgaactgttccgccttgctgaaggcggccaggcggaacagctgctgtggcgctacctgcagcaggcgccagtttccgaggcctttgtctggcggcgctggctttatctgctgtgggatgaggtggatagtctggtcaacaccgggcgctttgatcgcgcccgttttgacctcgctgcaaaatcactcctgccctggctcgcctga

SEQ ID NO: 4915 - DNA, 1290 bp, Klebsiella pneumoniae
agtttgatggaatccctgacgttacaacccatcgcacgcgtagagggcaccgtgaacctgccaggttcgaaaagcgtctccaaccgcgcgctgctgctggctgccctggcccgcggcacgacggtgctgaccaacctgctggacagcgacgatgtgcgccatatgctgaatgccctgagtgcgctgggggttcaatataccctgtctgccgaccgcacccgctgcgaagtgaccggcaacggcggcccgttgcgctctgccgcggcgctggagctgttccttggcaacgccggtaccgcgatgcgtccgctggcggcggctctgtgccttggctgcaacgatatcgtgctgaccggcgaaccgcggatgaaagagcgtccgatcggccatctggtggataccctgcgtcagggcggcgctcagatcgactatctggagcaggaaaattatccaccgctgcgcctgcgcggcggttttcagggcggcaacgtcgaggttgacggcagcgtctccagccagttcctgaccgcgctgctgatgaccgcgccgctggcgccgcaggataccgtcatcgtcattaagggcgatctggtgtcgaaaccctatatcgacattacgctgcacctgatgaaaaccttcggcgttgaggtggacaatcagtcttatcagcgatttgtggtgcgcggcaagcagcagtatcagtcgccgggagattacctggtggaaggcgatgcttcctcggcctcgtatttcctcgccgctggcgccattaagggcggcacggtaaaagtcaccggtatcggccgcaacagcgtacagggcgacattcgtttcgccgacgtactggagaaaatgggcgccaccgtcacctggggcgacgatttcatcgcctgcacccacggcgaactcaaggcggtcgatatggatatgaaccatatcccggacgccgcgatgaccatcgccaccgccgcgctgttcgcgcaagggaccactaccctgcgcaatatctacaactggcgggtcaaggagacggaccgtctgttcgccatggcgaccgagctgcgtaaagtgggcgccgaggtggaagagggggaagattatatccgcatcaccccgccggcaaagttgaagtacgcagaaatcggcacctataacgaccaccggatggcgatgtgcttctcgctggtagcgctgtctgatacgccggtgaccatccttgatcccaaatgtacggccaaaacgttccctgactactttgagcagctggcgcggatcagtaccctcgcctga

SEQ ID NO: 4916 - DNA, 801 bp, Klebsiella pneumoniae
  unsure (338): Identity of nucleotide at the above locations are unknown.
tggcaatcggactttccggctcaggaattggctgataccaggaggccaacagctcgcgttcgcgcgcccgcttctcttccacttcctcgaaataatagagcggcggacgtttcacttcctcctgcacgacctcgggctctggctccggtgggggaactggcgcgctttgcggctgatacgccgctggctccggctgatacggctgcggcgcgggctgaccggcatgcggatcgtaagccggctgctgatacggcgctggctcaggctgataggtctgcggcgcaggttgaccggcatagggatcgtaagccggctgctgatacggcgctggctcaggntgataggcttgcggcgcaggttgaccggcatgcggatcgtaagtcggctgctgatacggcgctggctccggctgataggcctgcggcgcgggctgaccggcatagggatcgtaagccggctgctgatacggcgctggctcaggctgataggcctgcggcgcaggttgaccggcatacggatcgtaagccggctgctgatacggcgctggctcaggctgatacgcctgcggcgcaggttgaccgacacgcggatcgtaaaccggctgttgatacggcgctggctcaggctgatacgcctgcggtgcggtttgccccgctggcggctgataagcagcctgctggaacggagcgggttcaggctgatacgcctgctgcggcggatagctggcttccggctgataagctggcgcagcgccgtgatggcccaccggtgattctgcccacgcctgcggcgcggcagtag

SEQ ID NO: 4917 - DNA, 1185 bp, Klebsiella pneumoniae
tgtttacaggagcagagaatgaatcagcaacagctaaagcagcagcttatcgcctggcgtcactatttgcatgcccatccggaaagcgccttcgaggagcagaatacttcacggtttattgccgaaaagctcgaagctatgggcattgaggtgcaccgcgatattggcaaaaccggggtggtggggagattgaaatgcggcgacgggaagggcgttatcgctattcgtgccgatatcgatgccattcaattgtccgaacagggagactggtcttaccgctccatgaccgccgagcggatgcacggctgcggacatgatggtcatacctgcattgcgctgggcgcggcgcagttgctattgcagcggcagaattttaacggcacggtctgctttgtttttcagcctgctgaggaacctggctatggcgccagagcgatgatggacgatggcgttattgaacgctttggcatagaggaaatctacggtctgcataatatgccgggtatgaaagccgggactatcgccacgcgagtcggtggcattatggccagtgaagataactttattattcgtattaaagggcagggagcgcatgcggcgcggccgcatatggcgaaagatccgctggtcattgcggcggaaatcatcctggctttgcagacaattgtttcgcgaaatgttgatccgaacgtgccagcggtcatttcctgtactgaactgcacaccgatggcatccgcaatgcgattccgacgcacgtcgaaatcaaaggggatacgcgcagctttgcaccggaggtgcagatgctgctcgaagaacgaatgcgtaccattagcgaagcgatttgcgcgatgcacggtgcgacgtgccagttcagctatacccatgaatttgcgccaacggtgaactggcagcaatgcgttgatgtggcggtcaccgctgcgattaacgtggtaggggctgagaaggtggacggcaacgtcgcacagatgatgatttcggaggattttggcgcttttctgcaaaaaatccccggctgtttcatctttttaggcaacggcgatagttcagatgctcagggcaatacaccgttgcataatgcctggtacgactttaatgatgagatattgctaactggcgcggagtattttgccgaggtcgtcagaacccgtctgccgcaggagtga

SEQ ID NO: 4918 - DNA, 1644 bp, Klebsiella pneumoniae
caaagattactcgcctttcgctgctttgaacgcttcagccatagcgttgttggagaagttcgcgtcttcctgcttgttcacggtagcgatagcgtctttttcttccgcttcgtctttcgcacgtacagacaggctcactacgcggttcttacgatccacgccggtgaatttcgcttcaacttcgtcgccaacgctcagaaccagagttgcgtcttcaacgcggtcacgggatgcttcagaagcacgcaggtaaccttctacgccgtcagccagttctacggttgcgcctttagcgtcaactgcagtcactttaccaacaacgatagcgcctttcttgttcagagcaacgtagttgttgaacggatcttccgcgagctgtttaacgcccagggagatacgctcacgctctgcgtcaacctgcagaacaactgctgcgatttcgtcgccttttttgtattcacgaactgcttcttcgcctgcaacgttccaggagatgtcagacaggtgaaccaggccgtcgatgccgccgtccaggccgatgaagataccgaagtcagtgatagacttgattttaccttcaacacggtcgcccttgttgtgggtttccgcgaactgctgccatgggttagatttgcactgcttcagacccagggagatacgacgacgctcttcgtcgatatccagaaccattacttccacaacgtcgccaacgttaacaactttggacgggtggatgtttttgttggtccaatccatttcggaaacgtgaaccaggccttcaacgccctcttcgatttcaacgaagcagccgtagtcggtcaggttggtcacgcgaccagtcagtttggtaccttccggataacgtttagcgatagctacccacggatcttcgcccagctgtttcaggcccagggatacacgggtacgctcgcggtcgaacttcagcactttaacagtgatttcgtcgccaacgtttacgatttcgctcggatgcttaacgcgtttccaggccatatcggtgatgtgcagcaggccgtcaacgccgcccagatcaacgaatgcaccgtagtcagtgaggttcttaacgatacctttgacttccatgctttcctgcaggttttccagcagctgatcgcgctctgcgctgttttcggattcgataacggcacgacgagaaacaacaacgttgttacgcttctggtccagcttgatgactttgaactcaagctctttgccttccaggtgcagcgtgtcgcgcaccggacgaacgtctaccagggaacccggcaggaacgcacgaataccgttcagctcaacagtgaagccacctttaactttgccgttgataacaccggtaacagtttcagcgtcttcgtaagctttctccagcgtgatccaagcttcgtgacgtttagctttctcacgggacagcagagtttcaccgaagccgtcttctactgcatccagagcaacgtcaacttcgtcaccaacctggatttccagctcgccctgggcgtttttgaactgctcagccgggatggcggactcagatttcagaccggcgtcaaccagtactacgtctttgtcgatagcaacaacaacaccacgaacgatggaacccgggcgggtttcgatttcttttaa

SEQ ID NO: 4919 - DNA, 1911 bp, Klebsiella pneumoniae
ataatgtcactgattagtatgcacggcgcctggctttccttcagcgatgcgccgctgctggataatgccgagctgcatattgaagataacgaacgcgtctgcctcgtcggacgcaacggcgccggtaaatctaccctgatgaagatcctcaaccgcgaacaggggctggatgacggacgcatcatttatgaacaggacctgatcgtggcgcgtctgcagcaggatccgccgcggaacgttgctggtacggtatacgattttgtcgccgaagggatcgccgagcaggcggcttatctgaaagcctaccatgacgtgtcgcatcaggtgatgaccgatccgagcgacaaaaatttaaatgaactggcgcgcctgcaggagcagctcgataacctgggactatggcagctggacagccgcattaacgaagtgattgagcagctgggccttgacgccaatgcgcagctggcgtcgctgtccggtggctggctacgtaaagcggcgctgggccgcgccctggtcagtgggccgcgcgtgctgctgctggatgagcccactaaccacctcgatatcgaaaccatcgactggctggaaggtttcctgaaaacctttaaaggcacgattatctttatttcgcatgaccgttcctttatccgcaatatggcgacgcgcattgtcgacctcgatcgtggcaagctggtgacctatccgggaaattacgatcagtatctcctcgataaagaagaagccctgcgggtcgaagaactgcagaatgcggaatttgaccgcaagctggcccaggaagaggtgtggatccgtcagggtatcaaagcgcgccggacccgtaacgaaggccgagtccgcgcgctgaaggcgatgcgccgcgagcgcggtgagcgccgggaagtgatgggcagcgcgaagatgcaggttgaggaggcttcccgttccggcaaaatcgtctttgagatggaaaacgtcaactatcaggttgacggcaaagtgctggtgaaggatttctccgcacagatccagcgcggcgacaagatcgccctgatcggccccaacggctgcgggaaaaccacgttgctgaagctgatgctcggccagctgcaggccgacagcgggcggatccatgttggcaccaagctggaagtcgcctacttcgaccagcaccgcgcggagttggatccggataaaacggtgatggacaacctggcggaaggcaaacaggaggtaatggttaacggtaagccacgtcatgtgctgggttatctacaggacttcctgttccatccgaaacgagcgatgaccccggtacgtgcgctttccggaggggaacgtaaccgcctgctgctggcccggctgttcctgaaacccagcaatctgctgatccttgatgaaccgactaacgacctcgatgttgaaacgctggagctgctggaagagctgatcgatggctatcaggggaccgtgatgctggtgagccacgatcgtcagtttgtcgacaataccgtgaccgagtgctggatcttcgaaggcggcggtcgtattggccagtacgtcggcggctatcacgacgcccgcggtcagcaggcccagtctttggcgcaaaagcagacggtcgttaaaaaaacgacggaagtcgctcagccaaaagcagaaactgtcaaacgcggcgggaacaaactaagctataacctgcagcgcgagctggaacaactgccgcagaagctggaggctctcgaggccgaactgcagacgctgcaggatcaggttgccgatcccgatttcttcgggcaaccgcacgatcgcacgcagcaggtgctggcgcagctggccgaagcggagcaggcgctggaagcggcctttgaacgctgggaatatctcgaaggattaaagaacggcgcctga

SEQ ID NO: 4920 - DNA, 1722 bp, Klebsiella pneumoniae
atgcgcgcacttttaccctatctggcgctctataaacgccataaatggatgctgctgcttggcgtcgtgctggccattgtgaccctgctggccagcatcggcctgctgacgctctccggctggttcctctccgcctcagcggtggtgggcgtcgccgggatctacagttttaactatatgctgcctgccgcgggcgttcgcggcgcggcaattatccgtaccgccgggcgctactttgagcgcctggtcagccacgacgctacctttcgcgtgctgcagcacctgcgcgttttcaccttcagcaaactgctccccctctctccggcggggctggcgcgctttcgccagggtgagctgctcaaccgggtggtggccgacgttgacaccctggatcatctctacctgcgggtcatttcgccgctggtcggcgcgctggtggtgattgtggtcgtcacctgcggattaagtctgctcgacgtcaccctcgcgctgacgctcggcggtatcatgctggcgaccctgctggttatgccgccgctgttctatcgcgcaggtaagccagccggcgaaagtatgacgcagctgcgcggccagtatcgccaacagctcaccgcctggctgcagggtcaggcggagctgatggtatttaacgccagcgaccgctaccgcgcacaaatggaaaagaccgagctgagctggcaggatgcacagcggcgccaggccgagctgaccgcgctttcgcaggcggtaatgctgttaatcggtggcatcgccgtggtggccatgctctggctggcctcagacggcgtcggcggcaatagtcagcccggggcgctgatcgcgctattcgtattctgcgcgctggcggcttttgaagccctggcgccggttactggcgctttccagcatttaggccaggtgatcgcctccgcgcggcggatctcgcagattaccgaccagcagccggaggtcacctttgtcgaagatgaagccagttcgccagcgcaggtggccctaacgcttcgggaggtcactttccgctatcctcagcagccctcccctgccctggagaatatttccctgcagattgccgccggagagcacatcgccattcttggccggaccggctgcggaaaatcgacgctgttgcagttgcttacccgcgcctgggacccgtcacagggagagattctgctcaacaatcagccgctctccggcctcagcgaagccactcttcggcaggcaatgagcgtagtgccgcagcgcgtgcacctgttcagcgccaccctgcgcgacaacctgctgctggcggcgcctgaagcggatgacgctcatctcagcgctacccttgagaaggtgggcctcgaaaaactgctgcaagatggtggtcttaacggctggctgggcgaaggcgggcgtcagctctccggcggcgaactgcgccgactggccattgcccgcgcgctgctccatgatgcgccgctgatgctgctcgatgaaccgacagaaggtctggatgcggccaccgaaagccagatcctgcatctactggcagatgtcatgcgcgacaaaaccgtgctgatggtgacccatcgcctgcgggacctggcgggttttaatcagataatagtcatggacaacggccagataattgagcaaggtagtcacgcggagctgctcgctaaacagggccggtacttccagtttaaacagcgtctgtag

SEQ ID NO: 4921 - DNA, 234 bp, Klebsiella pneumoniae; identical to SEQ ID NO: 2064

SEQ ID NO: 4922 - DNA, 489 bp, Klebsiella pneumoniae
tcacaggcttgcaggacgagatatatgatgaaacttgacgcatgggataaaaaaattcttacgctcttgcagcgtaataatcgcttgtcgcaacgggagatcgccgatcggatcagcctgtctccttcggcagtcaatcggcgtatcgctgcactggaggatgcaggggtgattaaaggcagtgttagcttagtggacgccagtaaagtgggaagaccaatcaccattatggtgcaggtgaccattgagaatgaacgtctcgatctgcttgaggaggataaacagcgtttcgtaacctgtccgcaagtgcagcaggtctactatgtcactggcgacttcgatttcctgctcgtgatcaacgtccgtgatatggcggaatacgaagcgctaacccgtgaactcttttttgcctcgggaaatatcaagtctttccggaccatcgtgtcgatgcaaaatgcgaagcaggaaatgacggtcattatcgagtaa

SEQ ID NO: 4923 - DNA, 1209 bp, Klebsiella pneumoniae
gggctccgttgtaagcatgaacgatggcgaaagctgggcttattttgcccaaaacgccgctttcgcccgctgcagtttttcataggctttcagcagcgactgatgggccgggaaggcctgcagatcgctatcgaccgcctggagaccatagaacggcgcttccccgctcagcgccgcgctggcggcttcgaccgcgtcggcgccgtacatacggatgaaggcgttcaggtactgcagcggctgacgctcttcttcctggctcagcagcagcagggtttgcagacagcgatagtagttcgcgcgctccgcgctgaagaccgaagcattaaattccatggtccactcggtccagatcagcgcctgttccagatcgccgccggccagggccagcatcgctttcagctcgccgacgcgcagagtataccagccgttgtcttttccggtggcgagccccagcagttcgcgaacgcgggtgaaatcatccagaccttcatcgtccatctgctcgatcagcgccaggtaatcttctttatcccactcgctgcccggcagggacagaatggtgtcccgcagatgagcgcccatgctgttgttcgccagccacaggtcttccgccgggtatatgtccgacatccccgggacgatgatacggcaggcgtaaacgcccaggtgctcgtagtcggcgatgtacacttctttatcttcggccttgaagatggccatcagggtggcgaactcttcttcggtagtaccagagaagctccagtcaacgaatggatagtcggcgtcctgcttgaacatatcccaggagatcaggccgctggagtcgataaagtgggtttcgaggttcgcgtgctcggcgacctcttcgtcatcgaaggttggcggcgtgaagacgtcgaggtctttcaggctgcggccctgcagcagttcggtgacggttcgctccagcgccacgccaaagtccgggtgggcgccgaaggaggcgaagcaggtgccgttagccgggttaaacagcacgacgcagataaccggatatttgccgcccagcgagccatcataggcaaagatcgggaaaccttcagcttccagtttggcgatcgactccacgacgcccggatagcgcgccatgacttccgccgggatctccggcaggctgatgctttcagcgatgatgcggtttttaatgtgacgttcaaagacctctga

SEQ ID NO: 4924 - DNA, 1014 bp, Klebsiella pneumoniae
cggagaacctgcatgtcggtattgcaactatcgcttaacgaggtgcgccacctccatctcgcggcgcaggggttgttaaagaagccccgacgtcgcgctcgcccgaaagacattctttccaccatccagcagatgtcgctgctgcaaatcgataccatcaacgtggtggcccgcagcccctacctggtgctgttcagccgtcttggcagctatccgcagcactggctggatgagtcgctgcgcaacggcgagctaatggaatactgggcgcatgaagcctgctttctgccgcgcagcgatttcgccctggtgcgccatcgcatgttgaatcccgacaatatgggctggaaataccatcgcgcgtggatggaggagcatgccgggagtattgccgagctggtggcgcatatcgggcaaaacggcccggttcgctcggcggattttacccacccgcgcaaaggcgccagcggctggtgggagtggaaaccgcataagcgccacctggaagggctgttcaccgccggcgaagtgatggtggtggagcggcgcaattttcaccgcgtgtatgatctaacccggcgggtgatgccggactgggacgacgagcgcgacgcgctctcccgcgaagacgcagaggccattatgttgcgcaatagcgcccgtagtctcggcatcttccgcgcccagtggctggccgattactatcgcttgcgccagccggcgctaccgggtctgctggcggcctggcaggaaaaagggctggtggtgccagttaacgtggaagcactcggcgagatgtggctgcatcacgaggcgctggcgcagctggagaccgcgcccggcggtaagctgaccgccagccatagcgccgtgctctcgcccttcgacccggtggtctgggatcggaaacgcgctgagcagctgttcaacttcagctatcgcctggagtgttataccccggcgccgaagcgtcagtatggctacttcgtactgcctctgctgcaccagggataa

SEQ ID NO: 4925 - DNA, 1050 bp, Klebsiella pneumoniae
caaaatcgctgtgctctttttttacgacaacaaattccctacaatcccagcccaatgtatgccaattattatggggatctcatgggcacagccaaacacagtaaactgcttatccttggttctggacctgcgggatacaccgcggcggtctatgccgcacgcgccaacctgcagccggtactgatcaccgggatggaaaaaggcggtcagctgaccaccacgacggaagtggaaaactggccaggcgatccgaacgatctcaccggtccgctgctgatggagcgcatgcacgagcatgccgcaaaattcgaaaccgagatcattttcgaccatatcagccgcgtcgatttgcaaaaccgcccgttccgtctgacaggcgacagcggcgagtacacctgtgacgcgctgatcatcgccaccggcgcttccgcccgttacctgggcctgccttccgaagaagccttcaaaggccgcggcgtttccgcgtgcgctacctgcgacggattcttctatcgcaaccagaaagtggcggtgatcggcggcggcaacaccgcagtggaagaggctctgtatctgtcgaatatcgcctctgaggtacacctgatccaccgtcgcgattccttccgtgcggaaaaaatcctcatcaaacgcctgatggataaagtggcaagcggcaacatcgtgctgcataccgatcgtaccctcgaagaggtgaccggcgaccagatgggcgtcagcggcctgcgcctgcgcgataccaaaaacagcgacaatgtcgagtccctggaagtggctggtttatttgtcgccatcggccacagcccgaacaccgccatctttgagggccagctggagctggagaacggctacatcaaagtgcagtccggtatccacggcaatgcgacccagaccagcatcccgggcgtgttcgccgccggcgatgtcatggaccatatctatcgtcaggccatcacttctgcgggcaccggctgcatggcggcgctggatgcggagcgttacctcgacggtttggctgacgcttgcaaataa

SEQ ID NO: 4926 - DNA, 3762 bp, Klebsiella pneumoniae
  unsure (1044),(1659): Identity of nucleotide at the above locations are unknown.
gcaccacgctgcaacccctgctgcacagcagcggcggcaccatcgcccctgttgtgtatctgggcggccgggctgacgctgttcaccggctggtcgtgggtcagcattgcggaaaagctgggcggcggcatcctgtccgttctcacctttgccagcaaccgtacccgtcgggatgatacctgggtcgatgaaggcgaatacgaagacgacgaggaagagtacgacgacgaagaggcggccaggccgcaggaatcgcgtcgcgcccgtatcttacgcagcgcgctggcgcggcgtaagcgtctggccgagaagtttaccaaccctatggggcgtaaaaccgacgctgcgcttttctccggcaaacggatggatgacggcgaagaggtggtgcaatacagcgccagcggggcgcctgttgccgccgacgatgtactgttttccggcgccagcgccgcgcgtcccgcagaggatgatgtgctgttctccggcgccagcgccgtgcgcccgggcgatttcgacccttacgatccgttgttgaatggccacagtatcgctgagccggtaagcgcagcggcggcggctactgccgcgccgcaggcgtgggcagaatcaccggtgggccatcacggcgctgcgccagcttatcagccggaagccagctatccgccgcagcaggcgtatcagcctgaacccgctccgttccagcaggctgcttatcagccgccagcggggcaaaccgcaccgcaggcgtatcagcctgagccagcgccgtatcaacagccggtttacgatccgcgtgtcggtcaacctgcgccgcaggcgtatcagcctgagccagcgccgtatcagcagccggcttacgatccgtatgccggtcaacctgcgccgcaggcctatcagcctgagccagcgccgtatcagcagccggcttacgatccctatgccggtcagcccgcgccgcaggcctatcagccggagccagcgccgtatcagcagccgacttacgatccgcatgccggtcaacctgcgccgcaagcctatcancctgagccagcgccgtatcagcagccggcttacgatccctatgccggtcaacctgcgccgcagacctatcagcctgagccagcgccgtatcagcagccggcttacgatccgcatgccggtcagcccgcgccgcagccgtatcagccggagccagcggcgtatcagccgcaaagcgcgccagttcccccaccggagccagagcccgaggtcgtgcaggaggaagtgaaacgtccgccgctctattatttcgaggaagtggaagagaagcgggcgcgcgaacgcgagctgttggcctcctggtatcagccaattcctgagccggaaagtccgattgccactaaaccgctgacgccgccgaccactgcgtccaaaccgccagtggagacaaccgtaatctctgcggtagcggctggggtgcatcaggctaccgccgccagcggcggcgcggcggcagcaacctcgtccactgccgctacgccattgttcagcccggcgtccagcggcccacgggttcaggtgaaagagggcatcggtccaaaactaccgcggcccaatcgcgtgcgtgttcctacgcgtcgggaactggcctcctacggcatcaagctaccgtcgcancgggaggcggaacagcgcgcgcggcatgcggagcgcgatccgcattatgatgatgagctgctctcggatgaggaagcggatgctatggagcaggatgaactggctcgccagttcgccgccacccagcagcagcgctacggtcatcgctgggaagacgatcacgcgactgatgaccatgaggccgacgccgcggcagaagcggagctggcgcgtcagtttgccgctacccagcagcagcggtacgctaccgagcagccgccgggcgccaacccgttctcgccggcagattatgaattctcgccgatgaaaacgttggtcaatgacggcccgagcgaaccgctgtttacgcccacgccggaagtccagccgcagcagccggcccagcgctatcaacaaccggcggccgctccgcagcagggttatcaacctgcgcagcatcagccgatacaccatcagcctgtgccgccgcagccgcagtcctatccgactgcgtcgcagcccgtacagccgcaacaaccggttgccccgcaggggcatcagcctgccgcccctgcgccgcaggagagcctgatccacccgctgctgatgcgtaatggcgatagtcgaccgctgcaaaagccgaccacgccactgccgtcgctggatctgcttaccccgccgccgagtgaagtcgagccggtggatacctttgctctcgagcagatggcacgcctggtggaagcgcgactcgccgatttccgcattaaagcggatgtggtgaactactcaccggggccggtgatcacccgcttcgaactgaatctggcgcctggcgttaaggccgcacggatctctaacctgtcacgggacctggcgcgatcgctgtcaacggtcgccgtgcgcgtggtggaggtgatcccgggcaaaccgtatgtcgggcttgagctgccgaataaaaaacgccagaccgtctacctgcgtgaagtgctcgacaacgccaagttccgtgataacccatctccgctcaccgtggtgctgggcaaagacatcgctggcgatccggtagtagccgatctggcgaaaatgccgcatctgctggtggccggtaccaccggttccggtaagtctgttggcgtcaacgccatgatcctcagcatgctctacaaggcgcagccggaagatgtgcgtttcattatgatcgacccgaaaatgctcgagctgtcggtctacgaaggaattccgcacctgctgacggaagtggtcaccgacatgaaagacgccgccaatgcgctgcgctggagcgtcaatgagatggagcgccgctacaagctgatgtcggcgctgggcgtgcgtaacctcgcgggctacaacgagaagatcgccgaagccgcgcgcatgggacgtccgatcccggatccgtactggaagcctggcgacagcatggacgccgtacatccggtgctggaaaaactgccgtacatcgtggtgctggtggatgaattcgccgatctgatgatgaccgtcggcaaaaaggtggaagagctgatcgctcgcctggcgcagaaagcgcgcgcggcggggatccacctggtgctggcgacacagcgtccgtcggtagatgttattaccggcctgattaaggccaacatcccgacgcgcatcgcctttaccgtgtcgagtaaaattgactcacgtaccattctcgatcagggcggcgcggaatcgctgctgggtatgggggatatgctttactccgggccgaactctaccacgccggtgcgtgtccacggggcgtttgtgcgcgaccaggaagtccacgccgtggttcaggactggaaagcccgcggtcgcccgcaatatgtggatggcattacctccgacagcgaaagcgaaggcggcggtggcggcttcgatggcggggaagagctggatccgttgttcgatcaggcagtcaactttgtgaccgagaagcgcaaagcgtcgatttccggggttcagcgtcagttccgcatcggctataaccgtgccgcgcgtattatcgaacagatggaagcgcagggtatcgtcagcgagcagggccataacggtaaccgcgaagtgctggcgccgccgccctttgaatga

SEQ ID NO: 4927 - DNA, 2298 bp, Klebsiella pneumoniae
gaaggtaggtgttacatgtccgagcttaatgaaaagttagccacagcctgggaaggttttgcgaaaggtgactggcagaatgaagtcaacgtccgtgactttattcagaaaaactacaccccatatgaaggcgacgaatccttcctggctggcgcgactgaagcgaccaccaagctgtgggacaccgtaatggaaggtgtaaaacaggaaaaccgcactcacgcgcctgttgattttgacactgccctggcttccaccatcacctctcacgacgcgggctatatcgagaaaggtctggaaaaaatcgttggtctgcagaccgaagcgccgctgaaacgtgcgatcatcccgttcggtggtatcaaaatggttgaaggttcctgcaaagcgtataatcgcgagctggacccgatgctgaaaaaaatcttcacagagtaccgtaaaactcacaaccagggcgttttcgacgtctataccccggacatcctgcgctgccgtaaatccggcgtgctgacgggtctgccggatgcttacggtcgtggtcgtatcatcggtgactaccgtcgcgttgcgctgtacggtatcgacttcctgatgaaagacaaattcgcccagttcaactctctgcaagcgaaactggaaagcggcgaagacctggaagcgaccatccgtctgcgtgaagaaatcgctgaacaacaccgcgcactgggccagatcaaagagatggccgctaaatatggctatgacatctccggtccggcgaccaccgctcaggaagcgattcagtggacctacttcggttacctggctgccgtgaaatctcagaacggcgcggcaatgtccttcggtcgtacctccagcttcctggatatctacatcgagcgtgacctgcaggcgggtaaaatcaccgagcaagacgcgcaggaaatggttgaccacctggtcatgaaactgcgtatggttcgcttcctgcgtaccccggaatatgatgaactgttctccggcgacccgatttgggcaacggaatccatcggcggtatgggcgttgacggccgtactctggtgaccaaaaacagcttccgcttcctgaacaccctgtacaccatggggccgtctccggagccgaacattactatcctgtggtctgaaaaactgccgctgagcttcaagaaattcgccgctaaagtgtccatcgatacctcttctctgcagtatgagaacgatgacctgatgcgtccggacttcaacaacgacgactacgctatcgcatgctgcgtaagcccgatggttgttggtaagcaaatgcagttcttcggcgctcgcgctaacctcgcgaaaaccatgctgtacgctatcaacggcggcgtggatgaaaaactgaaaatgcaggttggtccgaaatctgaaccgatcaaaggcgacgtcctgaacttcgacgaagtaatggatcgcatggatcacttcatggactggctggctaaacagtacgtcaccgcgctgaacatcatccactacatgcacgacaagtacagctacgaagcctctctgatggcgctgcacgaccgtgacgttatccgcaccatggcgtgtggtatcgctggtctgtccgttgctgctgactccctgtctgctatcaaatatgcgaaagttaaaccgattcgtgacgaagacggtctggctgttgacttcgaaatcgaaggcgaatacccgcagtttggtaacaacgaccctcgcgtcgatgacatggccgttgacctggttgaacgtttcatgaagaaaattcagaaactgcacacctaccgcaacgctatcccgactcagtctgttctgaccatcacctctaacgtggtgtacggtaagaaaaccggtaacaccccagacggtcgtcgcgctggcgcgccgttcggtccaggtgctaacccgatgcacggccgtgaccagaaaggcgcagtagcctctctgacctccgtcgctaaactgccgtttgcttacgcgaaagatggtatctcttataccttctctatcgtgccgaacgcgctgggtaaagacgacgaagttcgtaagaccaacctggcgggtctgatggatggttacttccatcacgaagcgtccatcgaaggtggtcagcacctgaacgtgaacgtcatgaaccgcgaaatgctgctcgacgcgatggaaaacccggaaaaatatccgcagctgaccatccgcgtatctggctacgccgtacgttttaactccctgaccaaagaacagcagcaggatgttattacccgtaccttcactcagaccatgtaa

SEQ ID NO: 4928 - DNA, 996 bp, Klebsiella pneumoniae
gatgcaattcggcgaatgatcgcgcgcatctggtccggggaatcgccgctgtggcgcctgctgctgccgctctcctggctgtatggcctggtgagcggggtgattcgcctcagctatcagctggggtggcaaaaagcctggcgcgcgccggtgccggtggtggtggttggtaacctgaccgctggcggcaatggcaaaacgccggtggtgatttggctggtggagcagctgcagcagcgcggtattcgcgttggcgtcgtgtctcgcggctacggcggtaaagctgaacgctatccgctggtgttggacgacaggaccagtacggcgcaggcgggtgatgaaccggtgttgatccatcagcgtaccggtgccccggtcgctgtcgctccgctgcgcagcgacgcggtaaaagcgttgctcagcgcgcacgatctgcagatgattgtgaccgacgacgggttgcagcactataagctcgcgcgggacagagaaattgtcgttattgacggcgtgcgccgctttggcaacggctggtggctgcctgccgggccgatgcgcgagcgggcgtcgcgcttgcaaagcgttgatgcggttatcgttaacggcggcgtggcgcgtccgggtgagatcccgatgcggctgcgcccagggatggcggttaacctgcttaccggcgaacgtcgcgatgtctccaccttcacgaacgtagtggcgatggccggcatcggccatccgccgcgcttcttcgccaccctcgaaagctgcggcgcccagccggtcaaaaccgtggcgctggcggaccatcaggcgctgagccaggctgatgtcgccgccctggtgaccgccgatcagacgctgctgatgaccgagaaagatgccgtgaaatgtcgcgatttcgccgctgcaaactggtggtatttaccggtcgacgccataatggccgatgaacgcgcacagcggttgcttgcggacttagcgacgttggcgcaacgttaa

SEQ ID NO: 4929 - DNA, 2175 bp, Klebsiella pneumoniae
gcaacccctcggccccgtgaggccctggaagcgtgttcagtggacctggtggcattgagtcaggaacttgaagccttcatcgaactaaccacacccgttctgccagccacggaagaagagcgcgacacccagccgacgctaagcttccagcgtgtgctgcagcgcgccgtcttccacgtacaatcttctggccgcagcgaagtgaccggcgccaacgtgctggtggcgattttcagcgagcaggagtcgcaggccgcctacctgctgcgtaaacatgaagtgagccgtcttgatgtggtgaacttcatttctcatggtacacgcaaagacgagccgagccagtcttccgataacagcggaagccagcctggcaatgaagagcaagccggcggggaggaacgtatggaaaacttcaccaccaacctcaatcagcttgctcgcgtcggcggcattgatcccctgatcggccgtgaaaaagagctggagcgcgcgattcaggtcctgtgccgtcggcggaaaaataacccgctgctggtgggggaatccggcgtcggtaaaaccgcgatcgccgaaggccttgcctggcgtattgtgcagggcgatgtgccggaagtgatggccgactgcactatctactcgctcgacattggctctttgctggcagggaccaaatatcgtggcgattttgaaaaacgcttcaaagcgttgctcaaacagctggagcaggataccaacagcatcctgtttattgatgaaatccacaccattatcggtgcgggggcggcgtctggcggacaggtcgatgcggctaacctgatcaaaccgctgctttccagcggcaagatccgggtgatcggctccaccacttaccaggagttcagcaacatctttgaaaaagatcgtgcgctggcccgccgtttccagaagatcgatattaccgaaccgtcggtggaagagacggtccagattatcaacggcctgaagccgaagtacgaagcgcaccatgatgtgcgttataccgccaaagcggtgcgtgcggcggtagaactggcggtgaaatacattaacgatcgtcatctgccggataaggcgattgacgtcattgacgaagcgggcgcgcgggcgcgcttaatgccggtcagcaagcgtaagaaaacggttaacgtggcggatatcgaatcagtggtggcgcgcattgcgcggatccctgagaagagcgtctcccgcagcgatcgcgacacgctgaaaaacctgggcgaccgtctgaaaatgctggtctttggacaggataaagccatcgaggcgctgaccgaggctattaaaatggcgcgcgccgggctgggccatgagcacaagccggtgggatcgttccttttcgccgggccgaccggggtcgggaaaaccgaagtgaccgtccagctggcgaaggcgttagggattgagctgctgcgctttgacatgtccgaatatatggaacgtcataccgtcagccgtttgatcggggcgcctccaggctacgtcggcttcgatcagggcgggctgctgaccgatgcggtgattaaacatccgcacgcggtattgctgcttgatgagatcgaaaaagcgcatccggatgtgttcaacctgctgctgcaggtgatggataacgggacgctgaccgataataacggccgtaaagcggacttccgcaacgtggtgctggtgatgaccaccaacgccggggtgcgggaaaccgagcgtaaatccattggccttattcagcaggacaacagtccggatgcgatggatgagatcaaaaagatctttacgccggagttccgtaaccgcctcgacaacatcatctggttcgatcatttgtctaccacggtgatccatcaggttgtcgacaagtttatcgtcgagctgcaggtccagctggaccagaaaggcgtctccctggaagtgagtcaggaagcgcgcgactggctggcgacgaaaggctacgatcgggcgatgggggcacgtccaatgggacgcgtcattcaggacaacctgaaaaaaccgctggcgaacgagctgctgtttggctcgctggtcgacggtggtcaggtcactgtctctctggacagcgacaaaaatacgctgacttacgacttccagagcgctccgaagcacaaaccggaagcggcccactaa

SEQ ID NO: 4930 - DNA, 2019 bp, Klebsiella pneumoniae
taccgacgtcgcagtggtgcaaggtctggaagagggcgacgaagtgatcgtcggcgagagcgcgagcggggcggcaaaatgacggcgctgcttgagctgcgagatatacgtcgcagctatccttccggcgacggcagcgttgaggtcctgaaggggatcaccctcagcatccatgcgggtgagatggtggcgatcgtcggggcctccggctcgggaaaatcgacgctgatgaatacccttggctgcctcgacaaacccaccagcggcacctatcgggtggcgggaaccgatatcgcgcagctggatggcgatgcgctggcccgtctgcggcgggaacactttggctttatctttcaacgctaccatctgctgtcccatctgaccgccgcgcagaatgtcgaagtgccggcggtgtatgccggcaatgaacggcgcgcgcgcctggcgcgcgctcatgagctgctggtgcggctggggctgggcgagcgcgccgactatcaaccgtcacagttgtctggcggtcagcagcagcgggtcagtatcgcccgcgccctgatgaatggcggggaggtgatcctcgctgatgaaccgaccggcgcgctggacagccattccggcgaagaggtaatggcgatcctgcaccagctaaaagcgcaggggcacacggtcatcattgtgacccacgatccgcaggtcgccgctcaggcggagcggatcgtcgagatccgcgatggcgagatcgtccgcaacccgcccgccagccgccagggcggcggactgcgcgcccgtccgcaggcggagccttcggcgtggcgtcagtttaccagcggctttcgcgaagcgctggtgatggcctggcgagcgatggcggcgaataaaatgcgtaccctgctgaccatgctcgggattattatcggtattgcctcggtggtgtcgatcgtggtggtgggggatgccgccaagcagatggtgctggcagatattcgcgccatcggcaccaataccattgatgtatatcctggtaaggattttggcgacgacgacccgcgctatcagcaggcgctgaagtatgacgatttgctggcgatccagaagcagccgtgggtgcgctccgccacgccggcggtttcaaaaagcctgcgcctgcgcgccaacaatattgacgttgccgccagcgcggagggggtcggtccacagtattttaatgtctacggcatgacctttagcgaaggcagtaccttcaatgaactgcagctcaacagtcgggcacaggtggtagtgctcgacagcaatacccgtcggcagctgtttcccaataaagcgaaagtggtgggagaggtgattctggtgggcaatatgccggccacggtgattggcgttgcggatgaaaaacagtcgatgttcggcagcagcaaaattctccgcgtctggttgccctacaccaccatggcgggaagagtaatgggccagtcgtggctgaactccatcactgtgcgcgttcatgaaggctacgacagtgaaaccgcagagaaacagctgctgcgtctgctggagctgcggcatggtaaaaaagatgtattcacctggaatatggacagcgtcttgaaaaccgccgaaaggaccacacataccttacagctgttcctgacattggtggcggtgattgccctggtggtcggcgggattggcgtaatgaatattatgctggtgtcggtgaccgaacgaacccgggagatcggcatccgcatggcggttggcgcccgggccagcgatgtgctgcagcagtttctcattgaagcggtgctggtttgcctggtcggtggcgcgctgggcgtagcattgtcgctgatgatagcctttattttacagctgtttctccccggctgggagattggtttttctccgctggcgctgctgacggcgtttctctgttcgacgctgaccggggtgctgtttggttggctgcctgcgcgcaacgcggcgcggctcgatccggtggatgccctggcgcgagaatag

SEQ ID NO: 4931 - DNA, 1584 bp, Klebsiella pneumoniae
acctgcatccgccacgggcactgggaggttggcatagtcatcagggactccttaagcgctaagcagctgctgcatatcttgttccacggtggtcacggaacgcagaccaaacttctcattgaggaccgccagcagatccggtgtgaagaaacctggcgccgtcggaccggtgacgatgtttttcacacccagcgacagcagcgtcagcaggatgacgatcgctttctgttcgaaccaggagagcaccagcgacagtggcagatcgttgacgccacagcccagtttctccgccagcgtgaccgccagaataatcgccgagtaagcgtcattacactgcccggcgtcgaccaggcgcggcagcccttcgatatcgccaaagtccagtttgttgaagcggtatttaccacaggccagggtcaggatcaggcagtcatccggcacgctggtggcgaaatcggtgaagtagttacgctccccgcgggcgccgtcgcagccgccgacgaggaagatatggcgcagtttttcacgactgaccagatcgatcagcgtatccgccgcgccaagcagggtctgacggccaaagccgacggtgatcagatgcgggatttcgctgtacgggaagcccgccatctgctgcgcctgggcaatgaccggggagaagtcttcgccttccagatggttcacacccggccagccgacgatgctgcgagtccagatgcgatcgtcgtaggcgccgacggtcgggtcgatgatgcagttagaggtcatcacgatggggcccgggaagcgggcgaactccacctgctggttttgccagccgctgccgtagttgccaatcagatgtttgaatttacgcagctccggatagccgtgagccggcagcatttcgccatgagtatagacgttgacgccggtgccttccgtctgctccagcaggttatacagatccttcagatcgtggccggagatcaggatgcacttcccttcggtggctttaacgttgacctgagtcggcgtcggatggccgtatttggtcgtttcaccggcgtcgaggatgctcatcactttgaagttcatctggccgatttccatcgaacattcgagcagcgcattcatatccgcaggccaggtgcccagccatgccatgattttatggtactgggcatagatagcgttgtcgtactggccgagcacgtgggcgtgctccatataggccgccgcacccttcagaccgtacaggcacagcaggcgcagaccgagaatattttcgccgatggcggctttatctttattcggggtatagtccgccgcctgacgctgcaggtcgcccagatcgtcgctgaccagctgcaggtcggcgaccgggctgtcgaccgcggcgctggcatcgatcgccaggcattgcgctttcagcgcctcacgcaaggcaattgcctggcgggcgtagccgacgatgcgcggggaatcgaagttaacgttagtcagggtggagaagaaggcgcggggggcaaagctgtcgacctgatgatcgataatgccatattcgcgcgctttaagcgcccaggcggacaggccttgcagtga

SEQ ID NO: 4932 - DNA, 978 bp, Klebsiella pneumoniae
cgccgctgccgtcggcgcactttacccggccgagtatcgttatcaaacctaacgccaatgcccggccgtgtggcgataccaccggttacctggcgaacccgaaggaggtgtgagatgggaaacggatggcatgaatggccgctgatggtctttacggtcttcggccagtgcgtcgtaggcggctttattgttctggcgctggcgctgatgacaggcaagctttcccgtgagcaggagcagcgcgtggtgggcagcatgttcggactgtgggtattgatggggatcgggtttattgcctcgacgatgcaccttggctcgccgctgcgggcctttaattcgctgaatcgcatgggagcctcgtcgctgagtaatgaaatagccagcggggcgatcttcttcgccgtcggcggaattggctggctgctggccgtgtgcaaaaagctgcctgccggcctgcggagcctgtggctggtggtgaccatggtgctgggcgtgattttcgtgtggatgatggtgcgggtatacaacaccatcgacacggtgccgacctggtacaccgtttggacgccgctgagcttcttcctgacgctgtttatcggcggtccactgctgggctacctgctgctgcgcgtcgcaggcgtcgatggttgggcgctgcgcctgctgccggtggttagtttgctggcgctgctggtcagtattatggtggtcgtgatgcagggaagtgaacttgccaccatccgcagctcagttcagcaggcctccgccctggtgccggattacgggttgcttatggcctggcgcgtagtgctgctggcgctggccctggcctgctggtgcgtgccgcagattcgcggtcgcaaaccggcggtctcgctgctcggcctggcctttgttctgatactggcgggagagatgatcggccgcggcgtattctatggcctgcatatgaccgttgggatggctgtcgccagttaa

SEQ ID NO: 4933 - DNA, 507 bp, Klebsiella pneumoniae
ctaaacaaacgcggcgcacgctcgctgtcgccgcgtttcatcacccgatccagtacttcagcctccagctcggccagcttcgccgaaccggtgcgccgcggtcgcgggatatccacgcttaaatcgaggccaatcttcttctcttcaattaacagcacccgatcggccatggccaccgcttcactgacgtcgtgcgtgaccagcaggaccgtaaagccatgctcctgccacagggagacgatcagctcttgcatctccagacgggtgagggcatccagcgcccccagcggttcgtccagcagcagcaggcgcgggcgatggatcagggcgcgggccagcgcaacgcgctgcttctgcccacccgacagcgcggccggccactcctgtgcgcggctttcaagtccgacgctggccaacgcctgcagggcggcgtcgcgccaggcgccttttagccccagccccacgttatcaatcactgttttccacggcagcaggcgcgcatcctga

SEQ ID NO: 4934 - DNA, 2460 bp, Klebsiella pneumoniae
ctgacattgcggtgttttctccagatgtggcccatccggggccgtgttggtgcgcagctcagcggctgcgtcgagtctgttttgacaggtacccaaagtatagataactggcaaagcaggctggggcggggaatgcttgttaaaaaggccccactgatgtggggcctttattgtacgccttttcagtcagacagggaattacatggtctgagtgaaggtacgggtaataacatcctgctgctgttctttggtcagggagttaaaacgtacggcgtagccagatacgcggatggtcagctgcggatatttttccgggttttccatcgcgtcgagcagcatttcgcggttcatgacgttcacgttcaggtgctgaccaccttcgatggacgcttcgtgatggaagtaaccatccatcagacccgccaggttggtcttacgaacttcgtcgtctttacccagcgcgttcggcacgatagagaaggtataagagataccatctttcgcgtaagcaaacggcagtttagcgacggaggtcagagaggctactgcgcctttctggtcacggccgtgcatcgggttagcacctggaccgaacggcgcgccagcgcgacgaccgtctggggtgttaccggttttcttaccgtacaccacgttagaggtgatggtcagaacagactgagtcgggatagcgttgcggtaggtgtgcagtttctgaattttcttcatgaaacgttcaaccaggtcaacggccatgtcatcgacgcgagggtcgttgttaccaaactgcgggtattcgccttcgatttcgaagtcaacagccagaccgtcttcgtcacgaatcggtttaactttcgcatatttgatagcagacagggagtcagcagcaacggacagaccagcgataccacacgccatggtgcggataacgtcacggtcgtgcagcgccatcagagaggcttcgtagctgtacttgtcgtgcatgtagtggatgatgttcagcgcggtgacgtactgtttagccagccagtccatgaagtgatccatgcgatccattacttcgtcgaagttcaggacgtcgcctttgatcggttcagatttcggaccaacctgcattttcagtttttcatccacgccgccgttgatagcgtacagcatggttttcgcgaggttagcgcgagcgccgaagaactgcatttgcttaccaacaaccatcgggcttacgcagcatgcgatagcgtagtcgtcgttgttgaagtccggacgcatcaggtcatcgttctcatactgcagagaagaggtatcgatggacactttagcggcgaatttcttgaagctcagcggcagtttttcagaccacaggatagtaatgttcggctccggagacggccccatggtgtacagggtgttcaggaagcggaagctgtttttggtcaccagagtacggccgtcaacgcccataccgccgatggattccgttgcccaaatcgggtcgccggagaacagttcatcatattccggggtacgcaggaagcgaaccatacgcagtttcatgaccaggtggtcaaccatttcctgcgcgtcttgctcggtgattttacccgcctgcaggtcacgctcgatgtagatatccaggaagctggaggtacgaccgaaggacattgccgcgccgttctgagatttcacggcagccaggtaaccgaagtaggtccactgaatcgcttcctgagcggtggtcgccggaccggagatgtcatagccatatttagcggccatctctttgatctggcccagtgcgcggtgttgttcagcgatttcttcacgcagacggatggtcgcttccaggtcttcgccgctttccagtttcgcttgcagagagttgaactgggcgaatttgtctttcatcaggaagtcgataccgtacagcgcaacgcgacggtagtcaccgatgatacgaccacgaccgtaagcatccggcagacccgtcagcacgccggatttacggcagcgcaggatgtccggggtatagacgtcgaaaacgccctggttgtgagttttacggtactctgtgaagatttttttcagcatcgggtccagctcgcgattatacgctttgcaggaaccttcaaccattttgataccaccgaacgggatgatcgcacgtttcagcggcgcttcggtctgcagaccaacgattttttccagacctttctcgatatagcccgcgtcgtgagaggtgatggtggaagccagggcagtgtcaaaatcaacaggcgcgtgagtgcggttttcctgttttacaccttccattacggtgtcccacagcttggtggtcgcttcagtcgcgccagccaggaaggattcgtcgccttcatatggggtgtagtttttctgaataaagtcacggacgttgacttcattctgccagtcacctttcgcaaaaccttcccaggctgtggctaa

SEQ ID NO: 4935 - DNA, 276 bp, Klebsiella pneumoniae
ttatcgcagcgccggagaacatcagtccggaaaaaggcactacctataaactggtgcgtaaggtgttcaataatcacgaacatgtgcacgtcgtggggctgcgcgggtttgccgcgccgctgccggaagcgctgccgggaacggccgacgcctcgtgacgatgcagctcactactggcgggtaagcgctgaaaagggcaacgttaagttgccctttttgctatccagcttgctatgccagggtggtataatctttaagcttctttacattaggtaa

SEQ ID NO: 4936 - DNA, 879 bp, Klebsiella pneumoniae
aaatcaaggcggccttccccggaaagccgcgatgaaccatacaacatggacgcgtccaatgttgaaggttcccagaccacaaaaacccgtctggcgttcgcgggcctgaaagcgggcgaatacggttcattcgactatggccgtaactacggcgcgatctacgacgtcgaagcggcaaccgatatgctggttgaatggggcggtgacggctggaactataccgacaactacatgaccggtcgtaccaacggcgtcgcaacctaccgtaactccgacttcttcggtctggttgacggtctgagcttcgcgctgcagtaccagggtaaaaacgaccatgaccgtgcgattcgcaagcagaatggcgacggcttcagcaccgcagccacctacgcgttcgacaacggtatcgcactgtctgcaggctactccagctctaaccgtagcgtcgatcagaaagctgacggcaatggcgacaaagccgaagcctgggcgacctctgcaaaatatgacgctaacaacatctatgcggccgtcatgtactcccagacttacaacatgactccggaagaagataaccacttcgccggtaaaactcagaactttgaagcagttgtacagtatcagtttgacttcggcctgcgtccgtccatcggctacgtacagaccaaaggcaaggacctgcagtcgcgtgctggcttctccggcggcgatgcggatctggttaaatacatcgaagtgggtacctggtactactttaacaagaacatgaacgtctacgctgcgtataaattcaaccagctggacgacaacgattacaccaaagcggctggtgtcgccactgacgaccaggcggccgtgggtatcgtttaccagttctaa

SEQ ID NO: 4937 - DNA, 942 bp, Klebsiella pneumoniae
tgtcatgggcgctattctcatcatgcaagggctgcatcgttcatgttttcgggactctttattattctgttgccgctggtcgtcggctatttactgcctcttcgtcactcctccgcgctaaagctgataaaccgcatgctcagctggattgtctatgtaatccttttttttatgggtatcagcctggcgttcctcgacaatctggccagcaacctgctggcaatattgcattacgccgcggtgagcgtggttatcattttactgtgtaatatcgccgccctgctgtggctggaaagtaaaatgccatggcgcagtcagcatcgtcaggagaaattaccctcgcgcctggccatggccctggaatcgctgcagctgtgcggtgtggtcgtgctcggttttctgctcggtctgaccagactgccttttttacagcacgcgacagaagccagcgaatatacgttgatttttctcctgttcctcgtcggtatccaattacgcaataatggaatgagtctgcgacaaatagtccttaaccgccggggaatgatcgtcgccgtggtggttacggccagttcattactcggcgggatacttaacgcctttattctcggtctgccgttaaagaccggtctggcaatggccagcggtttcggctggtattcgctctccggtattttactcaccgaatcctttggcccggtgatcggtagcgcggcgttctttaacgatctctgtcgcgagctgctggccatcatgttaattccgggccttattcgccgcagccgctccacggcgctggggctgtgcggcgccacctcgatggacttcaccttaccggtactgcagcgttccggcggcgtcgaaatcgtccctgccgccatcgtgcacggttttctgcttagtttgctggtcccgatcctgatcgccttttttaccgcctga

SEQ ID NO: 4938 - DNA, 927 bp, Klebsiella pneumoniae
tcgcccgggcggacagtgcgctgtatcaggcgaaaaataaaggacgtaatcaatggtcttattaacccggagacgctgccgggcaagggagaagggatgaaacggatgatgcggatcgtgctgctggcgctgctgctaaccggctgcgctggggaaaagggcattatcgatcgcgacggataccagctggacacccgtcatccggcgcaggctgcctatccgcgaataaaggtgttagtgatccactatacggctgacaattttgatgtctcgctggccacgttgaccgataaagaggtcagctcccactatttaattcctgaacagcccccgcgttatcagcataaaccgcggatctggcagctggtgccggaagaggatttagcctggcacgccggggtaagctattggcgcggcagtacgcgcattaacgatacctccattggcattgagctggagaaccgcggctggcagaagacggcgggcgtcaaaagttttaccccctttcatccggaacagattgcagctctgatcccgctggcgcgcgatatcatcgcccgctaccacatcgcgccgcagaatgtggtcgcccatgcggatatcgccccgcagcgcaaagacgatccggggccgttattcccctggcaacagctggcgcagcaggggatcggcgcctggcctgacgagcagcgggtggccttttatctcaacgggcggccggccagcgagccagtggaccccgaaatcgtactggatttgctctcgcgctacggctatcaggtgacgccggagatgacccccgcgcagaagaagcgggtgattatcgccttccagatgcacttccgtccgcagcgctgggatggggtagcggatgcgcaaaccgaagcgatagctgaggcgctgttagaaaaatatggccagggttag

SEQ ID NO: 4939 - DNA, 924 bp, Klebsiella pneumoniae
tcgaagcgcagctggcggtctataaagagaaaggaataccgctggatctcggcctggtggcgcgggagttcctggcgcagtatccgcgcgggcgtcacttcgacgtggcgcggatcgtcgtggatcaggcggtacagctgggcgtcgcccaggcagatttcaccggactgccggcaaaatggcagccgattaatgattacggagccaaggtacaggcgcatgtcattgacaaatattgaacaagtgatgccggttaagctggcgcaggcgttggccaatccgttatttccggcgctggacagcgccctgcgcgcgggccgtcatatcggtctcgacgagctggataatcacgcatttttgatggattttcaggattacctggaagagttttacgctcgctataacgtcgagctgatccgcgcgccggagggattcttctacctgcgcccgcggtccaccacgctgatttcgcgctcggtactgtccgagctggatatgatggtgggcaaaattctttgctatctctatctcagcccggagcgcctggcgaacgaagggatttttacccagcaggagctctatgacgagctgctgaccctggccgatgaatccaggctgctgaagctggtgaacaaccgttccaccggttcggatctggaccgccagaagctgcaggaaaaaatgcgggcctcgcttaaccgcttacgccgtctggggatggtgtggtttatgggccacgatagcagcaagtttcgcattaccgaatcggtattccgctttggcgccgatgtgcgcgccggcgacgacccgcgcgaagcgcagcgccgtctgatccgcgacggggaagcgatggccctggaaaatcacctgcagctcaatgatgagaatgaagaaaaccagccggatagcggggaggaagagtaa

SEQ ID NO: 4940 - DNA, 1146 bp, Klebsiella pneumoniae
agttataggcttatttttggaacccggaggcagcgtatggtaacgctatcgcgactttttattcatcctgttaaatccatgcgcggcatgggcctgacccacgcctttgctgatatcagcggcctggccttcgatcgcctgtttatggtcaccgaaaccgacgggacctttattaccgctcgccagtttccgcaaatggtgaaatttattccggcgccgctgcatgatggccttcacctgaccgcaccggacggcagcagcgccgtggtgcgttttagcgatttcgccacgcaggccgagccgaccgaagtctggggcaaccattttaccgccctcatcgcgcccgccgccgttaaccagtggctcagcggctttttcaagcgcgatgtccagctgcgctggctggggccgcagctaacccgccgggtaaagcgccatgatgcggtgccgctctccttcgccgacggctacccttacctgctggctaacgaggcctccctgcgcgatctgcaacagcgctgcccggccagcgtaagcatagaacagtttcgccctaaccttgtggtcaccggcgcggcggcctgggatgaagatagctggaaagtgatccgcatcggcgaggtggtgtttgacgtcgctaagccgtgcagccgctgcatttttaccaccgtcagcccggagcgcggtcagaagcatcccgccggggagccgctggaaaccttaaagcgttttcgtaccgcgctggacaatggcgatgtcgattttggccagaacctgattgcccgcaacagcggggtgatccgggtgggagatgaagtggaaatccttacccgcggcccggcgaaagcctacggggcaggtgaaagcgacgataccccggctcccgaggcgcagcagcaggctacggttgccatcgaatggcagggtcaacagtttaccggcaataaccagcaggtgctgctggagcaactggaacaacagggcattcgcgtaccctattcgtgtcgggcggggatctgcggcagctgccgcatccggctggaagagggagaagtgagtccgttaaagaaaaacgcggttgccggagatgggactattctcgcctgcagctgtgtaccgaaaacagcgctacgcctggcgccttaa

SEQ ID NO: 4941 - DNA, 1311 bp, Klebsiella pneumoniae
cgggctgaaaggacatcagcccgcgggatgacaaagttttactcaggcgagggtactgatccgcgccagctgctcaaagtagtcagggaacgttttggccgtacatttgggatcaaggatggtcaccggcgtatcagacagcgctaccagcgagaagcacatcgccatccggtggtcgttataggtgccgatttctgcgtacttcaactttgccggcggggtgatgcggatataatcttccccctcttccacctcggcgcccactttacgcagctcggtcgccatggcgaacagacggtccgtctccttgacccgccagttgtagatattgcgcagggtagtggtcccttgcgcgaacagcgcggcggtggcgatggtcatcgcggcgtccgggatatggttcatatccatatcgaccgccttgagttcgccgtgggtgcaggcgatgaaatcgtcgccccaggtgacggtggcgcccattttctccagtacgtcggcgaaacgaatgtcgccctgtacgctgttgcggccgataccggtgacttttaccgtgccgcccttaatggcgccagcggcgaggaaatacgaggccgaggaagcatcgccttccaccaggtaatctcccggcgactgatactgctgcttgccgcgcaccacaaatcgctgataagactgattgtccacctcaacgccgaaggttttcatcaggtgcagcgtaatgtcgatatagggtttcgacaccagatcgcccttaatgacgatgacggtatcctgcggcgccagcggcgcggtcatcagcagcgcggtcaggaactggctggagacgctgccgtcaacctcgacgttgccgccctgaaaaccgccgcgcaggcgcagcggtggataattttcctgctccagatagtcgatctgagcgccgccctgacgcagggtatccaccagatggccgatcggacgctctttcatccgcggttcgccggtcagcacgatatcgttgcagccaaggcacagagccgccgccagcggacgcatcgcggtaccggcgttgccaaggaacagctccagcgccgcggcagagcgcaacgggccgccgttgccggtcacttcgcagcgggtgcggtcggcagacagggtatattgaacccccagcgcactcagggcattcagcatatggcgcacatcgtcgctgtccagcaggttggtcagcaccgtcgtgccgcgggccagggcagccagcagcagcgcgcggttggagacgcttttcgaacctggcaggttcacggtgccctctacgcgtgcgatgggttgtaa

SEQ ID NO: 4942 - DNA, 4464 bp, Klebsiella pneumoniae
cggggaggaagagtaatgattgaacgcggtaagtttcgctcgctaacgctggttaactggaacggcttctttgcccggacctttgatcttgatgaactggtgaccaccctctccggggggaacggcgcgggtaagtccacgaccatggcggccttcgtcacggcgctgatcccggatttaaccctgctgcacttccgtaacaccaccgaagcgggggccaccagcggctcacgcgataaaggcctgcacggtaagctgcgcgccggggtgtgttactcggtactcgatgtgatcaactcccgccaccagcgcgtggtggtcggcgtgcgcctgcagcaggtcgccgggcgcgatcgtaaagtcgatattaaacctttcgccattcagggactgccgacctctatcctgccgacccagctgttgaccgaaacgctgaacgatcgccaggcgcgcgtcgtgagcctcaacgagctgaaagataaactcgaggcgatggaaggggtccagtttaaacagttcaactcgatcaccgaatatcactcgctaatgttcgatctgggcgtggtggcgcgtcgcctgcgttccgcctccgatcgtagcaagtactaccgcctgattgaggcctcgctgtacggcgggatctccagcaccattacccgctcgctgcgcgactacctgttgccggaaaacagcggcgtgcgtaaagcgttccaggatatggaagcggcgctgcgggaaaaccgcatgacgctggaagccattcgcgttacccagtccgaccgcgatctgtttaaacacctgatcagcgaagccaccaactacgtggcggcggactatatgcgtcacgccaacgagaggcgcattcacctggataaggcgctggagtatcgccgcgatctcttcacctcgcgttcgcagctggcggctgagcagtataagcacgtcgacatggcgcgcgaactgcaggagcataacggcgcggagggcgatctggaagccgattaccaggccgccagcgatcacctgaacctggtgcagactgcgctgcgtcagcaggaaaaaatcgagcgctacgaagcggatctcgacgagctgcagatccgtctggaagagcagaatgaagtggtggcggaagccgtcgatcgtcaggaagagaacgaagcccgcgctgaggccgccgagctggaagtggatgagctgaaaagccagctcgccgactatcagcaggcgctcgatgtgcagcagacccgcgccattcagtataaccaggcgctgcaggcgctggagcgcgcgaaggcgctgtgccatctgccggatctgaccccggagagcgccgacgagtggctggaaaccttccaggcgaaagagcaggaagcgacggagaaaatgctgtcgctggaacagaaaataagcgtggcgcaaaccgcgcacagccagtttgaacaggcttaccagttggtggcggcgattaacggcccgctggcgcgcaatgaagcctgggacgtggcgcgcgaattgctgcgcgacggcgtgaaccagcgccaccaggccgagcaggcgcaggggctgcgcagccgcctcaacgagcttgaacagcgcctgcgcgagcagcaggacgctgagcgtcagctggccgagttctgcaaacgccagggtaaacgttacgatatcgacgatctggaaacgctgcatcaggagctggaagcgcgcatcgcgtcgctggccgacagcgtctccaatgctcaggagcagcgcatggcgctgcgtcaggagctggagcaactgcagtcgcgtacccagacgctgatgcgccgggcgccggtctggctggcggcgcagaacagccttaaccagctgtgcgagcaaagcggcgagcagtttgagtccggccaggaggtcaccgaatacctgcagcagctgctggagcgtgaacgagaggctatcgttgaacgtgacgaggtcggcgcccgcaagcgcgccatcgacgaagaaatcgagcgtctcagccagccgggcggttcggaagatccgcgcctcaacgccctggcggaacggttcggcggcgttctgctgtccgagatctacgatgatgttagcctggacgatgcgccgtacttctccgcgctgtacggtccgtcgcgccatgcgatcgtggtaccggatctgtcgcgggtagccgagcagcttgagggactggaagattgcccggaagatctctatctgatcgaaggcgatccgcaatcctttgacgacagcgtattcagcgtcgacgagctggaaaaagcggtggtggtgaagattgccgatcgccagtggcgttattcgcgcttcccgtcgctgccgctgtttggccgcgcggcacgtgaaaaccgcattgaaaccctgcatgccgagcgtgaatcgctgtcagagcgttttgcgaccctgtcgttcgatgtgcagaaaacccagcgcctgcaccaggccttcagccgctttatcggcagccatctggcggtggctttcgaggacgatccggaagaagagatccgcaaactcaacagccgccgcggcgagctggagcgtgcgctgagcgcccatgaaagcgataaccaacagaaccgtgtgcagtacgagcaggcgaaagagggcgtgtcggcgctcaaccgcctgctgccgcgcctgaacctgctggcggatgatacgctggccgaccgcgtggacgagatccaggaacgtctggacgaagcgcaggaggccgcgcgctttattcagcagcacggtaaccagctggcgaagctggagcctattgtttcggtgctgcagagcgatccggagcagtttgagcagctgaaagaagattacgcctatgcgcagcaaacccagcgcgatgcgcgtcagcaggcttttgccctggcggaagttgtgcagcgcagggcccacttcagctactccgattcggcggaaatgctcagcggcaacagcgatcttaacgagaagctgcgccagcgtctggagcaggcggagtccgaacgcagccgcgcgcgcgacgcgatgcgtgcccatgcggcgcagcttagtcagtacaatcaggtgctggcctcgctgaagagctcgtatgacaccaagaaagagctgcttaacgatctgtataaagagttgcaggacattggcgtgcgcgccgacgccggcgcggaagagcgtgctcgcgcgcgtcgcgatgagctgcacatgcagctgagcagtaaccgctcccgacgcaatcagctggagaaagcgttgaccttctgcgaagcggaaatggacaacctgacccgtaaactgcgcaagctggagcgcgattactgcgaaatgcgcgagcaggtggtgaccgccaaggcgggctggtgcgcggtgatgcgtctggtgaaagacaacggcgtcgaacgtcgtctgcatcgccgcgagctggcctatctctccgccgatgagctgcgctcaatgtcggataaggcgctgggggcgctgcgtctggcggtcgccgataacgaacacctgcgtgacgtgctgcgtatctcggaagatccgaagcgtccggagcgcaaaattcagttcttcgttgccgtataccagcatctgcgcgagcgtattcgtcaggatattattcgcaccgatgatccggtggaagcgatcgagcagatggagattgagctcagccgcctgaccgaagagctgaccaaccgtgaacagaagctggcgatcagttcccgcagcgtggccaacattattcgcaaaaccattcagcgcgagcagaaccgtatccggatgctcaaccagggtctgcagagtgtctccttcggccaggtcaacagcgtgcgtctgaacgtcaatgtgcgtgagacccactcgatgctgctcgacgtgctctccgagcagcatgagcagcaccaggatctgtttaacagcaatcgtctgaccttctctgaggcgctggccaagctctatcagcgtctcaacccacagatcgacatggggcagcgcacgccacaaaccatcggtgaagagctgctcgactaccgcaactatctggagatggaagtggaagttaaccgcggctccgacggctggctgcgcgcggagtccggcgcgctgtctaccggggaagctatcggtaccgggatgtcgattctggtgatggtggtgcagagttgggaagatgaatcccgtcgcctgcgcggcaaggatatctcgccttgccgtctgctgttcctcgatgaagcggcgcgtcttgacgcccgctccatcgccaccctgttcgagctgtgcgaacgtctggagatgcagctgattatcgcagcgccggagaacatcagtccggaaaaaggcactacctataaactggtgcgtaaggtgttcaataatcacgaacatgtgcacgtcgtggggctgcgcgggtttgccgcgccgctgccggaagcgctgccgggaacggccgacgcctcgtga

SEQ ID NO: 4943 - DNA, 213 bp, Klebsiella pneumoniae
acagacgggagttccacgatgaaaaagttagttctggctgcactgctcacctctttcgcgttcggcgccgctgccgcggaaaaaatcagctttggcgtctccgcaacctatccgccgtttgaatcgatggacgctaataaccagattgtcggctttgatatcgatctggcccacgcgctgtgcaaacaaatgcaggcagaatgtacctttacc

SEQ ID NO: 4944 - DNA, 711 bp, Klebsiella pneumoniae
tacacagggagatggaaaatgaaagcctttgactggcagcggatggcgctcgataaagtaccggtggaattcctggcggaggtggcgttgcgcagcctctataccttcgttctggtctttattttcctcaagattaccggacggcgcggcgtgcggcagatgtcgctgttcgaggtgctgattattttgaccctcggctcggcggcgggtgacgtggcgttttatgacgatgtgccgctgctgccggtgctggtggtcttcgttacgctggcgctactgtatcgcggcattatgtggctgatggggcatagcgaaaagctggaggatctactggaggggaaacctatcgtagtggtggaagagggacagttggcctgggagaagctgcatgcggaaaacatgaccgaattcgaattttttatggagctgcgggtcaacagcgtcgagcagcttggccaggtccggctggcaatcctcgaaaccaacgggcagatcagcgtgttttattatcccgatgaagaggtgagggccggattatcgatccttccagcgcattgtaccacacgctataccaccattccgcaagaggggatctatgcctgcgtgcgctgcagcatcgtaatggcgatgcaggcgggagaaaaacgaatatgtccgcgctgcgcaaatgcagaatggtcgaaggccagccgggcgaaacggcttacctga

SEQ ID NO: 4945 - DNA, 1836 bp, Klebsiella pneumoniae
ccagatgatggagatagcacctgtcagataaaagccgtatcattgcgcgctttccgtacgacaaaagtgatcgccatgacccaaacgtttattcccggcaaagatgccgccctggaagattccatcgctcgcttccagcagaaattgctcgacctcggatttgatatcgaagaggcctcgtggctgaacccggtgccgcacgtgtggtccgttcacattcgcgataaagcgtgcgcgctgtgctttaccaatggtaaaggcgccaccaaaaaggcagccctggcctccgcgctgggcgaatatttcgaacgtctgtccactaactatttcttcgccgacttctggttaggcgacacaatcgctaacggcccgtttgttcactacccgaacgaaaagtggttcccgctgactgaggatgatgaagtcccggaaggtctgctggatgcccgcctgcgcgcgttctacgatcctgacgatcagttaacggccagtatgctggtggatctgcagtcgggtaacgatgagcgcggcgtgtgcggtctgccttttacccgccagtccgacggcgaaaccgtctatattccgatgaatattgtcggcaacctgtacgtctccaacggcatgtccgccggtaacacccgcaacgaagcgcgggtacaaggtctgtcagaggtctttgaacgtcacattaaaaaccgcatcatcgctgaaagcatcagcctgccggagatcccggcggaagtcatggcgcgctatccgggcgtcgtggagtcgatcgccaaactggaagctgaaggtttcccgatctttgcctatgatggctcgctgggcggcaaatatccggttatctgcgtcgtgctgtttaacccggctaacggcacctgcttcgcctccttcggcgcccacccggactttggcgtggcgctggagcgaaccgtcaccgaactgctgcagggccgcagcctgaaagacctcgacgtcttcacgccgccaaccttcgatgacgaagaggtcgccgagcacgcgaacctcgaaacccactttatcgactccagcggcctgatctcctgggatatgttcaagcaggacgccgactatccattcgttgactggagcttctctggtactaccgaagaagagttcgccaccctgatggccatcttcaaggccgaagataaagaagtgtacatcgccgactacgagcacctgggcgtttacgcctgccgtatcatcgtcccggggatgtcggacatatacccggcggaagacctgtggctggcgaacaacagcatgggcgctcatctgcgggacaccattctgtccctgccgggcagcgagtgggataaagaagattacctggcgctgatcgagcagatggacgatgaaggtctggatgatttcacccgcgttcgcgaactgctggggctcgccaccggaaaagacaacggctggtatactctgcgcgtcggcgagctgaaagcgatgctggccctggccggcggcgatctggaacaggcgctgatctggaccgagtggaccatggaatttaatgcttcggtcttcagcgcggagcgcgcgaactactatcgctgtctgcaaaccctgctgctgctgagccaggaagaagagcgtcagccgctgcagtacctgaacgccttcatccgtatgtacggcgccgacgcggtcgaagccgccagcgcggcgctgagcggggaagcgccgttctatggtctccaggcggtcgatagcgatctgcaggccttcccggcccatcagtcgctgctgaaagcctatgaaaaactgcagcgggcgaaagcggcgttttgggcaaaataa

SEQ ID NO: 4946 - DNA, 1215 bp, Klebsiella pneumoniae
cccagcagtggaccgccgataaacagcgtcaggaagaagctcagcggcgtccaaacggtgtaccaggtcggcaccgtgtcgatggtgttgtatacccgcaccatcatccacacgaaaatcacgcccagcaccatggtcaccaccagccacaggctccgcaggccggcaggcagctttttgcacacggccagcagccagccaattccgccgacggcgaagaagatcgccccgctggctatttcattactcagcgacgaggctcccatgcgattcagcgaattaaaggcccgcagcggcgagccaaggtgcatcgtcgaggcaataaacccgatccccatcaatacccacagtccgaacatgctgcccaccacgcgctgctcctgctcacgggaaagcttgcctgtcatcagcgccagcgccagaacaataaagccgcctacgacgcactggccgaagaccgtaaagaccatcagcggccattcatgccatccgtttcccatctcacacctccttcgggttcgccaggtaaccggtggtatcgccacacggccgggcattggcgttaggtttgataacgatactcggccgggtaaagtgcgccgacggcagcggcgctaccgcggccagctggccgtgcttagcgcgcagttcggcaatcggcccgaaatccaacgcccgcagcgggcaggactcgacgcagatcggctttttcccctcggcgacgcgctcgtgacagccatcgcacttggtcatatggcctttgtcggcgttgtactgtggggcgccgtacgggcaggccatatggcagtagcggcagccaatgcatacctcttcgttgaccaccacaaaaccgtcttcgcgcttatgcatcgcgccgctcggacagaccttggtgcaggccggatcttcacagtggttacaggcgatggagaggtaataggcaaacacgttctgctgccagacgccgttgtcctcctgccagtcgccgccggcatattcatagatgcggcggaagctgacctccggggtcaggttcttgtagtccttacaggccagttcgcaggttttgcaaccggtgcaacgggcggaatcaataaaaaatccatactgagttgtcatcggttactccttacagcttctcaacctgaacaaggttggtatgcgacgggtttcccttcgccagcggcgacggacgctgggtggtcagcacgttga

SEQ ID NO: 4947 - DNA, 1050 bp, Klebsiella pneumoniae
tacgcccccggtttgcacaccgggaatccaggagagttcatgtactaccccttcgttcgtaaagccctttttcagctcgatcctgagcgcgctcatgaagttacctttcaacaattacgccgtgtcaccgggacgccgctggaaatgctggttcgccagaaggtaccggccaggcctgtcacctgcatggggctaacctttaaaaacccgctgggtctggcggccgggctggataaaaatggggaatgcattgacgcgctgggcgcgatggggtttggttcgattgagatcggcaccgtgacgccgcgtccgcagccgggcaacgataagccaaggatcttccgtctggttgatgccgagggattgatcaaccgcatgggctttaataaccatggcgtcgataacctggttgagaatgtgaaaaaggcgcattttgacggcgtgctgggtatcaatatcggcaaaaataaagatacgccggttgagcacgggaaagatgattacctgatttgtatggaaaaagtctatccgtacgccgggtatatcgccattaatatctcctcgccgaataccccagggctgcgcacgctgcaatacggcgaagcgctggatgatttactctccggtattaaaaataagcagctcgagctgcagcagaagcatcaaacatatgtcccggtcgcagtaaagatcgcgccggatcttttgcctgaggaattgatccaggttgccgatagcctcgtgagtcataatattgatggcgtgattgcaaccaataccaccctcgatcgttccctggttcagggaatgaaacattgcgatgagaccggcgggcttagcggtcgtccattacaattaaaaagcactgaaattatccgtatgctctccgctgagctgaatggccgtttgcctatcatcggcgtgggcggcattgattcggtgattgccgcgcgggaaaagattgccgccggggcatcgctggtgcagatctattctggatttatttttaaaggtccgccgctgattaaagaaattgttacccacatctaa

SEQ ID NO: 4948 - DNA, 1323 bp, Klebsiella pneumoniae
tccccttcaggacctcaacgctgccgtcgccggaaggatagctgcgacgtatatctcgcagctcaagcagcgccgtcattttgccgccccgctcgcgctctcgccgacgatcacttcgtcgccctcttccagaccttgcaccactgcgacgtcggtatcattgcgggcgccaatgataacctcacgctctttgacctcaccggtgcgcaacagtcgaacatggtagcggttatcgcctaccgcgtcgcccagggcgctcagcgggatagtaatcacgttcttcacctcagccagctgaatgtgcacctgcgcggtcatgtcgaggcgcaggatcccctgcgggttcggtacctcgaagcgggcataatagaagatggcgtcattcactttttccggcgtcggcagaatgtctttcagtttaccttcataacgggtaagcgggtcgcccagcacggtaaaccacgctttttgccccggtctgaggtggatgacatccgcttcagagacctgcgctttaaccagcatggtgctgagatccgccagcgtcagaatgttaggcgcctgctgggcggcgatcactgtctgtccctgcagggtggtaatttgcgtcacttcgccggccatcggcgccaggatccgcgtgtaatcgaggttggtcttcgccgtatcgagcgtcgcctggttacgctttatttgcgcttcaatagtgccgatctgcgcctgtttcaccgccaaatcggtggccgcggtatcaaggtcctgccgcgagaccagctggcgctgcgccagctgctgctgacgggccagagtcacttgcgccagtttgctctccgcgcgcgcctgattgagctgggcgcgcagctccatgagcgtcgcttccacctctttaatctggttttgcgcctgctccggatcgataacccccagcaactgatcctttttaaccttatcgccaatattgacgtgcagcgttttcagctgtccgctgacctgggcgccgacgtcaacttttcgcagggcatccagtttgccggtggccagcacgctctgctggagatcccctttgcgaactaccagcgtctggtagctcggcagcggcgcattgaggatccgccatccccagatagccagccccagcacaacgatcgccaacagccaccagacggtcctgcgttttcccttcactttcatattccgattcctgctgtttccctgccgctccaggcggtgattctatcgaaacccgttggcaacaggacacccatttttcgcgtcaatgaggttttgtttagctgccggagagctttgtgccgccgtaaatga

SEQ ID NO: 4949 - DNA, 561 bp, Klebsiella pneumoniae
aaggggacagggggaaaaatgcggattaaacctgacgataactggcgttggtattacgatgaagagcacgaccgcatgatgctcgatctggccaatggcatgttatttcgctcgcgcttcgcccggcgcatgctgactccggatgcctttgccccttcgggattttgcgttgatgacgccgcgctctatttctcttttgaagaaaaatgtcgcgatctcgagctatcgaaagagcagcgggcggaattagtccttaacgcgctcaccgccatccgttttctcaaaccgcagatgccgaaaagctggcactttatcgcacatacccatcactggcagccgagcggcggcgacgccgcctgcgtttggctgagcgataccggcgagcaggtgaatttactggtggtggagccgggcgataacgccgcgctctgtctgttggctcagccgggtctcacccttgccggccgcgtcatgcagctgggcgatgtcataaaaatcatgaatgacagactgcagccggcgcagagcgcggtcagctacagtctggggcaggcggtttaa

SEQ ID NO: 4950 - DNA, 666 bp, Klebsiella pneumoniae
cagcaggcaggaaacagcctgatacctggagagcctttcttgagccaggaatacaccgaagacaaagaagtcaaactaaccaaactcagcagcgggcgccgactccttgaggcgatgctcatcctttgctccctcttcgccatctggctgatggcggcactactgagctttaacccctcggaccccagctggtcgcaaacggcatggcatgagcctattcataatttaggcggcgcccccggcgcgtggcttgccgataccctctttttcatttttggcgtcatggcctacaccatcccggtgatcatcatcggcggatgctggtttgcctggcggcatcaggaaaacgacgaatacattgattattttgccgtttcccttcgcctcatcggtgcgttagccctgatcctgacctcctgtggtctggcggcgattaacgccgatgatatctggtacttcgcctccggcggggtgatcggcagcctgctgagcaccacgctgcaacccctgctgcacagcagcggcggcaccatcgcccctgttgtgtatctgggcggccgggctgacgctgttcaccggctggtcgtgggtcagcattgcggaaaagctgggcggcggcatcctgtccgttctcacctttgccagcaaccgtacccgtcgggatga

SEQ ID NO: 4951 - DNA, 222 bp, Klebsiella pneumoniae
ttgttgaaaggtaacttcatgagcgcgctcaggatcgagctgaaaaagggctttacgaacgaaggggtagtacatgaactctcctggattcccggtgtgcaaaccgggggcgtattatgtgcgatctgttgcggaaagggaattgacctgcgacaaaaaatcccccatcagcgcaaacgattacctaccccgcgcgccattatgcgcttttcggctatctaa

SEQ ID NO: 4952 - DNA, 1188 bp, Klebsiella pneumoniae
aaaggcatgggctgcgcccatggtcatgcaggtcaccagggagttaagatgttaacaaataagcgagagcgcgcccggcagcagcgagccgcgttgtgggccaccagagataatgtccagcgccatgcgctgtccatgagtatgccctggctcgcctttgtcaatatcgcttttgcgttaatgattttcttccgcaattttatctttacctattttgataagaggctactgacgcaccgggcggttattccttatatcgaagcggcgttgattgcggttattatcatttcggccattttagtgattattgccctcacgccgcgactggcgcagggacgatatacgttgaatatcatcaccgggctgctgctggcgctcagtctgtgctggtccctgagtaattattgttttatttttttctggaccttgccctttgcctggccgctgctggtgatattaatgactaccggcctcaccgcgctgtatcaccattggcccggcataaccgcttttatgctgccgctatgggtgaccgccttgctggcgggaatacagctccactatcacaccgagatccgctttttgatcctctgggccatttttaccgcgattttgctgtatggccgacgtattttgcagcgctggtatgacgaagcctgggatacccaccaggagaatatgcagcttattcagcggctggaaagtatcgccaaccaggatgccttaaccggaaccgctaaccgtcgggcgctcaatgcttacctggcggcgatctggcagcaaaaaacgccgctggcgctgatgatgatcgatgtcgattattttaagcgctataacgatcgctatggccatcaggctggtgatgagtgcttatcttctgtcgcgcaggtgcttaaaatggcggtccgggcggagggcgatctggtggctcgctacggcggcgaagagtttgtcgtcgtgttgcccggggtgtccttagcgcatgccaccgctattgccgagcgtattcagcagaagatccgcgaggcaggcctaccgcacgccgcttcggcggtggcgtcggaggtcaccgtgagtatcgggatcgtcgcctccgatggcacggtcccgatagagacgctgatcgcccgggcggacagtgcgctgtatcaggcgaaaaataaaggacgtaatcaatggtcttattaa

SEQ ID NO: 4953 - DNA, 2625 bp, Klebsiella pneumoniae
aggttttttatgacacaacagccccaagccaaataccgccacgactatcgtgcgccggagtatctgattagcgatatcgatttgacctttgacctggatgccgcaaaaaccgttgttacggccgagagcaaggtctcccgccacgcggctgcgtctgatgtgccattgcgcctggacggcgaagatctgaccctgatcgctctgcaggtgaacggccagccgtggagtgactataaagaagaaaacaatcagctggtgatcggcggcctgccggagcatttcaccctgaccatcgtcaatgagatcagcccggcggcgaacaccgcgctggaaggcctgtatcagtcaggcgaagcgctgtgcacccagtgcgaagcggaaggtttccgccatatcacctggtatctggaccgtccggatgtgctggcgcgctttaccaccaaaattatcgccgataaagcgaaatacccgttcctgctttccaacggcaaccgtatggcggaaggggagctggagaacggtcgtcactgggtacagtggcaggatccgttcccgaagccgtgctacctgtttgcgctggtggccggtgattttgacgtcctgcgcgattcattccgcacccgctctggccgcgaagtggcgctggagctgtacgtcgatcgcggcaacctcgatcgcgcgccctgggcgatgacctcgctgaaaaactctatgaagtgggatgaggagcgctttggcctcgagtacgacctcgatatctatatgattgtcgccgtcgacttctttaatatgggtgccatggagaacaaaggactcaacgtctttaactccaaatatgttctggcccgtaccgataccgccaccgataaagactacctcgatattgagcgcgtgattggtcatgaatatttccataactggaccggcaaccgcgtcacctgtcgtgactggttccagctcagcctgaaagaggggctgaccgtgttccgcgatcaggagttcagttccgacctcggctcacgggcggtgaaccgcatcaacaacgtgcgcaccatgcgcgggctgcagtttgccgaagacgccagcccgatggcgcacccgatccgtccggatatggttatcgagatgaacaacttctacaccctgacggtctatgaaaagggtgccgaagtgatccgcatgttgcacaccctgctgggtgaagaaaacttccagaaagggatgcagctgtactttgaacgccatgacggcagcgccgccacctgcgacgatttcgtgcaggcgatggaagatgcctctaacgtcgacctgtcgcacttccgcctctggtacagccagtccggtacgccaatcgtcaccgtgcatgacgactataatccggagaccgagcagtatacgttgaccatcagccagcgtacgccgccgaccgccgagcaggccgagaagcagccgctgcatatcccgtttgccattgagctgtacgataacgagggcaaggtgatccccctgcagaagggcggtcacccggtacacccggtgcttaatgtgacccaggccgagcagacgtttgtcttcgataacgtttatttccagccggtgccggcgctgctgtgcgaattttcagcgcctgtgaaactggaatacaagtggagcgatcagcagctgaccttcctgatgcgtcacgcgcggaatgatttctcgcgctgggatgcggcgcagagcctgctggcgacttacatcaagctgaacgtcaaccgccatcagcaggggcagccgctgtcgctgccggtgcacgtagcggatgccttccgcgccatcctgctggatgagaagattgatccggcgctggccgctgagatcttaaccctgccgtcagccaacgaaatcgccgagatgttcgcgattatcgatccgatcgccatcgccgccgtgcgcgaagcgctcacccgcaccctggcgaacgaactggcggacgaattcctcgcggtttataacgccaataagctcgacagctatcgggtggagcacgccgatattggtaaacgtgctctgcgcaatacctgcctgcgctatctggcgtttgcggaaccgacgctgggcgataagctggtggcgacgcagtatcaccaggcagataacatgaccgacgcgctggccgccctgtcggcggcggttgccgctgagttgccgtgccgcgatgcgctgatgcaggagtacgatgacaaatggcatcaggacggtctggtgatggataagtggtttatcctgcagtccaccagcccggcagccaacgtggtggaaaccgtgcgcggtctgctgaaccaccgttcgttcagcatgagcaacccgaaccgtgtgcgctcgttaatcggcgctttcgccagcagcaacccggcggcgttccatgctgaagatggcagcggctatcagttcctggtggagatgctgaccgagcttaaccagcgtaacccgcaggtggcgtcgcgcctgattgagccgttgattcgtctgaagcgttatgatgagaagcgacaggcgctgatgcgcgccgcgctggagcagctgaaggggctggaaaatctctctggcgacctgttcgagaaaatcagtaaggcgctggcgtaa

SEQ ID NO: 4954 - DNA, 579 bp, Klebsiella pneumoniae
ccagcctttttccaccgacagctgcgccagctgctgccactgatcgagcgtcggatcgataccggtcgggttgtggcagcagccgtggaacagtaccacgtcgcccgcctgggcttcgttcaggctggccagcagaccatcaaagtccagcgcgtggttagccgcgtcgtagtatgcgtattcgcgcacttccagcccggcagaggtgaatacgcttttatggttcggccagctcggattacttacccacacacgtttcacgtcggtgtttttggcgaggaagtctgcggcgacacgcagcgcaccggtaccgccgggtgtctgcgcggtgcgggcgcgtttatcagcgataatcgcattgcctttaccgaacagcagctcctgggtgcagcgaccaaattcaggaataccatcgatgcccagatagtttttagtcgtttcattttccagcagatactgctctgcttttttgacgctggtcagaacgggcgttttaccggtttcatccttgtaaacaccaattccgaggttaattttttcagggcggtcatcggcacgaaacagatcggccagacctaa

SEQ ID NO: 4955 - DNA, 390 bp, Klebsiella pneumoniae
ccgccagccatagcgccgtgctctcgcccttcgacccggtggtctgggatcggaaacgcgctgagcagctgttcaacttcagctatcgcctggagtgttataccccggcgccgaagcgtcagtatggctacttcgtactgcctctgctgcaccagggataactggtcgggcggatggacagtaaaatacatggcaaaagccggggagctggatatcttcgccctgtggctggaggagggggtgaagatcacccgtggtctggagcaggggctgcgccgggcgattaacgacttcgcacgctggcaatcggcagagcggatcctgtgccgacgcctgccggaagggctgtttgtcggccaggagcaggggtgggaaatcgacgccgattga

SEQ ID NO: 4956 - DNA, 1683 bp, Klebsiella pneumoniae
agattaaacatgactgaatcttttgctcaactgtttgaagaatccttaaaagaaatcgaaacccgcccgggttccatcgttcgtggtgttgttgttgctatcgacaaagacgtagtactggttgacgccggtctgaaatctgagtccgccatcccggctgagcagttcaaaaacgcccagggcgagctggaaatccaggttggtgacgaagttgacgttgctctggatgcagtagaagacggcttcggtgaaactctgctgtcccgtgagaaagctaaacgtcacgaagcttggatcacgctggagaaagcttacgaagacgctgaaactgttaccggtgttatcaacggcaaagttaaaggtggcttcactgttgagctgaacggtattcgtgcgttcctgccgggttccctggtagacgttcgtccggtgcgcgacacgctgcacctggaaggcaaagagcttgagttcaaagtcatcaagctggaccagaagcgtaacaacgttgttgtttctcgtcgtgccgttatcgaatccgaaaacagcgcagagcgcgatcagctgctggaaaacctgcaggaaagcatggaagtcaaaggtatcgttaagaacctcactgactacggtgcattcgttgatctgggcggcgttgacggcctgctgcacatcaccgatatggcctggaaacgcgttaagcatccgagcgaaatcgtaaacgttggcgacgaaatcactgttaaagtgctgaagttcgaccgcgagcgtacccgtgtatccctgggcctgaaacagctgggcgaagatccgtgggtagctatcgctaaacgttatccggaaggtaccaaactgactggtcgcgtgaccaacctgaccgactacggctgcttcgttgaaatcgaagagggcgttgaaggcctggttcacgtttccgaaatggattggaccaacaaaaacatccacccgtccaaagttgttaacgttggcgacgttgtggaagtaatggttctggatatcgacgaagagcgtcgtcgtatctccctgggtctgaagcagtgcaaatctaacccatggcagcagttcgcggaaacccacaacaagggcgaccgtgttgaaggtaaaatcaagtctatcactgacttcggtatcttcatcggcctggacggcggcatcgacggcctggttcacctgtctgacatctcctggaacgttgcaggcgaagaagcagttcgtgaatacaaaaaaggcgacgaaatcgcagcagttgttctgcaggttgacgcagagcgtgagcgtatctccctgggcgttaaacagctcgcggaagatccgttcaacaactacgttgctctgaacaagaaaggcgctatcgttgttggtaaagtgactgcagttgacgctaaaggcgcaaccgtagaactggctgacggcgtagaaggttacctgcgtgcttctgaagcatcccgtgaccgcgttgaagacgcaactctggttctgagcgttggcgacgaagttgaagcgaaattcaccggcgtggatcgtaagaaccgcgtagtgagcctgtctgtacgtgcgaaagacgaagcggaagaaaaagacgctatcgctaccgtgaacaagcaggaagacgcgaacttctccaacaacgctatggctgaagcgttcaaagcagcgaaaggcgagtaa

SEQ ID NO: 4957 - DNA, 828 bp, Klebsiella pneumoniae
gatccgaacataactttggttatatggttaaaaaaggaaccatctggcatgcttttcacgctaaaaaaaatcgtcggcggcctgctgttgccgctacccgccttactgttgctgatcggtatcgggatcgcgctgttatggttcagccgctttcagcgtaccgggaagctatgcgtgagcctcggctggctactgctgacgctgctgagcctgcagcccgtggccgacagcctgctgaaaccgattgaagatacctaccccacctggcgcggcgagcagccggtgaactacgtggtggtgctgggcggcggctatacctggaatccggagtgggcgccaagctctaatcttatcaataacagcctgccgcgcctgacggagggcatccgcctgtggcaggcgaatcccggttcgaaaatgatctttaccggcgcggcggcgaaaacgaaccccgtcagcacggcggaagccggggcgagagtggcggagagccttggcgtacctcgcagcgatatcattgtgctcgatcggccgaaagatacagaagaggaagcgctggcggtgaagcgcgccatcggcgacgcgcccttcctgctggtcacctcggcgtcacaccttccgcgggcgatgatattctttcgccatgccggcctggatccgcttcccgcgccggccaatcagctggcggtgacctcgccgctcaatccgtgggagcgggccattccttctccagtgtggctgatgcacagcgaccgggtcggctatgaaacccttggtcgcgtctggcaatggctgaaaggcagctcaggcgagccagggcaggagtga

SEQ ID NO: 4958 - DNA, 621 bp, Klebsiella pneumoniae
ggaagaacaatgaaaaaactcgcaatcacctgtgcattactgtctggtatggtcgtcagccaggtctgggcagatgcggccagcgacttaaaaagccgtcttgataaagtgagcagcttccatgccagcttcacgcaaaaagtcaccgacggcagcggtaacgccgtgcaggacgggcagggagacctgtgggtgaaacgcccgaacctgtttaactggcatatgacccagccggatgagagcgtcctcgtttcggatggtaaaacgctgtggttctataacccgttcgtcgagcaggccacggcgacctggctgaaagacgctaccagcaacacgccgtttatgctgattgcccgcaaccagtccagcgactggcagcaatataatatcaagcaaaatggcgatgattttgtgctgacgccaaaaagcggcagcggcaacctcaagcagttcacgatcaacgtcggtcgggacggcactatccatcagttcagcgccgtcgagcaggatgatcagcgcagcagctatcagctgaaatcgcagcagaacggcgccgtcgacgcagctaagttcacctttacgccgccgaaaggggtgacggtggacgatcaacgtaagtag

SEQ ID NO: 4959 - DNA, 393 bp, Klebsiella pneumoniae
ctgcttcaaattttgacgcatttttcgccgttccccctcctcaatcgcttgacgcgttttcgtatttctctaaattgtagtggcgagagttggcgagcaattgaacaactcgtcactccaccaccggttcattccatcttactaataaagatttacgaaggatgtcgaagtatggaaatgggtactgttaagtggttcaacaatgccaaagggttcggttttatctgccctgagggcggcggcgaagacattttcgcccattactccaccatccagatggatggttacagaacgctaaaagccggacaagccgttcggtttgatgttcaccaggggccaaaaggcaaccacgccagcgtgatcgtccctgtggaagcggaaacggctgcataa

SEQ ID NO: 4960 - DNA, 717 bp, Klebsiella pneumoniae
atgaacgaaatttttccattagcaagcgccgccgggatgaccgtcggccttgccgtttgcgcgctcgtcatcggcctggtcctggcgatgctctttgcggtactggagtcagtgaaatggcgcccggtagcctggcttgcaaccggcatagtgaccatcctgcgcgggctaccggaaattctggtggtgctgtttatctatttcggctcttcccagctgctgctgacgctctctgacggtttcaccatcccgctcgggttcacgcagatcccggtgcagatgcagattgagaactttgacgtcagcccgttcctctgcggggcgatcgccctgtcgctgctgtacgccgcttacgcctcgcaaacgctgcgcggcgcgctgaaagcggttccgcagggccagtgggagtccggccaggcgctggggctgtcgaaagcggccatattcttccgtctggtgatgccgcagatgtggcgccatgccctgcccggcctcggtaaccagtggctggtgctgctgaaggacaccgcgctggtgagcctgatcagcgtcaacgatctgatgctgcagaccaaaagcatcgccacccgcactcaggaaccctttaactggtatatcattgcggcggcaatctatctcgtcatcaccctgttgagtcaatacatccttaagcggattgaccagcgtgcgacgcgcttcgaacggagaccaggctga

SEQ ID NO: 4961 - DNA, 1323 bp, Klebsiella pneumoniae
acgctgggaatatctcgaaggattaaagaacggcgcctgagccgaggagttgtcatgtgcgatcatcatcatgctgcgcgacatattctatgtccccaatgtgatttgctggtggctttgccgcagcttgagcatcgccagaaagccgcctgcccgcgctgcggtacaacgttaaccaccacgtgggacgcgcctcgccagcgtcccacggcgtatgcgctggtcgcgctgtttatgctgctgctggccaacctgttcccttttatctatatgaaagtgggcggcatcagtagcgaaatagagctgctggaaattcccaacgtactgtttaccgaggattacgccagtctcgggactttctttttactctttgttcaattagtgccggcgttttgcctggtcaccattttgctgctggttaatcgggtcagaatgcctgccggcctgaagacgttccttgcgcgaattctctttcaactgaaaacctggggcatggcggagatctttcttgccggcgtgctggtgagcttcgtcaagctgatggcatacggtgatatcggcatcggtctgagctttgttccctggtgtatgttttgcctgctgcagttacgtacttttcagtgcgtcgaccgccgctggctatgggatgatattgcccccatgccggccattacccagccgctgaaggtcggggtgaccggtatccgtcaggggctgcgctcctgtgcctgctgtacggcggtgttgccggtcgatcagaccgtctgtccgcgctgtaacagtaaaggaacggcgcggcgcaaaaatagcctgcagtggacgctggcgctgctggtgacgtcatttatcctttatctccctgccaacattatgccgatcatgatcaccgatctgctgggcgataaaatgccatcgaccattatggccggggtgattttactgtggagcgaaggttcatatccggtggcgctggtgatctttatcgccagtattatggtgccgacgctgaagatgatcgctatcgcctggttatgctggaacgccaacggcaacggcgcgcgagattcggagcgcatgcatctgatctatgaggtggtggaatttgttggccgctggtcaatgattgacgtttttgtcatcgccgtgctctctgcgctggtccgcatgggagggttaatgaatatctatccagccatcggcgcggtcatgtttgcgctggtggtggtgatgaccatgttttcagccatgacatttgatccccgtttactgtgggatcgtgagccagattcaagccatgaggaaatacaacaacatggaaaataa

SEQ ID NO: 4962 - DNA, 729 bp, Klebsiella pneumoniae
tttttgctgatgcgtattgaggttaaaatgcgtctggttcagctctcccggcactctatcgccttcccctctccggaaggcgccttgcgagaacctaatggcctgctggcgctcggcggcgatctgagccccgcgcggctgctgatggcctatcagcgtggtatttttccctggttttcccctggcgacccgatcctctggtggtcgcccgacccccgggcggtactttggccagagcaattccatctcagccgcagcatgaagcgctttcatcagcgttcgccctaccgggtcacgctcaaccacgcctttggcgaagtgattgagggctgcgccagcgatcgtgacgaaggcacctggataaccagcagtatcgttcgcgcctatcaccagctgcatgagctgggtcatgcccactccattgaagtctggcaggagaataccctagtgggaggaatgtacggcgtagcgcagggagcgctgttttgcggcgaatcgatgtttagccgggcagaaaatgcctccaaaaccgcgctgctggtattttgccaggactttgcgcacagcggcggtaaattaattgactgccaggtactgaacaaccataccgcgtcattaggcgcagtggatattccccgccgcgattatctggactatctgtcggtattacgcggctaccgactgcccgagcgattttgggtgccgcgggtgctatttcctggtggataa

SEQ ID NO: 4963 - DNA, 327 bp, Klebsiella pneumoniae
acactgacgatgagtaagagagattggctggacttcgagcacctggttgacgacgaagttcgtgatgcgattaaaccgccatctatgtataaagtgatattggtcaatgatgactacactccgatggagtttgttattgacgtgttacaaaaattcttttcttatgatgttgaacgtgcaacgcaactgatgctcacggttcactatgaaggtaaggcgatttgtggcgtgtttaccgcggaagtggcggagaccaaagtcgctatggtgaatcagtacgcgagggagaacgagcatccattgctgtgtacgctggaaaaagcctga

SEQ ID NO: 4964 - DNA, 873 bp, Klebsiella pneumoniae
tcgctgattgttttcgcccctaaggcgtcagatgctgaaggccgggataattcccggtcttttcatttctgccgtcagcaaaaaaaaaccggcccctggccggttttttacattgaagatatcgcctccttagtgggccgcttccggtttgtgcttcggagcgctctggaagtcgtaagtcagcgtatttttgtcgctgtccagagagacagtgacctgaccaccgtcgaccagcgagccaaacagcagctcgttcgccagcggttttttcaggttgtcctgaatgacgcgtcccattggacgtgcccccatcgcccgatcgtagcctttcgtcgccagccagtcgcgcgcttcctgactcacttccagggagacgcctttctggtccagctggacctgcagctcgacgataaacttgtcgacaacctgatggatcaccgtggtagacaaatgatcgaaccagatgatgttgtcgaggcggttacggaactccggcgtaaagatctttttgatctcatccatcgcatccggactgttgtcctgctgaataaggccaatggatttacgctcggtttcccgcaccccggcgttggtggtcatcaccagcaccacgttgcggaagtccgctttacggccgttattatcggtcagcgtcccgttatccatcacctgcagcagcaggttgaacacatccggatgcgctttttcgatctcatcaagcagcaataccgcgtgcggatgtttaatcaccgcatcggtcagcagcccgccctgatcgaagccgacgtagcctggaggcgccccgatcaaacggctgacggtatgacgttccatatattcggacatgtcaaagcgcagcagctcaatccctaa

SEQ ID NO: 4965 - DNA, 984 bp, Klebsiella pneumoniae
catctctgcgtggggtggagcatgcttaatcctctccgcgccctgactctgggcggactgctgctattctcttcgctgggtcacgccgccccggcggcgcctgacgctctgcgcatcggctaccaaaaaggcagtgtcagcatggtgctggcgaagagccatcagctgctggagcagcgctatccgcaaacccatatctcgtggattgagttcccggccggtccgcagatgctggaggcgctgaacgtcggcagcattgatatcggcagtaccggcgatattccgcctatctttgcccaggcggcaggcgccgatttggtctatatcggcgcagagccgcccaagcccaaggcggaggtgatcctggtggcgcagggcagcccgattcataacgttactgagttaaaagggaaaaaggtcgctttccagaaaggctccagctcccacaatctgctgctgcgcgccctgcagctcgcaggtctgaaatttagcgatattcagccggtttaccttgcccccgccgatgcgcgcgccgctttccagcagggcaatgtcgatgcatgggccatctgggatccgtactactccgccgcgctgctgcagggcggcgcccgggtactcactgacggaaccgatctgaaacagacgggatccttctatcttgcttcccggccctacgctgaacgcaatggcgctttcattgaaggcgtactcgacacctttactcaggccgatgccctgacccacagccaacgcgcgcaaagcattacgctgctggcgaaaacgatgggcttaccggaggcggtgatcgccagctatctggaccatcgtccccccacagcggttaccccggtgagcgccgaaaccgccgctcgccagcagcagacggcagacctgttctacgagaacaagctggtgccaaaaaaagttgatatccgggcccgcatctggcagcccaccgccacacaaggagcgaaatcatga

SEQ ID NO: 4966 - DNA, 1797 bp, Klebsiella pneumoniae
tattggggcgttttacttctaattaaaaaacaacgacttttggcccttacgaaaatgacccgacccgacctggcgcctattttgaaaccttcccaggcgctgtttgctcaagctgaattttcccatccggccccctccctctcgggcgatctgcagccgcgttggttttatgggcttgagcagctgctgtacacgccggcagtctcctccttcatgctggtgaaagcccctgaagagccggaatatctgcaatggctggcggctgaaacccggactctgcacgagcctgccgcaccgctttacggcgtccgctatgaggtaaccgacgctcaggtgacgctcgcaccggcgcagggcgctgaggataatttcgccagcactgccccggtcgtgatggccgattgggtagaagcggaacagctgtttggctgcgtacgccagtttaacggtgcaatcaccctccagcctgggctggtccatcaggccaacggcggcgtgcttgtgctttcgttacgcacactgctggcgcaaccgctgctgtgggtgcgtctgaaaaatatggtgactcgtcagcgctttgactggctttctatggatgaatcgcgtccgctgccggtcagcattccctctatgccgctgagtctgaaaatcgtcctggtgggcgaacgcgaatcgctggccgatttccaggaaatggagccggagctggctgcgcaggcgatctatagcgagtatgaagacactctgcagtttgctgacgccgacacgctaaaggcctggtgccagtgggtatggcagaatgcgcagcagctggagctgccgggcccggcagccgatgcctggcctctgctgatcgatgagggaacgcgctataccggcgatcaggagaccctgccgctcagtccgctatggataacccgccagctgcgggaggctgccgccttctgcgaaggcgaggagattaccggcgaagcgatgcagaccatgctggcgcgccgggtatggcgtgaaggctacctggcggagcgtatgcaggatgaaatcctgcaggaacagatcctgattgaaaccgaaggcgaatgcgtcgggcagatcaacgccctgtcggtgatcgaattccccggtcatccacgcgcgttcggtgaaccttcacgcatcagctgcgtcgtgcacattggcgatggcgaatttatcgacgtcgaacgtaaagccgagctgggcggtaacattcatgcgaaaggcatgatgatcatgcaggcttttctgatgtccgagctggagctggagcagcagcttcccttcactgcttcgctgacctttgagcagtcctacagtgaagtggatggcgacagcgcctccatggcggaactctgcgccttaatcagcgccctggccaatgtaccgataaatcagagcatcgcgatcaccggctccgtcgaccagtttggtcgcgtgcagccggtcggcggcctgaacgagaaaattgaaggtttcttcactatctgtcagcagcgcggtttaaccggcaaacagggagtgattatccctgccgccaacgttcgtcatctcagcctgagccacgagctacgtcaggccgttgccgacaaccagtttgctatctgggccattgacgatattaccgaagcgctgccgatgttgacccagctgatgtgggacggtgaaggacagacgttgcgacaaaccattcaggagcggatagcgcaggcgacccagcaagagactcgccatcgttttccgtggccgctacgctggttaggtgggacaagttctaactga

SEQ ID NO: 4967 - DNA, 381 bp, Klebsiella pneumoniae
gtcaccagcttgccacgatcgaggtcgacaatgcgcgtcgccatattgcggataaaggaacggtcatgcgaaataaagataatcgtgcctttaaaggttttcaggaaaccttccagccagtcgatggtttcgatatcgaggtggttagtgggctcatccagcagcagcacgcgcggcccactgaccagggcgcggcccagcgccgctttacgtagccagccaccggacagcgacgccagctgcgcattggcgtcaaggcccagctgctcaatcacttcgttaatgcggctgtccagctgccatagtcccaggttatcgagctgctcctgcaggcgcgccagttcatttaaatttttgtcgctcggatcggtcatcacctga

SEQ ID NO: 4968 - DNA, 216 bp, Klebsiella pneumoniae
atatgcagctttagtggcaggtacagcattgttttaagcggccaatgccgtctccgcagaaattttaacaaaacagcttttgataaagtccatacgcaatataccaaaatcggcgccattttctctactggtcaaaccgcatccaacgatgcccgtgaagagctgattaaaaaaacaaatgaacaaggggggcgtcattgtcccctcctccggtaa

SEQ ID NO: 4969 - DNA, 1824 bp, Klebsiella pneumoniae
tctttaagcttctttacattaggtaaggcaaaagccttttcgtctttatatactgtgttaaagcccacgaatttgtgggcggcaatgtgtgacaacagggggcaagggatgttgcttaagaaacggtatggtcgtccattgtcagcgctcagtctgagcctggcaatggcatttgctccgctgttcaatgtccaggccgcagagcctgaagtcgtaccaggtgatagctccgctacgcctggagagctttccgtcgcgctgtcgcaaagcgacgggcaatcgccggcggtcgcgaagctggccggtgagcagccgttgtcgatggaagccgcggcgaacagtcgcgcccagatcgaagcgctattgccggctggctacaaacccgtctttatgaatccgctggtctcgctatacgccgccagggatatgaaaccgatgtgggaaaaccgcgaggcggtgcaggcgttccagcagcagctggcggagatcgccatcgccggttttcagccgcagtttaccacctgggtcagtctgctgaccgatcctgctgtcagcggcatggcgcgcgatgtggtgttgtctgatgccatgatgggctatctgcactttatcagcggcatccccacccaggggacccgctggttatatagctcgacaccgtacaagatggcgaccccgccgctgtcggtgattaaccagtggcagctggcgctggataatggctccctgccggcgtttatcgccggcctggcgccgcgtcatccgcagtatgagaccatgcaccagtcgctgctggcgctggtggctgattcacgtccatggccgcagatgaccggcagcggctcgctgcgtccgggagaatggagcaatgatatcggcgcgctgcgcgagatcctccagcgtaccgggatgctggaaaattccgccaatatcgttctgcccggcgacgtggtgagtccttcggcgaagaaaaagagcaagcccgcggcgcgcggtgtgtacgatcgccagctggtggagggcgttaagcgctttcaggccatgcaggggctgggggcggatggggtcatcggccaatccacccgtgactggctcaatgtctcatcggcgcagcgcgctggcgtgctggcgctgaacattcagcgtctacgtctgctgccaggcaaactatcgaccggtatcatggtgaatattcccgcgttttcgctggtttattaccaggacggcagtcaggtgctggcctcgcgggtgatcgtcggacgtccggaccgcaagacgccgatgatgagcagcgcgctgaacaacgtagtggtcaatccgccgtggaacgtaccgcccaccctggcgcgcaaagatattctgcagaaggagcgtaataatcctggctatctggagcagcatggctacaccgtgatgcgcggctggaacagtaaagagaccatcgatccttaccgggttgactggtcaaccatcaccgagaacaatttaccgttccgttttcagcaggcgcctggggcacgtaattcactggggcgttacaagtttaatatgccgagttcggatgctatctatctgcacgatacgccgaatcataatctgtttcagaaggatgtccgtgcgctcagttccggctgcgtcagggtcaataaagcctcggagctggccaatatgctgctgcaggacgcgggctggaatgacacgcgcatatccgacgccctgaagcagggggatacgcgctatgtcaatattcggcaaaatataccggtgaatttatattacttaacggcgtttgtggacgctgatggacgtacacaatatcggtga

SEQ ID NO: 4970 - DNA, 2478 bp, Klebsiella pneumoniae
cgcttgtcagtttattgtgagcaaccaaagcgagtatccatgaaaattaaagcccctgatgctttactggctgctgaggtaagccgccgtggtctgatgaaaaccacggcaataggcggcctggcgctggccagcaacgcactaacgttaccctttacccgactgtcgcatgctgccgatacgccggcgcccgccagtgagaaggtggtctggagcgcctgcaccgtcaactgcggtagccgttgcccgctgcgcatgcacgtggtggatggcgcgattaaatacgtcgaaaccgataataccggtgacgataactatgacggtttgcaccaggtccgcgcctgcctgcgtgggcgttcaatgcgccgccgagtctataatccggaccgtctgaagtacccgatgaagcgcgttggtaaacgcggtgagggcaagttcgagcaaatcagctgggaagaggcgttggataccatcgccagcaatatgcagcggctgattaaagagtacggcaatgaatccatctatctgaactacggcaccggcacgctcggcgggacgctgacccgctcctggccgccggggaaaacgctgattgcccgtctgatgaactgctgcggtggctatctcaatcattatggcgactattcatcagcgcagattgctgccggtctgaattacacctacggcggctgggcggacggcaacagcccatcggatattgaaaacagtcagctggtggtgctgttcggcaataaccccggcgaaacgcggatgagcggcggcggggtgacatactaccttgaacaggcgcggcagaaatccaatgcccggatgataatcatcgatccgcgctataccgacaccggcgccgggcgtgaagatgaatggatcccgattcgtccggggaccgatgcggcactggtttcgggcctcgcgtgggtgatgatcaccgagaatctggtcgatcagccgttcctcgataaatactgcgtaggatacgacgagaaaacgctgcccgccggtgcgccagccaatggtcattacaaagcttacattcttggccagggcactgacggtatcgccaaaacgccggagtgggcctcgacgattaccggtattccgcgcgaacgcattgttaaactggcgcgcgaaattgccaccgccaaaccggcctatattagccagggctggggtccgcagcgtcacgccaacggtgagatcgccacccgcgccatctcaatgctcgccattctgacgggtaacgtcgggatcaacggcggcaatagcggggcgcgcgagggctcgtatagtctgccttttgagcgtatgccgacgctggataatccggttgagaccagtatctcgatgtttatgtggaccgatgcgattgagcgcggcccggaaatgaccgctctgcgcgacggcgtgcgcggtaaagataagctcgacgtgccgatcaaaatgatctggaactatgcgggcaactgtctgattaaccagcattctgagatcaaccggacccacgaaatcctgcaggacgacaagaaatgcgagatgattgtggtcattgactgccatatgacctcctcggcgaaatacgctgatattctgctgccggactgtaccgcctccgagcagatggatttcgcgctggatgcctcctgcggcaacatgtcctacgttatctttgccgatcaggccatcaagccgcgctttgaatgcaaaaccatctatgagatgaccagcgaactggcaaagcgtctgggcgtcgaagagcagtttaccgagggccgtacccaggaaggctggatgcgctatctgtatgagcagtcgcgcaaagcgattcccgacctgccggatttcgacaccttccgtcagcagggcatctataagcagcgcgatccgcaaggtcatcatgtggcctacaaagccttccgtgaggatccgcaggctaatccgctgaccacgccttcgggcaagatcgaaatttactcgcaggatctggcgaaaatcgcggctacctgggagctgccggaaggggatgttatcgatccgctgccgatctacaccccgggtttcgaaaactacaacgatccgctgacagcgaaatacccgctacagctcaccggcttccactataaatctcgcgtccactcgacctacggcaacgtcgatgtgctgaaggccgcctgtcggcaggagatgtggattaacccgatcgacgcccgcaagcgcggcattgccaacggcgatcgtattcgcatcttcaacgatcggggtgaagtgcatatcgaagcgaaggtgacgccgcgcatgatgccgggcgtcgtcgcgctgggggaaggggcctggtacaacccggacgcctcgcgtgtggatcaggcgggcagcatcaacgtgctgaccacccagcgtccgtcgccgctggcgaagggaaacccgtcgcataccaaccttgttcaggttgagaagctgtaa

SEQ ID NO: 4971 - DNA, 285 bp, Klebsiella pneumoniae; identical to SEQ ID NO: 2106

SEQ ID NO: 4972 - DNA, 1881 bp, Klebsiella pneumoniae
tctttacaagtcagtaacaaaggtaaagaaggcgacgaaaagtcgcctttatttttgctgcgatgtaacattgccgtgcccaatactccgataacgacacctgcaaagcgcgcaatgaataaaacccgtcaacaagagttaacccgctggttaaaacagcaaagcattatctcccgtcgctggttgatgatttcccgcctgcttggcgtggcgagcggtctgctgatcgtggcgcaggcctggttcctggcgcggatcctgcaccggatggtgatggagaatattccagcgaccgccctgctgctgccgctcacgctgctggtgctgatctttgtactacgcgcctgggtggtctggctgcgtgagcgggtcggctttcaggccgggcagcatattcgctatgaaattcgccgccaggttcttgaccgcctccagcaggcaggcccggcgtggatccagggcaaaccggccggcagctgggcaacgcttattcttgagcaaatcgacgacatgcacgactattatgcccgctacctgccccagatgacgatggcggcctgcgtaccgctgctgatcgttattactatttttccgattaactgggccgccgcgctgatccttctcggcaccgccccgctgatcccgcttttcatggcgctggtcgggatgggcgccgccgacgccaaccggcgtaacttccaggcgctggcccgcctcagcggccacttcctcgaccgcctgcgcggcatggaaaccctgcgtatttttcatcgcggtcaggcagaaaccgataatattcgcgacgcctcgcaggattttcgccaacgcaccatggaagtcctgcgtctggccttcctctcctccggggttctggagtttttcacctccctctccattgcgctggtagcggtgtattttggcttttcttaccttggcgagctgaacttcggccactatggcgcgggcgtcacgctgatggcgggattcctgacgctgatcctcgccccggaatttttccagccgttacgtgacctgggtaccttctaccatgccaaagctcaggccgtgggcgccgcagacagcctgaaaacgtttatggaaacgccgctgacccaggtagagcgtggcgagaaaacgttaaatgacaacgatctgattagcgtggaagcgcgcgacctggtgatcaaatctccggaaggtaaagttctggcggggccgcttaattttgtgctgcccgctggcgctcgcgtggtgctggtcggccagagcggatccgggaaaagctctttgctgaatacactgctcggctttctgccctatgaggggtcgctgatggtcaacggcgtagagctgcgcgagctggacgctgagcgctggcgccgcctgctgagctgggtaggacagaatccgcagttacctgccgccacgctgcgggaaaacgtgctgctggcgtggcccgaagctagcgaagcacagcttaggctggcgctggacaaggcctgggtcagcgagtttatcgccctgctgccgcaggggatccataccgccgtaggcgatcaggcggggcgtctgtcggtaggccaggcgcagcgtatcgcggtcgcccgcgcgctgttggtgccgtgccgcctgctgctgctggatgaacctgccgccagccttgacgcccatagcgaacagcgagtcatgcaggccctgacccacgcctccagtgagcaaaccacgctgctggtcacccatcagcttgaggggctggccgactgggacgacgtctgggtgatgcaggacggacagattatcgaacaaggcgactacgccacgctggcccgtgctggtggggtcttctcggcgctgctggcccatcgtcaggaggagatttaa

SEQ ID NO: 4973 - DNA, 405 bp, Klebsiella pneumoniae
ccaccattattagcgagatgttatatgagtcattatctgcagattaacggccaacggcttatcgattccctgtatgcacttggcgaacatggtgcgctgccaggcggcggcgtatgccgcctggcagcgactgccgaagataaagccggcagggactttgttgtagcccgcatgaaggcgctgggcctgaacgtgtcaattgatgctatcgggaatgtcaccggcgtttatcacggcgaggagacgttgccgatggtgatgatggggtcacatattgatacgttcgccaccgatgggttatacgatggcaaatacggcgttatggccggccttgaggtgattgccacctttcaggatgccggggatccgcacccgacgacggttggcggtaactttctttactaa

SEQ ID NO: 4974 - DNA, 771 bp, Klebsiella pneumoniae
aaactatctttcacattgatgtttttcggggaaatgacgatgaaaaaagtactgattgccgccctgctcgcaggcatgagcctctccgcttccgccgcgcagaccattcgtttcgccaccgaggcctcttaccctccgtttgagctggtggacgccaacaaccagatcgtcggtttcgatgtcgatctggcgaacgcgttgtgtaaagagatcgacgccacctgtaccttcaccaaccaggcctttgacagcctgatcccgggactgaaattccgccgtttcgacgcggtcatggccgggatggacatcacgccggagcgtgaaaagcaggtgctgttctctaccccgtattatgacaactcggcgctgttcgtcggccagcagggtaagttcaccagcattgaccagctgaagggcaaaaaagtgggcgtgcagaacggcaccacccaccagaaattcatcaccgataaacatccggaaatcactaccgtgccttacgacagctaccagaatgcgaagctggacctgcagaacggtcgtatcgacgcggtctttggtgacaccgccgtggtgaccgaatggctgaagagcaatccgaagctggcggccgtgggcgataaagtgaccgacaaagcctatttcggcaccgggctgggcattgccgtacgtcagggcaacaccgacctgcagcagaaatttaacgctgcgctggaaaaagtgaagaaagacggcacttaccagaccatctataacaaatggttccagaagtaa

SEQ ID NO: 4975 - DNA, 606 bp, Klebsiella pneumoniae
atgcaaacatttagttataaggagagagagatgcgcgtcattacgcttgcgggcagcccgcgttacccttcccgttccagcgccttgctggaatacgccagagagacgctcaccgccgccgatatcgaagtctgccactggcatctgcagaactttgccccggaagacctcctgtacgctcgttttgacaacccggcgctgcagacgctcaatgaacagttggccggggctgatggcctgatcatcgccacgccggtgtataaagcctcgttctccggcgcgctgaaaacgctgctcgacctgctgcctgagcgagcgctggagggcaaaattgtgctgccgctggccaccggcggcaccatcgctcacatgctggcggtggactacgcgctgaagccagtgctgaatgccctcaaggcccaggagatcctccatggcgtcttcgctgatgacagccaggtgaccgattaccagcataagccgcagtttaccgcgaatctgcagcggcgccttgatgacgccctggagaccttctggcaggcgctgcatcgccccagcagccgtgcgccgtcgttaacatctctgcgtggggtggagcatgcttaa

SEQ ID NO: 4976 - DNA, 828 bp, Klebsiella pneumoniae
cctggcgtttccgctgcgcgacggtatcccggtgctgctggagacagaggcgcgtccgctggcgctagaagagagtcactcatgagtttcgtggtcattattcctgcgcgtttcgcctccacgcgcctgccgggaaaaccactgcaggacattaatggtaagccgatgattgtccatgtgctggagcgcgctcgcgaatccggcgcggatcgcattattgtcgccaccgatcacgaagatgtcgcccgggcggttgaagccgccggcggcgaggtctgtatgacccgcgccgaccatcagtccggcaccgaacggctggcggaagtggtggaaaagtgcgcgttcagcgatgacaccattatcgtcaatattcagggcgatgagccgatgatccccccggcgattgtccgccaggtggcggagaatctggctgccagcagcagcggaatggcgacgctggcggtaccgatccatgatgcggaagaggcgtttaacccgaatgcggtgaaagtggtgatggatgccaagggttacgcgctctatttctcccgcgcgactattccctgggatcgcgatcgctttgcccaatcccgcgagaccatcggtgactccctgttgcgtcacatcggcatctatggctatcgcgccggctttatccgccgctatgtcagctgggcgccgagcccgctggagcagattgaaatgctcgagcagctgcgagtgctgtggtatggcgagaaaatccatgtcgccgtagcggcggaagtgcccggcaccggcgtggataccccggaagatctggagtgcgtccgcgctgagctgcgttag

SEQ ID NO: 4977 - DNA, 492 bp, Klebsiella pneumoniae
acatccttatccttctgccgtttgcagtgcccgccggtggtgtcatcggtgggcctgctgcaactgtacggttcggggccgatggccatggtcggtacgccgtggatcctgatcggttgctacttcaccgtggccctgccctttatgtaccgggccatcaccaacaacctgcaagccatcaacctgcacgacctgatggacgccgctcaactgctcggcgccagcacctggcaggcggcgtttctggtggtgttgccgaacttgcgcaaaggcttgctggtggcgttgctgctgtcgttttcgttcctgtttggcgagtttgtgtttgccaacatcctggtcggcactcgctacgaaaccttgcaggtgttcctcaataacatgcgtaacagcagcggccatttcaccagcgcgctggtgatctcgtacttcctttttgtactggtgctgacctgggttgccaccttcctgaacaaggacaaaagccaatga

SEQ ID NO: 4978 - DNA, 594 bp, Klebsiella pneumoniae
cctgatgcttttgagcaccatgaaaagggagttgcactgatggccctggcaatttttgacatggatgaaacgttgattcacggcgactgcgccaccttgtggagcgagcaaatgggccgcctcggttgggtcgatccgcaggcgtttttaaagcgcaataacgaactgatgcacgcctacagccaaggcgagttgaagatggaagactacatggccttcagcctggagcccttgatcgggcgcacccctgaggaagtcgatcacttggtcggcccgtgggttgaggactttatcgaaccgatcatttttagtgacgcgaccaaaacagtggccgctcaccgcaaagccggcgatcgcattttgattatttcggcgtcgggcgtgcatttggtcaaaccgattgccgaccgtttgggtattgatgaagtgctgggtattgaactggaagtcgcacacggtgcgtacaccggcaacaccgtgggcaccttgacctaccgagaaggcaaaatcacgcgcctgctggaatggctggacgagcaagaggtcttcaccacggggctgcaaggttccgcgcttagcgctacattcggggca

SEQ ID NO: 4979 - DNA, 1089 bp, Klebsiella pneumoniae
cagcagcggccatttcaccagcgcgctggtgatctcgtacttcctttttgtactggtgctgacctgggttgccaccttcctgaacaaggacaaaagccaatgagttttgtcagcgtcgaacacctgcaaaaaacctactccggcacgccggtcttcagcgacatcaatttcaccatcagcaagggcgagttcgtcaccctgctcggcccgtcgggctgcggcaagtcaacgctgctgcgctgcattgccgggctgacgccggtggatgacggcaagatcctcctcgatggccaggacatcgtgccgctcaacccgcaaaaacgcgggattggcatggtgttccagagctacgcgctgttccccaacatgaccgttgaccaaaacgtcgcgtttggcctgcgcatgcaaaaggtcaacgccaatgacagccaaaaacgcgtggctgaggtgctgcaactggtcgagctcaatgactttgccaagcgctacccgcaccaactgtcgggcggtcaatgccagcgtgtggcgctggcccgctcactggtgacgcgcccacgcctgttgctgctggacgaaccgttgtcagcactggacgcccgtatccgcaagcatttgcgcgagcagatccggcagatccagcgcgagctgggcctgaccccgattttcgtcacccacgaccaggaagaagcgctgaccatgagcgaccgtatcttcctgatgaacaagggccggatcgtccagagcggcaatgccgaaagcctctacgtcgccccggtggacgtgtttgccgcgagttttattggcaactacaacctgctggacgccgataccgccagccgtttattgcaacgcccggtcaccagccgcatcgccatacgcccggaaaccctgggcttgagcctgcacggcgacgccgacacactgatccgcaaccatagcctgctgggcaacgtgatccgctatcgggtcgaagtccgtggcgtggagttgatcgtagacgtgctcaaccgttctgcggccgacctgtacgcggatggtcagcgcgtggcgttgaccatcgattccagcgccttatgtgaggtagcctga

SEQ ID NO: 4980 - DNA, 702 bp, Klebsiella pneumoniae
agaggagctaccatgtcgcgcgctgaaaccggaaccgccagcgtttatcaccgcacggtggtttacctgctgtttattattttgctgttgccgctgctgggcacgtttgtgtactcgatcgccagcagttggtccgccaccgtgttgcccagcggcttcaccttcaagtggtacctgcaactgtggagcgacccgcgctttttgaccgcattcggccattcgctgttgatctgcttcgggtctttgctgctgtcggtggtgctgattctgccgctgctgtttgtggtgcattaccacttccccaagctcgacgcgctgatgaacatccttatccttctgccgtttgcagtgcccgccggtggtgtcatcggtgggcctgctgcaactgtacggttcggggccgatggccatggtcggtacgccgtggatcctgatcggttgctacttcaccgtggccctgccctttatgtaccgggccatcaccaacaacctgcaagccatcaacctgcacgacctgatggacgccgctcaactgctcggcgccagcacctggcaggcggcgtttctggtggtgttgccgaacttgcgcaaaggcttgctggtggcgttgctgctgtcgttttcgttcctgtttggcgagtttgtgtttgccaacatcctggtcggcactcgctacgaaaccttgcaggtgttcctcaataa

SEQ ID NO: 4981 - DNA, 213 bp, Klebsiella pneumoniae
ctctggaacaccatgccaatcccgcgtttttgcgggttgagcggcacgatgtcctggccatcgaggaggatcttgccgtcatccaccggcgtcagcccggcaatgcagcgcagcagcgttgacttgccgcagcccgacgggccgagcagggtgacgaactcgcccttgctgatggtgaaattgatgtcgctgaagaccggcgtgccggagtag

SEQ ID NO: 4982 - DNA, 465 bp, Klebsiella pneumoniae
ctttgccaagcgctacccgcaccaactgtcgggcggtcaatgccagcgtgtggcgctggcccgctcactggtgacgcgcccacgcctgttgctgctggacgaaccgttgtcagcactggacgcccgtatccgcaagcatttgcgcgagcagatccggcagatccagcgcgagctgggcctgaccccgattttcgtcacccacgaccaggaagaagcgctgaccatgagcgaccgtatcttcctgatgaacaagggccggatcgtccagagcggcaatgccgaaagcctctacgtcgccccggtggacgtgtttgccgcgagttttattggcaactacaacctgctggacgccgataccgccagccgtttattgcaacgcccggtcaccagccgcatcgccatacgcccggaaaccctgggcttgagcctgcacggcgacgccgacacactgatccgcaaccatag

SEQ ID NO: 4983 - DNA, 252 bp, Klebsiella pneumoniae
aggctttcggcattgccgctctggacgatccggcccttgttcatcaggaagatacggtcgctcatggtcagcgcttcttcctggtcgtgggtgacgaaaatcggggtcaggcccagctcgcgctggatctgccggatctgctcgcgcaaatgcttgcggatacgggcgtccagtgctgacaacggttcgtccagcagcaacaggcgtgggcgcgtcaccagtgagcgggccagcgccacacgctggcattga

SEQ ID NO: 4984 - DNA, 228 bp, Klebsiella pneumoniae
tgcaccacaaacagcagcggcagaatcagcaccaccgacagcagcaaagacccgaagcagatcaacagcgaatggccgaatgcggtcaaaaagcgcgggtcgctccacagttgcaggtaccacttgaaggtgaagccgctgggcaacacggtggcggaccaactgctggcgatcgagtacacaaacgtgcccagcagcggcaacagcaaaataataaacagcaggtaa

SEQ ID NO: 4985 - DNA, 873 bp, Klebsiella pneumoniae
caaaccgctgtgccagaccttattgagacccgcgccatgacccgtggtaaatggctggcattgttgtgcctcgcgccctttgcaattgtctttatcgtgttccagattgccccgctggtgtgggtgctggtgcacagcctgcaatcagaagacaccggctggggcctggataacttcagcaagatcttcgcctcgaagttctacttacaggccatccagcacagcctggagatcagtttctggtccagcctgttcggcatcgtgattgccgtgctcggcagctactcgctgcacaaagtcgactcaaagctgcgcaacttcgtcaacgccttcgccaacatgaccagcaacttctccggggtgccactggcgtttgccttcatcatcctgctggggttcaacggcagtatcacgatcatgctgaaacaggcggggatcatcgaggacttcaacctctactccaaaaccggcctgatcattttgtacacctacttccagatcccgctgggtgttctgctgctgtacccggcctttgatgccctgcgtgaagactggcgcgagtcagcgtcattgctgggcgccaacagctggcagttttggcgctttatcggcctgccggtcctcaccccggcgctgctgggcacctttgtgatcctgctggccaacgccctcggcgcctacgccacggtgtatgcactgaccaccggcaacttcaacgtattgcccatccgcattgccgcgatggtgtcgggtgatatcagcctggacccgaacatggccagtgcgctggcggtgattctggtggggttgatgaccctggtgacgctggtgcatcagtggctgttaaagaggagctaccatgtcgcgcgctga

SEQ ID NO: 4986 - DNA, 885 bp, Klebsiella pneumoniae
ccaacctgttcgataaagattacgagacagtttatggctaccaatctgcaggacgggaatacaccttgtctggcagctacaccttctgatccacgtcccaccgtgctggtgtttgattccggcgtcggtgggttgtcggtttataatgagattcggcagctgctgccgaatctgcattacatatatgctttcgataacgttgccttcccctatggcgagaagagcgaggagtttatcgttgagcgcgttgtggaaatcgtcaccgctgtccagcagcgttatcccctggcgctggcggtgatcgcctgcaataccgccagtaccgtctccctgcctgccctgcgtgaaaagttcgctttccccgtcgttggcgtggtgccggcgatcaagcccgccgcccgtttaacggcgaacggcattgttggcctgctggcgacgcgcggtaccgtaaagcgtccttatacccgtgagctgatcgaccgctttgccaatgaatgtcggattgaaatgctggggtcggcggagctggtggagctggcggaagcgaagctgcacggcgagcctgtgccgttagaagagctgcgccgtatcctgcgcccgtggctgcggatgcaggagccgccggatacggtggtgctgggctgcacccactttcctcttttacagaaggagctgcagcgcgttctgccggaaggcacacggctgatcgattccggcgcggcgattgcccgtcgcaccgcctggctgttagagcatgaagcgccggatgcgaagtccagcgacgagaataaggcattctgcatggcgctgacggcagaaacagaacagcttttacccgttctgcgtcgctatggcttctcgacgctggaaaaattaccgctctaa

SEQ ID NO: 4987 - DNA, 1008 bp, Klebsiella pneumoniae
gaatgcggttctgagccagcgcgggtaatgcacgggcttccccgggtcgcggctgacgccttacccgggctacgaaccggtagcccggataagccgtttacggcgcaatccgggggcacgcacatatttagggtgagggggtcaaccccgcaccgaatcaacaggaaagacaagactatgcagaccattatcgacgcctggttcgtccagggcatgatcaaagccacctccgacgcctggctgaaaggctgggacgaacgcaacggcggcaacctgacgctgcgtctggatgaagcggatatcgaaccttacgcggcggatttccacgcccaaccgcgctatatcgccctcagccagccgatgccaaccctggccaaccagccgtttatcgtcaccggctccggcaaattcttccgtaacgtccagctcgacccggccgctaacctcggcgtggtgaaggtcgacagcgacggcgcgggataccatatcctgtggggcctgacggaggatgccgtcccgacctccgagctgccggcacacttcctgtcgcacagcgagcgcatcaaactgaccggcggcaaagaccgggtgatcatgcactgccatgccaccaacctgatcgccctgacctatgttctggagaaccacagcgatcttttcacccgtaagctgtgggaaggtagcaccgaatgtctggtggtcttcccggatggcgtcggcattctgccgtggatggtgccgggcaccgatgaaatcggccaggcgaccgccgaaaccatgcaaaaacactcgcttgtgctgtggccgttccacggcgtcttcggcagcggccccacgctggatgagaccttcggcctgatcgataccgccgagaagtccgccgaagtgctggtgaaagtcttgtcgatgggcgggatgaagcagaccatcacccgcgacgagcttatcgcccttggcaaacgcttcaacgtgcagccgctgcagtccgctttagatctttatccataa

SEQ ID NO: 4988 - DNA, 711 bp, Klebsiella pneumoniae
ctcgctttttttatatctgtagcaaggagagcagccatgcattatccggtgaatgtctttgtcggcaaaatcagggactacgcgggcagtcgccccagcgcgatcgacaaaatccaggtcgacggagaattgcagctcggcgatctcggtctcgatggggaccagcaggcggagaagaaaatccacggcgggccggaccgcgcgctgtgtcattatccgcgcgaacactatgccgactggatccgtgacttcccccagcaggccgagcggttctgcgcgccggcgttcggcgaaaacctctccaccaccgggcttaccgagcaaaacgtttatatcggcgatatctttcgctggggcgaggcgctgatccaggtcacccagccgcgatcgccgtgcttcaagctcaactttcattttgcgatcaatgatatggcgcaactgatgcaaaacagcggaaaaaccggctggctgtaccgggtgattgccggagggcaagtttccagcgatgcgccgctcgagctggtttcccggctgagtgatgtcagcgttcatgaggccggggcgattgcctggcagatgccgtttgatgatgatcagtaccaccgcttattgtcggcagcgggcctgtctgttagctggagccgaacgatgcagaaacggcgtttaagcggcaagatagaggatagttcgcggagattatgggggaaataa

SEQ ID NO: 4989 - DNA, 960 bp, Klebsiella pneumoniae
tgggggctatcgcccccatttttattggctaaaataactatgactgatatcagccgttcacaggcgtggctggaaagcctgcgtcctaaaacgttaccgctggcatttgccgcgattattgttggcaccgttcttgcctgggagcagggccattttgatccctgggttgccctgctggcgctgatcaccgccggcttgctgcaaattctttccaacctcgccaatgactacggcgacgcggttaaggggagtgataaaccggatcgcatcgggccgctgcgcgggatgcagaaaggggtgattaccccccagcagatgaagcgcgccctgatcgtcaccgtcgtgctgatctgtctgtttggtctggcgctgctgtgcgccgcctggcagagcgtcggcgatttcatcggcttcctcgccctgggaggcctgtctatcgtggccgccatcacctacacggtgggcacccgtccgtatggatatattggtctgggtgatatctcagtactcgttttcttcggctggctgagcgtcctcggcagctggtatctgcaagcccataatgtggaagcggccatttttctgccggcgacagcctgcggtctgctggcgaccgccgtgctaaacatcaataatctgcgcgatatcgacagcgaccggcagaacgggaagaacaccctcgccgtgcgcctgggcccggtcaatgcccgccgctatcatgcctgcctgctgctcggcgccctgctgtgtctggcgctatttaacctgctggcgctgcattcagcctggggctggctgtttattctcgccacgccgctgctggtgaaacaggcgcgctacgtcctgcgcgaatccgatccgctggcgatgcggccaatgctcgaaaagacggtcaaaggggccttactgaccaacctgctgtttgttatcggaattattgccagtaagctgatggcttaa

SEQ ID NO: 4990 - DNA, 726 bp, Klebsiella pneumoniae
ccattcattcccattccagggcaaaacggattaagttttatcctcgggtatagtgccaccaggggctatggaagggattcatacatcgtgatgggcgtaagagcaccagcaaaaagaaaaaacccgcccgttcgctggtggaagcggcatttcacccaacttagcgctgagcggagtttcgccagcctgagcttgcgtgaagtggcccgggaagcagggatcgcgccgacgtccttttatcgtcattttcgcgacgtcgatgagctgggcctgacgatggtcgatgagagcggactgatgctgcgccagctgatgcgccaggcgcgccagcggatagccaaaggcggcagcgtgatccgcacctcggtctccacctttatggaatttatcggtaacaacccgaacgccttccgcctgctgctgcgcgagcgctcgggaacttctgcggcgtttcgcgccgccgtcgcacgcgagatccagcactttattgcggaactcgccgactatttagaactcgaaaaccatatgccgcgcgcctttaccgaagcgcaggctgaagctatggtcaccatcgtttttagcgctggcgcggaagcgctggatgtcggccctgagcagcgccggcagctggaggaacggttggtactgcagcttcgaatgatctcgaaaggcgcgtattactggtatcgccgtgaacaagaaaaaatgtcacatcattccgaataa

SEQ ID NO: 4991 - DNA, 1359 bp, Klebsiella pneumoniae
acggcttatccgggctaccggttcgtagcccgggtaaggcgtcagccgcgacccggggaagcccgtgcattacccgcgctggctcagaaccgcattctcataagcccgtacgctgtccagccactggctgcccgccggcgtgtcgtgacgctgacagtacatctcccagatggcctgccacggcagcgatttttgctcttcgagcagcgccaggcgggcggtgtaatcgccgtcgttctccagctggcgcagctgggcggtcggttccagcagggcgcgcagcagcgcttttttcatattgcgggtgccaatcacccaggccgcgatgcggttgatggaggcatcgaagaagtcgaggccgatgtgcacgcggtcaaacaggttatggcgaatgatttcgctggcgatggcctgggtttcatcatccagcagcaccacgtggtcgctgtcccagcgcaccgggcggctgacgtgcagcagcaggcgcgggatgtagagcatggcggcggagatcttgtcggagatcacttccgtcggatggaagtggccggcatcgaggcacagcgccgtctgacggctggtggcgtaacccatatagaactcgttggagccgacggtgtagctttcggcgccgatgccgaacagcttgctctccacggcgtcgatatggtgcgccgggtcgagcttctcgctgatcacctcatcaagggcgttcagcagccgctggcgcggggcgaagcggtcaacggttatatccttcatgccgtccggcacccagatattcatcaccgacggcgtgcccagctgttcgccaaaataagcggatacgcggcggctggctttgcagtggtcgatccagaactggcggatctcatcgttggcgtgcgacagggtaaagccgtcggcgctcagcggatgcgagaagcaggaggggttgaaatccagccccagtttgttggctttcgcccatgtaacccagtttttaaagtgctccggcttaatctcattgcgcgctaccggcgcgtcggattccaggtaaatagcgtgcagattgagacgctttggccccgggatcaggctcagcgcctgctcaaggtcggcgcggagttcttctgcattgcgcgctttgcccgggtagttgccggtcgcctggataccgccggtcaggcttcccgccgggttttcgaaaccggcgacgtcgtcaccctgccagcagtgcatggagacgggcagacggtccagctggcgcagggcctcctcgacatccacgccgacggcggtgtagcgctgcttagcaatttcccaggcttgttcaagttgagtggtcatgcgcaaagctccttggtctgttgtggctga

SEQ ID NO: 4992 - DNA, 1185 bp, Klebsiella pneumoniae
ttatatttcccgcggcattcgaggctggacatccccggcgctttccctacaatccccgcgtacttattttattcaggatacatcatgacccccgaacaccttcctaccgaacaatacgaagcgcagctggcagaaaaagtcgtccgtttgcaaaccatgatggcgccttttgccgcgccggttccggaagtgtttcgttcgccggtcagccactaccgtatgcgcgccgagttccgtctgtggcacgatggcgacgatctgtaccatattattttcgatcagcagacccggtcgcggattcgcgttgacagcttcccggccgccagcgcgctgatcaatcagctgatgaccgccatgctggagggcgtacgcaacaatcccgtgctacgccagaagctgttccagattgactatctgaccaccctcagcaaccaggcggtcgtgtcgctgctgtatcataaaaagctggacgatgcctggcgagagcaagcggaggcgctgcgtgacgccctgcgagcccaggggctcaatgtgcatctgattgggcgggcgaccaaaactaaaatcgagctcgatcaggattatatagatgaacgcctgccggttggcggtcgggagatgatctaccgtcaggtggaaaacagctttacccaaccgaacgcggccatgaacattcagatgctggagtgggcactggatgtcaccaaaggggcgactggcgacctgctggaattgtactgcggcaacggtaacttctcgctggcgctggcgcgtaatttcgatcgcgtattggccaccgaaatcgccaaaccgtcggtggcggcggcgcagtacaacatcgccgctaaccatatcgacaacgtgcagattatccgcatggcggcggaagagtttactcaggcgatgaacggggtgcggcagttcaaccggctgcagggtatcgatctgcatagctatcagtgcgaaaccatcttcgtcgatccaccgcgcagcgggctggacagcgagacggaaaaaatggtgcaggcctatccgcgtattttgtacatttcgtgcaacccggaaacgctgtgtcgcaatctggaaacgctaagccagacgcacaacgttacccggctggcgctgttcgaccagttcccgtatacccatcacatggagtgcggcgtcctgctgacccgcaaatag

SEQ ID NO: 4993 - DNA, 1326 bp, Klebsiella pneumoniae
tataggtcaccagctctgcgccggcataaccactggcacccacaatcagcgtatttaacattggaagcgcatctccttacattcgatgggttttcttacgctcaacgatattgtatttttattcacaataaatgcatgaatattgatactatcacgacccaaggtgtgtcaacaatgaaaaacaatttaccgccctttatcgagatttaccgcgcgttgatcgccacaccgtccatcagcgcgaccgaagaggctctcgatcaaagcaatgagtctttaatcaatttgctggcaggctggttccgcgatctcggcttcaatgttgagatacagccggtaccggatacgcgccataaattcaacctgctggccagcaccggacacggcgccggcggcctgctgctcgccgggcataccgataccgtgccgttcgatgatggccgctggacgcgcgacccgttcaccctcaccgaacacgataacaagctctacggcctcggcacggccgatatgaaaggcttcttcgcctttattctcgacgccctgcgcgatgtcgacgtcaccacgctgaaaaagccgctgtatattctggccactgccgacgaagagaccagcatggccggcgcgcgctactttgccgaaaccacccggctgcgcccggactgcgccatcatcggcgagcccacctccctgcagccgatccgcgcccataaaggccatatgtccaacgcgatccgtattcagggccagtccggccactccagcgatccggcgcgcggggtcaacgcgattgagctgatgcacgacgccatcggccggattatgcagttgcgcgatctgcttaaagagcgctatcacttcgaggcgtttacggtcccttacccaaccctcaacctgggcgctatccatggcggcgatgcctcaaaccgtatctgcgcctgctgtgaactgcatatggatatccgcccgctgccggggatgaccctaaacgatcttaatggtctgttgggcgaggcgctggccccggttagcgaacgctggccgggccgcctgacggtctctgagctgcatccgccgatccccggctacgagtgcccgccggaccataagctggtgcaggtggtcgagaaactgcttggcgcgcagaccgacgtggtgaactactgcaccgaagcgccgtttatccagacgctgtgtccgacgctggttctcggcccgggctccatcaatcaggcccatcagcctgacgagtatctggagacgcgctttatcaagccgacccgggagctgattagccaggtggttcatcacttctgctggcactaa

SEQ ID NO: 4994 - DNA, 1314 bp, Klebsiella pneumoniae
aattgcccgtttcgtggcgcagtttcagccacaacagaccaaggagctttgcgcatgaccactcaacttgaacaagcctgggaaattgctaagcagcgctacaccgccgtcggcgtggatgtcgaggaggccctgcgccagctggaccgtctgcccgtctccatgcactgctggcagggtgacgacgtcgccggtttcgaaaacccggcgggaagcctgaccggcggtatccaggcgaccggcaactacccgggcaaagcgcgcaatgcagaagaactccgcgccgaccttgagcaggcgctgagcctgatcccggggccaaagcgtctcaatctgcacgctatttacctggaatccgacgcgccggtagcgcgcaatgagattaagccggagcactttaaaaactgggttacatgggcgaaagccaacaaactggggctggatttcaacccctcctgcttctcgcatccgctgagcgccgacggctttaccctgtcgcacgccaacgatgagatccgccagttctggatcgaccactgcaaagccagccgccgcgtatccgcttattttggcgaacagctgggcacgccgtcggtgatgaatatctgggtgccggacggcatgaaggatataaccgttgaccgcttcgccccgcgccagcggctgctgaacgcccttgatgaggtgatcagcgagaagctcgacccggcgcaccatatcgacgccgtggagagcaagctgttcggcatcggcgccgaaagctacaccgtcggctccaacgagttctatatgggttacgccaccagccgtcagacggcgctgtgcctcgatgccggccacttccatccgacggaagtgatctccgacaagatctccgccgccatgctctacatcccgcgcctgctgctgcacgtcagccgcccggtgcgctgggacagcgaccacgtggtgctgctggatgatgaaacccaggccatcgccagcgaaatcattcgccataacctgtttgaccgcgtgcacatcggcctcgacttcttcgatgcctccatcaaccgcatcgcggcctgggtgattggcacccgcaatatgaaaaaagcgctgctgcgcgccctgctggaaccgaccgcccagctgcgccagctggagaacgacggcgattacaccgcccgcctggcgctgctcgaagagcaaaaatcgctgccgtggcaggccatctgggagatgtactgtcagcgtcacgacacgccggcgggcagccagtggctggacagcgtacgggcttatgagaatgcggttctgagccagcgcgggtaa

SEQ ID NO: 4995 - DNA, 630 bp, Klebsiella pneumoniae
aacagcgtcacccccagctgcgcttccagatggcggatatggcgggtcagcggcggctgcgagataaataaccgctgcgccgcccggctgatgttattttcctccgctaccacggcaaaggcgcgcagcaggcgaatatccagagaatgtaatcttgaagttgtcatactgaaaaggtatcacgaaaagggtattactcaagtccggcacacttccctacccttcctcttaacgcaccatcacagagaggaaaaaacgatgtccagcgaacgttacatcatcggtcaggaaatgcttcagcgggtggatggtaagggcggggaagccgtcgtcgacagcctgcgggatatcgcccccgatttcgcccgctatctgattgagttccccttcggcgatatttacgccaggccagggctcgatttacgcagccgggaaatcgccaccatcgccgcgctcacggcgttgggtaacgccgagccacagctgaaagtacacattgccgcaggattaaacgtcggcctgacgcaagaggagattacggaagcgatcatgcagatggcagtctatgccggattcccggcggccctcaacggcctgtttgccgccagggcggtatttgcggcccactga

SEQ ID NO: 4996 - DNA, 441 bp, Klebsiella pneumoniae
aagagccgcactggatcatccagctacgatcgtctttcttctcggcggtggttttcggcgcttcttccacccgagttaccggcgccgcggcctgggtacgcggctgcgtggtattggtatgcgctggcgtctgcagcagatcctggtacggctgctggtttgacgcggtctgcttcggctgttgctgctgaaccggcttcggctgctgaacgcgcggcggctgctgttggacggtctgcgcctgagtctgcgcccattgttgctgctgcgcctgctgctgttgctgcgctaaacgctgacgctgaagcgtctgctggcgctgcgccggcgtttgttcgttccacggcacttcggtcagctgggtcggctgctggcgcatatcggcctgcatctgggcgagcagctggcgctgctcgtcggtcagctgttccggtttcatga

SEQ ID NO: 4997 - DNA, 609 bp, Klebsiella pneumoniae
cctgttttaacggagacgaccgtcttgaccaactggaattatcaactgacgcactttgtcactagcgcgccagatatccgccatcttcctgccgataccggtattgaagtggcgttcgccggccggtccaacgcgggaaaatccagcgcgctgaatacgctgactaatcagaagaacctggcgcgtacctccaaaaccccggggcgtacgcagctgattaacctgttcgaagtcgctgagggcaagcgccttgtcgacctgcccggctatgggtatgcgcaagtacccgaagagatgaagatcaagtggcagcgcgcgctgggggaatacctggaaaaacgtctgtgcctgaagggtctcgtggtgctgatggacatacgtcatccgcttaaagatctcgatcagcagatgatcgaatgggcggtagagagcgatattcacgtgctggtactgctcaccaaagccgataaactcgccagcggcgcgcgtaaagcgcaagtgaatatggtgcgtgaagcggtactggtcttcaatggcaatgtccaggttgaacccttctcttcgctgaaaaaatctggcgtcgatacagctgcgacagaagctggatag

SEQ ID NO: 4998 - DNA, 2463 bp, Klebsiella pneumoniae
cacggaccaacggtagcaagtcttgctccaacatttggtcgcggtgcgatgaccaaccactgggttgatattaaaaacgccaacctggtcgtagtgatgggcggtaacgccgcagaagcgcatccggtggggttccgctgggcgatggaagccaaaattcataacggcgccaagctcatcgttatcgatccgcgctttacgcgtacggcgtcggtggctgatttctataccccgattcgttccggtaccgacattaccttcctgtcgggcgtgatcctgtatctgctgaataacgaaaaattcaaccgcgaatacaccgaagcctacaccaacgccagcctgatcgtgcgtgaggactatagcttcgacgacgggctgttcagcggctataacgcagaaaaacgccagtacgacaaaaccagctggaactatgagctggacgaaaacggcttcgccaaacgcgatactacgctgcaacatccgcgctgcgtctggaacctgctgaagcagcatgtttcccgttataccccggatgtggtcgaaaacatctgcggtacgccgaaggccgacttcctcaaagtctgtgaatacattgctgaaaccagcgcgccggataagaccgcatcgttcctgtacgctctcggctggacccagcactccatcggtgcgcagaatatccgcaccatggcgatgatccagctgctgctcggcaacatggggatggcgggtggcggcgtcaacgccctgcgcggccactccaatatccagggtctgaccgacctcggcctgctctccaccagcctgccaggctacatgtcgctgccgaacgaaaaacaggccgacctgcagacctacctgacggctaacacgccgaagccgctgctgaaagaccaggtcaactactggggcaactatccgaagttcttcgtctccatgatgaaagccttcttcggcgacaaagccaccgcggaaaacagctggggctatgactggctgccgaagtgggataagagctacgacgttctgcagtacttcgagatgatgaatcagggcaaagtgaatggctatatttgccagggctttaacccggtcgcctcgttcccgaataaaaacaaggtcgtcgcttccctgtcgaagctgaagttcctcgtgactatcgacccgctcaataccgaaacgtccaccttctggcaaaaccatggtgagtcgaacgatgtcgatccggcgaaaatccagaccgaagtgttccgtctgccctccacctgcttcgccgaagagaatgggtctatcgtcaactccggccgctggctgcagtggcactggaaaggcgcggacgccccggggatcgccgtcaccgatggtgaaattctcgccggtatcttcactcgcctgcgtaagatgtatgccgaagagggtggcccggcgccggagccggtgctcaacatgacgtggaactactccacgccacacgagccggcatcggaagaagtggcgatggaaagcaacggtaaagcgctggcggatatcaccgacccggcaaccggcgcggtgatcgtcaagaaaggccaacagctgagctcctttgcgcagctgcgagatgatggcaccacctccagcggctgctggatcttcgccgggagctggacgccggaaggtaaccagatggcgcgccgcgataacgccgatccatccggtctcggcaataccctgggctgggcctgggcctggccgctcaaccgccgcatcctgtataaccgcgcctccgcggacccgcagggtaaaccgtgggatccgaagcgtcagttgctgaaatgggacggcgccaaatggggcggcgtggatattccggactacagcgccgccgcgcctggcagcgacgtcggtccgtttatcatgcagccggaagggatgggccgtctgttcgctatcgacaagatggcggaaggaccgttcccggaacactacgagccgtttgaaacgccgctcggaaccaacccgctgcacccgaacgtggtctctaacccggccgctcgcgtcttcaaaggcgatctcgagcagatgggtaaggccgagaagttcccgtacgtcggcaccacttaccgtctaaccgagcacttccactactggaccaagcatgcgctacttaacgccatcgcccagccggaacagttcgtggagatcggggaaaaactggcgaataagctcggcatcggccacggcgataccgtgaaagtttcctccaaccgcggctatatcaaagccaaggcggtggtgaccaaacgtattcgcacgctgaaagttgacggtaaggatatcgataccatcggcattcctattcactggggctatgagggcgtggcgaaaaaaggctttattgccaataccctgacgccgttcgtcggtgatgcgaatacgcagacgccggagttcaaagctttccttgtgaacgtggaaaaggtgtaa

SEQ ID NO: 4999 - DNA, 702 bp, Klebsiella pneumoniae
cgcaatgcaaccttattttttggcggcaaaacgcgctgcagcttcgtcccagttcactacgtcccagaaggctttgatgtagtccgggcggcggttctggaatttcaggtagtaagcgtgttcccagacgtccaggccgataatcgggaagccggaagcgccggaaatggcttcgcccatcagcggggaatcctggttggcggtggagacaacggccagtttgtcacctttcaggaccagccacgcccagccggagccgaaacgggtagcagcggctttttcgaattccgctttgaagttctccacggaaccgaaatcgcgctcgatagccgctttcaggtcgccctgcagggtggtaccggttttcaggcctttccagaacaggctgtggttcgcgtggccgccggcgttgttacgcagtacggtttttttgtcagccggcagctgatccagcttggtaatcagctcttcagcggacaggttagcgaactccggcaggctttccagcgcggcgttggcattgttcacgtaggtctggtggtgtttagtgtgatggatctccatcgtctgcttgtcgaagtgcggttccagagcatcgtaagcgtaaggcagggatggcagggtatagctcataatcatctccattattgtcgagcggctcaagtgttaacgccgcgtaagcagtttgtccattatagttaa

SEQ ID NO: 5000 - DNA, 984 bp, Klebsiella pneumoniae
gacagcgaaacgatagtggcacaacgagattatgtacgccgcagccaaccggcttcttcgcggcgcaaaaagagcacgacccgaagctcaaggaataagcaaagcagccttccggcgatttcaccggcgatggtggcgatcgcggcggctgtgctggtggcctttatcggtggcctctatttcattacgcatcataagaaagaagaagcggaagcgatgcaaaatcgccaggccgccggcaacggcttgccgcccaaaccggaagagcgctggcgctatattaaagagctggaaagccgccagcctggcgtccgcgcgccgaccgaaccgaccgccggtggcgaagtcatgaaaccggaacagctgaccgacgagcagcgccagctgctcgcccagatgcaggccgatatgcgccagcagccgacccagctgaccgaagtgccgtggaacgaacaaacgccggcgcagcgccagcagacgcttcagcgtcagcgtttagcgcagcaacagcagcaggcgcagcagcaacaatgggcgcagactcaggcgcagaccgtccaacagcagccgccgcgcgttcagcagccgaagccggttcagcagcaacagccgaagcagaccgcgtcaaaccagcagccgtaccaggatctgctgcagacgccagcgcataccaataccacgcagccgcgtacccaggccgcggcgccggtaactcgggtggaagaagcgccgaaaaccaccgccgagaagaaagacgatcgtagctggatgatccagtgcggctcttttaaaggcgccgagcaggccgaaaccgtccgcgctcagctggctttcgaagggtttgcttcgcacattaccactaacaacggctggaaccgcgtggttattggcccgttgaaaggcaaagaaagcgccaacgagatgatcacccgcctgaagatggctggacacgcgaactgcattcgtctcgccgccaggggttga

SEQ ID NO: 5001 - DNA, 639 bp, Klebsiella pneumoniae
ccatatcgaacgaatttccattataatgaacacataatgatcgtttttcaaggcgaacgaattgttcgatataaaaaacaaggggcgggtatgacacagccaatcagcgttatcgccaaaagtctggtgcgggagcgggcgcggaccgggctttcgctggcggaagtcgcgcgtcgggcgggtatcgcaaaatccacgctatcgcaactggagtccggcaacggcaacccgagtctggaaacgctgtggtcgctctgcgtagcgctggatattccatttgccaggctgcttgagccgcaggtgaacaaaacgcaggtgatccgccgcggcgaggggaccaaagtggtggcagagcaggcgaactatcaggccattttgctggccgcctgtccgcccggcgcgcgtcgggacatctatttgctgctcacccagcccggcgccgaccgcatttcgcatccgcatccgccaggctcggtggaacatattatcgtcacccaggggcgggcgcgggtagggctaacgtcggcgccggaagagctcggcgagggcgactatatctgctacccggcggatcaggagcatgtttttcaggcgctggagccggatacgcaggccctgctgatcgctgagcaaaactga

SEQ ID NO: 5002 - DNA, 1023 bp, Klebsiella pneumoniae
ctttcctatgcgaaaacagggatttttatgtcgctgaaagccattgccaaacaacttgggatctccgtcacgaccgtcagccgggcgttgaacggctacgacgatgtgtcgcaggagacccgcgcccgggttgaggctgaagcgcagcgccggggctatcgccccaacactttcgcccgccgtctgaaaatgggcaccatcgatgccgttggtctcgtcttccctgtccgccccgcgccgctcaacaataacgtttttctcgagatggtcggggagatcagccatgagctggcgcgccatgacattgatttgttgctgatcgccgatgatgagcaggcggataaacatggctatatgcgcatggtgcagggccgtcgcgtcgatgcattaatcgtggcccatactctggatgacgatccgcggctggcgcagctgcaggcctccggctttccgtttctggcgctcggccgtagccgcctggcgcagccctacgcctggtttgatttcgataactatgccggcacctgccgcgccacccgccatctgattcaacagggccaccagcgtatcgctctgctgggcgagaacaacaatcaggcgtttattttgcaacggcgtaacggctacctcgatgccctgcgcgaggcggggttatccgatgcatggctgcgtagcgtgccggcgtcgcgccgcggcggctatcaggccacgctggagctgctgcgtctgcctgagccgcctaccgcgattatcaccgactgcaacacccatggcgatggcgccgcgatggcgctcgcccacctggggcgtttaaccggcgacaaccgcgtcgccctggtggtgtacgacgggctgccgcaggacagcatcattgagaccgatgtcgccgcggtgatccagtccacgcgccagggcgtgggaaggcagattgctgatatggtgcgtcgcttaatcgccggggaggatctcgccacgctgcaggtgctatggcagccggaatttttcccgggtgaaaccgcctga

SEQ ID NO: 5003 - DNA, 1068 bp, Klebsiella pneumoniae
caacatcgcgccccgctcaccgagacggggcgaaatatcacctgcaaaccctacaaaactaactcatgtggagtaaaagcaatgaaaacaaagacaagcttgatcctcaccgttgccgccctggcgttgtccggttccgccttagccgaagttaaaatcgcccttgtggcgaaatcgctgggaaatggcttcttcgaagccgccaacgttggcgcccaacaggcagccaaggagttaggtgatgtcaaagtgatctacaccggcccgaccactaccaccgccgaggcgcagatcgacgtgctgaacgggttgatcgcccagggggtggatgcgatcgccatttccgccaacgatccggacgcggtggtgccggtgctgaaaaaagcgatgcagcgcggcatcaaggtggtctcatgggactccggcgtggcgccggcaggccgtcagatccatcttaacccctcaaataacgccttaattggcgaaaccaacgtcaagcttgccgccgatgcgctgcaggcgctgaacgttgagaaaggcgaggtggccgtgttaagcgccaccccaacctccacgaaccagaacatctggattgaggagatgaaaaaggtgctaccgcagtatccgtcggtgcagctggtcaccgtcgcctacggtgacgatctgtcggataaaagctaccgcgaagcggtgggtctgctgaaatcatatccggacctgaaagtcattgtctcgccgtcgtcggtggggattgttgccgccgcgcaggcggtgaaggaccagggcaaaatcggcaaagtgtatgtcaccgggctggggctgccgtcggaaatggccggcgcgatcaagtccggcgccagcaaaagcttcgccatctggaacccgattgacctgggctacgccgccacctatctggccgacgatttagtcaaaggcacggcgaccaaaaccgaagccagtatgggcaagctgggcaaagtgaagctggacgccgaggggaatggcgcgatggccaagccgtttgtctacgatgcgagcaacatcgataagttctcgaaaattttctaa

SEQ ID NO: 5004 - DNA, 321 bp, Klebsiella pneumoniae
acaatgacagcaaatccttccgctttttgtttagcgatgtgcgggatactatttaacacatcaaggcacagcgccttatctaaacaactaaatgaaagggtttatatcatgaaaagcatcaaaacttttgtcgcagtaatcgctatggccgcctctttcgcttccttcgctgctgaaaccgtgaccgcaaccgcctccacaatggacggcgcggaagcgaaaatcgccgcacaggcgcaggctgccggcgcttcgtcttacaaaatcaccgaagcgtttaccggcaaccgcgtgcatatgactgccgaactgaacaaataa

SEQ ID NO: 5005 - DNA, 1386 bp, Klebsiella pneumoniae
gtggctgcagcaggcggggctggcgctgcccatcctcgacccggaaagcgccattctgattggtctgcaacgcgtgtgatggtatcgggccgcgctgcggcccttcttgaggaaaatataatgaacccgaccgtctgtacccacaaaaacaaccccaacttctggattttcgggctgttcttctttctctacttcttcatcatggccacctgctttccgtttctgccgatctggctgtcggacgtcatcggcctgaataaaaccgaaaccggcctcgttttctccagcctgtcgctgttcgccatctgtttccagccgatcctcggagtgatctctgacaagctggggctgaaaaaacacctgatgtggatcgtgaccgttctgctggtgctgattgctcccttcttcctttatgttttcgctccgctgctgaaaaccaatatctggctcggagcgctgagcggcggcgcctatatcggctttgtattctccgcaggcgccggcgcgatggaggcctatatcgaacgggtaagccgcaacagcgggtttgaatacggcaaggcgcgcacctttggctgcctgggatgggcgctgtgcgcgactaccgccggaatgctgttcagcattaatcccgaatgggtgttctggatggggtcggccgccgcgctgctgctggtggtgctggtggccatcgccaaaccgcaggccagtcagtccgcgcaggtaatggactcgctcggcgccaatcgcccggcgatcgatttaaaaacggcggtgcgcatgttccgccagcgtaagatgtggatgtttattctgtatgttatcggcgtggcctgcgtgtatgacgttttcgatcagcagttcgccaccttcttcaaatcgttcttcgcgaccccggaagcgggcacccgcgcctttggtttcgccaccaccgcgggagaaatatgtaacgccatcattatgttcagctcgccgtggattattaaccgtatcggagcgaagaataccctgctgatcgccgggatggtgatggcggcaagaatgattggctcttccttcgccaccaccgccgcggaagtcgtagcgttgaaaatgctccatgcgctggaggtgccgttcctgctggtgggcgcctttaaatacatcaccggcgtgtttgacgtccggctgtcggcgaccatttatctggtgggcttccagttcgccaagcaggtggcggcgatcttcctctccgctttcgccggcaatatgtacgatcggatcggctttcaggatacctatatgatcctcggcggtattgccctgaccgtcaccttaatctccgcgtttacgttagcgggtaagacgaaaaccgagccgctgcgcgataatgcaatgaccgtttaa

SEQ ID NO: 5006 - DNA, 342 bp, Klebsiella pneumoniae
ggttcgcgagctctatctggaggccttatgatccgtaaagccttcgtcatgcaggtgaaccccgacgcgcacgaggagtaccagcgccgccataaccccatctggccagagctggaagcagtgctgaaagcgcacggagcgcaccactacgccatctatctcgataaagaacgccatctcctgttcgcgacggtggagattgaatcggaagcccgctgggaagcggtcgccagcacggaagtatgccagcgttggtggaaatacatgcgcgaggtgatgcccagcaacccggacaacagcccgctgagcgcggagctcaaagaagtgttttatctggcgtaa

SEQ ID NO: 5007 - DNA, 627 bp, Klebsiella pneumoniae
ttttccacggcgcggaaggagacaaaaatgctctatatctttgatttaggtaatgtgattgtcgacattgacttcaaccgggtattgggagcctggagcgatttaacccgcatcccgctggcgacgctgaagcagcatttcaccatgggtgaggctttccatcagcatgagcgcggcgagctcagcgatgaagactttgccgccgccatgtgccatgaaatgaatatgcccctcagctatgaacagtttgctcacggctggcaggcggtgtttgtcgcgctgcgcccggaggtgattaccatcatgcataaacttcgtgcccaggggcatcgggtggtggtgctctccaataccaatcgtctgcacaccacgttctggcccgatgaatacccggaagtgcgcgcggccgccgatcgcatttatctgtcgcaggagatgggattgcgtaagcctgaagcgcaaatttatctgcgagtactggaagaagaggggttttccgccgcagatacggtcttttttgatgataacgtcgataatatagcaggggccaaccggttggggatcaccagtatcctggtgactggtaaggagaccatccctgactatttcgcgaaacagctatgctaa

SEQ ID NO: 5008 - DNA, 1356 bp, Klebsiella pneumoniae
gataaaacggctcagatcttcatctgccaccagaacatccaggtgtttactcacatattcggcatcaatagtgacggtctggccgttcatctcgctggcatcataggagatatcttccaccaggcgctccagcacggtgtgcaggcgacgcgcaccgatgttctcggtggtttcgtttacctgccatgcggcctgggcgatgcgcttgatgccgtcttcggtgaattcgatgttcaccccttcggtcgccatcagcgccttgtactgcacggtgatggaggcattcggctcggtcaggatgcgctcgaagtcgtgggtggtcagcgccttcagctcaacgcggatcggcagacgcccctgcagttccgggatcagatcggatgggctggccacctggaatgcgccggaggcgataaacaggatgtggtcggtcttgaccatcccatgtttggtggagacggtgcagccttccaccagcggcagcaggtcgcgctgtacgccttcgcgggagacgtccgggccggaggtgttgccgccgcgcttacagattttgtcgatttcgtcgataaagacgataccgtgctgctctacagcgtcgatggcttcctgcttcagctcttccggattgaccagtttggccgcttcttcttcaatcagcagcttcatcgcgtctttgattttcagcttacgcggtttctgcttctggccgccgaggttctggaacatagactgcaactggctggtcatctcttccatgcccggaggggacatgatttcaacgcccatcggcgccgcagcgagatcgatttcaatctctttatcgtccagctggccttcacgcagttttttacggaacgcctggcgcgctgcagacggttcctgcgacggctcagtctggccccagttgttcttcgccggtgggatcagcacgtcgagcacgcgctcttccgccagctcttccgcgcggtaacggttcttatcgatggactgcatgcgaaccattttgatcgccgcatcggtcaaatcgcggatgatggagtccacttctttaccgacatagcccacttcggtgaacttcgtcgcttcaactttgataaacggcgcgttagccagttttgccagacgacgggcgatttcggttttaccgacgccggttgggccgatcatcagaatgtttttcggcgtgacttcatgacgcagctcttcgttaagctgcatccgacgccagcggttacgcagggcgatagcaacagaacgcttggcggcgtcctgaccgataatgtgtttgtccagttcgctgacaatttcgcgtggggtcatttcagacatgggagatccttacgctttagaaggtaa

SEQ ID NO: 5009 - DNA, 2121 bp, Klebsiella pneumoniae
gcttccgcggcgcgaaaacgatggcggcgaagctcgagcagaacaaggacgtggcttatctctcttatcagctggcgaccatcaaaaccgacgtcgagctggagctcacctgcgaagagctggaagtcacaccggcggccgccagacgttctgcgggcgctgttcagacagtatgaatttaagcgctggaccaccgacgttgaggccggaaaatggctgcaggctaaggggggcaaaccggctgcgaaacctgcagtgcctgcagcagcggcagaagcggaagaagaggttgaagccgctactgcactttcagcagagcattatgtcactatccttgatgaggctacgctgctcacctggatcgataagctgaagcaggcgccgctctttgcctttgatacggaaaccgacagcctggataacatctccgccaacatggttggtctttcattcgctgttgagccgggcgtggccgcctatgttctgggagcgcatgattaccttgatgcgccggatcagatcccgcgcgagcgcgtgctgacgctgcttaaaccgctgctggaggatgagaaggtgctcaagggcgggcaaaatctcaaatacgatcgcggcattttggctaattacgacattgagctgcgcgggattgcgttcgataccatgctcgagtcttacattctcgacagcgtggctggccgccacgatatggacagtctttccgaccgctggctgaaacataaaaccattaccttcgaagagatcgctggtaaaggtaagaatcagctcacctttaaccagattgcgctggaagaggctggtcgctacgcggcggaagatgccgacgttacgctccagctgcatctgaagatgtggccgaagctacagcagcatgaaggcccgctgaatatcttccagcatattgaaatgccgctggtgccggtgctgtctcgcgttgagcgcaacggcgttaaaatcgaccccgccgtgctgcatgcgcactcgcaggaaattgcccagcgcctggttgagctggagcagcgagcacatgagatcgccggggaagcgtttaatctctcctccaccaaacagctgcaaacgatcctgtttgaaaaacagggtatcaagccgctgaagaagacgccgggcggtgcgccgtccacctctgaagaggtgctggaagagctggcgctcgattatccgttgccgaaagtgattctggagtatcgtgggctggcgaagctgaagtcgacctataccgataagctgccgctgatgattaaccccaaaacgggccgcgtgcatacctcctatcatcaggcggtcaccgccaccggccgtttgtcgtctaccgatccaaacctgcaaaacattccggtgcgtaacgaagaagggcgccgtattcgccaggcgtttatcgcgccggaagattacgtcattgtctcggcggactactcgcaaatcgagctgcgcattatggcgcacctgtcgcgggataaaggcctgctgaccgccttcgcggaagggaaggatattcaccgggcgacggcggctgaagtatttggcttaccgctggacagcgtcagcagcgaacagcggcgcagtgcgaaagccatcaacttcggtctgatctacggcatgagcgcctttggcctggcccgccagctgaacatcccgcgtaaagaagcgcagaagtacatggatctttatttcgaacgttatccgggcgtcctggagtatatggagcgcacccgcgcacaggcgaaggagcaagggtatgttgaaacgctggatggccgtcgactctatttgccggatatcaagtccagcaatggcgctcgtcgtgccggcgcggagcgtgcggcgattaacgccccgatgcaggggacggctgcggatattatcaagcgggcgatgattgccgttgatgaatggctccggagcgagaaacctcgcgtgcggatgatcatgcaggttcacgatgaactggtctttgaagtgcataaggatgagctcgatgccgtatcgaaaaagatccacgaactgatggagaacagcactacgctggcggtaccgttgctggtggaagtgggcagcggcgaaaactgggatcaagcgcactaa

SEQ ID NO: 5010 - DNA, 447 bp, Klebsiella pneumoniae
aaaccgcactacgctgatccgcgccgccagcggcgccgcgctggcgcttgccgccgtaccgtttgtgcccaccgggctgccggtgctgctttcgctgttcggtttactgtcgaggaaaaaataatgggcaatatgacgctgtttatcgccggtatcgccatcctgtcgctgggaacctatctgatgcgcctcggcggcgcgaagctcggcaatcggctggcattttccgagcgctcgcaggcgctgctttccgatgcggcgacggtgctgcttttttccgtcgcccttgccaccactttctatgagggcgcacatttcgccggtatggcgcgcgttctgggcgttgctttcgctgtgttcctcgcctggcgcaaggtcccgctgatcggcgtgattatcgccgccgccgtggtgaccgcgctgctgcgcctggcgggtataaactaa

SEQ ID NO: 5011 - DNA, 198 bp, Klebsiella pneumoniae
agttccttatactgttttaatatccagtgttatagcctggattatggcgaaaagacaggcctgttgaggtcgcctgtgcattatggaaagcggctcgcaaaaaagagtttacctgacaaaatcctgtttgtttccgattccaaaagctgtagattgctcataacttcatcactggtgatatacttgaggtatatatga

SEQ ID NO: 5012 - DNA, 471 bp, Klebsiella pneumoniae
agataccatctccagtgcgctgggtctgtggcaagactgcgaagaagacggcatggaatatcaacgtcagctacgcaaggagtggtaatgacctccggatctgcgctttttgataccaatattcttattgatttatttagcgggcgtcgcgaagccaaacaggcgctggaggcctggccaccgcagaatgcgatcagtctgattacctggatggaggtgatggttggcgctaaaaaatatcaccaggagcagcgcacgcgaatggcgctgagcacctttaatatcattaacatctcacaggatattgcagagcgaagcgttgcgctgcggcaggagtataagcttaagctgccggatgccatcattctggcgacggcgcaactccatcgtctggaactaattacgcggaatacgaaggattttgccggtattcctggcgtagtcacgccgtacgaaatccaccctgaataa

SEQ ID NO: 5013 - DNA, 897 bp, Klebsiella pneumoniae
ccaacccttcattactatcagccggtgactgataatttttctcattacgagggtggcatcatgaccatattgcacagtacggatttctttaaggccgggatctcgacggtggctattgaaccccgcctccctcagtcggcctttccggagcatcaccatgattttcatgaaatagttatcgtggagcagggagcgggtattcacgtcttcaatggccagccctataccatcggcggcggttcggtctgttttatccgcgatcacgaccgccatctttacgagcacacggataatctgtgtctgaccaatgtgctctatcgcgcgccggatgcgtttcgctttctcgccggggtcagtcaactactgccccaggaacaggaaggaaactacccctcgcactggcgggtgaatcaaaccgtcctgcaacaggtgcggcatatcgtggcgcagatcgaggccgtggggagcgatacggatactcatgccgtcgccagccgtgagatcctgtttatgcagctgctggtgctgctacgtaaaagcagccttgcggaagaggccaccaacaacgatgcgcggctgaatcagctgttggcctggcttgaagaccattttgcgcaggagatctgctgggaggaggtggcggcgcagttttcgctgtcgctgcgtacgctgcaccgccagctgaagcagcaaaccggtctgacgccacagcgctatcttaatcgggtgcgcctgatgaaagcccgccacctgctgcgccacagcgatgaaagcgtgactgatatcgcttttcgctgcggcttcggcgacagtaaccacttttcgacgctttttcgccgggagttcgactggtcgccgcgcgatatccgccaggggcgcgacgccattcttcagtaa

SEQ ID NO: 5014 - DNA, 375 bp, Klebsiella pneumoniae
ttttatcctcatctttttttatcggagacggcggcttccgatgggatgagtgtaaaaattggccgctttggccgccttcaggacgttgccacaggatggcgaaccctggcaaccatgggcttaattagttgttctacatcacaaaacgacgggtatttcttctggttatatccatatgaaaaatacggcattgataagcattttcaataccatttaattaactataatggacaaactgcttacgcggcgttaacacttgagccgctcgacaataatggagatgattatgagctataccctgccatccctgccttacgcttacgatgctctggaaccgcacttcgacaagcagacgatggagatccatcacactaa

SEQ ID NO: 5015 - DNA, 210 bp, Klebsiella pneumoniae
tgggttcatcatcacaccttaaataagagactgcgtctcagcgaagccgaaacgaatattcgcgcactgcaccgcctgcgctgcggcgcctttcagcaggttatcctctgccgcgacgacgatgagatgatcgtcctgcacggcaaaaccgatatcacagaatggcaggccttcgacgcttttcaaagcgggcacgcctttatcatataa

SEQ ID NO: 5016 - DNA, 1497 bp, Klebsiella pneumoniae
gatatcagtcagatcctattctcaatggtccagcgggtggaatacatccgcggcccgcgttccgcggtgtacggttccggagcgatcggcggggtggtgaacatcatcaccatgaccgacgctgagcgttcgcagatcaacgccggcgcgggtacgaacggctatcagtcatatgacggcgcctttaacaagcggtttggcgatacgttggttaccgctgctggcgcctatcagaccaccaaagggtttaacgtccagccgaattcctcttacagcggcgacagcgatcgcgacggctaccgcaataaaatgctgtggggcggggtacagcatcagttcgatgacaacttctcggggttcttccgcggctatggttattccgccaacgctgactatgaccagggtaactggggctacgcaggtggaaacgatgaagatcaatcctatacccaatcctgggataccggtctgcactaccactccggaatttactcctcccagctgattgctaactatcagcgcatcaaagattacaactacagcagcgacggtggccgatatgccgcgggcaccaccgtggatgatatggaacagcgctatatccagtggggaaataatgttgtggtaggccatggggcagtgagcggcggcgttgactggagaccagagaagctgaaatccagcggaacgaccagtaccgacgtgtataagcgggacaccaccggtcttattctgacgggacagcagcagattgacagcgtgacgttggaagcttccggccgtgaggatcatgacgagcagtttggctggcacggtacctggcagacggccgcaggctgggaatttatcgacggttatcggacaacgctctcgtacggcacaggattcctcgccccttccctcgggcagcagtacggcgcagaacgctttggcatcgcctctaacccgaatctgaagccagaggagtcgaagcaatgggaagcgggccttgaagggttaactgggccggtcgactggcgcctctccgcgtatcgctatgagattcaaaacctcatcgattacgacaacaacgcctattacaacgtcaagtcggcgacgattaaggggctggagtggacggggaatataaccaccgggccggtggagcaccatctgacgctgcagtatgttgaccctcgcgatgatgaaaccaataagatcctctatcgccgggcgaagcagcaggtgaaatacgagctgaacggccaggtctacgatctggggtgggatgtgacgtatcactacatcggcaagcgttacgattatgactacgacaactcgcgtaccgtcaatatgggtgggttgagcctctgggatgtcggtttatcgtatcccgtcacctcacacctgacagttcgtggtaaaatagccaacctgttcgataaagattacgagacagtttatggctaccaatctgcaggacgggaatacaccttgtctggcagctacaccttctga

SEQ ID NO: 5017 - DNA, 2136 bp, Klebsiella pneumoniae
tggagatgtctgatgtctgattcgctgattcacctgcaaagcgccggtgccgatgttgtgattaaaacccgccctttcgccgaaattgtctactggggaccgcatttaagccacttttcgccgcaggatgccgacagcctgacgcgcccggtcgccaacggcagactggatgttgattcgccagtgaccttaatggcggagctgggccatggtctgtttggcgcgccgggcattgaaggccatcgtcaggggctggatgcctctccgctgttcaccacaagcgaagtgcggcacgagggccagacgctgaccctggtcagcgaagatccgcaggccggcctgcgcctgcagagcgagatcgcgttggatgccagcggcgtgctgagcgtgcgccatggcgtgaccaatctgcgcgccagcccatggcaggtggatcgcctggcggtcacgctgccggtcgccgaacgcgctcgcgaggtgatggctttccatggccgctggatccgcgagtttcagcctcaccgcctgacgcttgagcacgacagctttgtgctggagaaccgccgcgggcgcacctctcacgaacatttcccggccctgatcaccggcagccgcgcctttagcgagatgcagggtgaagtctggggcgtgcatctggcctggagcggtaaccatcgcctgcgggcggaggtgaaaaccgatggccgtcgctatctgcaggccgaggcgctctatctgccgggcgaaatggcgctggcggaaggggaaaccttgtggacgccgtacctgtatgccagctactcggcgaatgggctgaacggcatgagccagcagttccatcgttatctgcgcgaacggattattcgtttcccgggcaacaaaccgcgcccggtgcatctcaacacctgggaggggatctatttcgaccacgacccggactacatcatgcgtatggccgacgaagcggcggccctgggcgtcgagcgctttattatcgatgacggctggtttaaagggcgcaacgacgactgggcggcgcttggcgactggtatctcgatgagaaaaaatacccctacggcctgacgccggttatcgatcacgtgaagtctctgggtatggaattcggtatctgggtggagccggaaatgattaacccggattccgatctgtaccgggcgcacccggactgggtgctggcgctgccgggctataccccgctgaccggccgccatcagtttgtcctgaacctcaacattcccgaagcgtttgattatctgctggagcggatgagctggctgctgggcgagcatgcggtggactacgtgaagtgggatatgaaccgcgagttggtgcagcctgggcatcagggacgcgccgctgcggacgcgcaaacgcgccagttttaccgcctgctggatacgctggtggcccgtttcccgcacattgaatttgaatcctgctcctccggcggcggacggatcgattatgaagtcctcaaacgcagccatcgcttctgggcttctgacaacaatgacgcccttgagcgcaacaccatccagcgcggcatgagctacttctttccacccgaggtaatgggcgcgcatattggcaatcgccactgtcatgccaccttccgccagcatagtatcgccttccgcggcctgacggcgctgttcggtcatatgggccttgagctggatccggtgagcgccgatgaagaagagcgcgccggataccgaaaatatgcggccctgcataaacagtggcgcgacgtgatccatcacggcgtgcagtggcgaatagatatgccggatgctaccactcttgcccatggcgtcgtcagcccggataaagcgcaggcgattttcctcgttagccagctggcgatgccggactacaccctgatggcgccgctgcgcctggcgggcctggaggcgagcgcccgctatcaggtgacgctcctcgatcatccgaacattcagatcaccggtgagggcggccacaccatgcggaagctgccggcatggatgacgacgctgcagacggtgagcggtgagtggctgcagcaggcggggctggcgctgcccatcctcgacccggaaagcgccattctgattggtctgcaacgcgtgtga

SEQ ID NO: 5018 - DNA, 432 bp, Klebsiella pneumoniae
agacatggccaagtggtgacgcgaggcatcaccctgatcaataccatgaccaacactatcctcggaccggatgaggtggttactaagtacggcgtcccgccggagctgattattgatttcctggcgctgatgggcgactcctcggataacattcccggcgtgccgggcgtgggcgaaaagaccgcccaggcgctgctgcaaggcctcggcggccttgatacgctgtatgcggaaccggagaagatcgctgaactgagcttccgcggcgcgaaaacgatggcggcgaagctcgagcagaacaaggacgtggcttatctctcttatcagctggcgaccatcaaaaccgacgtcgagctggagctcacctgcgaagagctggaagtcacaccggcggccgccagacgttctgcgggcgctgttcagacagtatga

SEQ ID NO: 5019 - DNA, 534 bp, Klebsiella pneumoniae
atcgcgacacaaacgttttgggagtatgtgatgcgcaatgttatcgctgccgtcatggcctcaacgctggcgctaagtgcatatagccaggccgctgaagtcgttaccagcgttaactggctccccggagacgaagggggacagcgcggtagccaaagccatatgtttgacggcataagtttaaccgagcagcaacgtcagcagttacgggatcttatgcaacgggcacgccacgacaggctccccgttaatgttagcgaaatggagacaatgcatcgccttgtcaccgcagaaaattttgatgaaaacgctgtgcgcgctcaggcagaaaagatggcgcaggaacaggttgcccgccaggtcgagatggctaaggttcgcaaccagatgtaccacctgcttacgccagagcagcaagcggttttaaatgctaagcaccagcagcgtatggatcagttgcgtgaggttgcaaggatgcagaaaggctcagcgatgatgctttcgagtagtagcaacaccctgcaaccccagtaa

SEQ ID NO: 5020 - DNA, 516 bp, Klebsiella pneumoniae
aaactctcgcagcaactgaacgttaagcctatgaaatacgatacttccgagctttgtgacatctaccaggaagatgtcaacgtcgtggaaccgctgttctctaactttggaggacggtcgtcgtttggtggacagatcattacggttaaatgtttcgaggataacgggttgctctacgatctgctcgagcagaatggccgtggtcatattctcctgatcgacggcggcggctcagtacgacgcgcgttaattgacgctgacctggcgcgtctggccgtccagaatgaatgggaagggttggtggtctatggcgcggtgcgccaggttgacgaccttgaggaactggacattggtattcaggcgctggcggcgattccggtcggcgcggctggcgaaggcatcggcgaaagcgacgtgcgcgtcaatttcggcggggtgactttcttctccggcgaccatctgtatgccgataacaccgggatgatcctgtcggaagacccgctggatatcgaataa

SEQ ID NO: 5021 - DNA, 2028 bp, Klebsiella pneumoniae
acggtgcagcagttccgcctgcaggacgttcagcgggtcggtatagatattacgcagctggatagactcggcgatccacggcaggtcggccatcagatgggagtcgttggcgatggccagcacgacgttgatatcggcagccagcagcttgcgcagctcggaacccagcgcccacagctccggcttcaccaggcgctgatcgtagtactccgccagccacaggtcggccttcgagtaaaccatctccagcatgccgaggcgggtagagaagaacggccagtcgcgacacatggcttccagttcactctgttttccaccttcgaccaccttctgcagcgcagcgccagcgcccagccaggctggcagcatcaggcggttctgggtccaggcgaagatccacggaatggcgcgcagcgactcgacgccgccggttggacgacgttttgccggacgcgaacccagcggcagtttgcccagctcctgctccggggtcgcagagcggaagtaagggacgaaatctttgttttcacgcacgtagccgcgatacatcttgcacgacacgtcggacagctcggccatgatgtcgcgccattctgctttcggctccggcggcggcagcaggttggcttccagaatggcgctggtatacagcgacaggctgctgatggtgatttccggcaggccgtacttaaagcggatcatctcgccctgctcggtaacgcgcaggccgcctttcaggcttcccggcggctgcgagagcagcgcggcgtgggccggcgcgccgccgcggccgatagagccgccgcgaccgtggaacagcgtcagttcaataccggctttttcgcaggttttgatcagcgcgtcctgcgcctggtactgcgcccaggaggcggccatcacgccggcatctttagcggagtcagagtagccgatcatgaccatctgcttgccctggataaagccgcggtaccagtcgatattcagcagctgggtcatgacgtcgttggcgttgttgaggtcatccagcgtttcgaacagcggggccaccggcagagcaaagccaatcccggcttctttcagcaggagatgaaccgccagcacatcggacggcgttttcgccatcgagatcacgtaggcggcgatcgatccgcgcggcgcctcggcgatcaccttgcaggtgtcgagaacttcacgcgtctcttcgcttggctcccactggcgcggcagcagcggacgtttggaattcagttcgcggatcaggaaagcctgtttgtcggcttccgaccagctttcgtagtcgccgatcccgaggtaacgggtcatttcacccagcgcttcggtatggcgggtgctttcctgacgaatatcaatacgcaccagcggtacgccgaaagacttcacgcggcgcagggtgtcgagcagctcgccgttggcgataatgcccatgccgcaggcctgcagcgatttatagcaggcgtacagcggctcccacagctgctcgttctgagtgatcagtcccgccggtttcggcagcttctggcctttcaggcgcgcttccagccaggcctgggtctccatcagctgagagcgcagttttttcatcagataacggtacggttcctgagcgccctcggcgccagccagggcgcgcagctcgtcggtacactccaccatcgacagctcggagatcagcacctgcacgtctttgaggaacaggtcggtcgctttccagcggctgagcagcagcacgtggcgggtgatgtcggcagtcacgttcgggttgccgtcgcggtcgccgcccatccacgaggtgaaacgcaccgggacgaagtccaccggcagctgatagccaaggttggcttccagctgttcgttcagctcgcgcagatagttaggcaccccttcccacaggctgttttccaccaccgcgaagccccatttggcttcatcgaccggggaagggcggtgcttacgaatttcatcggtatgccacgactgggcgatcagctggcgcagacggcgcattag

SEQ ID NO: 5022 - DNA, 324 bp, Klebsiella pneumoniae
  unsure (107): Identity of nucleotide at the above locations are unknown.
aacctgcggcatcctttttctgtttcggatgcttttacaatgattaaaaaagcttcgctgatgacggccttatccgtcacggcattttccggctgggcgcaggatancaattcagatacgttggtggtgacagcaaaccgttttcaacagccggtcaataccgtgctggcgccgaccgacattgtgacgcgcgatgacatcgaccgctggcagtccaaagatttaaacgatgtcatgcgtcgtcttcccggggtcgatattgcccgcaacggcggcatggggcagaacgcttcgctgtatgttcgggggacggaggctcgttag

SEQ ID NO: 5023 - DNA, 348 bp, Klebsiella pneumoniae
ccaatatttaacccgcaattaaacgctgcggatgggtataaactgtcgccctgcccggcttgcaaaagcccaccagcgtcagattgcagcgctcggcaacttccactgctaaggtggtggccgccgagaccgcgaacaggatctcgacgccgcacatcgcggccttctgcaccatttcatagctggcgcggctggagaccagcgcggcgccatgctgccacccctcgccgacttccgcccgccggcccaacaatttatccagggcgacatgccggccaacgtcttcaaacccgcccgccagttcgcccgtcaaccggacccacgcggccgcgtgagtacagccggtga

SEQ ID NO: 5024 - DNA, 789 bp, Klebsiella pneumoniae
atcatccttaatcacgatgcgtacatttatccagtttttggcaaatttgtcatctggcgatccttcgaacgaaagccgtatgcttacctcaacgacagcaccgaattaagcattgaggaaaacacaatggaactctatctggataccgccaacgtcgccgaagtggaacgcctggcccgcatctacccgctggccggggtaaccaccaacccgagcattatcgccgccggtaaagtcccggtctgggatgtgctgccgcgcctgcaaaaagccgtcggtccggagggcaccctcttcgcgcagaccatgagccgcgacgcgcagggcatggtggaagaggccaaacgtctgagcaatgccgtgccgggcattgtggtcaaaatcccggtcaccgccgaagggctcgccgctatcaaactgctgaagaaagaaggcatcccgacccttggcaccgccgtctacagcgcttcgcaaggcctgctggccgcgctggccggcgcaaagtacgtcgcgccttacgttaaccgcgtcgacgcccagggcggggacggcatccgcatggtgcaggagctgcaatccctgctggaaatgcatgcgcccgagagcaaagttctggcggcaagcttcaaaacgccacgccaggcgctggattgtctgctggctggctgcgaagcaatcacccttccactagatgtagcgcaacaaatgctcggcacccctgcggtagagtcagccatagagaagttcgaacaggactggaataacgcctttggcacgctgaatctgtaa

SEQ ID NO: 5025 - DNA, 291 bp, Klebsiella pneumoniae
attgctcataacttcatcactggtgatatacttgaggtatatatgagcatgatggctgaaagggatatgggcagaattcttctcgatttatcagacgatgtcattcaacgtctcgatgacctcaaagtgcagcgtaacattccgcgagcggaactgttacgtgaagcggttgaacaatatctggagaaacaagatcgagctaaagataccatctccagtgcgctgggtctgtggcaagactgcgaagaagacggcatggaatatcaacgtcagctacgcaaggagtggtaa

SEQ ID NO: 5026 - DNA, 702 bp, Klebsiella pneumoniae
acaatgaataaaatcctgttagttgatgatgaccgggagctcacctccctgttaaaagagctgctcgatatggaaggttttaacgtgctggtggcccatgatggggaacaggcgctggcccttctggacgacagcgttgatttattgctgctcgacgtgatgatgccgaagaaaaacggtattgatacgctgaaagagctgcgtcagacacaccagactccggttatcatgctaacagcgcgcggaagcgagctggatcgcgttctcggcctcgagctgggcgcggatgactatttgcctaagccattcaacgatcgcgagctggtggcccgtatacgcgcgattctgcgccgttcccactggagcgagcagcagcagacgaccgaagccggctcaccaaccctggaagtggatgccttaagcctcaatccgggccgccaggaagccaatttcgatggccagacgctggagctcaccggcaccgagttcaccctgctctatctgttagcgcagcatctcggtcaggtagtctcccgtgagcatttaagccaggaagtgttaggcaagcgcctgacgccgttcgaccgcgccatcgatatgcatatttccaacctgcggcgtaagctgccggagcgcaaagatggccatccgtggtttaaaacgctgcgtggccgcgggtatctgatggtttccgcttcatga

SEQ ID NO: 5027 - DNA, 1125 bp, Klebsiella pneumoniae
aaattctgtaactcactgccgcgactatctgataaaaatgatgcagcagttagcgcccaagggaaatgccagcgccattcagcgaggagaaaccaggtgaagcccaaaaaacaagtggttgccgccaccatgaaagacgtcgccctcaaggcaaacgtttccacggcaaccgtgtcccgagcgttgatgaaccctgataaggtgtcgcaagccacccgtaaccgggtcgagcaggcggcgctggaagtcggctatttaccgcagtcgctcggacgcaatatgaagcgcaacgaatcgcggacgatcctcgtgatcgtcccggatatctgcgatcccttctttagtgaagtgatccgcggtattgaagtcactgccgccgagcacggctatctggtgttaatcggcgattgcgcccaccagaatcagaaagaaaaaacctttatcgaccttatcatcaccaagcagatcgacggcatggtgctgctcagctcgcgcctgccgtttgacgccagcgtggaagagcagcgcaatttgccgccaatggtcatgtcgaatgagtttgcgccggagctggagctgcccaccgtccatatcgataacctgacggcggcctttaacgcggtaaattatctccacgagctgggacatcagcgtatcggctgtatcgccggcccggaagatatgccgttgtgccattatcgcctgcagggttatgtgcaggcgctgcgccgcagcggtatcaccgtcgatccgcactatattgctcgcggcaactttaccttcgaagccggcgccaatgcgctggagcagctgctggcgcagccggtgccgcccacggcggtcttttgccatagcgatgtgatggcgctgggcgccttatcgctggcaaaacgtcgcggtctgaaagtgccggacgacctgtcaattgtcggcttcgataacatcgcgttatctgaattttgcgatccgccgttgaccacggtttcacagccacggtttgatatcggccgtgaaggaatgctgctattactggagcaaatgcaggggcataacgtgaacagcggctcgcgtctgctcgattgcgaactgattgttcgcggcagtacgcaaaaaatcagacgataa

SEQ ID NO: 5028 - DNA, 1500 bp, Klebsiella pneumoniae
actgcggacaatgattttaagaaggatcgtttcatgagtattcgtcattgtgtcgctgtcgatttaggcgcctccagcgggcgggtgatgctcgccagctatcagcccgggccgcgcgccctgacgctgcgcgaaattcatcgcttcaccaatagtctgcagaaagtagacggcttcgactgctgggatgtagatagcctggaaggcgagatccgccgcgggctggagaaagtgtgtgagcagggcattctggtagacagtatcggcatcgatacctggggggtagattatgtcctgctggataagcagggccagcgcgtcgggctgccgatttcctatcgtgacgaccgcacccagggcctgctgcgtcacgctgaagcgcagctgggccgggcggaaatctatcgccgcagcggcattcagtttttgccgtttaacacgctttatcagctgcgcgctctggtggagcagcagccggagttggtcagtcaggctgcccatgccctgctgatccccgactatttcagcttccgcctgaccggcaatctgaactgggaatataccaacgccaccaccacccagctggtcaatattaacagcgatagctgggatgagacgctgctgaactggaccggcgcgccgttggcgtggttcggaaagccgacccaccccggcaatgtgataggccactggatctgcccgcagggtaaccgaattccggtagtcgctgtcgccagccacgacaccgccagcgcggtgatcgcctccccgctggccgaccgccatgccgcctatctctcctccggcacctggtcgctgatggggtttgaaagcctgacgccgtacacctgcgacgcggcgctgcaggccaatatcaccaacgaaggcggagccgaaggccgctatcgggtgctgaaaaatatcatgggcctgtggctgctgcagcgggtgctaaaagagcaaaacgtcagcgacctgcaggggctgatcgcccgcaccgccgcgctaccggcgtgccgcttcataattgactgcaacgatgaccgctttatcaacccggccagtatgagcgccgagatccaggccgcctgtcgcgacgccgggcagccggttcctgaaagcgatgccgaactggcgcgctgcattttcgacagcctggcgctgctctacgcccgggtgcttaacgagctggcggcgctgcgcggccaccccttcagccagctgcatatcgtcggcggcggctgtcagaacacgctgctcaaccagctgtgcgctgacgcctgcgggatcgccgtcgtggccggcccgatagaggcctccaccctcggcaatatcggcatccagttaatgaccctcgacgagctggccaatgtcgatgagtttcgtcaggtagtgcgcggcaacgcggcgctcaccacttttacccccaatcctgatagtgaaattgcccgtttcgtggcgcagtttcagccacaacagaccaaggagctttgcgcatga

SEQ ID NO: 5029 - DNA, 1170 bp, Klebsiella pneumoniae
cgacctgtaaaaatcgttggtattgacctgccagtggatactctctttaccattaatgcctgtaaaacttttggctgccgcaatttaggtttaccgtctgcggctgagtatcatttcccgaattttcggctgggctacccggcgctctactgcgcagcctgcggcagctatccccccctgtttaacgaacgggaattccgcccctggctggcggcttatctgacggatcatgcccgccgctacggctatttttgcccggtatgctatcagcgggatattattcgctacggccgcaatccgcagggtacgcaacgccttcagtgccgccactgtaaaaaggtctggacgccaaaattcccacacatcgccccaattgaagccccacgacgtatttgcagcgtaccgttgatagcgccattccagggtaatgccgccgggcaaaagctctattttttattaagctttgatgccgtgcgcggtaatgttattcatcttacctctaatttcactcctttcgcggtaggcgaatcattacgctatcactggcgcggcggacaagccgacagggaggagactgacgatattattcaacgtatttctctcactgaaatgcgctttttacaacgcagtcagttcgatgaaatccagtacggcagcgcaatgcaaaagcgccatgcccgcggcaatatattgcgcccggttatcgccgcgcacggtcatttcaaactgctcagccagcggtttccagaggtgaaaacgcacgttattgcgcatgaatgctttttacgcggcgcggcgatcgttgcctgggcgccgctttttcgtcagcggcaaggcgatctatggtatgtggaagaagagataaggaacccagccagcccggctccgtggcagctacaggggaaaacccatcatggctggtggcaaaattcatggcagcgttggacgcaggaagagaatcagaaaatggtctgccggcttgccggcactgtagaagagaacgcctttctaccagaccttgcggccagccgacggtttacaatatggctgaaaaacagacccgcgtttgcgcagagcgccctgtattccgcagggcgcgtaacgcaaatagtggcctcactggttcaagagtataacgcgacgcttacagcagctgcgccaggcggttaa

SEQ ID NO: 5030 - DNA, 2310 bp, Klebsiella pneumoniae
agcgcatcaaaggcggcgaatcatacagaatttgaccagcatatgcaaactgatccgcgccgccttatcgtaatgtgtatactatcccgccagatttcaagtcaggaagatgacatgtccgtcgcccacgttgccctacccgttccgctaccgcgcacttttgactacctgctgcctgaaggcatggcggtcaaagcgggctgtcgggtgcgggtgccgttcggcaaacaggagcggatcggcattgtcgcggcggtgagcgagcgcagcgaactgccgctggatgagctaaaaccggtcgccgaagcgctggacgacgagccggtcttctccacgactgtctggcgactgctgatgtgggcggctgagtattaccatcacccgatcggcgatgtgctgttccatgcattacccgttatgctgcgccagggcaaacccgccagcgccacgccgctgtggtactggttcgccaccgagcaggggcaggttgtcgaccttaacggcctgaaacgctcccggaagcagcagcaggcgctggcggcgctgcgccagggcaaaatctggcgtcatcaggttggcgaactggaattcaatgaagcggcgctgcaggcgctgcgcggtaaagggctggcggagctggcctgcgaagcgcccgccctcaccgactggcgcagcgcgtattcggttgccggcgaacgcctgcgcctgaataccgagcaggccaccgccgtcggggcgatccacagcgccgccgatcgtttctccgcctggctgctggcgggtattaccggctccgggaaaacggaagtctatttgagcgtgctggagaatgtgctggcgcaggggcgccaggcgctggtgatggtgccggagatcggcctgacgccgcaaaccatcgcccgatttcgccagcgctttaacgcgccggtggaagtgctgcactccgggctcaatgacagcgaacgtctctcggcctggctgaaggcgaaaaatggcgaagcggccattgtgatcggcacccgctcctcgctgtttaccccatttaaagatctcggcgtcatcgtcatcgacgaagagcatgacagctcctacaagcagcaggaaggctggcgctaccatgcccgcgacctggcggtatggcgcgcccacagcgagcagatcccgataattctcggctcggcgacgccggcgctggagactctgcataacgtccgccagggtaaataccgccagttaaccttaagcaaacgcgcgggcaatgcgcgcccggcccagcagcacgtgctcgatctcaaagggcaaccgctgcaggcgggcctgtctcccgcgctgattagccgtatgcgccagcacctgcaagcggataaccaggtgatcctgtttcttaaccgccgcggctttgcgccagcgctgctgtgccacgattgcggctggatagcggaatgcccgcgctgcgacagttactatacgttgcaccaggcgcagcaccatctgcgctgccaccattgcgacagccagcgcccgatcccgcgccagtgtccttcctgcggctccacgcatctggtgccggtagggatcggcaccgagcagctggagcaggccctggcgccgctgttccctgaggtgcctatctcgcgtatcgaccgcgataccaccagccgcaaaggagcgctggaggagcatctcgccgccgtccatcgcggcggggcgcgtattctgattggcacccaaatgctggccaaagggcaccacttcccggacgtcaccctcgtctccctactggatgtcgacggggcgctgttttccgctgatttccgctccgcagagcgtttcgctcagctttatacccaggtctccggacgagcgggccgggcaggaaaacagggcgaggtcattcttcaaacccaccatccggaacaccctctactgcagaccctgctgtataaaggctacgacgcctttgccgaacaggcgctggcagagcggcagacgatgcagctgccgccgtggaccagccatgtgctgattcgtgcggaagaccataacaaccagcaggcaccgctgtttttacaacagctgcgcaatctgctgcaggccagcccgctggccgacgaaaagctatgggtgctcggtccggttccggcgctggcgccaaagcgcggcggccgctggcgctggcaaatattgctgcagcatccttcgcgggtgcgtctgcaacatatcgttagcggtacgctggcgctgatcaatacgcttccggaggcgagaaaagtgaagtgggtgctggatgtcgatccgattgaaggataa

SEQ ID NO: 5031 - DNA, 564 bp, Klebsiella pneumoniae
atcggtgaaaagtcaggctccagagtaatcattgtcacaatagacgtcaatacatctggacatctaaacttctttgcgtatagattgagcaaagtgcaaatagccgttaaaattatatgcattagcgcacgtcgtcggcggcttatctcatgtcagaaagcccgcgcatacggtaaactacgcgcaattatagcccgggcggaatattctggcccttcactaataaacagaggattaaggtatctcatggctgaatggagcggcgaatatatcagcccatacgctgagcacggtaagaagagtgaacaagtaaagaaaattacggtttccattcctctgaaggtgttaaaaatcctcaccgatgaacgcacgcgtcgtcaggtgaataacctgcgtcacgcgaccaacagcgagctgctgtgcgaagcgtttctgcatgcctttaccggacaaccgttgcctaacgatgaagacctgcgtaaagagcgcagcgatgagatcccggaagcggcgaaagcgattatgcgtgaactgggaatcgacccggatacgtgggaatactga

SEQ ID NO: 5032 - DNA, 612 bp, Klebsiella pneumoniae
caatgtcgaaacaaggagcgaaccatgcaggtcagcagaaggcagttctttaagatctgcgctggcggtatggcgggaaccacggcagcagcgctgggctttgccccggcaactgcgctcgcggagacacggcagtacaaattgctgcgcacgcgcgaaacccgtaacacctgcacatactgttctgtcggctgtgggctgttgatgtatagcctcggcgacggcgcgaaaaacgccaaagcatccattttccatatcgaaggcgatccggatcatccggtcaaccgtggtgcgctctgtccgaaaggggctggtctggttgactttatccattctgaaagccgcctgaaattcccggaatatcgcgcgccaggctccgataaatggcagcaaatcagttgggacgaagcgttcgatcgcatcgccaagctgatgaaagaggaccgcgacgccaactttatcgcgcaaaacgacgccggcaccaccgtcaaccgctggttgacgaccgggatgctgtgcgcctccgcctccagtaacgaaaccggctatttaacgcaaaaattcacccgcgccctcgggatgctggcggtggataaccaggcgcgtgtctga

SEQ ID NO: 5033 - DNA, 459 bp, Klebsiella pneumoniae
aacagaagaaacagaacaaccatgattgcattaattcaacgcgtatcccgtgcaagcgttaccgtggcggacgaggtgacgggcgaaattggcccggggcttctggtgctgctgggcgtcgagaaagacgatgatgaacaaaaggcgaatcgcctttgtgaacgcgtgctgggctaccgcatcttcagcgatgcggaagggaaaatgaacctgaatgtccagcaggcgggcggcagcgtgctggtggtttcgcaatttacgctggcggccgataccgagcgggggatgcgaccgagcttctcgaaaggcgctgcccctgaccgcgctgaggcgctgtatgagtatttcgtcgcccgctgtcgccagcaggaaatgcacacccagaccggaagattcgctgcggatatgcaggtttctttggtcaatgatggtcccgtgaccttttggttgcaggtatga

SEQ ID NO: 5034 - DNA, 480 bp, Klebsiella pneumoniae
agagctggaaagccgccagcctggcgtccgcgcgccgaccgaaccgaccgccggtggcgaagtcatgaaaccggaacagctgaccgacgagcagcgccagctgctcgcccagatgcaggccgatatgcgccagcagccgacccagctgaccgaagtgccgtggaacgaacaaacgccggcgcagcgccagcagacgcttcagcgtcagcgtttagcgcagcaacagcagcaggcgcagcagcaacaatgggcgcagactcaggcgcagaccgtccaacagcagccgccgcgcgttcagcagccgaagccggttcagcagcaacagccgaagcagaccgcgtcaaaccagcagccgtaccaggatctgctgcagacgccagcgcataccaataccacgcagccgcgtacccaggccgcggcgccggtaactcgggtggaagaagcgccgaaaaccaccgccgagaagaaagacgatcgtag

SEQ ID NO: 5035 - DNA, 843 bp, Klebsiella pneumoniae
agcaaagtgaacaagaagcctctcgaacaaatcaaaaatgtgacgaatgtcacaggatatcgccaggtctccctctggaaacgcgaggatctgcaacaccctcagccagatgagttagcggaagaggtgcccgtcgcgctggtctacaacggtatctcccacgtggtgatgatggcctccccgaaagatttggagcaattcgccgtcggcttctccttatccgaagggattatcgagcaccggcgggagattttcggcatggacgtggtagcggtgtgcaacggccttgaggtgcagattgagctctccagccggcgttttatgggcctcaaagcccggcgtcgcgcgctggccgggcgcaccggctgcggcgtatgcggcgtcgagcagctcaatgatattggtaagccggtccagccgctgccgttcactcagtcgttcgatttagccaatctcgatcaggccctggcgcatcttaacgactttcaaccggttggccggctcaccggctgtactcacgcggccgcgtgggtccggttgacgggcgaactggcgggcgggtttgaagacgttggccggcatgtcgccctggataaattgttgggccggcgggcggaagtcggcgaggggtggcagcatggcgccgcgctggtctccagccgcgccagctatgaaatggtgcagaaggccgcgatgtgcggcgtcgagatcctgttcgcggtctcggcggccaccaccttagcagtggaagttgccgagcgctgcaatctgacgctggtgggcttttgcaagccgggcagggcgacagtttatacccatccgcagcgtttaattgcgggttaa

SEQ ID NO: 5036 - DNA, 1458 bp, Klebsiella pneumoniae
  unsure (15): Identity of nucleotide at the above locations are unknown.
agcgcagcgaatgtnatcatcgtgtttattttatgtataaaacaggtgagtaataccatgtcacactcttgggattatgatgcaatagtgattggttccggtcctggcggggaaggcgccgccatgggactggtgaaacagggagcacgcgttgccgtcatcgagcgctaccataatgtcggcggcggttgcacccactggggcaccatcccgtcgaaagccctccgccatgccgtcagccgtattatcgagtttaaccaaaaccccctctacagcgaccactcccgccttcttcgctcttctttcgccgacatccttaaccatgccgacagcgtcatcaaccagcagactcatatgcgccagggattctatgagcgcaaccactgtgaaattctgcagggcaatgcccacttcgtggatgagcatactctggcgctggagtgccatgacggcacggtcgagactgtgaccgcggagaaattcgttatcgcctgcggatcgcgcccctaccatccggcggatgtcgatttccaccacccgcgcatctatgacagcgattcgattctcagcctgcagcatgagccgcgccatgtgatcatttacggcgccggggtgatcggttgtgaatatgcgtcgatcttccgcggcatggaggtgaaggtcgatctgatcaacacccgcgatcgtctgctggccttcctcgatcaggagatgtcagactcgctctcttatcacttctggaacagcggcgtggttattcgccacaacgaggagtatgagaaaattgaaggggtggatgacggggtgatcatgcacctgaagtccggcaaaaagctgaaggccgattgcctgctgtacgctaacggccgcaccggcaacaccgacaccctggcgctggaaaatatcggtctgcagaccgacagccgcggtcagctgaaggtcaacagcatgtatcagaccgccctcccgcacatctatgcggttggcgatgtcatcggctatccaagcctggcttctgccgcttacgatcaaggacgcattgccgcccaggcgctggtgaaaggcgaagcctcagcgcatctgattgaagatatcccgaccgggatctataccattccggaaatcagctccgtcgggaaaaccgagcagcagctgacggcgatgaaagtgccgtatgaggtgggccgcgcccagtttaaacacctggcgcgggcgcaaatcgtcggtatgagcgttggtacgctgaagatcctgttccatcgtgaaaccaaggagatccttggcattcactgctttggcgagcgcgcggccgaaattattcatatcggccaggcgatcatggagcagaaaggcggtggcaacaccattgagtacttcgtcaacaccacctttaactacccgaccatggcggaagcgtaccgggttgccgcgctgaacggcttaaaccgcctgttttaa

SEQ ID NO: 5037 - DNA, 1092 bp, Klebsiella pneumoniae
tcggcgcagaacgcaacgagatgcagatcattcgtaactttatcggccaggccgataacgccgatcatccgcagaaaaaacgctatggccgcctggaaatggtgggcccgttttccgtccgggaacggggaggataactatcagctctatctgattcgtcccgccagcacctcacaatccgactttatcaacctgctgtttgaccggccgctgctgctgctgatcgtcacgatgctggtcagcgccccgctgctgctgtggctggcgtggagcctggcgaaaccggcgcgtaagctgaaaaatgccgccgatgaagtcgcccagggcaacctgcgccagcatccggagctggaagccgggccgcaggagtttttagccgctggcgccagttttaaccagatggtgacggccctggagcggatgatgaccagccagcagcggctgctgtccgatatctcgcacgagctgcgcacgccgcttacgcgcctgcaattaggtaccgccctgctgcgtcgccgcagcggagagagcaaggagctggagcgtatcgaaactgaagcgcaccggctggacagcatgatcaacgacctgctggtgatgtcgcgcaatcaggcgaaaaacgccctggtcagcgagacggtgaaagccaatcagctatggaacgaagtgttggacaatgcggcctttgaagctgagcagatggggaaatcttttaccgttgagtatccgccgggcccatggccgctgtacggtaaccccaatgcgctggaaagcgcgctggagaatatcgtgcgcaacgccctgcgctactcgcatacgaaaatttccgtcagcttctcggtggataaagacgggattacggttaacgtcgatgacgacggcccgggagtcagcccggaggatcgcgaacagattttccggccattctaccggaccgacgaagcgcgcgaccgcgagtccggcggcaccggcctggggctggcgattgtcgaaaccgctattcagcagcaccgcggctgggtgaaggccgacgacagcccgctgggtggtctgcgtttaacaatctggctgccgctgtataaacgaacctga

SEQ ID NO: 5038 - DNA, 1017 bp, Klebsiella pneumoniae
tggtcccgtgaccttttggttgcaggtatgacccagcttccgggcaggctgcgggtaacaaaagagagtacgactatgtatcaccttcgtgtaccgcaaacagcagaagagttagagagctactaccagttccgctgggagatgctgcgtaaaccgctgcatcagcctaagggatcggaacgtgacgcctgggatgcgatggcgcatcatcagatggtagtggatgaagagggcaacctggttgccgtcggccggctatatatcaatgcggagaatgaagcctccatccgctttatggctgtgcatccctcggtgcaggataaagggctgggtacgctgatggcgatgaccctggagtccgtcgcgcgtcaggaaggggttaagcgggttacctgcagcgcgcgcgaagatgcggtggaatttttcgccaagctcggatttgtcaatcagggtgagatcaccaccccgaccaccacgccgatccgtcattttctgatgatcaaaccggtcgcgtcgctggacgatattttgcaccgcggcgactggtgcgcacagctccagcaggcgtggtatcagcatattccgctgagtgaaaaaatgggcgtacgtattcagcagtacaccgggcagaaatttattaccaccatgccggaggcggggaaccagaatccgcaccatacgctgttcgccggcagcctgttttcgctcgctaccttaaccggatgggggcttatctggctgatgctgcgcgagcggcacctgggaggcaccattattctggcggatgcgcatatccgctacagccagcctattagcggccgccccagcgccatcgccgacctcggttctctgagcggcgatctcgaccgactggcgcgcgggcgtaaagcccgcgtgcaaatgcaggtggagctttttggcgacgataaacagggcgccgttttcgaggggatctacatcgtgctgccggcgaagccctttggctcgtacgaagagggtggcaacgaggaagagtaa

SEQ ID NO: 5039 - DNA, 1194 bp, Klebsiella pneumoniae
cttttcaccgattcagcccaggaacttcccaacatgacgcgtaaacaggccaccatcgcagtgcgtagcggtttaaatgacgacgagcagtacggttgcgttgtcccgccgattcacctctccagtacctataacttcaccggctttaatgaaccgcgcgcccacgactactcccgtcgtggcaatccgacgcgcgatgtggtgcagcgcgccttagcggagctggagggcggcgccggcgcggtgctgaccaataccggaatgtcggcgatcctgctggtgacgacggtgttccttaaaccgggcgatctgctggtggcgccgcacgactgctacggcggcagctaccgtctgttcgacagcctggcgaagcgcggctgctatcgcgtccagtttgtcgatcaaagcgatgagcaggcgctgcgggcggcgctggcggaaaaaccgaagctggtgttggtggaaagcccaagtaatccattgctgcgggtggtggatattgcgaaaatctgtggtctggcgcgtgaggccggggcaattagcgtggtggacaacaccttcctgagcccggcgttgcaaaacccgctggcgctgggcgccgatctggtgctgcattcctgtaccaaatacctcaatggtcactccgatgtggtggccggggtggtgattgccaaagatccggcaactgtcaccgaactggcatggtgggcgaataatattggcgtcaccggcagcgccttcgacagctatctgctgttgcgcgggctgcggacgctgtctccacggatggaagtggcgcagcgaaatgccctggcgatcgttgagtatctgaaaacccagccgctggtgaaaaagctgtatcatccatcgctgccggaaaaccaggggcatgaaattgcggcgcgtcagcaaaaaggttttggcgcaatgttaagcttcgagcttgacggtgacgagcagacgctgcgccgttttctgagcgggctgtcgctgtttacactggcggaatcgctggggggcgttgaaagcctgatttcccatgcggcaacgatgacgcatgccggcatggcgcctgaagcgcgtgccgccgccggaatttcagaaacgctcctgcgtatatcgaccggtattgaagatggtgaagatttaattgccgacctggaaaatggcttccgggcagcaaacgaggaataa

SEQ ID NO: 5040 - DNA, 1281 bp, Klebsiella pneumoniae
acggaagccgatcagaccgcggcttgggatcacgtagtcgagacgtacgcggcctttaccgtccggattcatgtttttcaggtcgcctttacgctcgcccagcgcctgcatgacagaaccctgatgctgctcttcgacgtccagcgtcacgttctcgaacggctcttgtttacggccgtcgatttcgcggaagataactttcggacgggaaaccgccatctcgaaaccttcacgacgcatgttttcaatcagaacggacaggtgcagttcaccacggccggaaacgcggaacgcatcagcgtcttcggtttcttcaacgcgcagcgccacgttgtgcaccagctctttattcagacggtccaggatctggcgagaggtaacgaacttaccttctttaccgcagaacggagaggtgttgacgttgaagaacatggaaacggtcggctcatcaacggacagggccggcagcgcttcgacattctgcgggtcgcagatggtgtcggagatgttcagctcacccagaccggtgatcgcaatgatgtcgccagcttcagctacgtcgctctcaattcgctccagacccaagtgagtcagtaccttaccgactttaccgttacgggttttaccttcgctatcgatgatagtgacctgctggttcggcttcactttaccgcgcttgatgcggccgatgccgataacaccaacgtagttgttgtagtccagctgggagatctgcatctgcagcggaccgtcaagatcaacgtccggcgccggcacgcgatcgacaatcgcctggtacagcggggtcatgtcgtcagccatgtcttcgtgatccagacccgcgataccgttcagcgcggacgcgtaaacgatcgggaagtccagctgttcgtcggtcgcatcgaggttaacgaacaggtcgaacacctgatcgacaacccagtccggacgcgcgcccgggcggtcaactttgttgatgaccacgatcggcttcagaccgtgggcaaaagcttttttggtcacgaagcgcgtttgcggcatcgggccatcaaaggcatctaccaccagcagcacagagtcaaccatggacataacacgctcaacttcacctccgaagtcggcgtgccctggggtatcaacgatgttgatacggtaatcattccatttgattgcggtgtttttcgcgaggatggtaatcccacgctctttctccaaatcgttggagtccatcacacgttcttgtgcttcagtacgtgcgtcgaacgtaccggattgctgtag

SEQ ID NO: 5041 - DNA, 879 bp, Klebsiella pneumoniae
ctatttcgcgaaacagctatgctaaaaaccgttcatcaaaaattactccaccatacccggccgctgctggcgtggctaaagctgctgtggcggcgcattgatgaagaccatatgaccaccctggcggggaacctcgcctatgtgtcattactgtccctggtgccgctgattgccgtcgtgttcgcgctgtttgcggcctttcctatgttctccgaagtcagcgtgcagatccgtcattttatcttcgccaattttattccggcgaccggggatgtaatccagggatatatcgagcagttcgtggccaactccagccgcatgaccgccgtaggcgcctttggcctgatcgtcacctcgctgctgctgatgtactcgatcgacagcgcgctaaacaccatctggcgcagcacgcgcagccgccccaaagtttattcctttgccgtttactggatgatcctgaccctcggcccgctgctggcgggcgccagcctggcgatcagttcctatctgttgtcgctgcgctgggcaagcgacctggacggcgtaattgataatctgctccgcctatttccgctgatcctctcctgggcagcgttctggctgctctatagtattgtaccgactacccaggtacgtaaccgcgacgcggtgatcggggcgctggtggcggcgctgctgtttgaggcaggtaaaaaggcgtttgccctctatatcaccacctttccgtcctatcagctaatttatggcgtgatttcggtggtgccgattttgttcgtctgggtgtactggacctggtgtatcgtcttgcttggcgctgaaattactgtcactctcggtgaataccgcaaacttaaaacagaagaaacagaacaaccatga

SEQ ID NO: 5042 - DNA, 2064 bp, Klebsiella pneumoniae
agaagtagagaaagaagaacagcccgaaaatccagaagttggggttgtttttgtgggtacagacggtcgggttcattatattttcctcaagaagggccgcagcgcggcccgataccatcacacgcgttgcagaccaatcagaatggcgctttccgggtcgaggatgggcagcgccagccccgcctgctgcagccactcaccgctcaccgtctgcagcgtcgtcatccatgccggcagcttccgcatggtgtggccgccctcaccggtgatctgaatgttcggatgatcgaggagcgtcacctgatagcgggcgctcgcctccaggcccgccaggcgcagcggcgccatcagggtgtagtccggcatcgccagctggctaacgaggaaaatcgcctgcgctttatccgggctgacgacgccatgggcaagagtggtagcatccggcatatctattcgccactgcacgccgtgatggatcacgtcgcgccactgtttatgcagggccgcatattttcggtatccggcgcgctcttcttcatcggcgctcaccggatccagctcaaggcccatatgaccgaacagcgccgtcaggccgcggaaggcgatactatgctggcggaaggtggcatgacagtggcgattgccaatatgcgcgcccattacctcgggtggaaagaagtagctcatgccgcgctggatggtgttgcgctcaagggcgtcattgttgtcagaagcccagaagcgatggctgcgtttgaggacttcataatcgatccgtccgccgccggaggagcaggattcaaattcaatgtgcgggaaacgggccaccagcgtatccagcaggcggtaaaactggcgcgtttgcgcgtccgcagcggcgcgtccctgatgcccaggctgcaccaactcgcggttcatatcccacttcacgtagtccaccgcatgctcgcccagcagccagctcatccgctccagcagataatcaaacgcttcgggaatgttgaggttcaggacaaactgatggcggccggtcagcggggtatagcccggcagcgccagcacccagtccgggtgcgcccggtacagatcggaatccgggttaatcatttccggctccacccagataccgaattccatacccagagacttcacgtgatcgataaccggcgtcaggccgtaggggtattttttctcatcgagataccagtcgccaagcgccgcccagtcgtcgttgcgccctttaaaccagccgtcatcgataataaagcgctcgacgcccagggccgccgcttcgtcggccatacgcatgatgtagtccgggtcgtggtcgaaatagatcccctcccaggtgttgagatgcaccgggcgcggtttgttgcccgggaaacgaataatccgttcgcgcagataacgatggaactgctggctcatgccgttcagcccattcgccgagtagctggcatacaggtacggcgtccacaaggtttccccttccgccagcgccatttcgcccggcagatagagcgcctcggcctgcagatagcgacggccatcggttttcacctccgcccgcaggcgatggttaccgctccaggccagatgcacgccccagacttcaccctgcatctcgctaaaggcgcggctgccggtgatcagggccgggaaatgttcgtgagaggtgcgcccgcggcggttctccagcacaaagctgtcgtgctcaagcgtcaggcggtgaggctgaaactcgcggatccagcggccatggaaagccatcacctcgcgagcgcgttcggcgaccggcagcgtgaccgccaggcgatccacctgccatgggctggcgcgcagattggtcacgccatggcgcacgctcagcacgccgctggcatccaacgcgatctcgctctgcaggcgcaggccggcctgcggatcttcgctgaccagggtcagcgtctggccctcgtgccgcacttcgcttgtggtgaacagcggagaggcatccagcccctgacgatggccttcaatgcccggcgcgccaaacagaccatggcccagctccgccattaa

SEQ ID NO: 5043 - DNA, 669 bp, Klebsiella pneumoniae
agatggctggacacgcgaactgcattcgtctcgccgccaggggttgaaaccctcaaaatcccccccatctataattgcattcggccccgcggacagcgcggggcccctgttccgcttttgcaaccaaggggtctgctcgtgactacaattgtaagtgttcgccgtaacggccatgttgttattgccggtgatggccaggccacgctgggcaacaccgtgatgaagggcaatgtgaagaaagtgcgtcgtctgtacaacgacaaagtgattgccggtttcgctggcggcaccgccgacgccttcacgctgttcgaactgtttgaacgtaaactggaaatgcaccagggccatctggtgaaggccgccgttgagctggccaaagactggcgaactgaccggatgttgcgcaaactggaagcgctgctggccgtcgcggacgaaaacgcgtcgcttatcatcaccggtaacggtgacgtagtacagccggaaaacgatttgattgctatcggctccggcggtccttacgcccaggccgcggcccgcgcgctgttggaaaataccgatatgggcgcacgcgacatcgccgagaaagcgttggatattgcaggtgatatctgcatctataccaaccatttccacaccatcgaagaattaccttctaaagcgtaa

SEQ ID NO: 5044 - DNA, 1191 bp, Klebsiella pneumoniae
ggggaaacggatttcccaaaatcaacattaaggagaattatcatgagttttatgttggcactacctaaaatcagcctccacggcgcaggcgcgatcggtgatatggtcaagctggtagcgggcaaacagtggggcaaggcgctgatcgtcaccgacggtcagctggtgaagctgggcctgctggacagcctgttcgccgcgctggatgaacagcagatggcttatcagctatttgacgaggtattccccaaccccaccgaagcgctggtgcagcaaggctatgcggcttaccaggcggcccgctgcgattacctgatcgccttcggcggcggtagcccgattgataccgccaaagcgataaaaatcctcaccgccaacccaggcccctccaccgcctactccggcgtcggcaaagtgaaaaacgctggcgtgccgctggtggccatcaacaccaccgccggcacggcggcggagatgaccagcaacgcggtaattatcgatagcgagcggcaggtgaaagaggtgattatcgacccgaacctgatcccggatatcgccgtcgacgacgccagcgtgatgctcgacattccgccagccgttaccgccgccaccggcatggatgccctgacccacgccatcgaggcctttgtctccgttggcgcccatccgctgaccgacgccaacgccctcgaggccattcgtctgattaacctgtggctgccgaaagcggtagacgatgggcacgatctgcaggcccgcgagcagatggcgtttggccagtatctggcgggcatggcgttcaacagcgccggtctcgggctggtacatgccctggcccatcagcctggcgccacccataatctgccgcacggggtatgcaacgccatcctgctgccgatcatcgaaaactttaaccgcccgaacgcggtggcgcgctttgcccgcgtggcggaggcgatgggcgtcgatactcgcggcatgagcgatgaagctgccagcatggaggccatcaatgccatccgcacgctgagcaaacgcgtagggatcccccagggttttagccagcttggcgtcagcaaagccgatatcgaaggctggctggataaagcgctggccgacccatgcgcgccgtgtaacccgcgccccgccagccgcgatgaggttcgcgagctctatctggaggccttatga

SEQ ID NO: 5045 - DNA, 669 bp, Klebsiella pneumoniae
caaactcaggagagagtaatgaccagaaagatccccctgctggccttaggattcggcatggctttagccagcgcccaggcgttcgcccacggcaaccatagccatggcccggcgttaaccgaagtggagcgtcaggccagcgaaggcatttttgcggataaagatgtgcaggaccgcgcgctgagcgactgggaaggcgtctggcagtcggtgaacccgtatctgctcaacggcgatctcgatccggtgctggagcagaaggcgaaaaagcccggcggcaagagcgtggaggagtatcgcgcctattataagaagggctacgccaccgatgtggagcagattggcattgaagatgacgtgattgagttccacgttggccagaccgtcaatagctgcaaataccgctattcaggctataaaattctgcattacgcctccggtaagaagggcgtgcgttatctgttcgagtgccagcagggcgatgccaaggcgccgaaatttgtgcaattcagcgaccatatcattggcccgcgtaaatcacagcatttccatattttcatgggcaatgaatcacaggaggcgttgctgaaagagatggataactggccgacctattatccgtatgcgctgcataaagaacagatcgttgatgagatgctgcaccactag

SEQ ID NO: 5046 - DNA, 1431 bp, Klebsiella pneumoniae
ccaatccgggagagtttaagtatgtccgctgaacacgttttgacgatgctgaacgagcacgaagtgaagtttgtcgatctgcgcttcaccgataccaaaggtaaagaacagcacgtcacgattccgtctcatcaggtaaatgccgaattcttcgaagaaggcaaaatgtttgatggctcctcgattggtggctggaaaggtatcaacgaatctgacatggtcctgatgccggacgcgtccaccgcggtcattgacccgttctacgaagaaccgaccctgatcatccgctgcgatatcgtcgagccaggcaccctgcagggctatgaccgtgacccgcgctccatcgcgaaacgcgctgaagattacctgcgcgccaccggcatcgctgataccgtcctgttcgggccagaaccagaattcttcctgttcgacgacatccgctttggcgcctctatctccggctcccatgtcgcgatcgatgacattgaaggtgcgtggaactcctctaccaaatacgaaggcggtaacaaaggtcaccgtccgggcgtgaaagggggttacttcccggttccgccagtagactcttctcaggacatccgttccaccatgtgtatgatcatggaagagatgggtctggttgttgaagcccatcaccatgaagtagcaaccgcaggtcagaacgaagtggcaacccgcttcaataccatgaccaaaaaagcggatgaaattcagatttacaaatacgttgttcacaacgtcgctcaccgctttggtaaaaccgcgacctttatgccgaaaccgatgttcggcgacaacggctccggcatgcactgccatatgtctctggcgaaaaacgggaccaacctgttctccggcgacaaatacgccggtctgtctgagcaggcgctgttctacatcggcggcgtaatcaaacacgctaaagccatcaacgccctggcgaacccgaccaccaactcctacaagcgtctggtcccgggttacgaagcgccggttatgctggcttactctgcccgtaaccgctctgcctctatccgtattccggtggtgacctctccgaaagcgcgtcgtatcgaagtgcgcttcccggacccggctgccaacccgtacctgtgctttgcggcgctgctgatggctggccttgatggtatcaagaacaaaatccatccgggcgaagcaatggataaaaacctgtatgacctgccgccggaagaagcgaaagagatcccgcaggttgccggttctctggaagaagccctgcaggccttggatgctgatcgcgagttcctgaccgctggcggcgtgttcaccaatgacgctatcgatgcctacatcgccctgcgtatggaagagaacgaccgcgtacgcatgactccgcatccggttgagttcgaactgtactacagcgtctaa

SEQ ID NO: 5047 - DNA, 867 bp, Klebsiella pneumoniae
cgtggattttgcgatacccgcccgacgcgcgacttccgccagcgaaagcccggtccgcgcccgctcccgcaccagacttttggcgataacgctgattggctgtgtcatacccgccccttgttttttatatcgaacaattcgttcgccttgaaaaacgatcattatgtgttcattataatggaaattcgttcgatatggctaagtgatatgaaacaaactctctccagtctcagcggagacacgataaaagcgattgttttggtctgccttgccgtcggggtggtgggcatgtcctatgggtcgctggcggtggcttacggcttccctttatgggtgccgctcttgctttcggtgtccgtgctggcaggcgcttctgaattcatgtttatcggcattgtcgccagcggcggtagtccgctggccgccgccgccgccggcctgttagtcaatgcgcgtcatatcccgttcggggtgaccgtacgcgaactggttggtcggcgcgccttaagctttatcgggtgccacattatgaacgacgagagcgtggtctttggcttgtcgcagcccacccccgcgcagcgcaaagcggcctactggctgtgcggcgctggcgtcgcgctgatctggcccctcggtacgctaaccggcgcggccgtcggcaaactgctgccagcgccggaaaccatcgggcttgatgcggtcttcccggcgatcctgctggcgctggtgatcccggcctttaaaaaccgcactacgctgatccgcgccgccagcggcgccgcgctggcgcttgccgccgtaccgtttgtgcccaccgggctgccggtgctgctttcgctgttcggtttactgtcgaggaaaaaataa

SEQ ID NO: 5048 - DNA, 2487 bp, Klebsiella pneumoniae
agatttaattgccgacctggaaaatggcttccgggcagcaaacgaggaataaagatgagtgtgattgcgcaggcaggggcgaagggtcgtcagctgcacaaatttggtgggagtagtttagcggatgcgaaatgttacctgcgcgtcgcggggatcatgaaggagtattcgcaggcgggggatatgatggtcgtctccgccgctggcagcaccaccaaccagctgatcagctggcttaagcttagccagagcgatcgccttgctgcgcatcaggttcagcagtcgcttcgccgctatcacaccgagctgattggcggtctgctggagcctgcggcggcggatacgttgatagccgcctttatccacgaccttgagcgtctggctggtctgctggacggcggggtttccgaagcggtctatgcggaagtggtcggccatggggaagtgtggtccgcgcgcctgatggcggcggtcctcaaccagctgggtatggaagcggcctggctggacgcgcgcgcgttcctgcgcgcggaacgcgccgcgcagccgcaggtggatgaaggattatcctatccgctgctgcagcagctgatggcgcagcatcctaacaaacgtctggtggtgaccggctttatctcccgcaaccaggccggcgaaaccgtcctgctgggccgtaacgggtctgactactctgccacccagatcggcgcgctggcgggcgcctcccgggtcactatctggagcgacgttgccggggtgtacagcgcggatccgcgcaaggtgaaagacgcctgcctgctgccgctgctgcgtctggacgaagccagcgagctggcgcgcctggccgcgccggtgctccatgcccgcacgctacagccggtttccgccagtgatatcgatctgcagttacgctgcagctacacgccggaacagggttccacgcgcattgagcgcgtgctggcctccggtaccggcgcacggattgtcaccagccatgacgacgtctgcctggtggagttccaggtgccggccggtcacgatttcaaactggcgcataaagagctggacgctctgctcaaacgcgcccagctgcgcccgttagccgttggcgtccatgccgaccgtaagctgctgcagttctgctatacctccgaggtggccgacagcgcgctgaaattgctcgatgaagccggtctgccgggcgagctgcgtctgcgtcagaagctggcgctggtggcgatggtgggcgcgggagtcacccgtaacccgctgcactgccaccgtttctggcagcagctcaaagggcagccggtggagttcacctggcagtctgaagaggggatcagcctggtggcggtgctacgcgccgggccgacggaaagcctgatccaggggctgcatcagtccttgtttcgcgccgaaaagcgtattggcctgatgctgttcggcaaagggaacattggttcccgctggctggagcttttcgcccgtgaacaaactacgctctcggcgcgtaccggtttcgagtttattctcgccggcgtagtcgacagtaaacgcagcctgctgaattacgacgggctggatgccagccgggcgctggctttcttcaacgatgaagcggtggagcaggatgaagagtcgctgttcctgtggatgcgcgcgcacccgtatgatgatttagtggtgctggacgtcaccgccagcgaacagctggccgaccagtatcttgattttgccagccatggcttccacgtcattagcgccaacaagctggcgggcgccagcagcagtgataaatatcgtcagatccacgacgcgtttgagaagacggggcgccactggctatataacgccaccgtgggcgccggcttgccggtgaaccatacggtgcgcgacctgatcgacagcggcgatactattctcggcctgagcggtatcttctcgggaacgctctcctggctgttcctgcagttcgatggcaccgtgccgttcaccgacctggtggatcaggcgtggcagcaggggctgaccgagccggatccgcgcgtcgatctgtccggtaaggatgtgatgcgtaagctggtgatcctcgcgcgggaagcgggctatgacatcgaaccggatcaggtgcgtgtggaatcactggtgccggcgcactgtgaagaggggtcggtcgatcacttctttgagaatggcgaagagctgaacgagcagatgctgcagcgtctggaagcggcccgcgagatgggactggtgctccgctacgtggcgcgctttgatgccaacggcaaagcacgcgtcggtgtggaagcggtacgcgaagagcacccgctggcggcgctgctgccgtgcgataacgtgtttgccatcgaaagccgctggtatcgcgataacccgctggtgatccgcgggcccggcgccgggcgcgatgtgaccgccggggcgatccagtcggatattaaccgcctggcgcagctgctgtaa

SEQ ID NO: 5049 - DNA, 915 bp, Klebsiella pneumoniae
cggagacgacttatggcttaccaatcgcaagatattattcgtcgttccgcgactaacggtttcacccccgcgcctcaggcgcgggaccaccagcaggaggtggcgaagcttatcgacgtcaccacctgtatcggctgcaaagcctgtcaggtggcctgctccgaatggaacgatattcgtgatgaagtcggtcacaatgtcggggtgtatgacaacccggcggacctgaccgccaagtcatggacggtcatgcgcttctcggaggtggaacaaaacgacaagctggaatggctcatccgcaaggatggctgcatgcactgcgcggacccgggctgcctgaaggcctgcccgtcagaaggcgcgatcattcagtacgccaacggtattgtcgacttccagtccgagcagtgcatcggctgcggctactgtatcgccggctgtccgttcgatgtaccgcgtctgaacccggaagacaaccgcgtctacaaatgtaccctgtgcgtagaccgcgtgaccgtcggccaggagcctgcctgcgtgaaaacctgtccgaccggcgcaatccactttggctccaaagaggatatgaaaacgctggccggcgaacgcgtggctgagctgaaaacccgcggttatgacaatgcgggcctgtacgatccggccggcgtcggtggcacccacgtcatgtacgtgctgcaccatgccgacaagccgaatctgtaccacggcctgccggaaaacccggagatcagccagaccgtcaagttctggaaaggcatctggaaaccgctggcggccgtcggcttcgccgcgaccttcgcagccagtatcttccactacgtcggcgtcggtccgaaccgcgcggaagaggaagaggacaatctgcatgaagagaaagacgaggtgcgcaaatga

SEQ ID NO: 5050 - DNA, 189 bp, Klebsiella pneumoniae
agtgggtgctggatgtcgatccgattgaaggataagccttctcttgcgagccggatcgaaaaatttaacaagcatcacgtttttcatgaaaattctgtaactcactgccgcgactatctgataaaaatgatgcagcagttagcgcccaagggaaatgccagcgccattcagcgaggagaaaccaggtga

SEQ ID NO: 5051 - DNA, 459 bp, Klebsiella pneumoniae
aacgctgcgtggccgcgggtatctgatggtttccgcttcatgattggaagtttgactgcacgcatcttcgccatcttctggctcacgctggcgctggtgttgatgctggtgctgatgttgcccaaactggattcccggcagatgaccgagctgctggaaagcgagcagcgtcagggcatcatgatcgagcagcacgtcgaggccgagctggccaacgatccgccaaacgacctgatgtggtggcgtcgtttgtttcgcgccatcgataaatgggcgcctccgggacaacgcctgctgctggtgaccagcgaaggccgcgtgatcggcgcagaacgcaacgagatgcagatcattcgtaactttatcggccaggccgataacgccgatcatccgcagaaaaaacgctatggccgcctggaaatggtgggcccgttttccgtccgggaacggggaggataa

SEQ ID NO: 5052 - DNA, 1506 bp, Klebsiella pneumoniae
acgagccttcgcctcgttgatagcctgggctacctgctgcggcgagacgccgcctttcgctgcgcgtttctcgaggcaagactgcagcgacaggatcggatacacatcgtccgcaatcaccgggctgaatttctgcagatcggccagggtcagcgcttccagcggtttcccttgcgcaatggcttccactaccgcttcaccgacaatatggtgcgcctcgcggaacggtacgcctttcgccaccagataatccgccagctcagtggcgttggcatagccctgctgcgccgcttccgcacagcgcgggcgttttacctgaatgccgtccagcaccagggccgccatatgcaggcagtcgagccaggtatccagggcgtcgaaaagcccctctttatcttcctgcatgtctttgttgtaggccagcggcagtcctttcagcgtcatcatcatgccggtcagcgcaccctgcacgcggccgcatttgccacggataagctccagggcgtccgggtttttcttctgcggcatcagcgaggagccggaggtcacgcggtcggaaagctcgacgaagttcgcctcgccggagttaaagaaaatcagatcttccgcaaagcgcgacagatgcaccataccgatagccgcatcggaaagcagctccagcacatgatcgcgatcggacacgctgtcgaggctgttgcgggtggcggaggcaaagcccagccagccggccagctgctcgcggtcgatctcatacgccgtccccgccagcgcgccgcagcccagcgggctgacgtcgaggcgcttcagcgcgtcctgcagacggctttcgtcacgcgccagcatttcaacgtaggccagacaccagtgcgcgaacgtcaccggctgggcgcgctgcaggtgggtgtaccccggcattaccgcgtcctgattctgctgggcggtctccaccagcgcgctctgcagctggcggttcgccgagagcagttcgacaacggtatctttgcaccacagtttaagatcggtggcgacctggtcgttacggctgcgcccggtgtgcagtttcttgcccagctggcccactttatcgatcagcttgccttccacccagctgtgaatatcttcggcatcgctggcgaggatttgctgcggattggcgcgcacctcttccagcagcacgttcagcgcttcttccagctgctgctgttcagcggcactcagaacgccgaccgttaccagcgctttcgaccaggcgacagagccaacgatatcctgctccgccagacgatagtcgaagcgcaacgagtcgttgaactgtttgaaccgttgatctgctgcctgtgtaaaacgcccgccccaaagtgccataacatgcttcctttattcgttagttccgccggcggcattgtgccgctcggcctacggtcttgtaagcccggcagacgacgcgccgccgggcatgaaatcttaagccagaatacgtgtgccgatcggcgtgccgttaaataa

SEQ ID NO: 5053 - DNA, 930 bp, Klebsiella pneumoniae
atgagtattcgcataatcccgcaagacgagctgggttcgagcgagaaacgcacggcggaagcaattccgccgttactgttccccaggctgaaaaatctgtataaccgccgcgctgaacgcttgcgcgagctggccgctaataacccgctaggcgattacctgcgctttgccgcgctgattgcccatgcccaggaagtagtgctgtacgaccatccgctgcagatggatctcaccgcccgcattaaagcggccagcgaacagggcaagccgccgctggatatccacgtcctgccgcgcgacaagcactggcacaagctgttgcactcgctgattgccgagctgaagccggagatgagcggcccggcgctggcggtcattgagaatctggaaaaagcctctgagcaggagctggagcagatggccagcgcgctgtttgtttccgatttcgcctccgtcagtagcgacaaagcgccgttcatctgggctgcgctgtcgctctactgggcgcagatggccagtctgatcccaggaaaagcgtgcgccgaatacggcgaacagcgccagttctgcccggtgtgcggctcgatgccggtctccagcatcgtgcaaatcggcaccactcaggggctgcgctatctgcactgcaacctgtgcgaaactgagtggcacgtagtacgcgtcaagtgcagcaactgcgagcagagccgcgacctgcactactggtcgctggacaacgagcaggcggcggtgaaagccgaaagctgcggcgactgcggaacctacctgaagattatgtatcaggagaaggatccgaaagtcgaagccgtcgccgacgatttggcctccctggtgctcgacgcccgcatggaacaggagggcttcgccagaagctcaattaacccgttcatgttccccggcgaaggggagtaa

SEQ ID NO: 5054 - DNA, 219 bp, Klebsiella pneumoniae
aaccgcttgctgctctggcgtaagcaggtggtacatctggttgcgaaccttagccatctcgacctggcgggcaacctgttcctgcgccatcttttctgcctgagcgcgcacagcgttttcatcaaaattttctgcggtgacaaggcgatgcattgtctccatttcgctaacattaacggggagcctgtcgtggcgtgcccgttgcataagatcccgtaa

SEQ ID NO: 5055 - DNA, 912 bp, Klebsiella pneumoniae
aataatgtccggtatgatgaaaagggtgatgcgctgaacggaagaatgatggacaacgatatcaatcaacttattgatgcattgctaaaaaagcagaccagcctcggccgggtttatttcgccggcgagacgcgctcgcctgctgagccggtggtgcaggtggattttccccgtctgaatatcctcctcgatgggcagttgcccgaccaggcgctcggcgataacgccccgctccttgaggcccatgacgtgctctatatccctggcgatagctggaactgcccgcagtggcaagcgccttgcctgctgttaagcatcctgttcgataagcagcagctggagtgctcgctgcagcactggaatggcaaggcgataactgttgtcgacaagcggcaggcgctgcgccgcgggccgcgcgtcggatcatttctgctgcaggcgctcaatgaactccggatgcaaccgcaggagcagcaaaccgcccgcagcatcgtcgtcagcctgctcagccactgccatgatcttctcggcagccaggcgcaaacctcctcgcgcagccaggcgttgtttgaagcgatccgccaatatatggacatccattatgcggaaccgctgagccgggaatcggtggcccaggcgttctacctctcttccaactatctttcccatctgttccagaaatgtgggccaatgggcttcaatgaatatctaaaccatattcgtctcgaacaggcccgtatgctgctgaagggccacgatatgaaagtgaaagacatcgcccacgcctgcggcttcgccgacagcaactacttctgccgcctgttccgcaaaactacggaacgctcgccgtctgaataccgccgccagtaccatagccagctgacggaaaaagcatccccggtaaaaaactag

SEQ ID NO: 5056 - DNA, 654 bp, Klebsiella pneumoniae
cacttgagccgctcgacaataatggagatgattatgagctataccctgccatccctgccttacgcttacgatgctctggaaccgcacttcgacaagcagacgatggagatccatcacactaaacaccaccagacctacgtgaacaatgccaacgccgcgctggaaagcctgccggagttcgctaacctgtccgctgaagagctgattaccaagctggatcagctgccggctgacaaaaaaaccgtactgcgtaacaacgccggcggccacgcgaaccacagcctgttctggaaaggcctgaaaaccggtaccaccctgcagggcgacctgaaagcggctatcgagcgcgatttcggttccgtggagaacttcaaagcggaattcgaaaaagccgctgctacccgtttcggctccggctgggcgtggctggtcctgaaaggtgacaaactggccgttgtctccaccgccaaccaggattccccgctgatgggcgaagccatttccggcgcttccggcttcccgattatcggcctggacgtctgggaacacgcttactacctgaaattccagaaccgccgcccggactacatcaaagccttctgggacgtagtgaactgggacgaagctgcagcgcgttttgccgccaaaaaataa

SEQ ID NO: 5057 - DNA, 1488 bp, Klebsiella pneumoniae
aagtttccacggcaacaaaatatcccgggcatctcgcgccacaacacgacataccctggatttacagcaaaattagacgctgtagtacagttcgaactcaaccggatgcggagtcatgcgtacgcggtcgttctcttccatacgcagggcgatgtaggcatcgatagcgtcattggtgaacacgccgccagcggtcaggaactcgcgatcagcatccaaggcctgcagggcttcttccagagaaccggcaacctgcgggatctctttcgcttcttccggcggcaggtcatacaggtttttatccattgcttcgcccggatggattttgttcttgataccatcaaggccagccatcagcagcgccgcaaagcacaggtacgggttggcagccgggtccgggaagcgcacttcgatacgacgcgctttcggagaggtcaccaccggaatacggatagaggcagagcggttacgggcagagtaagccagcataaccggcgcttcgtaacccgggaccagacgcttgtaggagttggtggtcgggttcgccagggcgttgatggctttagcgtgtttgattacgccgccgatgtagaacagcgcctgctcagacagaccggcgtatttgtcgccggagaacaggttggtcccgtttttcgccagagacatatggcagtgcatgccggagccgttgtcgccgaacatcggtttcggcataaaggtcgcggttttaccaaagcggtgagcgacgttgtgaacaacgtatttgtaaatctgaatttcatccgcttttttggtcatggtattgaagcgggttgccacttcgttctgacctgcggttgctacttcatggtgatgggcttcaacaaccagacccatctcttccatgatcatacacatggtggaacggatgtcctgagaagagtctactggcggaaccgggaagtaaccccctttcacgcccggacggtgacctttgttaccgccttcgtatttggtagaggagttccacgcaccttcaatgtcatcgatcgcgacatgggagccggagatagaggcgccaaagcggatgtcgtcgaacaggaagaattctggttctggcccgaacaggacggtatcagcgatgccggtggcgcgcaggtaatcttcagcgcgtttcgcgatggagcgcgggtcacggtcatagccctgcagggtgcctggctcgacgatatcgcagcggatgatcagggtcggttcttcgtagaacgggtcaatgaccgcggtggacgcgtccggcatcaggaccatgtcagattcgttgatacctttccagccaccaatcgaggagccatcaaacattttgccttcttcgaagaattcggcatttacctgatgagacggaatcgtgacgtgctgttctttacctttggtatcggtgaagcgcagatcgacaaacttcacttcgtgctcgttcagcatcgtcaaaacgtgttcagcggacatacttaa

SEQ ID NO: 5058 - DNA, 657 bp, Klebsiella pneumoniae
agagaaagacgaggtgcgcaaatgaaaagacgtgacaccatcgtgcgctacacggcgccggaacgcatcaaccactgggtcaccgccttctgcttcgtcctggcggcggtgagcgggttaggctttttcttcccgtcctttaactggctgatgcatatcctcggcacgccgcagctggcgcgaattctccacccgttcgtcggggtggtgatgttcgcgtcgtttatcatcatgtttttccgttactggcatcacaacctaatcaatcgggatgatatcttttgggcgaagaatattcgtaagatcgtcgtcaacgaggaggtgggcgataccgggcgctataacttcggccagaaatgcgtattctgggcggcgattatcttcctggtactgctgctggtgagcggtgtgatcatctggcgtccgtattttgcgccggctttctcaatcccggtgatccgatttgcgctgatgctgcattcatttgccgcagtggcgttaattgtggttatcatggtgcatatctacgccgccctctgggtgaaaggcaccattaccgcgatggtggaaggctgggttaccaaaacgtgggcgaagaaacatcacccgcgctggtaccgagaggtccgccagaaacaggaaaagtcatctgaatga

SEQ ID NO: 5059 - DNA, 375 bp, Klebsiella pneumoniae
cgtgaaggacgagcaatgaaacactcagttcaagataaaggtacgctgctgctggcgctgattgccgggttatccattaatggcgcctttgcggcgctgttcagttcgatagttccgttttccgtcttccccattttatccctgctgctgacggtctactgtctgcatcagcgctatcagaatcgcagtatgcccgttgggctaccgggcctggccgccgccttttttattctcggggtgctgttgtacagcaccgtcgtgcgtgcggagtacccggatatcggttctaacttcttcccggccgttctgtccgtcgcgatggtcttctggatcggctacaagatgcgtaaccgcaaagataccgcagccgagtaa

SEQ ID NO: 5060 - DNA, 1020 bp, Klebsiella pneumoniae
ggagatgcgcttccaatgttaaatacgctgattgtgggtgccagtggttatgccggcgcagagctggtgacctatatcaatcgtcatccgcatatgaacataaccgctttgacggtctccgcgcaaagcaatgatgcgggaaaattaatttccgacctgcatccgcagctcaaaggcattgtcgatatgccgctgcagccgatgtccgatatcagcgaattcagcgctggcgtggacgtggtgtttctcgccaccgcgcacgaagtgagtcacgatctggcgccgcagttccttgccgctggctgcgtggtgttcgatctctccggtgccttccgcgttaacgatggggtgttctacgaaaaatattacggtttcactcatcggcatcccgacctgctcaaacaggcggtgtatggtctggcggagtggagcgcggatgcgcttaaagacgcgcagttaatcgcagtgccaggctgctatccgacggcggcgcagctgtcgctgaagccgctgattgaggctaatctgctggatctcaaccagtggccggtaatcaacgctaccagcggggtgagcggcgcgggtcgtaaggccgcgatcggcaacagcttctgtgaagttagcctgcagccgtacggcatatttaaccatcgccatcagccggagattgccagccacctcggggcaaaggtaatttttaccccgcacctgggtaattttaagcgcggcatcctggaaaccattacctgccgcctgaagccgggcgtcggccatgcgcagatcgcggcggtttaccagcaggcttacgccgataaaccactggtacgtttatatgataaaggcgtgcccgctttgaaaagcgtcgaaggcctgccattctgtgatatcggttttgccgtgcaggacgatcatctcatcgtcgtcgcggcagaggataacctgctgaaaggcgccgcagcgcaggcggtgcagtgcgcgaatattcgtttcggcttcgctgagacgcagtctcttatttaa

SEQ ID NO: 5061 - DNA, 1158 bp, Klebsiella pneumoniae
  unsure (988): Identity of nucleotide at the above locations are unknown.
ccggatccgcgagccgcctgcgggcggcgtcacggtcatcgaggaggaatcgaaatggatcgcattattcaatcaccaggcaaatatatccagggcgcaggcgccatcaagcgcctcggcgactatctgaaaccgctggccgagcgctggctggtggtcggtgataagttcgtcctggggtttgcggaagagatgctgcgtaaaagcctggccgacgctggcctggcggccgaaatcgcgccgtttggcggtgagtgttcgcataatgaaatcaaccgtctacgcgatatcgccggcaacgcgaagtgcaccgccgtgctggggatcggcggtggcaaaaccctggataccgcgaaagcgctggcccactttatgaatgtgccggtggcgatcgcccccaccatcgcctccaccgatgcgccgtgcagcgcgctgtcggtgatatacaccgacgaaggggaattcgacagctacctgatgctgccgcgcaaccccaacatggtcattgtcgatacgcagatcgttgccggcgcgccggcccgcctgctggccgccgggattggcgatgcgctggctacctggttcgaagcccgcgcctgctcccgtagcggcgccaccaccatggcgggcgggaagtgcacccaggcggcgctggcgctggccgagctatgctacaacaccttactcgaagagggtgaaaaagcgatgctggccgccgaacagcacgtggtcaccccggcgctggagcgggtggtggaagccaacacctatctgagcggcgtgggtttcgaaagcggtggtctcgcggcggcgcacgcgattcataacggcatgacggccatccctgacgcccatcactattatcacggggaaaaagtggcgttcggaacactgacgcacctggtgctggaaaatgccccggtggacgaaatagagaccgtcgccgcgctgtgccacagcgttgggctgccgatcaccctggcgcagntggatatcaaaggtgatatcccgaccaaaatgcgtctggtggcggaagccgcctgcgctgaaggcgaaaccattcacaatatgccgggcggcgttgattccgaccaggtctacgccgcgctgctggtggccgaccagtatggtcagcgcttcctgcaggaatgggaataa

SEQ ID NO: 5062 - DNA, 1038 bp, Klebsiella pneumoniae
cgccgccagcggcatcggccaggaggcggcatgatgggacacgcatggctgaaacatcgcgaagcgctgctggctttggtcatcattttgatgatcggcgccatcggcagccgggcgccgtcgttcgtttcaccgggcaatctggtggagatgtttaacgataccgccatccttatcatcctcgccctcgggcagatgatggtgttgctcaccaaaggcattgatctgtcgatggccgccaacctggcgctgaccgggatgatcgtcgccctgcttaacgcccactatccgggtattccggtggtggcgctgctggcgctggcaaccctgctgggcctgctgatgggagtaattaacggcctgctggtctggcgcctcggcattcccgccattgtggtgaccctgggcaccatgagcatttatcgcggcattatcttcctgctgactgacggcggctgggttaactcacatcagatgagcgctgattttctcagtctgccgcgcagccccctcctggggctgccgctactgagctggtgcgccatcgccgcgctgctgctggtgggttatttcctgcgctacagccgcaccggccgggccttatacaccgcgggcggcaacgcgacggcggcatactacaccggcattaacgccggaaaaatgcagttcgtcagcttctgtctctccggcgcgctggctggcttctgcggctatctgtggatctcgcgcttcgccgtcgcctatgtcgacgtcgccaacggttttgaactccaggtggtcgccgcctgcgtgatcggcggtatcagcaccatgggcggaagcggacgggtgctgggctgcctgtgcggcgcgctgttcctcggggtcatcaataacgccctgccggtgatcggcatctcgcccttctggcaaatggcgatttccggggcggtgatcgtcatggcggtgctgctcaacgagcgcggcaatcgcggtcacgggcggttaatcctgcgcaacgcggcgttagcccgacagaaacaggcggtgaaatcatga

SEQ ID NO: 5063 - DNA, 1476 bp, Klebsiella pneumoniae
attcaccagctggccgggtcataccgaattttcggtatacctgcctattcggaagtagaggtgtttatgcaacgagggatagcctggatcgttgatgacgatagctccatccgctgggtgcttgaacgcgcgctcaccggagccggcttgagctgcacaacgttcgaaagcggcaatgaggtgctagatgccctcaccaccaaaaccccggatgtactgctgtcagatatccgtatgcccggaatggatggtctggcgctgctcaaacagattaagcagcgccatccaatgcttccggtcatcataatgaccgcgcattccgatctggacgccgcggtcagcgcttatcagcagggcgcgtttgattatttgcccaaaccttttgatatcgatgaagccgtcgccctcgtcgaccgggcgataagccactatcaagagcagcagcagccgcgaaatgcgccgataagtagcccaactgccgacatcatcggcgaagcgccagctatgcaggatgtctttcgcattattggccgcctgtcgcgctcatccatcagcgtgctgatcaatggcgaatccggtaccggtaaagagcttgtcgcacatgccctgcatcgccatagtccacgctcaaaagcgccgtttatcgcgctgaatatggcggcgatccccaaggacctgattgagtccgagctgttcggccatgaaaaaggagcctttaccggcgcaaataccgtccgtcagggtcgctttgaacaggctgacggcggtacgctgttcctggatgaaattggcgatatgccgcttgatgtccagactcgtctgctgcgcgtgctggcggatggtcagttttatcgcgtgggcggttacgcgccggtcaaggtcgatgtgcggatcatcgccgctacccaccagaacctggaacagcgcgtgcaggaggggaaatttcgtgaagatttgttccaccgcctgaacgtcatccgggtgcatttaccgccgctgcgtgagcgccgggaagatattccacgcctggcccgccattttctgcagatagccgcccgcgagctcggcgttgaagccaaacagctgcatccggaaacggagacagcgctgacccgcctggcgtggccaggcaacgtccgtcagctggaaaacacctgtcgctggctcaccgtcatggccgccggccaggaggtgctgacgcaggatctgccgagcgaactgtttgagaccacgattcctgatagcccaacgcagatgcagcctgacagctgggcgacgctgctgggtcagtgggccgatcgggcgttgcgatccggtcatcaaaacctgctctcagaagcgcaacccgaaatggagcgcacgctgctaacgaccgccctgcgccatactcaggggcacaaacaggaggctgcgcgcctgctgggatggggacgtaataccctgacgcgtaagctaaaagagttgggtatggagtag

SEQ ID NO: 5064 - DNA, 1122 bp, Klebsiella pneumoniae
tctcgcgagctttttaccgataaaaagctatactgcactaaattggtgcactcattttcaggagactgtcgaatggcaacaggcacactgcccgatgctgggcagatccttaactcccttatcaacagtattttactggtcgatgatgacctggcggtgcactttgccaaccctgcggcgcagcaactgctggcgcagagctcgcgcaaactgtttggcaccccattacctgaactgttgagctatttttcgttgaatatcgggctgatgcaggagagtctgcaggcgggccaggggtttaccgataacgaagtgacgttggttatcgatggccgttcgcacatcctgtcgttgaccgcccagcggctgccggaaggctttattctgctggaaatggcgccgatggataatcagcgccgcctgagccaggagcagctgcagcatgcgcagcaggtcgccgctcgcgacctcgtccgcggcctggcgcatgagataaaaaacccgttaggcggcctgcgcggcgcggcccagctgctcagcaaagcgctgcccgatccggcgctaacggaatataccaaagtgatcattgagcaggccgaccggctaagaaatctggtcgaccgcctgctcggaccacagcatccgggcatgcacgttaccgaaagcatccacaaagtcgccgaacgggtagttaaactggtttccatggagttgccggacaacgtgaagttgatccgcgattacgaccccagcctaccagagctaccccacgacccggatcaaattgaacaggtgttgctgaacatcgtccgtaatgcgctgcaggcgctggggccggaagggggcgaaattattcttcgcacccgcaccgctttccagctgacgctgcacggggtgcgttatcgcctcgccgcccgcatcgacgttgaagataatggcccgggtattccgccccatctccaggatacgctgttctatccgatggtcagcggccgcgaaggcggtaccggcctgggcttatctatcgcccgtagccttatcgatcagcactccggcaaaattgaattcaccagctggccgggtcataccgaattttcggtatacctgcctattcggaagtag

SEQ ID NO: 5065 - DNA, 921 bp, Klebsiella pneumoniae
taccttttcagtatgacaacttcaagattacattctctggatattcgcctgctgcgcgcctttgccgtggtagcggaggaaaataacatcagccgggcggcgcagcggttatttatctcgcagccgccgctgacccgccatatccgccatctggaagcgcagctgggggtgacgctgtttcagcgccatagcaaaggcctgatcctgaccgacgcgggtaaagaggtgctggagatgattcaacctctgctggcgctccaggaacgcacgctggcggcattgagtgagctcgccgttcactcgccgcaggctctacgtctgggcgtgacgacggccttcgaacagggcattttcgccgccgttgaggctgcgctgagcgaacatacccgcgcgttgcatatcacccgccacgcctcaccggcgctggctcagcaggtacgcaaaggcaaactcgatgcggcgctggtcgcgctgccgctcaatactgaagggctgcacctgcacccattgccgtatcatgagccgctcattgcggcattaccggcctcctggccggaagccgccaggccagggctgacgttaagcgcgctcaatcatcggccgctgttctggtttaaacgcgagcgtaatcctggtttctttgactacacgcgccgcattttcgaccgggctggctatgccccgacgtatgtggaagagccggccgagcatgatgtgctgctggcgcgtattgcgcgcggcgaaggcatgatcctgctgccggcgtccttttccgcgattcagcgtcagggggtggcgttctgcccggtggctgagggcgacgcgatgccgttaagccttggggtgatttatccgcctcaccaggcagagtccgtgcagcaatggctttctctgctggatggcattctggcgactggctag

SEQ ID NO: 5066 - DNA, 1056 bp, Klebsiella pneumoniae
aaaaagatgaggataaaatcaatgaaccacgcgattacgatgggtattttttggcatttgataggggccgccagtgccgcctgtttctatgccccgttcaagaaagtaaaacactggtcgtgggaaaccatgtggtcggtcggggggatcgtctcctggctgattctgccctgggccatcagcgccacgctgttacccgacttctgggcctactaccgctcttttagcgcctccacgctgctgccggtctttctgttcggcgccatgtggggcattggtaatatcaactatggcctgaccatgcgctatcttggcatgtcgatggggattggcatcgccattggcatcacgctgattgtcggcacgctgatgacgccgattattaacggtcagtttgcagtgctgatgcacacccagggcggtcaaatgacgctgctcggcgtgctggtggcggtgattggcgtcggcatcgtcacccgcgcaggccagctgaaagagcgcaaaatgggcatcaaagccgaagagttcaatctgaagaaagggcttctgctggcggtaatgtgcggtatcttctccgcagggatgtcgttcgcgatgaacgccgccaaaccgatgcatgatgccgccgcggcgctcggcgtcgacccgctgtacgcagcgctgccaagctacgtggtgattatgggcggcggggcgctggttaaccttggcttctgctttattcgtctggcgaaagtgaagaacctgtcagtcaaagccgatttctcgctggccaaaccgcttatcatcagcaaccttctgctctctgccctcggcggtctgatgtggtatctccagttcttcttctatgcctggggccacgccagcattccggcgcagtatgattatatgagctggatgctgcacatgagtttctacgtgctgtgcggcggtgtggtgggtctggtgctgaaggagtggaacaatgccggccgtcgtccggtgagcgtcctgagcctcggctgcgtggtgattatcatcgccgccaatatcgtcggtctgggaatggccagttaa

SEQ ID NO: 5067 - DNA, 1530 bp, Klebsiella pneumoniae
  unsure (1066): Identity of nucleotide at the above locations are unknown.
tttttgtggagaactatcatgtcagcatcaacgccactgctgtcgctgaaggggatcaccaagatttttcccggtgtgcgcgcccttgagaacgtgcagcttgatctctggcccggcaaagtgaccgccttaattggcgaaaacggcgcggggaaatccacgctggtcaaagtgatgaccggtatttatcagcccgaagagggcgagatcctctataaagcgatccccattcatctgccaacgccggagtcggcgcataaggtagggatcaccgccattcaccaggaaaccgtgctgtttgacgaactctcggtcagcgaaaacattttcgtcggccagtatctgtataagggagtgctcaaaacgctcgactggccggcgatgcaccgcagagccaacgagatcctcacccggctggaagtccagatcgacccgcgagccacgctgaaaaccctcagcatcgcccagcgtcacatggtggcgattgcccgggcgctggctttcgacgcccaggtggtgatcctcgatgagccgaccgccgcgctttcccagcatgaaatcctggagttttatcacatcgttgagcgtctgaagcaggacggcaaagcgatcctgtttatctcgcataagttcgatgaaatcttcgagctggccgattattacaccatcctgcgcgatggggtgtacgtcagctccggggcgataagcgacatcaccgaagagcggatggtgtcgatgatggtgggccgggcgatcagccaaacctacccgaaagtcgactgcacacccggagaaacggtgctggaggtgaccgatctctgtcatcctaccgagtttgcccatatcagcttccgcctgcgcaagggagaaattctcggcttttacggcctggtgggcgccggacgcaccgagctgatgcaggcgctctccggtgtctcgcgcccctcctccggcgagatccgcctgaacggcagaaccatgcgctttcaccagcccgccgacgccatccgcgcgggcatcgtctgcgtgccggaagagcggcagaaacagggagcgatcatcgccntgcctatcgcccagaacatcagtttaccgcagctcagcaagctcaaccctaacggcgtcctgaacgacgcccgggaatggcggctggccgacgagtacgcctcgcgcctgcaggttaaagccttcagctggcggcagccggtggagaccctctccggcggcaaccagcagaaagtggtgattggcaaatggctggcgacccagcccgaggtgatcattctcgatgagccgaccaaaggcatcgatatcggctcaaaggccgccgtgcatcagtttatgtccgagctggtcagccaggggctggcggtgattatggtgtcgtcagagctgccggaagtgatgggcatggccgaccggattatcgtaatgcacgaagggctgatggtcgccgaataccaggccggggaagcgacagcggaaaccatcgttagcgccgccagcggcatcggccaggaggcggcatga

SEQ ID NO: 5068 - DNA, 2166 bp, Klebsiella pneumoniae
acggtaagtggtgccgacgtacgggaacttctcggccttacccatctgctcgagatcgcctttgaagacgcgagcggccgggttagagaccacgttcgggtgcagcgggttggttccgagcggcgtttcaaacggctcgtagtgttccgggaacggtccttccgccatcttgtcgatagcgaacagacggcccatcccttccggctgcatgataaacggaccgacgtcgctgccaggcgcggcggcgctgtagtccggaatatccacgccgccccatttggcgccgtcccatttcagcaactgacgcttcggatcccacggtttaccctgcgggtccgcggaggcgcggttatacaggatgcggcggttgagcggccaggcccaggcccagcccagggtattgccgagaccggatggatcggcgttatcgcggcgcgccatctggttaccttccggcgtccagctcccggcgaagatccagcagccgctggaggtggtgccatcatctcgcagctgcgcaaaggagctcagctgttggcctttcttgacgatcaccgcgccggttgccgggtcggtgatatccgccagcgctttaccgttgctttccatcgccacttcttccgatgccggctcgtgtggcgtggagtagttccacgtcatgttgagcaccggctccggcgccgggccaccctcttcggcatacatcttacgcaggcgagtgaagataccggcgagaatttcaccatcggtgacggcgatccccggggcgtccgcgcctttccagtgccactgcagccagcggccggagttgacgatagacccattctcttcggcgaagcaggtggagggcagacggaacacttcggtctggattttcgccggatcgacatcgttcgactcaccatggttttgccagaaggtggacgtttcggtattgagcgggtcgatagtcacgaggaacttcagcttcgacagggaagcgacgaccttgtttttattcgggaacgaggcgaccgggttaaagccctggcaaatatagccattcactttgccctgattcatcatctcgaagtactgcagaacgtcgtagctcttatcccacttcggcagccagtcatagccccagctgttttccgcggtggctttgtcgccgaagaaggctttcatcatggagacgaagaacttcggatagttgccccagtagttgacctggtctttcagcagcggcttcggcgtgttagccgtcaggtaggtctgcaggtcggcctgtttttcgttcggcagcgacatgtagcctggcaggctggtggagagcaggccgaggtcggtcagaccctggatattggagtggccgcgcagggcgttgacgccgccacccgccatccccatgttgccgagcagcagctggatcatcgccatggtgcggatattctgcgcaccgatggagtgctgggtccagccgagagcgtacaggaacgatgcggtcttatccggcgcgctggtttcagcaatgtattcacagactttgaggaagtcggccttcggcgtaccgcagatgttttcgaccacatccggggtataacgggaaacatgctgcttcagcaggttccagacgcagcgcggatgttgcagcgtagtatcgcgtttggcgaagccgttttcgtccagctcatagttccagctggttttgtcgtactggcgtttttctgcgttatagccgctgaacagcccgtcgtcgaagctatagtcctcacgcacgatcaggctggcgttggtgtaggcttcggtgtattcgcggttgaatttttcgttattcagcagatacaggatcacgcccgacaggaaggtaatgtcggtaccggaacgaatcggggtatagaaatcagccaccgacgccgtacgcgtaaagcgcggatcgataacgatgagcttggcgccgttatgaattttggcttccatcgcccagcggaaccccaccggatgcgcttctgcggcgttaccgcccatcactacgaccaggttggcgtttttaatatcaacccagtggttggtcatcgcaccgcgaccaaatgttggagcaagacttgctaccgttggtccgtgtcagacacgcgcctggttatccaccgccagcatcccgagggcgcgggtgaatttttgcgttaa

SEQ ID NO: 5069 - DNA, 1164 bp, Klebsiella pneumoniae
cgccctgccggtgatcggcatctcgcccttctggcaaatggcgatttccggggcggtgatcgtcatggcggtgctgctcaacgagcgcggcaatcgcggtcacgggcggttaatcctgcgcaacgcggcgttagcccgacagaaacaggcggtgaaatcatgagcaaaatgatggtatctgaagagatgaaaaacgccccggccgcgccgtcgccgctgcgccgcctgctgtgctgggaagggtttttactggcggtcaccctggcggtatttatcggcaacgccgtggcttccccgtacttcctcaatatctggaacctgtcggacgccacctttacctttaccgagaatgcgatcgtcgtcctgccgatggcgatgctgattatcgcccgggaaatcgatctgtcggtagcctcgacgatggcgctcagctcaacggtgatgggcttctgcgcggcggcggggatggacactccgctgctggtggtcatcggcctgggcgtaggtctgctgtgcggcctgttcaacggcttgctggtgacccgctttaacctgtcgtccattgtgatcaccatcggcaccatgagcctgtatcgcggcatcacctatatcctgctgggcgatcaggcactcaaccactatccggagagctttgcctggttcggacaggggtacgtgtggggggcgctctcttttgagtttgcgctgtttatcctcctcgcggccgccttcaccttcctgctgcataaaaccaactttggtcgccggacctacgccatcggcaataacccgaccggcgcctggttctctgggatcaacgttaagcgtcataacctggtgctgttcgcgctgcttgggctgatggccgggctggcggcggtcctgctgacctcacggctcggcagtacccgccccaccctggcgatgggctgggagctggcggttgtcaccatggcggtgctcggcggcgtcaatattctcggcggctccggcagcatgcccggggtgatcatcgccgcctttctgatggggctggtgaccttcggcctgagcctgctgaacgtccccggcatcgtgatgtcggtgattatcggcgccatgctgatcgtggtgatctccctgccgattattacccggcggatgatgcagcgaagacgatgttaa

SEQ ID NO: 5070 - DNA, 849 bp, Klebsiella pneumoniae
gccgtggccggtctgattttacgtaaagaggagtttttcccttccgccacacaggcagtggcggtggcagaccgctacccgcaaaatgtctttgccgaacatacccatgagttctgcgagctggtgctggtgtggcgaggcaacgggctgcacgtccttaacgatcgcccctggcgcattacccgcggcgatctgttctacattcgcgccgaagataaacactcctatgcttccgttaacgatctggttctgcagaacatcatctattgcccggagcggctgcagctcaattttgactgggctggggcgatccctggcctcttcggcacgccgtggaagccccactggcgcatgggcagcacaggtatggcgcaggcgcgccaggtgattagccagcttgagcatgagtgcgcccggcgcgacgcgcagggaaatgcgatggccgaactgctttttgcccagctggcgctgacgttgcagcgccatcgctacgcgacggatgatcccgcggcgacgcagcgcgaagcgctgctggacaaactgctggccgcgctggcggccagccttagccgcccctttgttctggagcgtttctgcgagcaggagggcggcagcgagcgggcgcttcgccagcagtttcgccagcaaaccgggatgaccatcaatcactatttacgccagctgcggatctgccatgcgcagtatctgctgcagcataccgagcgcttaatcggcgatatcgccatgcagtgcggctttgaggacagtaactacttttcggtggtttttagccgggaaatcggcatgtcgccggggcagtggcggcagcgcagtcgcgccgccgcctga

SEQ ID NO: 5071 - DNA, 1587 bp, Klebsiella pneumoniae
cggttctttatcactctgaaaggaactccgatgaaactaaaaacaatgagcgcagcacttctgttgactttgcctttctgggcctgcgccaaagatgtcaccatcatttataccaacgatcttcatgcccatgtcgaaccttataaagtgccatggatagcggatggtaaacgagatattggtggttgggcgaatatcacgacgatggtgaaacaggaaaaagcgaaaaataacgcgacctggttttttgatgccggggattattttaccgggccttacatcagtagcctgacgaagggcaaagcgataatcgatattatgaatacgatgtcctacgatgcggtgactatcggtaatcatgagttcgatcacggctgggataatacattgcttcagcttagccaggcgacattcccgattgttcagggcaatattttttatcagaacagcgataaatcgttctgggataagccctataccattatcgaaaaagatggcgtgaaaattggcgtgattggcctgcacggcgtgtttgcttttaatgacaccgtttctgccgcgacgcgagtgggtatcgaagcgcgcgatgaggtgaaatggctacagcattatatcgatgaacttaacggtaaagtggatctgaccgtggccctgatccatgaaggcgtcccggcgcgtcagtcgagccaggggggaaccgatgtgcgtcgtgcgctggataaagatattcagactgcgggtcaggtgaaaggcctggacgttttaattaccggccatgctcacgttggcacaccggagcccattaaagtgggtaatacgttgatcctttctaccgatagcggcggcatcgatgtgggtaaactggtgctggattatcaggagaaaccgcaccaattcacggtgaagcactttgagctgaagacgctttatgccgatgagtggaagcctgatccgcagacaaaacaggtcatcgacggctggaataagcaacttgatcaactggtgcagcaggtcattacacaatcgcccgttgaactgacccgtgcgtatggcatctcttcgccgttgggcaatcttgccgctgacgccttgctgttggcagcaggtaggagtacgcagatggcgttaaccaactcgggcgggatccggaatgagatccccgccggagcggtaagcatgggggccgttatcagcaccttcccgtttcccaacgagctggtcaccatggatctaaccgggaagcagttgcgtagcctgatggagcatggcgccgggttgagcaacggcgtgctgcaggtctcccggggactggaaatgaagtatgacagcagcaaacctgtgggccagcgcgttgtgttattcaggctaaacggtaaaccgattgacgatacgacggtttaccatattgccaccaacagcttccttgcagatggcggcgatggttttgtcgcgtttaccgaggggcaggcgcgtaatacctccggcggctattacgtttcaaatgcggtcgtagactatttcaaagccgggcaaaagataacggatgagcagcttagcgggcagcgcgttgtcgatgtgaagaaataa

SEQ ID NO: 5072 - DNA, 921 bp, Klebsiella pneumoniae
ataatgaatattcgcgatcttgaatacctggtagcgctcgccgaacaccgccacttccggcgggcggctgactcatgccatgtgagccaaccgacgctcagcggacagatccgcaagctggaggatgagcttggcgtcatgctgctggagcgcaccagccgtaaggttctgtttacccaggcggggctgttgctggtggatcaggcgcgtaccgtgttacgcgaagtaaaagtgctcaaggaaatggcaagccaacaaggggaaaccatgtccgggccgctgcatatcggcctgatcccgacaattggcccgtacctgctgccgcacatcattccgatgctgcatcagaccttcccgaagctggaaatgtatctgcacgaagcgcagacccatcagctgctggctcagctcgacagcggtaagctcgactgcgccatcctggcgctggtcaaagagagcgaggcctttatcgaggtgccgctgttcgatgagccgatgatgctggctatctatgaagatcatccgtgggcgaaccgcgatcgggtgccgatgtcggatctggccggtgaaaagctgctgatgctagaggatggccactgtctgcgcgatcaggcgatgggcttctgctttgaagcgggggcggatgaggatacccacttccgcgcgaccagcctggaaacgctgcgcaatatggtggcggcaggcagcggcattaccctgctgccggcgctggcggtgccgcaggagagaaaacgcgatggcgtagtgtacctgccgtgcattaagccagagccaagacgcactatcggtctggtttatcgtccgggctccccgctgcgcagccgctatgaacatctggcggaggccatccgcggcacgatggatggccatttcgacaaggcgttaaaacaggcggtttaa

SEQ ID NO: 5073 - DNA, 222 bp, Klebsiella pneumoniae
ggttctcccatgaaaaaaggtattcacccaaattacgacgaaattactgctacctgttcttgcggtaatgtcatgaaaatccgctccaccgttggtcacgacctgaacctcgacgtgtgcggcaaatgccacccgttcttcaccggcaaacagcgtgatgttgctaccggtggccgtgttgaccgcttcaacaagcgcttcagcatcccgggcagcaagtaa

SEQ ID NO: 5074 - DNA, 1344 bp, Klebsiella pneumoniae
ggatctcccatgtctgaaatgaccccacgcgaaattgtcagcgaactggacaaacacattatcggtcaggacgccgccaagcgttctgttgctatcgccctgcgtaaccgctggcgtcggatgcagcttaacgaagagctgcgtcatgaagtcacgccgaaaaacattctgatgatcggcccaaccggcgtcggtaaaaccgaaatcgcccgtcgtctggcaaaactggctaacgcgccgtttatcaaagttgaagcgacgaagttcaccgaagtgggctatgtcggtaaagaagtggactccatcatccgcgatttgaccgatgcggcgatcaaaatggttcgcatgcagtccatcgataagaaccgttaccgcgcggaagagctggcggaagagcgcgtgctcgacgtgctgatcccaccggcgaagaacaactggggccagactgagccgtcgcaggaaccgtctgcagcgcgccaggcgttccgtaaaaaactgcgtgaaggccagctggacgataaagagattgaaatcgatctcgctgcggcgccgatgggcgttgaaatcatgtcccctccgggcatggaagagatgaccagccagttgcagtctatgttccagaacctcggcggccagaagcagaaaccgcgtaagctgaaaatcaaagacgcgatgaagctgctgattgaagaagaagcggccaaactggtcaatccggaagagctgaagcaggaagccatcgacgctgtagagcagcacggtatcgtctttatcgacgaaatcgacaaaatctgtaagcgcggcggcaacacctccggcccggacgtctcccgcgaaggcgtacagcgcgacctgctgccgctggtggaaggctgcaccgtctccaccaaacatgggatggtcaagaccgaccacatcctgtttatcgcctccggcgcattccaggtggccagcccatccgatctgatcccggaactgcaggggcgtctgccgatccgcgttgagctgaaggcgctgaccacccacgacttcgagcgcatcctgaccgagccgaatgcctccatcaccgtgcagtacaaggcgctgatggcgaccgaaggggtgaacatcgaattcaccgaagacggcatcaagcgcatcgcccaggccgcatggcaggtaaacgaaaccaccgagaacatcggtgcgcgtcgcctgcacaccgtgctggagcgcctggtggaagatatctcctatgatgccagcgagatgaacggccagaccgtcactattgatgccgaatatgtgagtaaacacctggatgttctggtggcagatgaagatctgagccgttttatcctataa

SEQ ID NO: 5075 - DNA, 519 bp, Klebsiella pneumoniae
agattacacatcatgaaaaaaccgacatccgccacccgtggcaaatccggccgcaagtcgcgtgaagagttaaatcaggaagctcgcgatcgcaaacggcagaagaaacatcgtggccacgcggcaggcagtcgcgcgaacggcggcgatgcggcttcagcgggtaaaaaacagcgtcaggcgcaagatccgcgcgtgggtagcaaaaaaccgatcccgctgggcgtgagcgaaagcagcgctccagcccccaagcagcataaaccaaagagcgagaaacctatgctttcaccgcaggctgagctggagttgctggagaatgatgagcgcctggacgcgctgctggaacgtctggaagagggcggcaccctgaatgctgaagagcagagctgggtggacgccaaactggatcgcattgatgagctgatgcagcagctcggcctctcttacgatgatgaagatgaagaagaggaagagcgtcaggaagatatgatgcgtctgctgaagggtggaaactaa

SEQ ID NO: 5076 - DNA, 978 bp, Klebsiella pneumoniae
atcaactccttcgcctatcccgtgagcgtcacaagttcgggttatactaagcgcattgcaggagaaggagcctatatgaatcaatcttatggccggttggtcagtcgcgccgctatcgccgcgacggctatggcctccgcgttacttttgatcaaaatttttgcgtggtggtataccggttctgtcagtattctggctgcgctggtggattcgctggtggacattgccgcctcgctgaccaacctgctggtggttcgctattcgctacagcctgctgatgaagaacatacctttggtcatggcaaagcggagtcgctggcggcgctggcgcaaagcatgtttatctccggctcggcgctgttcctgtttctcaccggcattcagcacctggtgcgtccggagccgctgcaggccgccggcgtcggggtcgtcgtcacattgatcgccctcgttagtacgctggcgctggtgactttccagcgctgggtggtgcgaaaaacccagagccaggcggtgcgggcggatatgcttcattatcagtctgatgttatgatgaacggcgccattctggtggcgctgggcctctcctggtacggctggcatcgcgccgacgcgttgtttgccctggggattggcatctatattttatatagcgcgctgcggatgggctatgaggcggttcagtcactactcgaccgcgccttgcctgacgaggagcgtcaggacattatcaccatcgtgaccgcatggcccggcatccgcggggcgcacgatctacgaacgcggcagtcagggccgacccgctttattcagattcatttggaaatggaagataacctcccgctggtgcaagctcacgtgattgcagaccaggtggagcaggcgattctgcgccgtttcccggggtccgatgtcattatccatcaggatcccagctctgtggtgccagcggcgcagcagggcttttttgagcgttag

SEQ ID NO: 5077 - DNA, 2685 bp, Klebsiella pneumoniae
caaaataaaatgagatggggtgtctggggtaacatgaacgaacaatattccgcattgcgtagtaatgtcagtatgctcggcaaggtgctgggcgataccatcaaggatgcattgggagaaaatattcttgatcgtgtcgaaactatccgtaagttgtccaaatcttcacgcgccggcaacgaagctaaccgccaggagctgctgaccacgctgcagaatttgtcaaacgacgaactgctgccggtggcccgtgccttcagccagtttctgaatctggccaacaccgctgagcagtaccacagcatttcggccaatggcgaagcggccagcaatccggaagtcattgcgcgtaccctgagaaagctcaaagaccaacccaatctcaacgaagagaccatcaaacaagcggtggaatcgctgtctctggagctggtgttaaccgcccacccgaccgagatcacccgccggacgctgatccataaaatggtggaagtgaacaactgccttaagcagttggacaacaaagatatcgctgactacgagcaccatcagctaatgcgccgtctgcgccagctgatcgcccagtcgtggcataccgatgaaattcgtaagcaccgcccttccccggtcgatgaagccaaatggggcttcgcggtggtggaaaacagcctgtgggaaggggtgcctaactatctgcgcgagctgaacgaacagctggaagccaaccttggctatcagctgccggtggacttcgtcccggtgcgtttcacctcgtggatgggcggcgaccgcgacggcaacccgaacgtgactgccgacatcacccgccacgtgctgctgctcagccgctggaaagcgaccgacctgttcctcaaagacgtgcaggtgctgatctccgagctgtcgatggtggagtgtaccgacgagctgcgcgccctggctggcgccgagggcgctcaggaaccgtaccgttatctgatgaaaaaactgcgctctcagctgatggagacccaggcctggctggaagcgcgcctgaaaggccagaagctgccgaaaccggcgggactgatcactcagaacgagcagctgtgggagccgctgtacgcctgctataaatcgctgcaggcctgcggcatgggcattatcgccaacggcgagctgctcgacaccctgcgccgcgtgaagtctttcggcgtaccgctggtgcgtattgatattcgtcaggaaagcacccgccataccgaagcgctgggtgaaatgacccgttacctcgggatcggcgactacgaaagctggtcggaagccgacaaacaggctttcctgatccgcgaactgaattccaaacgtccgctgctgccgcgccagtgggagccaagcgaagagacgcgtgaagttctcgacacctgcaaggtgatcgccgaggcgccgcgcggatcgatcgccgcctacgtgatctcgatggcgaaaacgccgtccgatgtgctggcggttcatctcctgctgaaagaagccgggattggctttgctctgccggtggccccgctgttcgaaacgctggatgacctcaacaacgccaacgacgtcatgacccagctgctgaatatcgactggtaccgcggctttatccagggcaagcagatggtcatgatcggctactctgactccgctaaagatgccggcgtgatggccgcctcctgggcgcagtaccaggcgcaggacgcgctgatcaaaacctgcgaaaaagccggtattgaactgacgctgttccacggtcgcggcggctctatcggccgcggcggcgcgccggcccacgccgcgctgctctcgcagccgccgggaagcctgaaaggcggcctgcgcgttaccgagcagggcgagatgatccgctttaagtacggcctgccggaaatcaccatcagcagcctgtcgctgtataccagcgccattctggaagccaacctgctgccgccgccggagccgaaagcagaatggcgcgacatcatggccgagctgtccgacgtgtcgtgcaagatgtatcgcggctacgtgcgtgaaaacaaagatttcgtcccttacttccgctctgcgaccccggagcaggagctgggcaaactgccgctgggttcgcgtccggcaaaacgtcgtccaaccggcggcgtcgagtcgctgcgcgccattccgtggatcttcgcctggacccagaaccgcctgatgctgccagcctggctgggcgctggcgctgcgctgcagaaggtggtcgaaggtggaaaacagagtgaactggaagccatgtgtcgcgactggccgttcttctctacccgcctcggcatgctggagatggtttactcgaaggccgacctgtggctggcggagtactacgatcagcgcctggtgaagccggagctgtgggcgctgggttccgagctgcgcaagctgctggctgccgatatcaacgtcgtgctggccatcgccaacgactcccatctgatggccgacctgccgtggatcgccgagtctatccagctgcgtaatatctataccgacccgctgaacgtcctgcaggcggaactgctgcaccgttcacgccaggctgaagaagagggcaaggacccggatccgcgcgttgaacaagcgctgatggtcaccatcgccggcgtcgccgcaggtatgcgtaacaccggttaa

SEQ ID NO: 5078 - DNA, 783 bp, Klebsiella pneumoniae
ggtgtgatgatgaacccattaattatcaaacttggcggcgtattactcgatagcgaagaagcgctggagcgcctgtttaccgcgctggttaactaccgtgaagcgcaccagcgtccgctgattatcgtccacggcggcggctgcgtggtggatgagctgatgaagcagctcaacctgccggtgcagaagaaaaatggcctgcgcgttacgccggctgagcaaatcgacatcatcaccggcgcgctggcgggaaccgccaacaagacgctgctggcgtgggcgaaaaaacatggtatttcctcggtaggcctgttcctcggcgatggcgatagcgtgaaggtcacgcaactggatgctgagctgggccatgtcgggctggcgcagccgggctccccggcactgatcaacaccctgttggccggcggttacctgccggtggtgagctctatcggggtgaccgatgaaggccagctgatgaacgtcaacgctgaccaggcggcgacagcgctggcggccaccctgggggcggatctgatcctgttgtctgacgttagcggtatcctcgacggtaaagggcagcgcattgccgagatgaccgccgagaaagcggaacagctgatcgagcaggggattatcaccgacggcatgattgttaaagtgaatgcggcccttgacgccgcacgtgctctgggccgtccggtggatatcgcctcctggcgtcacgccgagcagctgccggcgttatttaacggcacgccgatcggcacacgtattctggcttaa

SEQ ID NO: 5079 - DNA, 903 bp, Klebsiella pneumoniae
ttgacagggatgggttatgcaatggcaaggaagagcgatccactggcgtttggtgggttggcgttattaacgctgatctggagctttagctggatcgcgatgaagcaagtgacgagctatatcggcgcttttgacttcacggcgctgcgctgtatttttggcgccgtggtgctatggatagtgatgttgatccgcggtaaagcgctcaagccgacgcctttcggctacaccctggcgatcgcgttattgcaaacctgtggcatggtcggtctggcacagtgggcgctaatgagcggtggcgccggtaaagtggcgatcctgagttataccatgccattctgggttgtggtgatggccgcgttattcttaggtgagcgcatgcggcgatggcagtatatcgccatcggggtggcatgcgtgggcctgatactcgtacttcagccttggcaactcgactttacctccctgaaaagcgccttgctggcgatcctctccggcgtgagctggggggcaggtgcgatcgtcgcgaagcgtatgtatacccggtatccgcaggttgatttgctggcgctaacgacatggcagatgctatatgccgccgtagtaatgagcgtagtggcctggctcgtcccgcaacgggcggtagactggcagcccgacgttttctgggccctggcttacagcgcaatccttgcaacggcgctggcctggagtctgtggctttttgtactgcgtaatttaccggcaagtatagccggcctgagtacgctggccgtaccggtctgtggcgtgctattttcctggtggctactacatgaaaatccaggaaaggtggaaggttgtggcattgcgttgatagtactggcgttggcgatgatcagtatcaagagaggaggggcatag

SEQ ID NO: 5080 - DNA, 1833 bp, Klebsiella pneumoniae
ggcaaagttgtgatcgaaaatctgcgtaatatcgccatcatcgcgcacgttgaccatggtaaaactaccctggttgacaagctgctacagcaatccggtacgttcgacgcacgtactgaagcacaagaacgtgtgatggactccaacgatttggagaaagagcgtgggattaccatcctcgcgaaaaacaccgcaatcaaatggaatgattaccgtatcaacatcgttgataccccagggcacgccgacttcggaggtgaagttgagcgtgttatgtccatggttgactctgtgctgctggtggtagatgcctttgatggcccgatgccgcaaacgcgcttcgtgaccaaaaaagcttttgcccacggtctgaagccgatcgtggtcatcaacaaagttgaccgcccgggcgcgcgtccggactgggttgtcgatcaggtgttcgacctgttcgttaacctcgatgcgaccgacgaacagctggacttcccgatcgtttacgcgtccgcgctgaacggtatcgcgggtctggatcacgaagacatggctgacgacatgaccccgctgtaccaggcgattgtcgatcgcgtgccggcgccggacgttgatcttgacggtccgctgcagatgcagatctcccagctggactacaacaactacgttggtgttatcggcatcggccgcatcaagcgcggtaaagtgaagccgaaccagcaggtcactatcatcgatagcgaaggtaaaacccgtaacggtaaagtcggtaaggtactgactcacttgggtctggagcgaattgagagcgacgtagctgaagctggcgacatcattgcgatcaccggtctgggtgagctgaacatctccgacaccatctgcgacccgcagaatgtcgaagcgctgccggccctgtccgttgatgagccgaccgtttccatgttcttcaacgtcaacacctctccgttctgcggtaaagaaggtaagttcgttacctctcgccagatcctggaccgtctgaataaagagctggtgcacaacgtggcgctgcgcgttgaagaaaccgaagacgctgatgcgttccgcgtttccggccgtggtgaactgcacctgtccgttctgattgaaaacatgcgtcgtgaaggtttcgagatggcggtttcccgtccgaaagttatcttccgcgaaatcgacggccgtaaacaagagccgttcgagaacgtgacgctggacgtcgaagagcagcatcagggttctgtcatgcaggcgctgggcgagcgtaaaggcgacctgaaaaacatgaatccggacggtaaaggccgcgtacgtctcgactacgtgatcccaagccgcggtctgatcggcttccgttcagagttcatgaccatgacctccggtaccggtctgctgtactccaccttcagccactacgacgacgttcgtccgggcgaagtgggccagcgtaacaacggcgtactgatctccaacggtcagggtaaagcggtagcgttcgcgctgttcggtctgcaggatcgcggtaagctattcctcggccacggcgctgaagtttacgaaggccagatcatcggtattcacagccgttccaacgacctgacggtaaactgcctgaccggtaagaaactgaccaacatgcgtgcgtctggtactgacgaagccacggttctggttccgccggttaagatgaccctggagcaggctctggagttcatcgatgacgacgaactggtagaagttactccgacctctatccgtatccgtaaacgtcacctgaccgagaacgaccgtaaacgcgcgatgcgcggtgcaaaagaagagtaa

SEQ ID NO: 5081 - DNA, 1386 bp, Klebsiella pneumoniae
aggaagcatgttatggcactttggggcgggcgttttacacaggcagcagatcaacggttcaaacagttcaacgactcgttgcgcttcgactatcgtctggcggagcaggatatcgttggctctgtcgcctggtcgaaagcgctggtaacggtcggcgttctgagtgccgctgaacagcagcagctggaagaagcgctgaacgtgctgctggaagaggtgcgcgccaatccgcagcaaatcctcgccagcgatgccgaagatattcacagctgggtggaaggcaagctgatcgataaagtgggccagctgggcaagaaactgcacaccgggcgcagccgtaacgaccaggtcgccaccgatcttaaactgtggtgcaaagataccgttgtcgaactgctctcggcgaaccgccagctgcagagcgcgctggtggagaccgcccagcagaatcaggacgcggtaatgccggggtacacccacctgcagcgcgcccagccggtgacgttcgcgcactggtgtctggcctacgttgaaatgctggcgcgtgacgaaagccgtctgcaggacgcgctgaagcgcctcgacgtcagcccgctgggctgcggcgcgctggcggggacggcgtatgagatcgaccgcgagcagctggccggctggctgggctttgcctccgccacccgcaacagcctcgacagcgtgtccgatcgcgatcatgtgctggagctgctttccgatgcggctatcggtatggtgcatctgtcgcgctttgcggaagatctgattttctttaactccggcgaggcgaacttcgtcgagctttccgaccgcgtgacctccggctcctcgctgatgccgcagaagaaaaacccggacgccctggagcttatccgtggcaaatgcggccgcgtgcagggtgcgctgaccggcatgatgatgacgctgaaaggactgccgctggcctacaacaaagacatgcaggaagataaagaggggcttttcgacgccctggatacctggctcgactgcctgcatatggcggccctggtgctggacggcattcaggtaaaacgcccgcgctgtgcggaagcggcgcagcagggctatgccaacgccactgagctggcggattatctggtggcgaaaggcgtaccgttccgcgaggcgcaccatattgtcggtgaagcggtagtggaagccattgcgcaagggaaaccgctggaagcgctgaccctggccgatctgcagaaattcagcccggtgattgcggacgatgtgtatccgatcctgtcgctgcagtcttgcctcgagaaacgcgcagcgaaaggcggcgtctcgccgcagcaggtagcccaggctatcaacgaggcgaaggctcgtttaagctaa

SEQ ID NO: 5082 - DNA, 279 bp, Klebsiella pneumoniae
gccgccgccgtcgatcaggagaatatgaccacggccattctgctcgagcagatcgtagagcaacccgttatcctcgaaacatttaaccgtaatgatctgtccaccaaacgacgaccgtcctccaaagttagagaacagcggttccacgacgttgacatcttcctggtagatgtcacaaagctcggaagtatcgtatttcataggcttaacgttcagttgctgcgagagtttttagtatatcccgcgaatcgcattgttggcaaaatcatcaattgttaa

SEQ ID NO: 5083 - DNA, 891 bp, Klebsiella pneumoniae
ggtatgagcttttttcacgccaatcagcgggaagccctgaatcagagcctggcggaagtccagggccagattaatgtgtcttttgaattctttccgccgcgcaccagtgaaatggagcaaaccctgtggaaatccatcgatcgcctgagcagtctgaaaccgaagtttgtttcggtaacctatggcgcgaactctggcgagcgcgatcgcacccacagcatcatcaaaggcattaaagagcgaaccggtctggaagcagcgccgcacctgacctgtatcgatgccagccgcgatgagttgcgcactatcgctcaggattactggaacaacggtatccgccatatcgtcgccctgcgcggcgacctgccgccgggcagcggtaaaccggatatgtacgccgccgatctggtgacgttgctgaaagaggtaggcgattttgatatctctgtcgccgcgtatccggaagtgcatccggaggcgaaaagcgcgcaggcggatttactgaacctgaagcgcaaagtagaagcaggggccaaccgcgcgatcacccagttcttcttcgatgtggaaagctacctgcgttttcgcgatcgctgcgtctcggcaggcatcgacgtggaaatcattcccggtatcctgccggtctccaactttaaacaggcgaaaaagtttgcggatatgaccaacgtccgtatcccggtgtggatgtcaaaaatgttcgaagggctggataacgacgccgaaacccgtcaactggtgggggcgaatatcgccatggacatggtgaagatcttaagccgggaaggggtcaaggatttccacttctacaccctgaaccgcgccgagatgagctacgccatctgccatacgctgggcgtacgcccggcctga

SEQ ID NO: 5084 - DNA, 1485 bp, Klebsiella pneumoniae
actacgacggttgtcgcggcgtcagaaatggctgcgcaaccggctcatgacccgcggtgcggtggggccgggacggcgtacccgtcggcggcaccatcggaaggagtgagcatgtctgagcagataatcgactgggatctggccctgatccagaaatataactattccgggccgcgctatacctcgtatcccaccgcgctggagttttcaccgcaatttggcgcggcggaattcgatgccgctgtggcccgttacccacagcgtcccctgtcgctgtacgtgcatatcccgttttgccataagctgtgttatttctgcggctgcaataagatagtcacccgccagcagcataaggccgatcaatatctcgatgtccttgaacaggagatcatccaccgcgcgccgctgtttgccactcgccaagtgaagcaactgcactgggggggcggcacgccaacttatctcaataaggcgcaaatcagtcgcctgatggatctgttgcgcagccatttccatttcagcgcggaagccgagatctccatagaggtcgatccgcgtgagatcgaactggatgtcctcgatcatttacgcgctgagggtttcaaccgcctgagtatgggcgtacaggacttcaataaagaggttcagcgtctggttaaccgtgagcaggacgaagcgttcatctttgatttgctcaaccatgcgcgggagattggttttacctcgaccaatatcgacctcatttatggcctgccgaagcaaacgccggagagcttcgcctttaccctgcaaaaggtctccgagctcaatcctgaccgcctgagcgtgtttaactatgctcatctgcccacgctctttgccgctcagcggaagattaaagatgccgatctgccctccgctgagcagaagctggagatcctgcaggaaaccatcggctcgctgacgacggcaggctatcagtttatcggcatggaccatttcgcccgtcccgatgatgaattagcggtcgcgcaacgtcacggcgtactgcatcgtaatttccagggctacaccactcagggcgataccgatctgctggggatgggcgtttcggcgatcagcatgattggcgacagctacgcccagaaccaaaaagagctcaagcagtactaccagcaggtagcagagcaagggaacgccctgtggcgcgggatcgcgttaactcgtgatgactgtctgcgtcgcgacgtgattaaagcgttgatctgtaacttccagctggatatcgcggcggtcaaggcgcagtgggacgtggattttgcgtcttatttcgccgaggatctgaagctgctggcgccgctggcgcatgacgggctggtggctgtggatgataaggtcattcaggtgacggcgaaaggccgcctgctgatccgcaacatctgtatgtgctttgatgcctacctacggcaaaaggcccggatgcagcagttctcacgggttatttaa

SEQ ID NO: 5085 - DNA, 951 bp, Klebsiella pneumoniae
cactggatattaaaacagtataaggaacttcatatggcgctggaaaaagggattgcttcgctggttgaggcatttattgcggcaggtcgtccgtcatcacgcgatcagcatattgatgatcggagggccggctatatcgccagtgcggtactcgccggggagacggaaacgcgagtgcgggtggaggatatcaccctggagggtatgcacttccgcgtcgtttcaccgcccactgccgacggcctgctacccacgcttatctactaccacggcggctgttttgtcagcggcggctttgccacccatgacaatcaattgcgccagcttgcctggttcagtgggtgccgggtgatcgccgtgcagtatcgtctggccccggagtacccttttccggcggcgcacgatgatgcagaacgaggtgccacgattattcaccagcacgcaaaacagcttggcgtggatgcttcgcgcatcaccctggccggcgacagcgccggcgggcatctcgccctggtcacggctctgcgcctgaaagcggcgggaacatggcagcctgcacagcttatcctgatttacccgatgctcgacgctaccgccagcatggcaagctacgccagcaacggcgaggattacatcattacccgggacacgctgcttagcggctacgaaatgtatttagcggccacacccgctacccatccggatgccagtccgctgtggcgcgaagattttcacggtctgccaccggtccacatcctgacggcggagttcgatcctttacgtgatgagggcgaagtgctgtaccgaaggctgacggagcaaggggtggagagttcctgtcagcgctatctgggggtgatccacggcttctttcagctggtaggcatcagcaacgccgcgcgtgatgccatgcgggatatcgcctggcgtgtggcatcgccaggacgataa

SEQ ID NO: 5086 - DNA, 825 bp, Klebsiella pneumoniae
ctggcggtatttaccctggcggacgttatgcagagtctccagcgccggcgtcgccgagccgagaattatcgggatctgctcgctgtgggcgcgccataccgccaggtcgcgggcatggtagcgccagccttcctgctgcttgtaggagctgtcatgctcttcgtcgatgacgatgacgccgagatctttaaatggggtaaacagcgaggagcgggtgccgatcacaatggccgcttcgccatttttcgccttcagccaggccgagagacgttcgctgtcattgagcccggagtgcagcacttccaccggcgcgttaaagcgctggcgaaatcgggcgatggtttgcggcgtcaggccgatctccggcaccatcaccagcgcctggcgcccctgcgccagcacattctccagcacgctcaaatagacttccgttttcccggagccggtaatacccgccagcagccaggcggagaaacgatcggcggcgctgtggatcgccccgacggcggtggcctgctcggtattcaggcgcaggcgttcgccggcaaccgaatacgcgctgcgccagtcggtgagggcgggcgcttcgcaggccagctccgccagccctttaccgcgcagcgcctgcagcgccgcttcattgaattccagttcgccaacctgatgacgccagattttgccctggcgcagcgccgccagcgcctgctgctgcttccgggagcgtttcaggccgttaaggtcgacaacctgcccctgctcggtggcgaaccagtaccacagcggcgtggcgctggcgggtttgccctggcgcagcataacgggtaa

SEQ ID NO: 5087 - DNA, 1017 bp, Klebsiella pneumoniae
gggagcgcttcaggcaacagaattattttttgcttcctaagttcagaggtagtcatgattaagaaaatcggtgtgttgacaagtggcggtgatgcgccgggcatgaacgcagcaattcgtggcgttgtgcgcgcggcattaacggaaggtctggaagtttttggaatctatgacggttacctcggattgtatgaagaccgtatggttcagctcgaccgttacagcgtttccgacatgatcaaccgcggcggtaccttcctgggctccgctcgcttcccggaattccgcgaagaacacatccgcgctgtggctatcgaaaacatgaagaagcgcggcctggacgcgctggtggttatcggcggtgacggttcctatatgggggcgatgcgcctgaccgagatgggcttcccatgcatcggcctgccgggcaccatcgacaacgatatcaaaggcactgactacaccatcggcttctttactgccctgagcaccgtggtggaagcgattgaccgtttgcgcgacacctcctcttcgcaccagcgtatctccgtggtggaagtgatgggccgttactgtggcgacctgaccctggcggcggcgattgccggcggctgtgagttcatcatggtgcctgaagtggaatatacccgtgacgatctggtggcagaaatcaaagccggtatcgcgaaagggaaaaaacacgctatcgtggccatcaccgagcacatgtgcgacgttgacgagctggcaagctacatcgagaaagagactggccgtgaaactcgcgccaccgtcctcggccacattcagcgcggcggttccccggttccttacgaccgcatcctggcttcccgcatgggcgcctatgcgattgagctgctgctgcagggccatggcggccgttgcgtcggcatccagaacgagaagctggtgcaccacgacatcatcgatgccatcgagaacatgaagcgtccgttcaagaacgactggctggattgcgcgaagaaactgtactaa

SEQ ID NO: 5088 - DNA, 1290 bp, Klebsiella pneumoniae
ctggcaatctccgctttcagctgcacagcgtcctgcaacaggaggggcgcacgtttaccgtcgtccagcggcgatatggactctctatggtggtcgatgaacaagattaatgcttctccccaggccatgctgatcgtgcgcctcgccgctgcgcaggcgccgctgcactggcaactcttcgcccccggcgagccgcaccacgaggccagcggccggtggccgactgacgacgccagccctttcccggcgctggctgagcagtacccggcctgggtgctgatcccggccagcgactgcgcgtttcactcgctcaccctaccggcgggcctgcgtaaaccgccgctgcaggtggccccgtttctgctggaagagcagctggccgacgatgtggaagccacccattttgccctgctccaccgccagcaggcccagtgcgagatcgtcgccgtacagcggcaaaaaatgcgcgactggctggcgcgctgcgaatcgctctccttacagcccctggcgttgacgcccgacgtgctggccctgccctggcaaccgccggcgtggagcgcggtgcaggtggacgagcagtggctgatccgccaccagccgtggggcggcatggcggcggaaaacgtctggctgacggagctgctgcagagcgaggcggaagagcacgtcatcgacagctattcgccgccgcccgcggcgccgggcgtctggcgggagcagcctgcgcagacattgctgacccttgccgcacgccatccggcagcgcagaaactcagtctgctgcagggggagttcgccgtccggcggcggtctgcgcaggcgagctggcgtccggcgcggtatgccgcgctggctctggcgttactggcaggggcaaacagcgtgctggaccatcgcgatctggcgcgtcaggccgaggcggcgcaacaggccagccgggccttctatcaccgctggtttccgacggagaaaaaggtgattaacccacgactgcagatgcagcagcacctgcaaaccctcacccgtcaggcgcagcatgcccccctcgtcgaccgcctcagcgccttgcaaaacatcctcagcgaaacgccggggatccgtctgcgagcgctgagctgggatgccgcgggcaatcctctgcagctggatatcgccgcggtcacttcccgggcgctggagcagtttacccagcgggcgcagccgcggtttcgcgtccggccgggcgacatgatcacgaaaccggatggcattgagggacaactgacgctggaggaaaacgatggctaa

SEQ ID NO: 5089 - DNA, 606 bp, Klebsiella pneumoniae
cgacagccttttgccgccagtttcgctacaatgtacgccattcttttcaggagtttattcatggcgctgaaagcgacaatatataaagctgcggtaaatgtagccgatctggatcgcaaccagtttctggatgctaacctgacgctggctcagcatccgtcagaaacccaggagcgcatgatgctgcgcctgctggcatggatcaaatatgccgatgaacggctacagtttacccgcggtctgtcgtcggatgacgagccggagctgtggctgcttaacgatcatctcggggtcgatctgtggatcgaactgggtctgccggatgagcggcggattaagaaagcctgctcacgggcgcaggcggtggcgctgtttgcttataatagccgggcagctgaaatctggtggcagcagaatcagagcaagcttgcggcgtacccgaagctgaccatctggtatcttgatgatgcgcaactggcactgcttagcgcctttgccgaccgtaccatgacgctgcaggccactctgcaggagggcagtatctggttatccgacgctcggaataatctggaaattcagcttaccgcctggcaagcgtcggcatga

SEQ ID NO: 5090 - DNA, 813 bp, Klebsiella pneumoniae
ctttcatcatcaggaaatgttatgaaaccgaccaccattgccctgctgcagaaatgcaaacaggaaaagaagcgctttgccaccattaccgcctacgatcacagcttcgcgaagctgttcgccgatgaaggcataaatgtgctgctggtaggcgactcgctgggaatgacggtgcagggtcacgactccaccctgccggttaccgtggaagatatcgcctatcacacccgcgccgtccgccgcggcgcgccaaacagcctgctgcttgccgacctgccgttcatggcctatgccacccccgagcagacctttgcaaatgccgccatcgtgatgcgcgctggcgccaatatggtcaaactcgagggcggcgcctggctggccgacaccgtgaggatgctggcggagcgcgcggtgccggtttgcggccatcttggcctgacgccgcagtcggtgaacgtattcggtgggtataaagtgcagggtcgcggcgatgcggcgcagaccctgtttgaagacgcgttagcgctggaggcggcgggtgcgcagctgttggtcctggagtgcgtgccggttgaactggcgaagcgcatcaccgacgctctgaccattccagtgatcggcatcggcgcgggcaatgtcaccgacgggcaaatcctcgtgatgcatgacgctttcggcattaccggcggccacattcctaaatttgccaagaatttccttgccgaagcgggcgacatccgcgccgcggtgcggcagtatattgccgaagtcgaatccggagtctatccgggcgaagaacacagtttccattaa

SEQ ID NO: 5091 - DNA, 1518 bp, Klebsiella pneumoniae
cgccttcaatctcggaggccgcccatgacgccagccgccgaacgccgtccgctgttgcccttcgcctgggcccgcgcgcaccatcttgtgctgctcagcgacggcgaatgctgcgaagcgttgtgccgccccgataccgccgcccgggcgctgctggaagcgcgccgcctggcggacgggccgatgcgcgtcagccgtctggcgccggacgcgttcgagaaagtgctggtgctcagctatcagcgtgattcggcggaggcgcaccgcatgatggccgacatcggcaacgagctcgacctctataccctcgccgaagagctgccggacaccgacgatctgctcgacagcgaggacgacgcgccgatcatccgcctgatcaacgccatgctaaccgaggccatcaaagagaaagcctcggatattcatatcgaaacctacgagcgccatctgcagatccgctttcgcgtcgacggcgtgctgcgggaaattctgcgcccgcagcggcggctggccgccctgttaatttcccgcatcaaggtgatggccagcctggacattgccgaaaagcgggtccctcaggatggccgcatggcgctgcgcatcggcgggcgagcaatcgacgtgcgcgtctccaccctgccctccagccacggcgaacgcgtcgtcctgcgtctgctggacaaaaacagcgtcaacctggatctgctgacgctgggcatgccgcccgccctgctcgatcgggtcgatgcgctgatcgcccgcccgcacggcatcatcctggtcaccggtccgaccggctccgggaaaagcacgacgctctacgccgccctcagccgcctcgacgcccgggagcgcaacatcatgaccattgaagatccggtggagtatgagctggagggcataggccagacccaggtcaacgccaaagtcgagatgaccttcgcccgcggcctgcgcgccatcctgcgccaggatccggacgtagtgctggtgggcgaaatccgcgatggcgaaaccgcccagatcgccgttcaggcctcgctgaccgggcacctggtgctgtcgaccctgcacaccaacagcgcgctgggcgccatttcccgtctacaggatatgggcgtggagccttttttactctccacctcgctgctggcggtgatgtcgcagcggctggtgcgccaactgtgcccacactgccgtcagccctggcaggcggatgccaacaccgcccggcagatggcggtcccggtcggcgcgcggctgtggcagcccaaaggctgtccggagtgtaatttcatcggctatcgcgggcgtaccgggatccatgaactgctgctaatcgacgatcgcgtgcgcgccgccatccaccgcggcgagaacgagatcaccctgatccagcagctggggccagcctggcaaaccctgcgtcatgccggacgcgacaaagcgctggcggggatcaccagctgggaggaggtgatgcgggtcaccgaacagcaaacgacggaaagcgtctaa

SEQ ID NO: 5092 - DNA, 1671 bp, Klebsiella pneumoniae
tgttgttcgtcattggtctggagctcgatccgcagcgcttatggaagctgcgcgcctcggtgtttggcggcggcgcactgcagatggtggccctgcggggtgttgatcggcctgttctgcatgctgctgggcctgcgctggcaggtggccgagctgattggtatgactctggcgctttcctcaaccgcgatcgctatgcaggcgatgaatgagcgcaatctgacggtgtcgcagatggggcggagcgccttcgcggtgctgctgttccaggatatcgccgcgatcccgctggtggcgatgatcccgctgctggcggccagcggcggcgccacctcgctgatggcttttgccctctccgcgctgaaagtggccgcagcgctggcgctggtggtggtccttgggcgctatctgacccggccgctgctgcgctttgtcgcccgttccggcctgcgcgaagtgttcagcgccgtggccctgttcctggtcttcggctttggcttattgctggaagaggtggggctgtcgatggcgatgggggcgtttctcgccggggtgctgctggccagctccgaatatcgtcatgcgctggagagtgatattgagccgtttaaaggactgctgttggggctgttctttatcggcgtcggcatgtcgattgatttcggcaccctggtcacccatccgctgcgtattgtgattttgctggtcggtttcctggcgataaaaatgctgatgctgtggcttatcgccaggccgcttggcgtaccgcgcgcccagcgccgctggtttgcggtgctgctggggcaggggagtgagttcgcgtttgtggtgtttggcgccgcgcggatggcggatgtactggacggcgaatgggcaaaagcgttgaccctggcggtggccctgtcgatggcggcaacccccattctgctggtgctgctgacccgtctggagaaatcgtccagcggccaggcgcgtgatgctgacgagattgatgaagagcagccgcgggtgattgtcgccggctttggccgcttcgggcagattgccgggcgattgctgctctcgagcggggtgaagatggtgatcctcgatcatgacccggaccatgtcgataccctgcgcaaatttgatatgaaggttttctacggcgatgccacccgggtcgatctgctggagtcggccggggccgaaaaggcggaagtgctgatcaatgccattgacgatccgcacgtcagcctggagctggtggcgagggtaaaagagcattttccgcatctgcagatcatctcccgcgcccgcgatgtcgatcattacattcagctgcgccaggctggcgtcgaggccccggagcgtgaaaccttcgaggcggcgctgaagtccggccgaatgacgctggaggcgctggggctcggcgcctatgaagcgcgcgagcgggccgatctgtttcgacgattcaacctgcaaatggtcgaagagatggtggcgatggcggaaaacgatgccgcgtcgcgggtggcggtcttcaagcggaccagcgatatgctgaccggcatcatcaacgaagatcgtcatcatctgtcgctggtgcagcgtcatggctggcagggtacggaagagggcaggcacaccggggatatcgccgatgagccggaaaataagccctcagcctga

SEQ ID NO: 5093 - DNA, 258 bp, Klebsiella pneumoniae
gctctaccgtcagtccgcgaaataatcagaacctgtttatgttctgctgtgctcgggaatacggcgttaaaaatttgttcaaaatgctcatttacgttttgtaaactgcgctttctcacaaattttttccttgtctacccatcgctcgcgacgaccataaacaggttcttcggagaagaaagcaatgccaaaacgtacagacataaaaagtatcctgattctgggcgcgggcccgattgttatcggtcaggcgtgtga

SEQ ID NO: 5094 - DNA, 1311 bp, Klebsiella pneumoniae
aacgcgcagtcgctggccgggatcagcacccaggccgggtactgctcagccagcgccgggaaagggctggcgtcgtcagtcggccaccggccgctggcctcgtggtgcggctcgccgggggcgaagagttgccagtgcagcggcgcctgcgcagcggcgaggcgcacgatcagcatggcctggggagaagcattaatcttgttcatcgaccaccatagagagtccatatcgccgctggacgacggtaaacgtgcgcccctcctgttgcaggacgctgtgcagctgaaagcggagattgccagtcaccacggtaaaagcggcgataaagcgtgcgctgtgcaccgtcagccagggacgggcaagcgtggtatcggttttctgcagcgtcggctgcgcgagaaaggcggcgacgctgctccacccggttcgcgggcggttgtgcagcagctgttgcgcctcctgcagcgtcagatcgccgggaaggagggccaccagcagggcggcctgggaggggcgcagggtgttgacattgacctgcagcgcgtcatccggctggacgcagacgaaggggagcaggcgctgatagagcgcggcgtccatcccggccagcaggcgcaactcgctgacatcctgcatcggctggttggcggcgagatagcccggggtttgcgccatatagacctcgtcctccgccccgttcagccgcggctggccgtcgctgtccgtccagtcgccaagggcggcggcgatctggctggcgcgcagcggcggctcgccgagcagcgccagcagccgaacgaagacgtcggtcgggtagggcgttccgtcgccagcctcatccgcgcgatggtcaatagcattgaggttgaagcaggcgtgcccgtcgcggatcgtggcgcggatttcgccatcgtcgagggtaaagcggcgcccctcctgcgcccaggtttgcgccaggttcgtttgactgggcgagtccagcgcatcgcgttgcagcagcgcggcggccatgttttccgccgccagggcgtaccatctggcctgcaaattatcgagggtcacggcggtatgctgatacatgaccgcggtgcgctcggtcatggcgctggcgaggatcatcatcagggcgaggatgaacagcaccatcaggagcgcgacgccgcgttgccgatttatcactggccgcctcccggggtgagtaaaaacaggcgggttatctccccgctgttcgccagcgtcagggtgatctccagcccctgcggcagcctctgcgggcggtcccaggtttcctgccagcgcccgtcggcgtaa

SEQ ID NO: 5095 - DNA, 360 bp, Klebsiella pneumoniae
cgtgctcttccgcctcgctctgcagcagctccgtcagccagacgttttccgccgccatgccgccccacggctggtggcggatcagccactgctcgtccacctgcaccgcgctccacgccggcggttgccagggcagggccagcacgtcgggcgtcaacgccaggggctgtaaggagagcgattcgcagcgcgccagccagtcgcgcattttttgccgctgtacggcgacgatctcgcactgggcctgctggcggtggagcagggcaaaatgggtggcttccacatcgtcggccagctgctcttccagcagaaacggggccacctgcagcggcggtttacgcaggcccgccggtagggtga

SEQ ID NO: 5096 - DNA, 315 bp, Klebsiella pneumoniae
acacaccgtccgggtgatgctcaagctggaaagctttgccaaagaagaaacccgcagccgccacccgctgtgcgtggagctgtggccgcgcttaacgcacccggagctgatcttaattgccgccctgttccacgacatcgccaaagggcgcggcggcgaccactcgatcctcggcgcgcaggatgtgctgaagtttgccgagctgcacgggctgaactcgcgcgaaacgcagctggtcgcctggctggtgcgtcaccacctgctgatgtcggtcaccgcccagcggcgcgatattcaggatccggaggtgattaa

SEQ ID NO: 5097 - DNA, 2148 bp, Klebsiella pneumoniae
gactcgtacccgatacacaccgtcctcatcgcgcttggcgccgtgaatatcggtctcaaagcccgggtaatgacggccgatagagcaaagcatcagcagaaaatcgagcaccgcccggctttcctcggtgatcatctctcccggcatcagcagcggaacccccggcggataagggaggatcatgttggccgaaatccgccccaccaggttctccagttcaatagtttccacctcccccttgatctggcgctgccaggcgtgatgcggcgtcattttcatttccggcaggacgtcaaaggcgctgagcatcagctgcggcagctgatgctgacggatcaagcggtggatcccctgcgccagatcctggatccgcatgttgcggtagaagtcgggatcttcggcgtacagatccggcagcatatttttcacccgcagattgagatcgtaggcgcgtttaaactcggtcaggccgcgcagcagccccatcgcccgggttttatcgatgccgatactgaacaggaacagcagattgtaggggcctgttttctctaccaccacgccccgctcgtcgaggaacttcgccaccagcgccgccgggatcccctcttcatccatattcccctgctcgtccatgcccggcgtcagaatggtgaccttcaccggatcgagatacatatgatccgcatcggcatctttgaaaccgtgccagtcctcgcccggcgctaccggccagcactcggctttatctacggcttccggctgccagatatcaaagaaccagccgtccgactcctcgcgcagtcgctgcacctctttgcggaagtccagcgcccgctcaatggagcgctggatcagacgtttaccggagttgccgcgcagcatcgccgccgcggtctcaatcgacgcgacgatggggtagctcggcgacgtagaggtatgcatcataaaggcttcgttaaaggtctcttcatcatagttgcctttaatgtggatcagcgaggcctgcgacagcgcggccagcatcttatgcgtcgactgcgtctcgaagatgactttcccggggatccgctccccgctcataccgcttttcccctgatatatcggatggaaatgggtatagggcacccaggcggaatcgaaatggatcgacgggacatcgagcgtctccttaagccaggtggtgttatagagcagaccatcgtaggtggagttggtgatcaccgcatgcacgggccactgcgccccgcccgtgtcgcgcactttctgctgaatgctgtcgcgggtaaattcgcgccgggggataccgccgaggatccccagcgcgttgcgggtcggcttcagccacaggggaactacatcgctcatcatcagcaggtgggccagcgatttgtgacagttacggtcaatcagcagggtgctgccggcgggcgccgagtacatgccgacaattttattggacgtcgaggtgccgttggtcaccatatagctttgctcggcgccaaaggcgcgcgcgatatactcctccgcctccaggtgcgggccggtatgatccagcagggagcccagctcggtgaccgaaatcgagacatccgccttcagcgtattcccgccaaaaaaatcatagaacaggcagcccaccgggcttttctgataggcgctgccgcccatatggcccggcgtacagaaggtatattttccctcctggacatagttgaacagcgcgcgggtaaacggcggagtgatattctccaggtactcgcgggtgtactgcccaatgcgggtggcgatctcttcggagagtcccagcgcatattcgaagaaccacagcgtcatgcgcaaatcctgactgctgacatccatcgtcgagtgggcgttaataaaggcgtacagaggaaggtattcattgagctgattgatatcgctgcacagatcgacgctgtattcatcccagtcgaagatcaccccgcagatgcgcgggttgtgctcgataaactgcagcaggtcggcgctgttttgcggccagatggtctggaagccctggcgctgcagcgccgcttccagttctttgatcggctcgtctttgtggtagacgccgtgaggccccatgatggcgatgatattcacgctttcctcctggtattcacctaa

SEQ ID NO: 5098 - DNA, 1533 bp, Klebsiella pneumoniae
aagttttgcccaattgaaacaatgtgccgcaagggcatttttttgacgacgcagcgcgccgggacggctaaaatgccgctctcttcatttgtattaccaataattgataacggcatgaaagcagaaactccctcttttgaagcacatcagtttgtgcgggtgcgtcgcggcgatgcggtgcgccgtctgattcaacgcgataaaacgccgctggcggtgctgtttatggcggcagtggtcggcacgctggcggggctggtgggcgtcgcctttgaaaagagcgtgaactgggtgcagaaccagcggatcggcgcgctggcgcaggtggcggaccactggtatctggtctggccgctggcgtttatcctgtcggcgctgctggcgatggtcggctattttctggtgcgtcgctttgcgccggaagccggcggctccgggattccggaaattgaaggcgcgctggaggagctgcggccggtgcgctggtggcgcgtgctgccggtgaaattcgttggcggcatggggacccttggcgccgggatggtgctgggtcgtgaaggaccgatggtacagcttggcggcaacattgggcgcatggtgctggacgttttccgcatgcgcagtccggaagcgcggcatacgctgttggcgaccggtgcggcgtcggggctttcggcggcctttaatgcgccgctggccggtattctgtttatcatcgaagagatgcgcccgcagttccgctacaacctgatctccattaaagcggtgtttaccggcgtgatcatgtcgagcattgtgtttcgcattttcaacggcgaagcggcgatcattgaggtgggtaaactaagcaacgccccggtaaataccctatggctgtatctggtgctgggcatgctgtttggctgctttggcccgctgtttaattttctggtgctgcgcactcaggatctgttccagcgcatccacggcggcaacatcaaaaaatgggtgttgattggcggattaatcggcgggctctgcggtctgctggggctgatgcagccctccgcggtgggcggtggctttaacttgatccctatcgccgctgccggtaacttctccgtcggactgctgctgtttatctttattgcccgcgtggtgaccacgctgatctgcttctcttccggcgcgccagggggcattttcgcgcctatgttggcgctcggcacgctgctgggcacggcgttcggcatggcggctattccgctgtttccggcctaccatctcgatgccggcaccttcgcgattgccggcatgggggcgctgctcgccgcctcggtgcgtgcgccgctgaccgggatcgtgctggtgcttgagatgaccgataactatcagctcattttgccaatgattattacctgccttggcgcaacactactggcgcaattcctcggcggtaagcctttgtattcgaccattctgcagcgtactctggcgaagcaggaagccgagcaggcggcaaaagcgcagcaggctccccgggagaatacttga

SEQ ID NO: 5099 - DNA, 1062 bp, Klebsiella pneumoniae
tatggcggcccgctattgcgactatctggtggccctgcgcggtggagaaatgattgcccaggggacgccggcggaactgatgcgcagcgacactctggaacagatctacggcatcccgatggggatcctgccacacccggccggtgcggcgccggtaagctttgtctattgatgatgaacccaactctgataacccgacgccgcctgctgatcgcgatggcgctctcgccgctgctgtggcagatgcgcggcgcgcaggcggccgacgtcgacccgcagcgcgtggtcgccctggagtggctgcccgcggagctgctgctggcgctcggcgtgacgccctatggcgtggccgatattcccaactatcgcttgtgggtgaacgaacccgcgctgcccgactcggtgatcgatgttggtctgcgtaccgaacccaaccttgaactgctgacgcagatgaaaccgtcgtttatcgtctggtcggcgggctacggcccgtcgccggagaagctggcgcgtatcgcgcccggccgcggtttcaccttcagcgacggcaaacggccgctggcgatggcccagcgttcgctactggaaatggccgatctgctgggcaaaacgcagcaggcgaagcgccatctggcggagttcgacgcgctgatggagagcctgcgtccgcgttttgccgggcgcggcgatcgtccgctgctgatgatctctctgctcgatccccgccacgtgctggtgtttggcgaaaactgcctgttccaggaggtgcttgatcgctttggtattaaaaacgcctggcacggcgaagcggcattctggggaagcgttagcgttggcatcgacaggctggcggcatttaacgaagccgatgtcatctgtttcgaccatggcaatgagcgagatatggctcaactgctggcgacgccgctctggcaggcgatgcccttcgtgcgcgcgggccgcttccagcgcgttccggcggtttggttctacggcgcgacgctgtcagcgatgcattttgcccgcgtgctggctgatgcccaggggagaccggcatga

SEQ ID NO: 5100 - DNA, 303 bp, Klebsiella pneumoniae
ccatcgataccgcagccttcggcgtcgctactttatccacgtgcggctcacgggccagggaatactgcgccaggcgggtcaacacctgatactgcgacgaatggcggtcgcccagcgaagcaaaccacgccgggagcgctttttcaccatggcccaccagggcatagaccacccccaccagacgcaccggcagccagtccacaatatgcaggataccatcgatcccggactgcaaccggtggtgcggcgtctggtagcgcgccagccatgtctgccaggcgcgcagtacgctgtaggcgataa

SEQ ID NO: 5101 - DNA, 1254 bp, Klebsiella pneumoniae
tgcgggtcaccgaacagcaaacgacggaaagcgtctaagatggccctgtttcgctatcaggcgctggacgcgcagggcaaaacccgccgcggccttcagcaggccgactccgcccgccacgcccgccagctgctgcgggacaagggctggctggcgctggaagtgacaactgccgacccggcgcggcgactgtgggccggcggatcccttacccggcgtaccagcgccggtgatttagccctgctcacccgccagctggcgactctggttgccgccgggatcccgctggaaaaggcgctcgatgccgtcgcccagcagtgcgaaaagccgtcgctaagaacgttaatggccggggtgcgcagcaaagtgctcgaaggccactcgctggcggaggcgatgcgcggctatcccgcctgcttcgacgggctgttctgcgccatggtggcggccggcgaaacctccggccatctcgacggcgtactgaaccggcttgctgactataccgagcagcgccagcagctccgcgcccgcctgctgcaggcgatgatctaccccatcgtactgacgctggtcgctatcagcgtgatcgccattctgctctccaccgtagtcccgaaagtcgttgagcagtttgtccatcttaaacaggccctgcccttctctacccggctgctaatgagcctgagcgacatcgtgcgcagcgcgggcccctggctggcgctgctgtcgttactggcgctgctggcgctgcgctatctgctgcgccagcccgcccggcggctcgcctgggaccgggcgctgctgcgcctgccggtcatcggccgcgtggcccgcagcgtcaacagcgcgcgctacgcccgcaccttaagcattctcaatgccagcgcggtgccgctgctgctgtcgatgcgcatcagcgccgacgtcctcagcaacgcctgggcgcgcagccagctggcggcggccagcgaatcggtacgcgaaggcgtcagtctgcatcgggcgctggaatccaccgccctgtttccgccgatgatgcgctacatgatcgccagcggcgaacagagcggcgaactgaccgccatgctggagcgcgcggcggagaaccaggaccgggagctgagcgcgcagatccagatggccctcagcctgtttgagcctctgctggtggtcaccatggccggcatggtgctgtttatcgtgctggccatcctgcagccgatcctgcaactgaacacccttatgagtatgtaa

SEQ ID NO: 5102 - DNA, 435 bp, Klebsiella pneumoniae
gatcgaccacctggctgtactccgagttggtcgacaaactgtgggcgtagggatcggtcacttcgtactgttcgactttacgcgactgcgggtggtaaacggtcatcgcgtagcggtagaacgcgcccttcaggtcgcttcccccctgccatgaccaggcgccggaggcgctgtcgcgggtcatcgggtggctggccaccaccttcttgtcggcgctgtagaccaccagttcgacctgctgcgccgtgggcgcccagacgcggaaggtcacgccgctatcggttagctgggcgccgtagctcagcgcctcggcggcggcggcataggtatcgtccagcacgccggcggtctgtacctgggtggcggagctcaggatcccatcgctttccgcggctatcgccaccgtctcgccctgcagcaattcatcgacgttaa

SEQ ID NO: 5103 - DNA, 414 bp, Klebsiella pneumoniae
gccataatgccacaaataccgcggttggcccttcccacgggaccggacgggcctgaattggaacgcccaagtttaattccaggtctgccattacagaatgaaaaggctttggccgctgggccccggcacttgaagcacaaaagggttcaagccttggtggacacagaacgccggcgaagctgccgggccccggcaaaaccgggcgttcccgggtccaaaacaagcctggcggcattaaaagattatttagccgtgttgatcgattttacccgcccgaaaggcacgttgaaccatctggcgttttgccgcgagcatggcaaagggatggtcatcggcaccaccggttttgacgacgctgacaaacaggcgattcgcgatcccgcgcaggacattgccattgttttcgccgcataa

SEQ ID NO: 5104 - DNA, 2430 bp, Klebsiella pneumoniae
ccccattcgccagcactcatccaccaggccaaccactttctcggtgttgtccatatcggcggtcatcaccgccgccataaactcggccgggtagtgcgccttaagccacagcgtctggtaggagaccaacgcgtaggcggcggagtgcgatttgttaaatccgtaaccggcgaatttctccaccaggtcgaagattttcatcgccagttcgccgtcaatgccgtttttcttcgccccatcctcaaagatagaacgctgcttggccatctcctccggctttttcttacccatcgcacgacgcagcatgtccgcgccgccgagggtatatccggacagcacctgggcaatctgcatgacctgttcctgatacaggatgatgccgtaggttggctccagcaccggtttcaggctttcatgctgccactgcacgtccggataagagatctcctcgcggccatgcttacggtcgataaagttatctaccatccccgactgcagcgggcccgggcggaacagagccaccagcgcgatcatatcttcgaagcagtccggctgcaggcgtttaatcagatctttcatgccgcgcgattcaagctggaagaccgcggtggtttccgagcgctgcagcatgtcgaagcttttcttgtcatccagggggatggcggcgatatccagcggcccttcgccgttcttctcacggcgcttgttgatcatctccagcgcccagttaatgatagtgagcgtacgcagaccgaggaagtcgaatttcaccagcccggcgtattccacgtcgttcttatcaaactgggtaaccggatgcagcccctgctcatcgcaatacagtggcgcgaaatcggtgattttggttggagcgataactaccccaccggcatgtttaccggcgtttcgcgtcaccccttccagcttacgcgccatgtcgatcagcgctttcacttcttcgtccgcctcgtagatctccggcagctgcggctcggcctcaaaggctttcgccagcgtcatgcccggatcgggcggcaccagcttggagatacgatcgacaaatccgtacgggtgacccagcacgcgaccgacatcgcggatgaccgctttcgccgccatggtaccgaaggtgatgatctgcgataccgcgtcgcggccgtacatatccgccacgtgctcgataacctggtcgcgtttctccatgcagaagtcgacgtcgaagtcgggcatcgagacacgttccgggttaaggaaacgttcgaacagcaggtcgaactccagcgggtcaagatcggtgatcttcagcgcgtaggccaccagcgaaccggcgccggaaccgcgtcccgggccaaccggcacgccgttatccttcgaccactggataaactccatcacaatcaggaagtagcccgggaaccccatctggttgataacctggagttcaatatccagacgctggtcatactccgggcgcttttcagcacggacggcaggatccgggaagaggaattccagccgctcttccagaccctctttcgatttcatgaccaggaaatcttccgtggtcatatcgccggtcgggaactgcggcaggaaatattcgccaagccgcacggtgacgttgcagcgcttggcaatttcaacgctgttcgccagcgcttccggaatatcggcgaacagctcgcacatctcttcctcgctgcgcatatattgctgcggcgagtagttgcgcggccgtttcgggtcgtcgagcgtaaagccgtcgtggatcgcgacgcggatttcatgggcgtcgaaatcgctggtgtcgagaaagcggacatcgttggtcgccaccaccggcaggccgcgcgcttccgccagcgccacggcggcgtggagataggcctcttcatcctgtcgaccggtacggatcagctccagaaaatagcggtccgggaaatgctcttcgtagaaggcgacgcactgttcaaccagcggcatattgccgcggatcaggctgacgccgacgtcacctttccggccgccggagagcagaatcagcccttcctgatgttccaccagccagtcgcgatcgatccacggccccagggcgccgtagccgcgctgataggcacgggaaatcaacagggtcaggttctggtagccggtgttgttcgccgccagcacggtcagctcggtaaattcgtcgccgagcaggtcgcactgcacgtgaaagtcggcgccgacgatcggcttaatccccgcgccgtgtcccgtcccgtagaacttcaccagtccgcagaggttggtgaaatcggtgatcgccagcgctggcatgccaagcgaggccgccttcttcaccagcggcccggtctttgccagcccatcgatcatggaatagtcgctgtgcacccgcaggtgtacgaaacgtggttcagccatctttag

SEQ ID NO: 5105 - DNA, 2445 bp, Klebsiella pneumoniae
cccccggagccttttgtgtcctcattgccggttgccgctgtccttccagaactgttatccgccctgcagcatgcgccgcaggttttgctcaacgcgccgaccggcgccgggaagtcgacctggctgccgctgcagatcctcgccgagggcaacatcgcgggacgcattatcctgctcgagccgaggcgcctggcggcgcgtaatgtcgcgcagcggctggctgaactgcttggcgaaaagccgggggagaccgtgggtttccgcatgcgcgccgaaacctgcgtcggaccgcagacccgcctggaggtggttacggaggggatcctgacgcgcatgatccagcgcgatccggagctgacgggcgtggggctggtgatcctcgatgagtttcacgagcgcagcctgcaggcggatctggccctggccctgctgctcgacgtccagcaggggttacgtgacgatctcaagctgctgatcatgtcggcgaccctcgataacgatcgcctgcagcgtctgctgccggaggcgccggtggtggtctcggaggggcgcgcttatccggtggagcgtcgcttcagcccgctctccgcgcagcagcgttttgatgaggctgtggcggtagcggcggcggagctcctgcggcatgaacagggatcgatgctgctgtttctgcccggcgtcggcgagatccagcgcgttctggaacaactgacggagcgcgtggcggaggatgtcattctctgcccgctgtatggcgcgttgcccttaagcgaacagcgcaaagcgatcctcccggcgccggccgggaagcgcaaagtggtgctggccaccaatattgccgagaccagtttgaccatcgaggggatccgcctggtggtcgacagcgcccaggagcgggtcgcccgctttgacccgcgcaccggcctgacccggctggtgacgcagcgcatcagccaggcatcgatgacgcagcgtgccggacgcgccggtcgtctctccccggggatctgcctgcatttgctcggcaaagaacaggcggaacgggcggcggcgcagagcgagccggagatcctgcacagcgatctgtcggcgctgttgctggagctgctgcagtggggctgccacgatccggccgcgctggcctggctggatcagccgcccgcggtcaatctggccgccgcgcgtcgcctgctggaggcgctgtcggcgctggacggcgagcggctgtcggcgtttggccgcaaaatggcagcgcttggcaacgagccgcggctggcggcgatgctggccgccgcgcagaccgatgacgaggcggcgacagcggcaaagctggcggcgatcctcgaggagccgccgcgcggcggactggtggatttgggggccgtcttttcccgtcagcaggccaactggcagcagcgagcgcagcagctgatgaaacgcctggcccgccgcggcggccagcccgatgccgggctaatggcggggctgctggcgtcggccttcgccgatcgcatcgcccgccgccgcggtcaggaggggcgctaccagctggcgaacggcatgggcgcgatgctggacgccgacgacgcgctgggccgtcatgaatggcttatcgctccgctgctgctgcagggtagcgcttcgccggatgcccgcatgctgttggctctgccagtggaaatcggcgagctgatcgccgcccgccctgaactggcgaaaagttccgacacggtggagtgggatgaagcgcaggggacgctaaaagcctggcggcggacggtgatcggccagttggtgatcaagacccagccgctggcgaagccctctgaggcagagctgcatcaggcgatgctcaacggtattcgtgagaaaggcctcggggtgctcaactggacgccagaggctgagcagctgcgcctgcggctgcactgtgcggcgcagtggctgccggaagaggcatggcccgcagtggatgacgcttcgctgctggcctcgctggagacatggctgctgccgcagatgaacggcgttcattccctgcgggcgctgaaggcgctggatctgcgtcaggcgctacaggactggctgccatggccgctgcgccaaaagctggatcgcgagctgccgacgcactataccgtgccgaccggcagccgcctggcgatccgataccatgcggagaacccgccagcgctggcggtgcgtatgcaggagatgttcggcgaggccacgacgccggtgatcgccgaggggcaggtgccgctggtgctggagctgctgtcgcctgcccagcgtccgctgcagatcacccgcgatctgagcgccttctggcaagggagctaccgcgaggtgcagaaagagatgaagggacgctatccgaaacacgtctggccggacgatccggccaacgccgccccgacccgccgcagcaaaaaatactcgtag

SEQ ID NO: 5106 - DNA, 858 bp, Klebsiella pneumoniae
cgccccgggcccgacgccgtggcagctgcagggaaaatggttaccacaggagcaaaaatgacgacactagccgcgttatcgctgcactttccctttgtctggtatggctttctgctgctgttcggcctggcgctgggcagcttttacaatgtggtgatctatcgtctgccgcgcatgttgacccagaccgcggacgacgagcggataaccctcagcaccccgggatcttcctgcccgcagtgccgccagccgatcgcctggcgggacaatatcccgctgctcagtttcctctggctgggccgtcgcgcccgctgctgtcaggcgcccatcgcgtggagctatccgctgaccgagctggccaccggcctgctgtttatcctcgccggagctttgctggcgccgggcctgccgctggcgggcggcctggtgctgctctcgttcctgctgatactggcgcggattgacgcccggacccagctgctgcccgatcgcctgactctgcccctgctgtgggccgggctgctgttcaatcttaacgaggtgtacattgccctgccggatgcggtcgccggggcgatggccggttatctggcgctgtggtcggtctactggctgttccgcctgctgaccgggaaagaggcgctgggctatggcgattttaagctgctggcggcgctgggcgcctggtgcggctggcaggttctgccgcaggtgctgttgctcgcttcggccagcgggctggtgtggaccctgctgcaacgcctgtggacccggcagtcgctgcagcagccgctggccttcggcccctggctggcgctggccggcgggagtatttttctctggcagcagatggtctag

SEQ ID NO: 5107 - DNA, 1338 bp, Klebsiella pneumoniae
cgtgccgggccatcacttctcggtatgttcgtggatatgacggctgatattgcgcatacgcttcatccccatcgccagctgctggtggccttcagcggcggtctggactcgacggttcttctgcatcagctggtgctgctgcgggaacaggatccctcgctgacgctgcgggcggtgcatgttcaccacggccttagcgcccacgcagacgactgggtggcgcattgtcggcagatttgccagcagtggcaggtgccgctggtggtgcatcacgtgacgttagcccggggagggctgggcgtcgaggcccacgctcgtgcggcgcgctatcaggcctttcaggatacgctcaatgccggcgaggtgttagtgaccgcccagcaccaggacgatcagtgcgaaaccctgctgctggcgttaaaacgcggcagcggtcctaccggcctgtcggcgatggcgccatcctctgcctttgccggcagtcgactactgcgtcctctcctcaatgaaacccgcgaatcactacgccagtgggcgctcgcccatcagctgtcgtggatcgaagatgagagtaatcaggatgatacctatgaccgcaatttcctgcgcctgcgggtgatcccggtgctgcgcgagcgttggccgcactttagcgaggccgtcgcccgcagcgccagcctgtgcgccgagcaggaacaactgctggacgagatgttggcggcggagctggcgtcgctggtggccgaagatggctcgctggctatcgcgccgctggcgacgatgagtccgccgcgccgagcggcgctgctgcgtcgctggctcgccgggcagcaggcgctgatgcccgcccgtgaggtgcctgagcgcctctggcacgaggtggcgttggcgcgggaagatgccagcccctgtctgcggttgggggaatttaccgtccgcagttttcaacagcgtttgtactgggtgaagtatcttcccggtcagacggacagcgttcagcgctggcccgactggcgccagccgctgcggctggcggacggtctcggcgagctgacgctgcagcccggcggcaggctgcgcccgccgtcggcggatgagccggtcaccgtccgctttcgcgccagcggccacctgcatattgtcgggcgccatggcggacgcaagcttaagaagctctggcaggagctgggcgttgctccgtggcgacgagacaccacgccgctgctgttttacggcgaaacgccgattgccgcagcggacgatctgtttgtgaccacagaaggtgaagtgaaggacggggaaggggtcaggctgatgtggaggaaaacgggcgattaa

SEQ ID NO: 5108 - DNA, 2250 bp, Klebsiella pneumoniae
ttctcgtttacgttatcattcactttcatcagagatatacccatggcgcgtccaaaaactgctcagccaaatcactcgctgcgtaaagtcgcagctgtagtagccacggcggttagcggcatgtctgtctacgcacaggcagcagaacaaccgaagcaagaagaaaccatcaccgtcgttgccgccccggccgcccaggaaagcgcctggggaccggcgccgactatcgcggcaaaacgctccgccacggcgaccaaaaccgataccccgattgaaaaaacgccgcagtctgtgtcggtggtgacgcgccaggagatggagatgcgccagccgacgacggtaaaagaggcgctctcctatacgccaagcgtcttctccactcgcggcagttcgaccacctatgacgtggtcaccattcgcggcttcaccacctcgacgaccgtcaacaccaaccagtatctggacggcatgaagctgcaagggaataactactctgaagtctccatggatccttacttcctcgagcgtgtggaagtgatgcgcgggccaacctcggtgctgtacggcaacagcaacccgggcggtatcgtcagcatggtcagcaagcgcccgactaccgagccgctgaaagaagtgcagtttaagatgggcaccgacaatctgtggcagaccgggtttgactttagcgacgccattgatgatgccggcgtctggtcgtatcgcctgaccggccttggccgcagtcaggatgcccagcagcagatggcgaaatcgacccgctacgcggtggcgccctcctttagctggcgtccggacgataaaactgacttcaccttcctgagcaacttccagaatgacccggatgcgggctactacggctggctgccgcgcgaaggcaccgtggtgccgtattacgacgccaacggtaaggcgcacaagctgccgaccgatttcaacgaaggcgagtccgataataaaatctcccgccgccagaagatggtgggctacagcttctcccatcagttcgatgacacctttaccgtgcggcagaacctgcgctatgccgatgtgcatacgctctatcgttccgtatacggcaacggctatgtcgcgccgggctacatgaatcgcgcctacgtgcgctccgacgagcacctgaacaccttcaccgtcgatacccagctgcagtctgatttcgccaccggcgcggtcagccatacgctgctgaccggcgtggactactcgcggatgcgtaacgatgtggatgccgactacgggacggcggatcctatcagcatgagcaatccgcagtacggcaatccgaatattcaggtcaccttcccgtacgcggtcctcaaccggatggagcagaccggcctgtacgcgcaggatcagatggagtgggataaatgggtgatgaccctgggcggccgttacgattacgccacgacctcaacgttaacccgcgccaccaacagcctggcggagaatcacgaccagcagttcagctggcgcggcggcatcaactacctgttcgataacggcatctcgccgtacttcagctacagcgaatcgtttgaaccggtatcgggttccaacagccgcggccagccgttcgatccgtcgcgcggtaagcagtatgaagccggcgtgaaatacgtgccgaaagatatgccggtggtggtcaccgcggcggtctatcagctgaccaaagacaagaacctgacggctgatccggctaaccaggcgttcagcatccagaccggcgagatccgctcccgcggccttgagctggaggcgaaggcggcggtgaacgccaatattaacgtcaccgcggcctacagctacaccgatgcggagtacactcacgatacggtgttcaacggcaaacgtccggcggaagtgccgcgtaacatggcctccctgtgggcggattataccttccacgaaaccgcgctgagcggtctgacgattggggccggggcgcgctatatcggttcaacggtcagctactacaaaaatgacaccagcaccggtaagaaaaatgatgcctttagtgtggccggttatgcgctgatggatgcgacggtgaaatacgatctggcgcgctttggcctgccgggatcgtcggtcggcgtcaacgtcaacaacctgttcgaccgcgaatatgtctccagttgctacagcgaatacgcctgctactggggcgccggacgtcaggtcgtcgccaccgccaccttccgtttctaa

SEQ ID NO: 5109 - DNA, 1479 bp, Klebsiella pneumoniae
agaatgaatacacaagatttggcaaaactgcgttccatagtgcccgagatgcgtcgcgttcggcacattcactttgtcggcatcggcggtgccggtatgggcggtattgccgaagtgttggctaacgaaggttaccagatcagcggctccgacctggcgccgaatccggtgacccagcagctgtcgcagcttggcgccaccatttatttcaaccatcgcccggaaaacgtgcgtgatgccagcgtggttgtcgtttcaagcgcgatttcggcagataacccggaaatcgttgccgcgcatgaggcgcgtatcccggtgatccgtcgtgccgaaatgctggcggaacttatgcgctttcgccacgggatcgccattgccgggacccacggcaaaaccaccaccaccgcgatggtatccagcatttacgccgaggccgggctggacccgaccttcgtcaacggcggactggtaaaagcggcgggcgtacatgcccgtcttggccatagccgttacctgatcgcggaagcggatgagagcgacgcgtcgtttctgcatctgcagccgatggtggccattgtcaccaacatcgaagccgatcacatggatacctaccatggcgactttgagaatctgaagcagacctttatcaacttcctgcacaacctgccgttctacggacgcgcggtgatgtgcgtggacgatccggtgatccgggaattgctgccgcgcgttggccggcagatcactacctacggttttagcgacgacgccgacgtgcgcgtcgaggactatcgtcaggttggggcgcaggggcatttccgcctggtacgccaggataaagcgatcctgcaggtgacgctcaatgccccgggacgccataacgcgctgaacgcggcggcggccgtcgccgtggcgacggaagaggggattgacgatcgggctattctgcgcgcactggagagcttccagggaactggacgccgctttgattttcttggcgagtttccgctggccgaagtcaacggcaaaccgggcagcgcgatgctgatcgatgattacggtcaccacccgacggaagtggacgccaccattaaagcagcgcgcgccggctggccggataaaaacctggtgatggtattccagccgcaccgttatacccgtacccgcgatctgtatgatgattttgccaacgtgctgacccaggtggatgccctgctgatgctggacgtctatccggcgggcgaagcgccgatccccggcgccgacagccgctcgctgtgccgtaccattcgcggtcgcgggaaagtggatccgatcctggtgcccgattcggcccaggccgcggagatgctggcgtcagtcctgaccggtaacgatttagtactggtgcagggcgccggtaacatcggtaaaatcgcccgccacctggctgaaatcaaactgatcccgcaaaaagcggaggaggagcgccatggctga

SEQ ID NO: 5110 - DNA, 972 bp, Klebsiella pneumoniae
tacaggaatactatgagtctgaatttcctagattttgaacagccgattgcagagctggaagcgaaaatcgattccctgactgcggtaagccgtcaggatgagaaactggatattaacatcgacgaagaagtgcatcgtctgcgtgagaaaagcgtagagctgacgcgcaaaatcttcgccgatctcggtgcatggcaggttgcgcaactggcgcgccacccgcgccgtccttacaccctggattatgtccgcctggcgttcgacgaatttgacgaactggccggtgaccgcgccttcgctgacgataaagcgattgtcggcggtatcgcgcgtcttgacggtcgtcctgtgatgatcatcggccaccagaaaggtcgtgaaaccaaagagaagattcgccgcaactttgggatgccggcgccggaaggctaccgcaaagcgctacgcctgatggagatggctgagcggtttaaaatgccgatcatcacctttatcgacaccccgggcgcctacccgggcgtcggcgcggaagagcgtggccagtcggaagcgatcgcccgcaacctgcgtgagatgtcgcgtctgagcgtgccggttatctgcaccgtaatcggtgaaggcggctccggcggcgcgctggcgatcggcgtgggcgacaaggtcaacatgcttcagtacagcacctattcggtcatttcgccggaaggctgcgcctccattctgtggaagagcgcggataaagcgccgctggctgcggaagcgatgggcattatcgccccgcgtctgaaagagctgaagctgatcgattctatcgttccggaaccgctgggcggcgctcaccgcaacccggaagcgatggcggcaagcctgaaggcgcagctgctggcagacctggcagacctcgatctgctcagcgaagaagagctgctgaaccgccgttatcagcgtctgatgagctacggttacgcttaa

SEQ ID NO: 5111 - DNA, 2679 bp, Klebsiella pneumoniae
ataaggaatacccccatgtcagaacgtttacacaatgacgtggatccgatcgaaactcgcgactggctacaggcgatcgaatcggtcatccgtgaagaaggtgttgagcgcgctcagtatctgattgaccaactcctttctgaagcccgtaaaggcggagtgaaggttgctgcaggcgcttccgccggcaactacgtcaacactattgccgttgaagatgagccggaatacccgggcaatctggatctggaacgtcgcattcgttctgcgattcgctggaacgccatcatgaccgttctgcgcgcgtcgaaaaaagatctcgaactgggcggccacatggcgtcctatcagtcttccgcgaccttctacgaagtctgcttcaaccacttcttccgtgcgcgcactgagaaagatggcggcgatctggtgtacttccagggtcacatctctccgggcgtatatgcacgtgcgttcctggaaggccgtctgaccgaagagcagatggacaacttccgccaggaagttcacggcaagggtctgtcctcttatccgcacccgaaactgatgccggaattctggcagttcccgaccgtatccatggggctggggccgttgggcgctatctatcaggccaaattcctgaaatatctggaacaccgcggtctgaaagacacctccgaacaaaccgtttacgccttcctgggcgacggcgagatggatgagccggaatcaaaaggcgctatcaccatcgccacccgtgaaaaactggacaacctggtcttcgtcatcaactgcaacctgcagcgtctggacggcccggtcaccggtaacggcaaaatcattaacgaactggaaggcatcttcggtggtgctggctggaacgttatcaaggttatctggggcggccgttgggatgagctgctgcgtaaagacaccagcggtaagctgattcagctgatgaacgaaaccgttgacggcgactaccagaccttcaaatccaaagacggcgcttacgttcgtgagcacttcttcggcaaatatccggaaaccgctgccctggtcgctgactggactgacgagcagatctgggctctgaaccgcggtggtcacgatccgaagaaagtctacgctgcattgaagaaagcgcaggagaccaaaggtcagccgaccgtgatcctggcgcataccattaaaggttatggtatgggcgataccgctgaaggtaagaacatcgcgcaccaggttaagaaaatgaacatggacggtgttcgctacgtccgcgatcgtttcaatgtgccggtggcggatgccgatctcgaaaaactgccgtacgtaaccttcccggaaggttccgaagagcacacttacctgcacgctcagcgtcagaagctgaacggctatctgccgactcgtcagccgaagttcactgagaaactcgagctgccgaccctggccgacttcagcgcgctgctggaagagcaaaacaaagaaatctctaccactatcgctttcgttcgcgccctgaacgtgatgctgaagaacaagtcgatcaaagatcgtctggtgccgatcatcgccgacgaagcgcgtaccttcggtatggaaggtctgttccgtcagatcggtatttacagcccgaacggccagcagtataccccgcaggaccgtgagcaggttgcttactacaaagaagacgagaaaggccagattctgcaggaagggatcaacgagctgggcgcaggcgcatcctggctggctgctgcgacctcttacagcaccaacaacctgccgatgatcccgttctatatctactactcgatgttcggcttccagcgtatcggcgatctgtgctgggcggctggcgatcagcaggctcgcggcttcctgattggcgggacttccggtcgtactaccctgaacggcgaaggtctgcagcacgaagatggtcacagccacattcagtcgctgactatcccgaactgtatctcttacgacccggcgtacgcctatgaagtggctgtcatcatgcatgatggtctggtccgtatgtacggcgaagcgcaagagaacgtttactactacatcactacgctgaacgaaaactaccacatgccggccatgccggaaggcgccgaggaaggtatccgtaaaggtatctacaaactcgaaaccatcgaaggtagcaaaggtaaagttcagctgctgggctccggttctatcctgcgtcacgtgcgtgaagcagcgcagatcctggcgaaagactacggcgtgggttccgacgtgtatagcgttacctccttcaccgaactggcgcgtgatggccaggattgcgaacgctggaacatgctgcacccgctggaaaccccgcgcgtgccgtatatcgctcaggtaatgaacgacgctccggcagtggcatccactgactatatgaaactgttcgctgagcaggttcgtacttacgtaccggctgatgattaccgcgtactgggtaccgatggcttcggtcgttccgacagccgtgaaaacctgcgtcaccacttcgaagtcgatgcttcctatgtggtcgtagcagcgctgggcgaactggctaaacgtggtgaaatcgataagaaagtggtggctgacgctatcgcgaaattcgacatcgatgcagaaaaagttaacccgcgtctggcgtaa

SEQ ID NO: 5112 - DNA, 1341 bp, Klebsiella pneumoniae
tgcggctggtttacaacatcatccgcatttgcggttaatcgaaatggaaaaagtatgaagaactggaaaacgctgcttctcggtatcgccatgatcgcgaataccagtttcgctgccccccaggtggtcgataaagtagcggccgtcgtcaataatggcgtcgtgctggaaagcgacgtcgatggtttgatgcaatcggttaagctcaatgctggtcaggctggccaacagctgccggatgacgccaccctgcgccatcaaatcctcgaaagactgatcatggaccagatcgtgttacagatggggcagaagatgggcgtgaagatctctgacgaccagctcgatcaggctatcgccaacatcgccaaacaaaataatatgaccttggatcagatgcgcagccgtctggcctatgaaggcatcaactacaacacctaccgtaaccagatccgtaaagagatgctgatttcggaagtgcgtaacaatgaagtgcgtcgtcgcatcaccgtgctgccgcaggaagtggaagcgctggcgaaacagatcggcgaccagaacgacgccagcaccgagctcaacctgagccacatcctgatcccgctgccggagaacccgacctctgatgaagtcgccgcggcccaggagcaagcaaactccatcgttgagcaggcgcgcaacggcgccaacttcggcaaactggcgatcacctactccgctgaccaacaggcgctgaagggtggccagatgggctggggccgtatccaggagctgccgggcattttcgctcaggcgttaagcaccgcgaagaaaggggatatcgtcggtccgattcgttccggcgttggtttccacattctgaaagtcaacgacctgcgcggtggtacccagaatatctccgttaccgaggttcacgcccgtcatattctgctgaaaccgtcgccgatcatgaacgacgcccaggctcaggctaagctggaacagatcgcagccgagattaagagcgggaaaatcacgtttgctcaagcggcgaaaacctattcggaagatccgggttcggcaaaccagggcggtgatttaggctgggccacgccggacatctttgacccggcgttccgcgatgcgctgatgcgtctgaacaaagggcagaccagcggaccggtgcactcttcctttggctggcatctgatcgaactgctggatagccgtcaggtcgacagaaccgacgccgcgcagaaagatcgtgcttaccgcatgctgatgaaccgcaaattctctgaagaagcggcaacctggatgcaggaacagcgcgccagtgcgtatgttaaaattctgagcaactaa

SEQ ID NO: 5113 - DNA, 909 bp, Klebsiella pneumoniae
aaggctaacacccacctcagggccctgaacggatgtcagggccttttttttacaaggacagtaccaatgactgcacatctcctccgcagcggactgcttacttttgccctgctcctgcttaccgcctgtaccctggacgttggccgcagctcgccttccacatctgctgccgatgaccattcatcatcctgggctgttaccctccagcgtcaaagctcgattgccggcagcggactgcgcgaaatcgccgaaagcgacctgcgctccggcgacctgctgttctcctccagcctgggcgtcacatcgcttgggatccgcgccttcagcgcctcttccgtaagccacgtcgcgctgtatgttggcgaaggtcaggttgcggaagccaccggtgccggcgtacaagtgattacccttcagcaggcgctggcgcacagcgataaactctttgctctcagggtgcctgacctgacgccggaccaggcaacgacgatgaaaagttttgcctggcaggtcaaagacagcgggtataactatcgcggcattattcagtttatcccttatatggtcaccaaaccgctctgctcgctcaaccccttctcacgagactttcgccagcagtgcgtcagtggcctggccaaagcgcagctgggcgatgcggcaagcggcgacaagaaagcgtggttttgctcggagtttgtcagcgaggcctttgtccgagccgggcatccgctgacgctcgcgcaggcggcgtggatcagtccttccgatctgctgcacatgcgggaaggagacgtcgccacgtttaaacccgaaacgcagctccagtatgtcgggcatttgaaactgggagtttatcttcaggccggtaagctggtggggctgaacaaaccgaaggacggtgcggagtaa

SEQ ID NO: 5114 - DNA, 1224 bp, Klebsiella pneumoniae
tgcaaatgcacaatgcagcgcgacgatgactcttttatgctggtgcccagcaaaggggaggactacatggctggctggcatcttgataccaaaatggcgcaggatattgtggcgcggaccatgcgcatcatcgataccaatatcaacgtgatggatgcccgcgggcggatcatcggcagcggcgatcgggaaaggattggtgaattgcacgaaggcgcgctgctggtcctctcccaggggcgggtggtggatatcgacgacgcggtcgctcgccatctgcacggggttcgccaggggattaacctgccgctgcgcctggagggggagatcgtcggggtgatcggcctgaccggcgagccggagtcgctgcgaaaatatggcgagctggtgtgcatgacagcagagatgatgctggagcagtcgcggctgatgcatcttctggcccaggacagccgtctgcgcgaagagctggtgatgaacctgattcaggcggaagagcataccccggcgctgaacgaatgggctcagcgtttaggcatcgatctcaatcagccgcgcgtggtggcgatgattgaggtagacagcggtcagctcggcgtggacagcgcgatggcggaactgcaacagttacagaacgcgctgaccacccccgatcgcaataatctggtggccattgtctcgctcacggaaatggtggtgctgaaaccggcgctgaacagctttggccgctgggacgctgacgatcacgtccggcgcgtcgagcagcttatcgccaggatgaaagagaatggccagctgcgctttcgcgtggcgctgggcaacttcttcaccggcccaggaagtatcgcccgctcttaccgtaccgcacggacgacgatgatggttggcaagcagcggatgccggagagccgcagttatttctatcaggatctgatgctgccggtgctgctcgacagcctgcgcggcggctggcaggccaatgagctggcccgtccgctggcgcgtttgaaggccatggacaacaacgggctgctgcggcggacgctgcaggcgtggtttcgccataacgtgcagccgctggcgacgtcaaaggcgctgtttattcatcgcaatacgctggagtaccggttgaaccgtatctcggagctgaccggcctggatctcggtagctttgacgacaggctgctgctgtatatcgcgctgcagctggacgaacaacgctaa

SEQ ID NO: 5115 - DNA, 660 bp, Klebsiella pneumoniae
tcatccggcacaacggatgttcagtgggaatcaacgatgcttgtctattggctggatattattggcacagctgtcttcgcgatctccggcgtactgctggccggaaaactgcgtatggacccattcggcgtgctggtgttaggggtagtgacggcggtaggcggcgggaccatccgcgacatggcgctggcgaatggcccggtattctgggtcaaagatcccaccgatctggtggtggcgatggtcaccagcatgctgaccatcctgctggtccgccagcctcgccggctgccgaaatggatcctgcccgttcttgatgccgtcggtctggcggtgtttgtcggcattggcgtcaataaagcttttctcgctggcagcggcccgctggtcgcggtgtgcatgggggtggtgaccggcgtcggcggcgggattattcgcgacgtgctggcgcgggaaattcctatgattctgcgtaccgaaatctacgccaccgcctgtatcgtcggcggtattgtccacgccacggcacacgacacctttcatctcccgctggagaattcggcaatgatggggatggtggtcaccctggtaattcgtctggcggctattcgctggcatctgaagctgccgacgtttgccctggacgataacggtcggtaa

SEQ ID NO: 5116 - DNA, 975 bp, Klebsiella pneumoniae
ataataaggtttaagcccttattagtaccgtgtatgaataggggcccattatcggccccttttttcaatttacgctgtttggccgttggccgggcagtatccacatctcccgaggattttagaatggctgaaattaccgcttccctggtaaaagagctgcgcgaacgtactggcgcaggcatgatggattgcaaaaaagcgctgactgaagcgaatggcgacatcgagctggcaatcgaaaacatgcgtaaatccggcgcgatcaaagcggcgaagaaagcaggcaacgtggctgctgacggcgtgatcaaaaccaaaatcgaaggcaactacggctacattctggaagttaactgccagactgacttcgttgctaaagatggtggtttccaggcatttgccgacaaagtactggacgccgctgttgcaggtaaaatctccgacgttgaagttctgaaagcgcagttcgaagaagaacgtgttgcgctggttgctaaaatcggcgagaacatcaacatccgtcgtatcgctgttctggaaggcgacgttctgggcagctaccagcacggtgcgcgtatcggcgttctggttgccgctaaaggcgctgacgaagagctggttaagcagctggcaatgcacgttgctgcaagcaagccggaattcgttaagccggaagacgtgtctgctgaagtggtagagaaagagtaccaggttcagctggacatcgcgatgcagtccggtaagccgaaagaaatcgcagagaaaatggttgaaggccgcatgaagaaattcaccggcgaagtttctctgactggtcagcctttcgttatggagccgagcaaatctgttggccagctgctgaaagagcacaacgctgacgtgactggcttcatccgctttgaagtgggcgaaggcattgagaaagttgagactgactttgcagcagaagttgctgcgatgtccaagcagtcttaa

SEQ ID NO: 5117 - DNA, 369 bp, Klebsiella pneumoniae
aatcgatcaacacggctaaataatcttttaatgccgccaggcttgttttggacccgggaacgcccggttttgccggggcccggcagcttcgccggcgttctgtgtccaccaaggcttgaacccttttgtgcttcaagtgccggggcccagcggccaaagccttttcattctgtaatggcagacctggaattaaacttgggcgttccaattcaggcccgtccggtcccgtgggaagggccaaccgcggtatttgtggcattatggcctaagcttatcttttttttgggtaacaattaccgtaaaattggttttcaagaaataatccaacccgttaaagtggggccgttacttaaaaaaacccccgtttaa

SEQ ID NO: 5118 - DNA, 1641 bp, Klebsiella pneumoniae
cgagatgggttactttttgggtcaggagtttccatgtcactgccgttcaaaccccatattatcgccctgctctgtagcgctggcttactcgcggcggcaggaacactctatgtgcaaagccgaaccccagcgacgatcgctgaaccgcctgcgcagcaagctccagcgcccgcagcgtcgacgacacagccggtggccgccacttacacccaggcgcaaattgatcagtgggtcgcccctatagcgctctacccggacagcctactgtcgcaggtgttgatggcctccacttatcccgacaacgtcctgcaggcggtccagtggtcccaggataaccccgcgatgaaaggggatgcggccgtgcaggcggttgccagccagccgtgggaccctagcgtcaaatctcttgtcgctttccctgccctgctggcgatgatgggcgagaatccgccctgggtggaaaatcttggcaatgcgtttttggcccagccgcatgatgtgatggattcagtgcagcgtctgcgcgccattgcccaacagaccgggacgctgaaatccacaccgcagcagaaagtgattgtcacccctgccgcaccggtttcagccagcagcagcacgacagcaaccgcaaccgcccacacaggagcgcctgcgcccacgcaggtcattaaaatagagccgaccaatccacaggtggtctatgttcccagctataacccctccaccgtctatggtacctggccgaacagcgcctatccgccggtctatctgccgccccctcccggggagcaatttaccgatagcttcgtcaaaggcttcgggtacagcctcggcgtggccaccacctgggcgctgttcagcagtatcgactgggatgatgatgaccatcaccatcacgatgacgactaccaccacggcgattactcgcataatggcgataacatcaatattaatgtaaataatttcaatcatataacaggagaaaacctgccgggaaaccacgttaactggcagcacaatcctgcctatcgcggacacacaccgtatcccgataatacggtagctcagcgcttccatcagaccaacgtttccggcggactgagcgcgacccaacatgcgccagtcgatcgggaagcgcagcgccaggcagcgatgacccagctgcagcataacgtaccgacggccacagcgggcaacctggcggcaaacaacacctcacgcgacgcccagcgtcaggcggcctcagcgcagctgaagcaagccacccaacgcagtaattaccgcggttacgacagtacgccgacccaacagcagcgtcgcgaggcggcaaaaacgcagctgaaaaaccccacgccgcagcaacagcagcgtcgagaagccgccaggagccacgagcagaaccgcacacctcagcagcagcagcgccggcagcagttccagtccgccacgccagcccagcgtcagcagacgctcagccatctgcgcgccaacgcccttagcggcaacgaaagccgcgccccctcctggcaagcgcagcaggaacgaggactgcagagccgccagttttccggcgtaaaccgcgagttacgcgatggcaccagagaacgtctttccgaacaccatgaactgcgtcgccgctaa

SEQ ID NO: 5119 - DNA, 1614 bp, Klebsiella pneumoniae
cgcatggcaacgcgccgtcagccgctaaaccttcgcgggctgatgccgggcctgttcgccgctacgctgctgtgcgctgtcgcgctggcggcgtttctggcgctgtggtttagcgcccccggcgcgggctggcaatcggtcttcagcgatagctacctgtggcatgtggtccgcttctccttctggcaggcgtcgctgtcagcgctgatctcggtgggaccagccatctttctcgcccgcgcgctttatcggcgtcgcttcccgggccgtacgctgctgctgcgcctgtgcgcgatgaccctgatcctgccggtgctggtggcggtgttcggtatcctcagcgtctatggccgccagggctggctagcctcactatttcacgcgctcggctggcaatgggagttctcgccctacggtctgcagggcatcctgctggcgcacgtctttttcaatatgccgatggcgacccgcctgctgctgcaggcgctggagaacattcccggcgagcagcggcaaattgccgcccagcttggcatgcgcggctatgccttcttccgcctcgtcgaatggccgtggctgcgccggcacattcccgccgtcgccgcgctgatttttatgctctgcttcgccagcttcgccaccgtgctctcgctgggcggcggcccgaaagccaccacgatcgagctggctatctaccaggcgctgagctttgactacgatccggcgcgagcggcaatgctggcgctgatccagatgctctgctgccttgggctggtgctgcttagccagcgtctgagtaaagccgtcgccatcggcgtcagccatgtgcgcggctggcgcgaccctgacgatcgcctgcatagccgcctgagcgacgggttgctgatcggcgccgccctgctgctgctgctcccgccgctgctggcggtcatcgtcgacgggatcaaccgtaatatgctggacgtgctggcgcagccagcgctctggcaggcattgagcacctctctacgcatcgccatcgccgccgggctattgagcgtgaccctgacgatgatgctgttatggagcagccgggagctgcgctctcgccagcggccgttggccgggcaggcaatggagctgagcggcatgctgatccttgcgatgccgggaattgtgctggcgaccggcttcttcctgctgctcaataacactatcggcctgccggagtccgccgacggcatcgtcatcttcactaatgccctgatggcgatcccctatgcgctgaaagtactggaaaacccgatgcgcgacattgccgcccgctacagcatgctgtgccagtcgctgggtattgaaggatttgcccggctgcgggtggtcgagcttcgcgctctccggcgcccgctggcccaggcgctcgccttcgcctgcgtactgtcgattggcgatttcggcgtggtggcgctgttcggcaacgaggcgttccgcaccctgcctttctatctgtaccagcagataggcgcctaccgcagccaggacggggccgtcaccgccctgctcctgctgctactctgtttcttgttgtttacgctgattgaaaaacttccggggcgtgatgctaaaactcaatga

SEQ ID NO: 5120 - DNA, 1389 bp, Klebsiella pneumoniae
tgcatgaaaacagaacagctgatccccctctgccgtcgctaccacgccatgctgctgcatagcgatgaacagacaatctctattgcggtggttaataccccgccggcggagttgatggaggcgctacgcttcgcgacgcaaaagcggatcgacattgaatgctggagccaggagcagatggataagcgtctgcaggcccaggaaaagcaggcgcaactggcgcagaacgacgggccggaaaatatcgccgaacgggtcaaccagatcctcgaacaggccctgcgtcagcgggcgtctgatattcatatcgagcccacggaaacgcacttacgcatccgcctgcgggtcgatggcgtccttcacgccctaccgttgctggctcccgaactggccgcaccggttatcgcgcgactcaaggtcctggccagtctcgatatcgccgagcaccgtttaccgcaggatggccagttcgcgctgaatcttgcgggacgaccgctctcttttcgcatcgccactctgccctgccgctatggcgaaaagattgtcctgcgccttctgcatcaggttgaccaggcgctggatctggaagcactcggactctcatcctcccagctggcggcctttcgccaggcgctgaaccagccgcagggtctgctgctggtcaccggcccaaccggaagcgggaaaacggtgaccctctacagcgccctgcaggccagaaaccgtgagcaagtgaatatctgtagcgtggaggatccactggagatccccatcgccgggatgaaccagacgcaaatcaatccccgcgccggactcacttttcacagtgtgctgcgcgccctgttacgccaggatccggatattgtcatggtgggcgagatccgcgatgccgagaccgctgaaatcgcgctcaaagccgcccagaccggtcatctggtgctctccaccctgcacaccaattccaccagcgaaaccctgacccgcctgcagcaaatgggcatcgcccgctggatgatttcctctgcgctctcgctggtcatcgcccagcgtctggtccgcaagctgtgtccccactgtcggcgtaatgccggcagcgccgccgacctgccgcacagcctgtggccccgcccgctgccacgctggcaggcagcgggctgcgaacattgttaccacggatattacggccggctggcgctgttcgaagtgctgcctgttacccccgggctacgccaggggatagtccagggacttaacgccattgagattgaatctctggcgcgagccgcagggatgatgacgctttttgaaagcggctgtcaggctatcgaacagggattgaccagcctcgaagaggtggtgcgggtgctggggatcccccatggcgactaa

SEQ ID NO: 5121 - DNA, 234 bp, Klebsiella pneumoniae
acggcagtgacatggaaactcctgacccaaaaagtaacccatctcgctaaagtatctgcgaaaaaggcgcgtttgctgagtataagtaagcggtatggctttttattgattattgttgggatcggcccgtggcgttgtacgcggaaaggaatttttgtcgcgggatttgaacagaaagcctgcaatatcctgcccttaacgattcagctaaattttaatgttgcttttttgtaa

SEQ ID NO: 5122 - DNA, 927 bp, Klebsiella pneumoniae
tcgatatcgacggcgcgccgttccgtattgagatccctgttttccgtctcgcagttccaacgctcattcattaaaacaatgtcaacataccttattggcgacgttcacggttgctacgatgaactgatcgcattattagcgcaggttgaattcgatccgcggagagatacgctgtggctgaccggcgatctggtggcccgaggcccgggatcgctggaggtcctgcgctatgtcaaatctctgggcgacagcgttcgactggtgctgggcaaccatgacttacacctgctggcggtctttgccggtatcagccgcaacaagccaaaggatcgtctgaaaccactgctggaagcgccggatgccgatgagctgctcaactggctgcgtcgccagccgctgctgcaggtggatgaagagaaaaagctggtgatggcccatgccggcattacgccgcagtgggatctggagaccgcccagcagtgcgcgcgtgatgttgaagcagtgctctccagcgactcctatcctttcttcctcgatgccatgtacggcgacatgccgaaccactggagcaacgagctgagcggcctggcgcgcctgcgctttatctctaacgcctttacccgcatgcgctactgtttcccgaacggccagctggatatgtattcgaaggaagcgcccgaggacgccccggcgccgctgaagccgtggtttgccattcccggcccggtcagcaatgcctacagcattgcctttggccactgggcttcgctggagggacgcggcacgccggaggggatttacgccctggataccggctgctgctggggcggggaactcacctgcctgcgctgggaagataagcagtacttcacccagccgtcaaaccggcagaaaagcctcgacgaaggcgaagccgtcgcgtcctga

SEQ ID NO: 5123 - DNA, 1311 bp, Klebsiella pneumoniae
ccagcgacgacagagcggcgccagcgccagcagcgccagcattaccgcgccgctacgcactaccctctccggcgtcgcactatatgtcgaccccgagatccacgtcaggatctgcgccatacgcggatcgccgctggcctgcagcatcatcagcagcatagtgaaggcggtgctcagcgccatccccgccagcagcatccgatgcggcgagaagccgccgcgcccggcggcgagcataatgatcagcaaggtggccgccgcgccaaggctgccggccggcagcagccagccaaaggcgtcgccaggcacgaagaacagcatcagcaccacgccaaaagccgcgccggagctgatgcccagcacttccgggctggccatcgggttgccggtcaggcgctggataatacagccggcgaccgccagcatgaccccggcgaacagggccgacagcacccgcggccagcgccagggcaggagttgctccagcagatcgccgtgggcccacagccagccgtgggcatcgcgaccaaaggccagcgccacgctcaccgccagcagcagcaacgcgacgcctgcgagaacaaaccattgcacataatagcgctcaggctgcacattatcgccgccgttcatcaccggggcgctgatgctgcgcaaccgcggcagcagccacagcagcagcggcgcgccaatcagggcggtgaccgagccagtggagacttcccgccatacccggctcagccagaggatcacctgatcggaaagccacaggagcagcgcgccgatcagcgccgccagcagcagccgcgccagcagccgacgggcgccaagcattttcgccagcagcggcgcgaacaggccgataaagccgataatccctaccgcgttcaccagcagcgcgctgatgacgatcgccagcgtcagggcgccgaggcgcgccagggacagcgccagcccgaggttacgcgccaccccgtcatcgagccccatcagggtcagcggccgcagcagcagcaaggtgagtattgccccgccaagcagctgcggccacaggcgctgcgccacgctccagtcggtctgcgtcagcgtcccggtgctccacaggaacatgctttgcagctggtcgtgatggaaaatcaccatcagctggttaagcgcgccacagtaaaggctgaccaccagccccgccaggatcagcgttaccggcgacaggcgcttgccccacgagacgccaaacaccagcgcgcccaccaggctggccccggccagcgcggcgaattgcgacgccagcacgccgggaatagcccataa

SEQ ID NO: 5124 - DNA, 621 bp, Klebsiella pneumoniae
agtaaggagaccatcatggcagagaaatttacccaacataccggcctggtggttccgctggatgctgcaaacgtcgataccgacgcgatcatccctaagcaatttttgcagaaggtcacccgcaccggctttggcgcgcacctgtttaacgactggcgctttctcgacgataaaggtcaacagccgaacccggagttcgtgctgaattttcctgagtaccagggggcatcgatactgctggcgcgggaaaacttcggctgcggctcctcgcgcgagcacgcgccgtgggcgctgaccgattacggctttaaggtcgttatcgccccgagctttgccgatatcttttacggcaacagcttcaataaccagctgctgccggtgaccctgagcgacgagcaggtcgatgagctgttcaagctggtgcaggccaacccgggcattacgtttgaagtggatctggaagcgcaagtggttaaagccggggataaaacctacagctttaggatcgacgatttccgccgccactgcatgctcaacggcctggatagcatcggcctgacgctgcaacatgaagcggcgatctccgactatgaacgcaagctgccggcgtttatgaattaa

SEQ ID NO: 5125 - DNA, 1734 bp, Klebsiella pneumoniae
atgatttctgcatggagtaacaagatggcaattgcgattggcctcgactttggtagtgactcagtccgcgctctggcggtggaatgcgcgtccggcgcagagctggcgaccagcgtggagtggtatccgcgctggcgggaaggacagtattgcgatggcgctaacaaccgcttccgccatcacccgcgagattacatcgagtccatggaagcggcgctgaaaagcgtgctcgcttcgctgagcgccgaacagcgcgccgacgtcgtgggcattggcgtcgacagcaccggctcaactccggctcccgtcgatgccgagggcaacgtgctggcgctgcgcgaagaattcgctgacaaccctaacgccatgtttgtcctgtggaaggatcacaccgcggtcgaggaagccgaggcgatcacccgcctgtgtcatcagccgggcaaagaggattactcgcgctatatcggcgggatctactccagcgaatggttctgggccaaaatccttcacgtcacccgcgaagatagcgcagtcgcccaggcagccgcctcgtgggtagagctttgcgactgggtgcccgccctgctctccggtactacgcgtccgcaggatctgcgccgcggccgctgcagcgccggacataaatcgctgtggcatgagagctggggcggtctgccgccggccagcttcttcgatgagcttgatcccatcatcaaccagcatctggcctggccgctgttcaccgatacctggacggccgatgtgccggtcggcacgctgagcgcagagtgggcccagcgcctgggtctgccgcagagtgtggccatctctggcggcgccttcgactgccacatgggcgccgttggcgccggcgcgcagcctaacgcgctggtgaaagtcatcggcacctccacctgcgacattctgatcgccgataaagagagcgtcggcgagcgcacggtcaaaggcatctgcggccaggtcgacggcagcgtggttccacactttatcggcatggaggcaggccagtccgccttcggcgatatttacgcctggtttggccgcattctcggctggccgctggagcagctggctcagcagcagccggcgttgcgcgagcaaatcaaagccagccaaaaacagttactgccggcgctcaccgaagcctgggccaacaatccatcgctggagcatctgccggtggtgctcgactggttcaacggccgccgcacgccgaatgccaaccagcgcctgaaaggggtgatcaccgaccttaacctggccaccgacgcgccggcgctgttcggcggtctgatcgccgccaccgccttcggcgctcgcgccattatggagtgcttcaccgagcaggggatcccggttaacaacgtcatggcgcttggcggtatcgcgcggaaaaaccaggtcatcatgcaggcctgctgcgacgtgctgaaccgaccgctgcagattgtcgcctccgatcagtgctgcgcgctgggggcggctatcttcgccgccgtcgccgccggcgtctatgaggatattccagccgcccaacagcggatggcaagccaggtggaaactaccctgcagccgcgtccggcgcaggcacagcgtttcgaacaactctatcagcgctaccagcaatggtcggtcagcgcggaacaacactatctcccttcggctgcaaaggcggaaaaagccccgcaatctcaggcagcgctcacctattaa

SEQ ID NO: 5126 - DNA, 426 bp, Klebsiella pneumoniae
cctgctgctgctgcagcagacgcagcaccagattgcgtcgttcaagggccagtttcgggttacgccacgggttatagaccgacgcccctttcaccatccccaccagcagcgcctgctggtcgaggctcagctcttccaccggacggccgaagtaatacaggctggccagcgggaagccgcgaatttcgttatcgccgctctggccgaggtacacctcgttcatatacagctcaaggatgcgatccttgctgtagcgggcgtcgacgatcagcgccatatacgcttcgttggctttacgccagtaggagcgttcgctggagaggaacaggtttttcaccagctgttgggtcagggtactcgccccctgcaccgttcggcctgccgtcaggttcgccagcaccgcgcggccgatggagtagagactga

SEQ ID NO: 5127 - DNA, 399 bp, Klebsiella pneumoniae
ttcagtgctgcgtatcgcagagaggacgaacgcatgatcggcagagtgacagaggccttaagcaaggttaaagggtcgattggaagcaacgagcgccatgctttgcctggcgtgatcggggacgaccttctgcggtttgggaaactgccactctgcctgttcatttgcatcattattacggcgattaccgtggtcaccactgcgcatcacacgcgcctgttgaccgcgcagcgtgaacagctggttctggagcgcgacgccctggatattgagtggcgcaacctgatcctcgaagagaacgcgctcggcgatcacagtcgggttgagcggatcgcgaccgagaagttacagatgcaacacgtcgatccatcacaagaaaatatcgttgtacagaaataa

SEQ ID NO: 5128 - DNA, 1299 bp, Klebsiella pneumoniae
cgcttcgctgctggcctcgctggagacatggctgctgccgcagatgaacggcgttcattccctgcgggcgctgaaggcgctggatctgcgtcaggcgctacaggactggctgccatggccgctgcgccaaaagctggatcgcgagctgccgacgcactataccgtgccgaccggcagccgcctggcgatccgataccatgcggagaacccgccagcgctggcggtgcgtatgcaggagatgttcggcgaggccacgacgccggtgatcgccgaggggcaggtgccgctggtgctggagctgctgtcgcctgcccagcgtccgctgcagatcacccgcgatctgagcgccttctggcaagggagctaccgcgaggtgcagaaagagatgaagggacgctatccgaaacacgtctggccggacgatccggccaacgccgccccgacccgccgcagcaaaaaatactcgtagccgccgctgccgggcggcatcctgcccggccagtcggttcgcaaacgctagaccatctgctgccagagaaaaatactcccgccggccagcgccagccaggggccgaaggccagcggctgctgcagcgactgccgggtccacaggcgttgcagcagggtccacaccagcccgctggccgaagcgagcaacagcacctgcggcagaacctgccagccgcaccaggcgcccagcgccgccagcagcttaaaatcgccatagcccagcgcctctttcccggtcagcaggcggaacagccagtagaccgaccacagcgccagataaccggccatcgccccggcgaccgcatccggcagggcaatgtacacctcgttaagattgaacagcagcccggcccacagcaggggcagagtcaggcgatcgggcagcagctgggtccgggcgtcaatccgcgccagtatcagcaggaacgagagcagcaccaggccgcccgccagcggcaggcccggcgccagcaaagctccggcgaggataaacagcaggccggtggccagctcggtcagcggatagctccacgcgatgggcgcctgacagcagcgggcgcgacggcccagccagaggaaactgagcagcgggatattgtcccgccaggcgatcggctggcggcactgcgggcaggaagatcccggggtgctgagggttatccgctcgtcgtccgcggtctgggtcaacatgcgcggcagacgatagatcaccacattgtaaaagctgcccagcgccaggccgaacagcagcagaaagccataccagacaaagggaaagtgcagcgataa

SEQ ID NO: 5129 - DNA, 381 bp, Klebsiella pneumoniae
cgatctggtgctcggctcgcacatgctggaagtgtgcccgacgatcgccaccgccgagaaaccgatcctcgacgttcagccgctgggcatcggcggcaaagcggatccagcgcgcctgatcttcaatactcaaaccggcccggcgatcgtcgccagcctgatcgacctgggagaccgcttccgtctgctggtcaataccatcgaaaccgtcccaacgccgcacgatctgccgaagctgccggtggccaacgccctgtggaaagcgcagccggatctgcgtaccgcgtcggaagcctggatcatcgccggcggcgcgcaccataccgtcttcagccatgcgctgaacctcgacgatatgcgccagttctccgagctgcatga

SEQ ID NO: 5130 - DNA, 360 bp, Klebsiella pneumoniae
acttctttcgctgccgcggcagccgctggagcagcggcggccggagcggcttctttcttctcttcctgcgcaggtgcagcggcggctgcaccttcggcggaatcgaaaatcataatcagtttgccagtctcggttttgtcgccgacggagactttaatctctttcacgacgccagcctgcggagacgggacttccatagaggctttgtcgccttctacggtgatcagcgactgttcagcttctactttgtcgccaactttgaccaggatctcggtgatttcaacttcatcagccccgatgtccggtactttgatttcgatagccattattcttttacctcttacgccagacgcgggttaa

SEQ ID NO: 5131 - DNA, 201 bp, Klebsiella pneumoniae
cggtcatccgcctgcagccgcaggggaaaacgtctgcagatcacccttcagccctgcgctttccaggcgctgatcgactggctggacgctccggcgatgcgcggcgtcaacgcgatctcgctgtccgtgaccgggcagccgtcgcgacccggctgggtcacggtcaaccatctgctgctggagcgcgacgatgaaggctaa

SEQ ID NO: 5132 - DNA, 696 bp, Klebsiella pneumoniae
atctgctattttccgctacagaacgccgaaaatatctgcgttctgtatcctaaatgctccgcatttagcgttacaatcagcgcgcgatcggctatcgcaaccatcatcatgacagtccaggcgctgtcgtatttatcatatgtaggagaggaattaatgtcagtggatactcccgcccaggcgggcgtcagcatcgacgcattgctggcggcgaaagagcagcgtgcagcccgccaggccgactggttggcccattatcagcagcctgttatttccctgaccctggtgaccccgggggcggtgaaggacagcattcgctatcgcaatatgatgggcgttgccctccaggcctgcgatcagctgctgtggaagcaccgctggcaaacgctggatcgtcaggtgctatggctgccgaccgggccagaagcgctgtggtgcgtagcgcatccggccagcgaaatcaaagcgatgtgcagtacgctggagcagagccatccgctgggacgcctgtgggatatcgatgtaatctgtccgcagaacgggctggtgggacgccagtcgctgggcgaatcgcagcgccgctgcctgctgtgcgatgagccggcgcacgcctgtgcgcgcagccgtcgtcacgacaccgatctcgtcgtcgcccgcgttgagcagatgattgacgcgtggttcgcccgcgattaa

SEQ ID NO: 5133 - DNA, 189 bp, Klebsiella pneumoniae
cggcaatgcgctggccatgccgaccgcggcggtcagtttgaggaagtctcgacgttgcatattcacatccttttattctgcgggcgaatatttgagcttaaaccctaccgtaacgggaaggtcaagcagaagagtaagaataaagatcggcgctgtgtaaagaagtatgctaatttgaagcgtcggtga

SEQ ID NO: 5134 - DNA, 720 bp, Klebsiella pneumoniae
cgtctcggcgcaatgagcgcatttcagttcgcgcaaataggcgtcatccgttcgccgtataaagagaagtttgccgttcctcgccagccaggcctggtgaaacacggcggcggagaactccatctggtcgcgccctataaccaggccgacgccgtgcgtggcctggagagcttcagccatctgtggatcctgtttgtgtttcatcagacaatggaaggcggttggcgtccgacggtgcgacctccccgactgggcggcaatgcgcggatgggcgtcttcgccacccgttcaacgtttcgccctaatcccatcggcatgtcgctcgttgagctcaagggcattcgctgtcagaaagatcaggtaatactggaactcggcagcctcgatctcgtcgacgggacgccggtggttgatatcaaaccgtatcttcctttcgccgaagccctgccggacgccagcgccagctatgcacagcaggcgccgctggcgggtatgaacgtcagctttacgccggaaatagacgcacagttactcacgctggaaaaacgctacccacatatcaaagcgtttatccgcgaggtgctggcgcaggatccgcgtccggcctaccgaaaagaggaacaagcgggaaaaacgtatgccgtctggctgctggatttcaacgtccgctggcgggtgactgcctccggttttgaagtctttgccctcgaagcgcgctaa

SEQ ID NO: 5135 - DNA, 1548 bp, Klebsiella pneumoniae
ataatgggcgcagagcattgttatctgcttcacactttcccctccatagcttatttatccatatcgtcaacgagttcctgcaacgtatttctgccaaccgcagccaataattctctccatactgcaacggagagaccgcacatggcagagaacacgctttcaataagagaaaagattggttacgggatgggtgatgccggatgcaatattatctttggcgccatcatgctgtttgtgaactatttttacactgatatattcggactggcgccggcgctggtcggcgtacttctgctctcggtgcgagtcatcgatgcggtaaccgaccctatcatgggcgctcttgccgaccgcacccgtagtaaatatggtcgctttcgtccatggctgctgtggatcgccttcccctacgccctgttcagcgtcctgatgttcaccactcctgagtggacctacaatagcaaagtcatctatgcgtttgtgacctactttctgctgtcgattacctataccgcgattaatattccctactgctcgctgggaacggtgatgaccgccgatccgaaagagcgtgttgcctgccagtcttatcgtttcgtcatggtgggtatcgccacgctcctgctgtcattgacgctgctgccaatggccgactggttcggcggcgccgataaagcgaagggctaccagatggcgatgaccgtgctggcctttatcggtatgtgtatgttcctgttctgcttcgccaccgtgcgcgaacgtatccgcccggcggtgcagacgaatgacgaactgaaaaaagatctgaaagacgtctggaaaaatgaccagtgggtgcgcatcctgctgctcacgctgtgcaacgtctgtccgggctttatccgcatggccgccaccatgtactacgtcacctgggtgaatggacaaaagcaccattttgccaacctgtttacaaccctcggcgttattgggatgatgattggcagcatgctggcgaaagtcctgaccgaccgctggtgcaaactgcaggttttcttctggaccaatatcgtgctggccgtgttctcctgcgccttctatttctttaatccacacgccaccacgctgattatggtgctctacttcctgctcaacattctgcatcaaatcccttccccgctacactggtcgctaatgtccgacgttgatgactacggcgaatggaaaaccggcaagcgcatcaccggtatcagcttctccggtaatctgttcttcctgaaggtcggcctggcggtcgccggggcaatggtcggtttcctgctgtcatggtacggctacgacgccggcgcgaaagcgcaaagcgcctccgcgctgaacggtatcgtgctgctattctcagtcattcccggcgtcggctatctgatcaccgccggcgtggtgcgcctgctgaaggttgaccgtaccctgatgcgccagattcagagcgatctggagaagcgccgcagcaactacagcgagctgaacgaataccaggaactgaaaaccagtgaacacgtaaggaaagcctga

SEQ ID NO: 5136 - DNA, 2040 bp, Klebsiella pneumoniae
aagcaaacagccatgaacagagccgccacgctgaccctcaacgcgcccctgctgatgctcgtcgctgcgctggcgctttcaacccccttcaccgccggcgccgcgccggcctttcttgattacgcccaacagcaaacccagcaatctcaggcgcaagaaaaaaacgatgccgcaagcgcaaaacaaacacaagaaagccgccagagcgcagataataaaaaaaccggtaccagcacctcacaattacaaaaaagaatcaccagccagcaggcggcgattgcacaaaaagataagcttatacagcaattaaaaaaacagcttgccgctacgccgcaaacggatactgccggagcgaatgagcaagcggcgttgaataagagaattaatgaattacaggtcgccttaagcgccgctactgcagaaaaagaggcattaataaaaaaagcaggcgttgtgcagaataataatctacagcaaagccaggccgcggcgcgtcagcagatccagcaattaacgacgcagattcagcaagccgtagctgaaaataaacgcctcagcgccagctttaccacgcttaataaagataaacacgcgctaatgacccaactggccgctgcggaaaaagagaaacaggccgctcttgagcaggtcaaagcgcttaacgctgacaaacagccgctgatgacccggctggccgccgcggaaaaagagaaacaggccgtcctcgagcaggttaaggcccttaacgccgataaacagtcgctgactattcgcctcgccgctgcggagaaggcgcagcaggccgctcttgaccaggctaaagcgcttaacgctgacaaacagccgctgacgacccggctggccgccgcggaaaaagagaaacaggccgtcctcgagcaggttaaggcccttaacgccgataagcagtcgctgactattcgcctcgccgctgcggagaaggcgcagcaggccgctcttgaccaggctaaagcgcttaacgctgacaaacagccgctggcgacccggctggccgccgcggaaaaagagaaacaggccgccctcgagcaggttaaggcccttaacgccgataagcagtcgctgactattcgcctcgccgctgcggaaaagacgcagcaggctgccctcgatcaggtcaaagcccttaacgccgataaacaatctctgtccacccggctggccgccgcggataaagtgccgcatggccccgctaacgacgccgctgcgccaaaaaatgagccaccagagatggcggccatagtggcagcctatcgcctgcaggcggataaagacaacgcccagctacggatgaaagaagatgaaatcgaactgctgagaacgcagctttctgtacagtccaaaacgcgcagcggcgagagcgccgctgccaaactcagcgcatcgggagaacagcaggcttatgcgatcggcgcctcgatgggaagcgaggcgctcaacgtccttaccacccgtcgcactcagggagttaccgtcgacgcaggcctggtgttgcagggcatcgaagatgcctttcgcggccagcttcgtctcggagagcaggaacgtaacaaggcgctgtttgatgtgtcacagcaggtttttcagaacctgaataaaatagagcagaaaaacatcagtgccggcaagaaatatcagcaggcgtttgcgcgcaaaaaagatgtggtctttaaagagggcgtctacagccgcgtcgattacccgggtaaaggaaaaataagcggtaatgacctggttaccgtggtgatcaaagagatgctgacggacgggacggtgatcaacgatatggaagcgaaagatcaggcgcttacgcaaaagctggatgcctatcccccggtgtttcgcgaaccgctgaagcgtctacagaaccacggctccgtgacgctcgtcgtcccgcctgaaaaggcctatggcagtaaaggattaccgccaaaaatcccgccaggcgccaccatggtttattccgtgcggatagtagatagccaacccgagcaggcaaaatag

SEQ ID NO: 5137 - DNA, 1404 bp, Klebsiella pneumoniae
caggtagaagcgggaagaaccggcatccccctgacgaccagcacggccgcgcagctggttatcgatacggcgagattcatgacgctcggtaccgatgatgtgcagaccgcctgcggccagtaccgcatcgtggcgtacctgccagtcggctttgattttctcaatctgctctggcgttgggttttccagcgcagcgacttccgcctgccagctaccgccgagcataatatcggtaccacgacccgccatgttggtggcgatggtcaccgcggaagggtagcccgcctgggcgacgatatccgcctcgctggcgtggaatttggcgttcaggacgttgtgcttgatgccggctttagtcagttcgcgggaaaccacttcagatttttcgatcgagatagtccccaccagcaccggctgaccggcagcggtacgagttttgatatcttcgataattgcctgaattttttccgcttcggtcatatagaccagatccgccatatctttacggatcatcggacggttggtcggtacaaccacggtgtccagcttatagatagagctaaattcaaaggcttcggtatcggctgtaccggtcatccccgccagcttctcgtacagacggaagtagttctggaaggtgatagaggccagagtctggttctcgttttggatctccacgccctctttggcctcaacggcctggtgcagaccatcggaccagcggcggccctgcatcgtgcggccagtgtgctcatcgacgatgataacttcgccatctttgacaatgtagtcaacgtcgcgggtgaacagcgcatgggcgcgcagcgcggcggtaacgtggtgcatcagcataatgttggttggagagtacagggactcaccttcatccataatgccttcttgtaccagcagctcttcaatcagcaccagaccacgttcggtcaggttaacctgacgcgctttttcatccaccgagaagtggccttcgccagtgaaagtatccgaatcctctttttcctggcggatcagatgcgggatgattttgtttaccttgcggtacatttcagagctgtcttccgccgggccggaaatgatcagcggcgtacgcgcctcatcgatcaggatggagtccacctcatccaccagcgcatagtgcagtttacgctgaacgcgctcttccgggctgaaggccatgttgtcgcgcaggtagtcgaagccgtattcgttgttggtgccataggtgatatcggcagcgtaagcttcacgcttcgccggcgccggcaggccggacatgttgatgccaactgtcatgcccagaaattcaaacagcgggcggttattttcggcgtcacgctgggccagatagtcgttgacggtcactacgtgaacgcctttgccggttag

SEQ ID NO: 5138 - DNA, 978 bp, Klebsiella pneumoniae
actgtcggagcgcctgcaggatttgtccttataaaaatgatggaaaattataaacatactacggtacttctggatgaagccgtcaacggcctcaatattcgtccagacggtatctatattgatggtacttttggccgcggtggtcactcgcgcctgatcctctcccggctgggtgcggaaggacgcttgctggccatcgatcgcgacccgcaggcgattgccgtcgcgcaaaccatcgatgacccccgcttttccatcgtacatggtcccttttcacaactcgctgagtacgtcggcgagcgcaatcttaccggtaagatcgacggcattctgctcgatctcggcgtctcttccccgcagcttgacgatgcggaacgcggcttttcctttatgcgtgacgggccgctggatatgcgcatggatccgacgcgcggtcagtccgcggccgaatggctgcagacggctgaagaagacgatatcgcctgggtgattaaaacctttggcgaagagcgtttcggcaaacgtatcgcccgcgcgatcgtcgaacgtaatcgcattcagccgatgacccgcaccaaagagctggcggaagtcatcgccgcggcgatgccggtaaaagataagcacaaacatcccgcgacccgtaccttccaggcggtgcgcatatgggtaaacagtgaactggaggagatagagcaggcgctaaaaagctcgctcagcgtgctggccccgggcgggcggctgtcgatcattagttttcattcgctggaagaccgcattgtgaagcgctttatgcgtgagcaaagccgcggtccgcaggttccggcgggaataccgatgaccgaagcgcagctcaaaaaactgggcggccgtgagttgcgagcactaggcaagttgatgccgggcgaagaagaggtggcagagaatccacgcgcccgtagttcagtgctgcgtatcgcagagaggacgaacgcatga

SEQ ID NO: 5139 - DNA, 645 bp, Klebsiella pneumoniae
ctttttatggctgaaacaaagtctcaacaatcaaggctcctggtgacgctgactgcgctatttgcagcgttctgcggcctctatctattaatcggcggggcatggctggtcgtgcttggcggctcctggtactaccctatcgccgggctggtgatgctgggcgtgaccgtaatgctgttccgcggcaagcgcgctgcgctgtggctgtacgccgcgctgctgctggcgaccatgatctggggcgtctgggaagttggtttcgacttctgggcgttgacgccgcgtagcgatatcctcgtcttctttggcatctggctgatcctgccctttgtctggcgtcgtctgccggtgccttccgctggcgccgttggcgcgctggtcgtcgccctgctgatcagcggcggcatgctgacctgggctggttttaacgacccgcaggaagtcaacggcaccctgagcgccgacgctacgccggccgcaccgatttccaccgtcgccgacggcgactggccggcctatggccgtaaccaggaaggccagcgcttctccccgctgaagcagattaacgccgataacgtgaagaacctgaatgaagcctgggtgttcccgcaccggcgacctgaaacagccgaacgatccgggtga

SEQ ID NO: 5140 - DNA, 261 bp, Klebsiella pneumoniae
ggctttgcggcggcgagaatatcttcgccaccagccgcgttcccctggccgcaggtgagccgcgaacaggtgctggcccgccagccgcaggcgatcgtggtgaccggggatgccagccgcattgccgaagcgcagcgcttttggcaacatcagctcaccatttcgttgattgcgttacacagcgactggtttgaacgcgccggcccacgtattatcctcgccgccaaacaactttgtgcggcgcttgaccaggtaaaataa

SEQ ID NO: 5141 - DNA, 543 bp, Klebsiella pneumoniae
gccggagcggcggcaggcgcagcgccttccacttcgaagaccatgatcagggaaccggttttgactttatcgccggtgctgattttgatctctttaacggtacccgcgaacggcgccggaacttccatagaggctttgtcgccctctacggtgatcagggactgttctgccgcgactttatcgccgactttaaccatcacttcggtgacttcaacttcgtcgccgccgatgtccgggacgttaacatctttcacgcctgctgcggcagccggagccgcagcagccggcgcggcagcctgtgccggagcggctgcaggcgcagcgcccgccacttcgaagatcataatcagggagccggtggaaactttatcgccggtattgattttgatctctttgacggtaccggcgaacggcgccggaacttccatagaggctttatcgccttctacggtgatcagggattgctcagcggcgatggtgtcgcccactttaaccatgatctcggtgacttcgacttcatcgccgccgatatccgggacgtga

SEQ ID NO: 5142 - DNA, 264 bp, Klebsiella pneumoniae
aacacggcggcggagaactccatctggtcgcgccctataaccaggccgacgccgtgcgtggcctggagagcttcagccatctgtggatcctgtttgtgtttcatcagacaatggaaggcggttggcgtccgacggtgcgacctccccgactgggcggcaatgcgcggatgggcgtcttcgccacccgttcaacgtttcgccctaatcccatcggcatgtcgctcgttgagctcaagggcattcgctgtcagaaagatcaggtaa

SEQ ID NO: 5143 - DNA, 1188 bp, Klebsiella pneumoniae
cgttctcaggcgacaggcacaagacggagagaaactatgtttgaacctatggaactgaccaacgacgcggtgattaaagtcatcggcgtcggtggcggcggcggtaacgccgttgaacacatggtgcgcgagcgcattgagggtgttgaattcttcgcggtaaataccgatgcgcaggcgctgcgtaagacggcggttggccagactatccagatcggtagcggtattaccaaaggtctgggcgcgggcgcgaacccggaagtcggccgtaacgcggctgatgaagaccgtgaagcgctgcgcgcagcccttgatggcgcagacatggtgttcatcgcggcaggcatgggcggcggtaccggtaccggcgcggctcccgtagtcgcggaagtggcgaaggatctggggatcctcaccgttgcggtggtcactaagccgtttaattttgaaggtaagaagcgcatggcgttcgctgagcaggggatcacccaactgtccaagcacgttgactcactgatcaccatcccgaacgacaagctgctgaaggtcctggggcgtggaatttccctgctcgacgcattcggcgcggcaaacgacgtcctgaaaggcgcggtgcagggtatcgccgaactgatcacccgtccgggtctgatgaacgtcgacttcgcggacgtccgtaccgtgatgtctgaaatgggctacgcgatgatgggctccggggtggcgagcggtgaagaccgtgcggaagaagcggctgaaatggctatctcttctccgctgctggaagatatcgacctgtcaggcgcgcgcggcgtgctggtcaacattactgcgggcttcgacctgcgtctggacgagttcgaaactgtgggtaacaccatccgtgcttttgcctcggataatgcgaccgtggttatcggtacctctctggacccggatatgaacgacgagctgcgcgtgaccgtagtgccgaccggtattggcatggataagcgtccggaaatcaccctggtaaccaacaagcaggttcagcagccggtgatggatcgttaccagcagcatggtatgtcgccgctgacgcaagagcagaagccggcagccaaagtggtgaacgacaatacgccgcaaaccgtgaaagagccggattatctggatatcccagccttcgtgcgtaagcaagccgattaa

SEQ ID NO: 5144 - DNA, 1509 bp, Klebsiella pneumoniae
ttaatcaaggcgagggaacaggtggcagatcgtaatttgcgcgacctactcgctccatgggtgccaaacgcaccggagcgcattctgcgagagatgacgctggacagccgggtggctgcttccggcgatctctttatcgcggtacagggtcatcaggcggacgggcgtcgttatatcccgcaggcgatagcgcaaggtgtggctgccattattgctgaagcgcagggcgaagctaaagacggtgagatccgtgaaatgcacggcgtgccggttatctacctgagccagcttaacgaacgcttatcggcgctggccgggcgtttttatcatcagccgtcgcagcagctgcgtctggtgggcgtcaccggcaccaacgggaaaaccaccaccactcagctgctggcgcagtgggcaaagctgctcggcgaaaccagcgcggtgatggggaccgtcggtaacggtctgctggataaagtcgttccaactgaaaacaccaccggttccgcggtggacgttcaacatgtgctctccagtctggtcgggcagggggctaccttcggcgcgatggaagtctcctcccatggtctggtacagcaccgcgtagcggccctgcagtttgccgcctcggtgtttaccaatctcagccgcgatcatctcgactaccatggcgacatggagcactacgaagcggcgaaatggctgctgtactccacccatcattgcggtcaggccatcgtcaatgctgacgatgaagtcggtcgtcgctggctggcaaaactgccggacgcggtggcggtatcgatggaagatcatatcaacccgaattgccacggccgctggctaaaggccaccgcggtgaactatcacgacagcggggcgaccatccagtttgactccagctggggcaagggcgaaatcgaaagccgcctgatgggcgcatttaacgtcagcaacctgctgctggcgctggccacgctgctggcgctgggctatccgctggccgatctgctgaagagcgcagcgcgtttacagccggtgtgcggccgtatggaagtgttcagcgcgccgggtaaacctgccgtggtggtggattatgcccatacgcctgacgcgctggaaaaagcgctgcaggcggcacgcctgcactgcagcggcaagctgtggtgcgtcttcggctgcggcggcgaccgcgacaaaggtaaacgtccgttgatgggcgctatcgcggaagaatttgccgacatcgtggtcgttactgacgataacccgcgcaccgaagagccgcgggcgattatcaacgatattctggccggcatgctcgatgcaggtcaggcgaaggtgatggaaggccgcgcggaagcggtgaccaacgccgtgatgcaggcgaaagagaacgacgtggtgctggtggcgggtaaaggccatgaagattaccagatcgtcggcaaccgccgtctggattattccgaccgcgtgaccgtcgcgcgtctgctgggagcggtagcatga

SEQ ID NO: 5145 - DNA, 342 bp, Klebsiella pneumoniae
ctcgcggtttacgccggaaaactggcggctctgcagtcctcgttcctgctgcgcttgccaggagggggcgcggctttcgttgccgctaagggcgttggcgcgcagatggctgagcgtctgctgacgctgggctggcgtggcggactggaactgctgccggcgctgctgctgctgaggtgtgcggttctgctcgtggctcctggcggcttctcgacgctgctgttgctgcggcgtggggtttttcagctgcgtttttgccgcctcgcgacgctgctgttgggtcggcgtactgtcgtaaccgcggtaattactgcgttgggtggcttgcttcagctgcgctga

SEQ ID NO: 5146 - DNA, 597 bp, Klebsiella pneumoniae
gggcgccttctcgttatcgtgagggaacaggagacggttgtgattgttcgtgatgacagtgaaagaggcatcccgccgctggtgacgcatcagccgccgtcctcgatggatgatgcgccggtgatccgcggacggatggtgcagatccccggctggattatcccgctgtacgccggattatttatcgcgctcggctggtttggcggcgagcagtggcgtcacccggcaccgccgcaaacgctgcccttgccggtggcgcatgcggcgcttctgccgttaaccgctgccggagaggccgcgccaaagacgccgccgccggcggcaaaagccagcgcgcccgcggcgccggaagtggacagcgatacgctgccgcctgtacgctacagcgcccatgtctatgcctcgcgaccggaaaagcgcagcattgtgttaaacggcaaagcgtggacggagggcgattcacccctgcccaatctggtggtggagcagatccagcaggatgtgacgatcttcagcttcaacggcacgacctttaccctcgcggcgctggaggactggccgggcggaaaaattgacgaggagccgaaagaggaataa

SEQ ID NO: 5147 - DNA, 858 bp, Klebsiella pneumoniae
atactttgttactttagcgctacgaactttaaattggtaagaccaattgactccgggctaatggcagagacagggaatatggcctacagcaaaatccgccaaccaaaattatccgatgtgatagagcagcagctggagtttctaattcttgaggggaccttgcgccccggtgaaaaactcccgccagaacgcgaactggctaaacagtttgacgtttcccgcccctcgctgcgtgaggcgattcaacgcctcgaagccaagggcttgttgcttcgtcgtcagggaggtggaacgtttgttcagagccgcctgtggcagagcttcagcgatccgctggttgagctgctgtccgatcaccctgaatcccaattcgatctgcttgagacccgtcacgcgctggaaggcatcgcggcctattacgcggcgctgcgcagcaatgatgaggatcgcgaccgtatccgtgagctgcatcaggctattgaacgcgctcagcagtcgggcgatttggacgctgagtccggcgccgtcgtccagtatcaaatcgccgtcaccgaggcggcacacaatgtggtgttgcttcatctgctaaggtgtatggagccgatgttggcgcaaaacgtgcgtcagaactttgaattgctgtatgcccggcgggaaatgctcccgttggtcagcaaccatcgcactcgcattttcgaggcgataatggccggggagcctgagcaggcgcgtgaagcgtcgcaccgtcacctggcgttcattgaggaaattttgctggatcgtagtcgtgagcagagccgtcgagagcgctcactgcgtcgtttacagcaacgaaaggacgagaactccggttcttaa

SEQ ID NO: 5148 - DNA, 693 bp, Klebsiella pneumoniae
cggcccagttattcggtattaacagaagacgaacgtgagctgggcgtctgcgttgtggatatcggcggtggtacaatggatatcgccgtctacaccggcggcgcattgcgtcacaccaaagtgatcccgtatgccggtaacgtggtgaccagcgatatcgcctatgccttcggtacgccgccgagcgatgccgaagccatcaaggttcgtcacggatgcgcattgggttccatcgtcggtaaagacgaaaacgtcgaagtaccgagcgttggtggacgtcctccgcgtagcctgcagcgtcagacgttggcagaggtgattgaaccgcgctataccgagctgcttaacctggtcaatgaagagatcctgcagctgcaggaacagctccgccagcagggtgttaaacatcatctggcggcggggattgtgttaaccggcggcgcggcgcaaattgaaggtctggcggcctgtgcgcagcgcgtgttccatactcaggtgcgcattggcgcgccgctgaacatcaccggtttaaccgactatgcccaggagccgtattattcaacggcggtggggctgctgcactacggaaaagagtcacatctcagtggtgaagcggaagtagaaaaacgcgtgacggcctcagtgggctcgtggattaagcgactcaacagctggctgcgaaaagagttttaa

SEQ ID NO: 5149 - DNA, 204 bp, Klebsiella pneumoniae
accgcgagttacgcgatggcaccagagaacgtctttccgaacaccatgaactgcgtcgccgctaaggatgagcagaatgagaaacccattatccgttgccctgtttacgttaatgctgtcgccgcttgccgccttcgcccaacagcagtttgccacgccggaacaggccgcaactgcgctggccgaagcgatcagccagcctaa

SEQ ID NO: 5150 - DNA, 900 bp, Klebsiella pneumoniae
aatgatgaatatggacaattggtgccactgataccttcggggagaaccacgcgtatggccgaaacgcaaaacgatccgctgctgccgggctactcttttaacgctcatctggtcaccggcctgacgccgattgaggcgcagggatacctggatttctttatcgaccgcccgctgggtatgaaaggctatattctcaatctgacgattcgcggcgagggggtgatcaacaaccacggcgaacagtttgtctgccggccgggcgatatgctgctgttcccgcccggggaaattcatcactatggccgccatcccgacgccagcgagtggtatcaccagtgggtctacttccgcccgcgcgcctactggcacgagtggctcaactggccaacgatttttgcccagaccggctttttccgtccggatgaacagtggcaggcgcgctttggcgagctgttcggccagatcgttgatgccgggcagggggcggggcgctattccgaactgttggcgataaacctgctggaacagctgctgctgcggcggatggaggcgatcaacgaatcgctgcatccgccgctggacaaccgggtgcgcgacgcctgccagtacatcagcgaccatctggcggacagccattttgatatcgccagcgtcgcccagcacgtctgcctgtcgccctcgcgtctgtcgcacctgttccgccagcagctgggggtcagcgtcctcggctggcgggaggatcagcgcatcagccaggccaaactgttgctcagcaccacgcggatgccgatcgccaccgttgggcgcaacgtcggcttcgaagatcagctctatttttcccgcgtgtttaaaaaatgcaccggggccagcccgagcgaattccgcgcgggttgtgaataa

SEQ ID NO: 5151 - DNA, 1446 bp, Klebsiella pneumoniae
aatgggcgatattattgcccgctatgtcgcagaaggggtgtaatcatggcgaagacgttatacgaaaaattatttgatgcgcacgtagtgtatgaggcgcagaacgaaaccccgctgctgtatatcgaccgccatctggtgcacgaagtcacctctccgcaggcgtttgacggtctgcgcgcccatggccgccaggtgcgccagccgggtaaaaccttcgctaccatggatcataacgtctcgacgcagaccaaagacattaacgcgtccggtgagatggcccgcattcagatgcaggagctgattaagaactgtaaagagttcggcgttgaactgtacgacctgaaccacccgtatcagggcatcgtccacgtcatgggcccggaacaaggggttaccctgccggggatgacgatcgtgtgcggtgactcccataccgccacccacggcgcgttcggtgcgctggcgttcggtatcggcacctccgaagtggagcatgtgctggcgacccagaccctgaaacagggccgcgcgaagaccatgaaaatcgaagtccagggcaaagcggcgccgggcattaccgccaaagatatcgtgctggccatcattggtaaaaccggtagcgccggcggcaccggccatgtggttgagttctgcggcgaagcgatccgcgatctgagcatggaagggcgtatgaccctgtgcaacatggcgatcgagatgggcgccaaagcgggcctggtcgcgccggacgaaaccaccttcaattacgtacgcggccgtctgcatgcgccgaaaggcaaagattttgacgatgccgtagcgtactggaaaaccctgaaaaccgacgacggcgcgacgtttgataccgtggtgacgctgcaggcggcggaaattgccccgcaggtgacctggggcaccaacccgggccaggtgatctcggtgacggataacatccccgatccagcgtcgttcagcgatccggtggaacgcgccagcgccgaaaaagcgctggcctatatggggctgaaatccgggatcccgctgacggaagtcgctatcgataaagtgtttatcggctcctgcaccaactcgcgcatcgaagatttacgcgccgcggcggaaatcgctaaagggcgtaaagtggcgccgggcgtccaggcgctggtggtgccgggttctggtccggtgaaagcacaggcggaagcggaaggtctggataagatctttatcgaagccggctttgagtggcgcttacctggttgctctatgtgtctggcaatgaataatgaccgcctgaatccgggcgaacgctgtgcctcaaccagcaaccgtaactttgaaggccgtcagggccgcggcggacgcacgcacctggtgagcccggcaatggccgcggcggcagccgttaccggccatttcgccgatatccgtaatctgaagtaa

SEQ ID NO: 5152 - DNA, 483 bp, Klebsiella pneumoniae
cgcatgactctggtctatatcgctcttggcagcaaccttgcttctccactggagcaggtgcaggcggctatccgcgccctgggcgaaattccgcacagccgcgtggtcgccgtctcttcgttctaccgcacgccgccgctgggcccgcaggatcagccggactatctcaacgccgccgttgcgctggaaaccgccctgccccccgagacgctgctcgatcatactcagcgcatcgaactgcagcaggggcgagtgcgcaaagccgaacgctgggggccgcgcacgctggacctcgatatcatgctgtttggcgatgctgtcattaacagcgagcgcctgaccgttccgcactacgatatgaaaaaccgcggctttatgctctggccgctgttcgagatcgccccggaccttcactttcctgacggcttggcgctgcgcgccgtgctggataatctcggcgcggcaaagcccgccagctggtaa

SEQ ID NO: 5153 - DNA, 759 bp, Klebsiella pneumoniae
aacaaacagtatagcggacggcgatcccggttggcgcggggccctcacgacatgctcactgtcgcctccccggcgcgctgccagtcatcgctgtctgcctgcaaaaaatacgagcaatccgtttcagggtcagaagatatggggtacacagtcgcgttaacaggcgggatcggcagcggtaaaagtacggtcgccgacgccttcgcgcagcttggggttaaggttatcgatgccgatgttatcgcccgtcaggtggtcgagcccggtaccccggcgctccaggccattgtcggccactttggaccacagatgattgcccccgacggcacgctgaaccgccgcctgctgcgggaaaaaatttttgctcacgtggaggaaaaagcctggctcaatgcgctgttgcacccgctgattcagcaggaaacgcgccgccagatgcaggccgccacctccccttatctcctctgggtcgtacctttgctggtcgaaaaccgcctgtccggccaggccgatcgcgtactggtcgtcgatgtgccgaaagagacgcaaatcgaacgcaccatgctgcgcgataaggtcagccgcgaacatgctgaacatattcttgccgcccaggccacgcgccagcagcgcctggccgtcgcggacgatgttattgaaaacactggcacgccggatgcagtggcatcggatgttgcccgcctgcacgaaaagtatttaacgctggcatcgcaggccgcctcacaggaaaactcgtaa

SEQ ID NO: 5154 - DNA, 1023 bp, Klebsiella pneumoniae
cgtcaaaatcatgaacatcggcgacagcgtgatggcgcgacgcattatcgatggcgtccgcgaaggccgcaacgtactggatgcactggaagacatgggtgcgctgggcagccgcgaagcacaacgaattccctttctaacttattgaggatttttgtcatggcagaacgtattactggacacactgagctgattggcctgatcgccaccccgattcgtcacagcatgtcgcccaccatgcacaacgaggctttcgcctatctcgggctggactacgtctatctcgcttttgaagtcggtaaccaggagctaaaagacgtggtgcagggcttccgggcgatgaagctgcgcggctttaacgtctctatgccgaacaaaaccgagatttgccagtatctcgataaactgtcgccggcggcacagctggtcggggcggtcaataccgtggtcaacgacgacggcgtactgaccggacatatcaccgatggcaccggctacatgcgcgcccttagcgaagccggtatcgatatcatcggcaagaagatgaccgtactcggcgccggcggcgcggcaacggcgctctgcgtccaggcagcactggatggcgtgaaggcgatctccatctttaaccgtcgcgataaattcttcgctaacgcagaagaaaccgtggccaagatccgccacaacaccgactgcgagatccatctgttcgatctcgacgatcatgacaagctgcgcgccgaaattgacagcagcgtgatcctgaccaatgccaccggggtcggcatgaagccgttcgaaggccagatgctgctacctgacgacagcttcctgcgtccggacctgatcgtctccgacgtcgtctacaacccgcgcaaaacccacctgctggaagtggccgagaaaaaaggctgccgcacgctgaacggcctggggatgatgctgtggcaaggcgcgcgcgcgttcgaaatctggacgggcaaacagatgccggttgattacatcaagagcattctgttctaa

SEQ ID NO: 5155 - DNA, 3612 bp, Klebsiella pneumoniae
aggctatcccaccgctgttcacctgcagaagctgcaggaacacggcgcaacagagcatcaccggcgcagttttggcccggtgaagcgtgccctgggcctggcgtccaactaagtcaccgggatctaaagatggctgaaccacgtttcgtacacctgcgggtgcacagcgactattccatgatcgatgggctggcaaagaccgggccgctggtgaagaaggcggcctcgcttggcatgccagcgctggcgatcaccgatttcaccaacctctgcggactggtgaagttctacgggacgggacacggcgcggggattaagccgatcgtcggcgccgactttcacgtgcagtgcgacctgctcggcgacgaatttaccgagctgaccgtgctggcggcgaacaacaccggctaccagaacctgaccctgttgatttcccgtgcctatcagcgcggctacggcgccctggggccgtggatcgatcgcgactggctggtggaacatcaggaagggctgattctgctctccggcggccggaaaggtgacgtcggcgtcagcctgatccgcggcaatatgccgctggttgaacagtgcgtcgccttctacgaagagcatttcccggaccgctattttctggagctgatccgtaccggtcgacaggatgaagaggcctatctccacgccgccgtggcgctggcggaagcgcgcggcctgccggtggtggcgaccaacgatgtccgctttctcgacaccagcgatttcgacgcccatgaaatccgcgtcgcgatccacgacggctttacgctcgacgacccgaaacggccgcgcaactactcgccgcagcaatatatgcgcagcgaggaagagatgtgcgagctgttcgccgatattccggaagcgctggcgaacagcgttgaaattgccaagcgctgcaacgtcaccgtgcggcttggcgaatatttcctgccgcagttcccgaccggcgatatgaccacggaagatttcctggtcatgaaatcgaaagagggtctggaagagcggctggaattcctcttcccggatcctgccgtccgtgctgaaaagcgcccggagtatgaccagcgtctggatattgaactccaggttatcaaccagatggggttcccgggctacttcctgattgtgatggagtttatccagtggtcgaaggataacggcgtgccggttggcccgggacgcggttccggcgccggttcgctggtggcctacgcgctgaagatcaccgatcttgacccgctggagttcgacctgctgttcgaacgtttccttaacccggaacgtgtctcgatgcccgacttcgacgtcgacttctgcatggagaaacgcgaccaggttatcgagcacgtggcggatatgtacggccgcgacgcggtatcgcagatcatcaccttcggtaccatggcggcgaaagcggtcatccgcgatgtcggtcgcgtgctgggtcacccgtacggatttgtcgatcgtatctccaagctggtgccgcccgatccgggcatgacgctggcgaaagcctttgaggccgagccgcagctgccggagatctacgaggcggacgaagaagtgaaagcgctgatcgacatggcgcgtaagctggaaggggtgacgcgaaacgccggtaaacatgccggtggggtagttatcgctccaaccaaaatcaccgatttcgcgccactgtattgcgatgagcaggggctgcatccggttacccagtttgataagaacgacgtggaatacgccgggctggtgaaattcgacttcctcggtctgcgtacgctcactatcattaactgggcgctggagatgatcaacaagcgccgtgagaagaacggcgaagggccgctggatatcgccgccatccccctggatgacaagaaaagcttcgacatgctgcagcgctcggaaaccaccgcggtcttccagcttgaatcgcgcggcatgaaagatctgattaaacgcctgcagccggactgcttcgaagatatgatcgcgctggtggctctgttccgcccgggcccgctgcagtcggggatggtagataactttatcgaccgtaagcatggccgcgaggagatctcttatccggacgtgcagtggcagcatgaaagcctgaaaccggtgctggagccaacctacggcatcatcctgtatcaggaacaggtcatgcagattgcccaggtgctgtccggatataccctcggcggcgcggacatgctgcgtcgtgcgatgggtaagaaaaagccggaggagatggccaagcagcgttctatctttgaggatggggcgaagaaaaacggcattgacggcgaactggcgatgaaaatcttcgacctggtggagaaattcgccggttacggatttaacaaatcgcactccgccgcctacgcgttggtctcctaccagacgctgtggcttaaggcgcactacccggccgagtttatggcggcggtgatgaccgccgatatggacaacaccgagaaagtggttggcctggtggatgagtgctggcgaatggggctaaaaatcctgcccccggatattaactccggcctgtaccatttccacgtcaacgacgatggcgagatcgtctacggcattggcgccatcaagggcgtcggcgaaggaccgatcgaagcgattattgaggcgcgcaacaatggcggctatttccgcgagctgttcgacctctgcgcgcgaaccgatattaaaaagctcaaccgtcgggtgctggaaaagctgattatgtccggggcgttcgatcgtctcggcccacatcgcgcggcgctgatgaattcgctgggcgatgcgttgaaagccgctgaccagcacgcgaaagccgaggccatcggccaggctgatatgttcggcgtgctggcggaagagcccgagcaaattgagcaatcctacgccagctgccagccatggcctgagcaggtggtgctggatggtgaaagggagaccctggggctatacctcaccggacacccgattaaccagtatctgaaggagattgagcgctacgtcggcggcgtgaggctcaaagacatgcatccgaccgaacgtgggaaagtcaccacggcggcggggctggtgattgcggcgcgggtaatggtcaccaagcgcggcaatcgtatcggcatctgtaccctggatgaccgttccgggcggctggaagtgatgttattcaccgacgcgctggataaatatcagcagttgctggaaaaagaccgcatacttatcgtcagcggacaggtcagctttgatgactttagcggggggcttaaaatgaccgcccgtgaagtcatggacattgacgaagcccgggaaaaatatgctcgcgggcttgctatctcgctgacggacaggcaaattgatgaccagcttttaaaccgactccgtcagtctctggaaccccaccgttcgggaaccattccagtgcacctctactatcagagggcggatgcacgcgcgcggttgcgtttcggcgcaacatggcgcgtctctccgagcgatcgtttacttaacgatctgcggggccttatcggctcggagcaggtggaactggagtttgactaa

SEQ ID NO: 5156 - DNA, 1764 bp, Klebsiella pneumoniae
aagcagcgccaaaaacgccttaaagcaaaacgtcaggaagaacaggccaactttatcagttggcgttttgcgttgctgtgcggctgtattctgctggcgctggcttttctgctgggtcgcgtcgcctggctacaggtgatcagccccgatatgctggtgcgccagggcgatatgcgttctctgcgcgtacaggaagtgtccaccgcgcgcgggatgataaccgatcgctccggacgtccgctggcggtcagcgtgccggtgaaggctatctgggccgacccgaaagagctccatgacgccggcggggttaccctggatacacgctggaaggcgctggcggatgccctcaatatgccgctggatcagctggcgacgcgcatcaataccaatccgcggatgcggtttatctatctggcgcgtcaggttaatcctgacatggccgattacatcaagaagctgaagctgccgggcattcatctgcgcgaagaatcccgtcgttactacccttccggggaagtaaccgctcacctcatcggctttaccaacgtcgatagtcaggggattgaaggggttgagaaaagctttgataaatggcttaccggtcagccgggcgagcgtatcgtacgtaaagaccgctatggccgggtaattgaagacatctcttctaccgatagccaggcagcgcacaacctggcgctgagtatcgacgaacgcctgcaggcgctggtctatcgcgagctgaacaacgccgtggcctttaacaaagccgagtcgggcagcgccgtgttagtggatgttaacaccggtgaagtgctggcgatggccaacagcccatcctataacccgaacaacttcgccggtacggcaaaagacaccatgcgtaaccgtgcgattaccgacgtgtttgagccgggttcgacggtgaaaccgatggtggtcatgacggcgctgcagcgcggtatcgtcaacgaaaataccgtgctcaataccgtgccttatcgaattaacggccacgaaatcaaagacgtggcgcgctacagcgaattgaccctgaccggggtgctacagaagtcgagtaacgtcggtgtttctaagctggcgttagcgatgccgtcctcagcgttagtagatacttactcacgttttgggcttggaaaggcgaccaatttggggttggtcggagaacgcagtggcttatatcctcaaaaacaacggtggtctgacatagagagggccaccttttctttcggctatgggctaatggtaaccccgttacagttagcgcgagtctacgcaacgattggcagctatggcatctatcgcccgttgtcgattaccaaagttgatcctccggttccgggcgagcgcgtcttcccggaatcactcgttcgtaccgtcgttcatatgatggaaagcgtggcgctgcccggcggcggcggtgtgaaagcggcgatcaaaggctatcgcatcgcgattaaaaccggtacggcgaaaaaagtggggccggatggccgctatatcaacaaatatattgcttacaccgcaggcgttgcgcccgccagccatccgcgcttcgcgctggtggtggtgatcaacgacccgcaggcaggtaaatactacggtggcgccgtttccgcgccggtcttcggtgccatcatgggcggcgtattgcgcaccatgaacatcgagccggatgcgctggcaacgggcgaaaaaagtgaatttgtaattaatcaaggcgagggaacaggtggcagatcgtaa

SEQ ID NO: 5157 - DNA, 480 bp, Klebsiella pneumoniae
atgatcagtctgattgcggcgttagcggtagatcgcgtcattggtatggaaaacgccatgccatggaacctgcctgccgatctcgcctggttcaaacgcaacacgttaaataagccggtggtgatggggcgtctgacctgggaatccattgggcgcccattgccggggcgtaaaaatatcgtgatcagcagcaaacccggcagcgacgatcgcgtgcagtgggtctcctccgtagaagaagcaattgccgcctgcggcgatgtggaagagattatggtgatcggcggcggccgggtgtatgagcagttcctgccgaaagcgcagaagctctacttgacccatattgatgcggaagtggaaggcgatacccatttcccggattacgatccggacgaatgggagtcggtgttcagcgagtttcatgacgccgacgcgcagaactcccatagctactgctttgagatcctcgaacgccgttaa

SEQ ID NO: 5158 - DNA, 456 bp, Klebsiella pneumoniae
aatctggcgcaccagccagaccgtcagccagatctgcaatatgccgatcccggcgaacaaggccatcgtcggcaccggcgccttcgcccactcctccggcattcaccaggacggcgtgctgaagaaccgcgaaaactacgagatcatgaccccggaatctatcggcctgaaccaggtgcaactgaacctgacttcccgctccggccgcgcggcggtgaaacaccggatggaagagatgggctaccaggagagcgattacaacctggatcatctgtacgacgcattcctgaagctggcggacaaaaaaggccaggtcttcgattacgatctggaagcgctggcctttatcaacaagcagcaggaagagccagagcatttccgcctggattacttcaacgtccaatccggatccagcgatatcgccaccgcctcgatcaaactggtctgcggggatga

SEQ ID NO: 5159 - DNA, 3336 bp, Klebsiella pneumoniae
tttaataagcatattagggactatcgaatgctcagatatacctgtcatgccctatttcttggatcgttagtattattgagtggctgtgataacagctcttcctcttctacctctggctcaccgggttcaccaggcaatcctggcaacccaggcactcccggcacgcccgacccgcaggatgtcgtcgtccgcttaccggacgttgccgtcccaggcgaagcggtgcaggcttccgccaggcaggctgtcattcatctcgtcgatatcgccggcatcaccagcagcacgccggccgactatgcgacgaaaaacctctacttatggaacaacgaaacctgtgacgcgctgagcgcgccggtggcggactggaatgatgtcagcaccacgccgaccggcagcgacaaatatggcccttactgggtgatcccgctgactaaagagagcggatgcatcaacgttatcgtccgcgatggcaccaataagcttatcgacagcgacctgcgcgtctctttcagtgatttcaccgatcggacggtatcggtcatcgccggcaacagcgcggtctatgactcccgcgccgacgccttccgcgccgcctttggcgtggcgctggccgatgcgcactgggtcgataagactactctgctgtggccgggtggggaaaataaacccattgtgcgcctctattacagccacagcagtaaggtggccgccgacagtaacggcgaatttagcgataaatatgtcaagctgacccccaccaccgtcaaccagcaggtaagcatgcgcttcccgcatctcgccagctatccagcctttaaactgccggatgatgttaacgtcgatgaattgctgcagggcgagacggtggcgatagccgcggaaagcgatgggatcctgagctccgccacccaggtacagaccgccggcgtgctggacgatacctatgccgccgccgccgaggcgctgagctacggcgcccagctaaccgatagcggcgtgaccttccgcgtctgggcgcccacggcgcagcaggtcgaactggtggtctacagcgccgacaagaaggtggtggccagccacccgatgacccgcgacagcgcctccggcgcctggtcatggcaggggggaagcgacctgaagggcgcgttctaccgctacgcgatgaccgtttaccacccgcagtcgcgtaaagtcgaacagtacgaagtgaccgatccctacgcccacagtttgtcgaccaactcggagtacagccaggtggtcgatctcaacgacagcgcgctgaagccggaaggctgggacgggctgacgatgccgcacgcgcataaaaccaaagccgacctggcgaaaatgacgatccacgagtcgcatattcgcgatctctctgcctgggatcaaaccgttcccgccgaactgcgcggtaagtatctggcgctcaccgcccaggagagcaatatggtccagcatctgaaacagctgtcggcctcgggcgtgacccatattgagctgctgccggtcttcgatctggcgacggtcaatgagttcagcgacaaagtcgccgatattcagcagccgttcagtcgcctgtgcgagatcaacagcgcggtgaagagcagcgagttcgcgggctattgcgacagcggttcgacggtcgaagaggtgctgacccagctgaagcagaacgacagcaaggataacccgcaggtgcaggcgttgaatacgctggtggcgcagaccgactcctataactggggctacgatccgttccactacacggtgccggaaggatcctacgccaccgatccggaaggcacggcgcgcattaaagagttccgcaccatgattcaggcgatcaagcaggatctgggaatgaacgtcattatggacgtggtgtacaaccacaccaacgccgccggcccgaccgaccgcacctcggtgctggataagatcgtcccctggtactatcaacgcctgaatgaaaccaccggcagcgtggaatcggccacctgttgctccgactcggcgccagagcaccggatgttcgccaagcttatcgccgattcactggcggtatggaccaccgattataagatcgatggcttccgcttcgacctgatgggctaccacccgaaagcgcagatcctctcggcctgggaacgcattaaagcgctgaacccggatatctacttctttggcgaaggctgggattccaaccagagcgatcgctttgaaattgcctcgcaaatcaatctcaaaggcaccgggatcggcacgttctccgatcgtctgcgcgacgccgtgcgcggcggcgggccgttcgactccggtgacgcattacgccagaaccagggcgtgggcagcggggctggagttctgccgaatgagctgaccaccctgagcgacgatcaggcgcgtcacctcgccgatctgacccgtctcggcatggccggtaaccttgcggactttgtgctgatcgacaaagacggcgcggtgaagagaggcagcgagattgactataacggcgcgccaggcggctatgcggctgatccgacggaagtcgtgaactatgtgtcaaaacacgataaccagacgctgtgggacatgatcagctataaagccgctcaggaggcggatctcgatacccgcgtccggatgcaggcggtgtcgctggcgacggtgatgctcggccaggggatcgcctttgaccagcagggctcggagctgctgcgctctaaatcctttacccgcgattcgtatgattccggcgactggtttaaccgcgtggactactccctgcaggacaacaactacaacgtcggtatgccgcgcagcagcgatgatggcagcaactatgacattatcgcccgggtgaaagacgcggtggctactccgggtgaaacggagctcaagcagatgaccgcgttttatcaggagctgaccgcgctgcgtaaatcgtctccgctgtttaccctcggcgacggcgcgacggtgatgaagcgcgtggacttccgcaatactggcgccgatcagcagacgggtctgctggtgatgaccatcgatgacgggatgcaggctggcgccagtctggacagccgtgtcgacggcatcgtggtggcgatcaacgccgcgccggaaagccggacgctgcaggacttcgccggcacatcgctccagctgagcgctattcagcaggcggcgggcgaccggtcgctggcgagcggcgtgcaggttgccgctgacggttcggtcacgctgccggcctggtcggttgccgttctcgagttgccgcagggcgagtcgcagggcgctggcctgccggtgagcagtaaataa

SEQ ID NO: 5160 - DNA, 1011 bp, Klebsiella pneumoniae
aattctgagcaactaatatcgatgcctgaaacccgtaaagttgttatcactcccggcgaacccgccgggattggccctgacctggtcgtgcagcttgcccagcgcgactggccagttgagctggtgatttgcgccgatggcgccctgttaactgaccgagccaagcggctcggtcttcctttatctctcctcccttacgatcccgcgcaacctcctgttcctcagcgcgccggtaccctgacgctgctgaacgtgccgctaaacgtcccggcggagcccggcgtgctgaatgtgcaaaacggcgcctacgtagtggagacgctggcgcgcgcctgcgacggctgccttagcggcgagtttgcggcgttagtgaccggcccggtgcataaaggcaacatcaacgacgccggtatcgcctttaccggtcataccgagttctttgaagaacgcgcgaaggccagcaaagtggtgatgatgttggcgaccgaggagctgcgggtggcgctggtcaccacccatctgccgttgaaagccatcagcgaagcgattacccccgagctactgcgcgagatcatcaccattctcgatcacgacctgcgcacgaaatttggcattgcccagccgcatgtgctggtttgcgggcttaacccgcacgctggcgaaggcggccatatgggaacagaagagatagacaccatcattccggtgctggaagagatgcgcgcaaaggggatgaacctcagcggtccgctgccggcagacaccctctttcagccgaaatatcttgatcatgccgatgcggtactcgcgatgtaccacgatcagggcctgcccgtgctaaaataccagggctttggccgcggcgtgaacattacgctcggtttaccttttattcgtacctccgtcgaccacggcaccgcactggaattagcgggccagggaaaagcggacgtcggcagttttatcacggcgcttaatctcgccatcaaaatgattgttaatacccaatga

SEQ ID NO: 5161 - DNA, 843 bp, Klebsiella pneumoniae
aaacactggcacgccggatgcagtggcatcggatgttgcccgcctgcacgaaaagtatttaacgctggcatcgcaggccgcctcacaggaaaactcgtaatgcatacccccgttctgtttgaacatcctcttaatgagaaaatgcgcacctggctgcgcatcgaatttctgatccagcagatggctttccgtccgcagattgccagccatgccgatgcgctccattttttccgtaacgccggcgatctgctggatgtcctggagcgcggcgaggtgcgcactgacctggttaaagagctggaacgccagcagcgtaagctccagtcatgggcagaagtgccgggcgtcgatcaggagcgcattaacgagctgcgccaccagttgaagcagtcctccagcaccctgatggccgcgccgcgcattggtcagtttctgcgtgaagatcgcctgattgcgctggtgcgtcagcgcctgagtattcctggcggctgctgcagcttcgatttaccgaccctgcatatctggctccatatgccacaggcgcatcgcgacgagcaggtggccagctggcttgccagcctcgatccgctggtccagtccctgagcctgatcctcgatcttatccgcaactccgcgctgttccgcaaacagaccagcctcaacggcttttatcaggataatggcgaagatgccgatctgctgcgcctgcgtctcgatctggctcacagcttttatccgcaaatttccggccataagagccgtttcgccatccgtttcctggcgctggacagtgaatatgggatcgtgccggagcgctttgattttgaactggcctgctgttaa

SEQ ID NO: 5162 - DNA, 549 bp, Klebsiella pneumoniae
cgatatcggcaactggaccctcgggaagaaatagtgtctcagcgcggtttcaccctcctggagatgatgctggtcctgctgctgatcggcgtcagcgccagcatggtgctgctggcgtttccctccgcccgcacccaggaggccacacagatcctggcgcgctttcaggcgcaactggattttgtccgcgagcgcgggcagcaaaccggtcagctcttcggcattatcatccaccctgagcgctggcagtttatgcgcctgcagcctgccgacgatagcgccccggcggcggctgacgaccggtggggcaacgcgcagtggctgccgctgcaggccggacgcgtcaccacggcggaaaccctcccgcgggccaggctgacgctgcgctttcccgacggccaggcgtggacgccgggcgagcagcccgacgtgcttatttttcccggcggtgaagtcacgccgtttcagctgcggattgacgccgcgaggggcatcaacgtcgacgcccagggcgacagccagccgctggcggcgcgggagcagccatga

SEQ ID NO: 5163 - DNA, 1740 bp, Klebsiella pneumoniae
gcctggaggcaaaccatggagatgttgtcaggagccgagatggtcgtccaatcgcttgtcgatcagggcgtcaagcaagtattcggctatcccggaggcgcagtcctcgatatctatgatgcgttacatacccttggcggtatcgatcatgtgctggttcgtcacgagcaggcggcggtgcatatggcggatggcctggcgcgggcgaccggggaggtcggcgtggtgctggtgacctctgggcctggggcgacgaacgccatcactggcattgcgacagcctatatggactctattccgttggtgatcctctcggggcaggtagccacctcgcttatcggctacgatgccttccaggagtgcgacatggtggggatttcccgtccggtggtgaagcacagtttcctggtgaagcagaccgaagatattcccggcgtgctgaagaaagccttctggctggcggccagcggtcgccccggtccggtagtggtcgatctgccgaaggatattctcaatccggcgaagaagctgccttacgtctggccggacgcagtgagcatgcgctcgtataacccaaccaccagtggccataaagggcagattaaacgcgcgctacagactctggtggccgcaagtaagccggtcgtctacgtcggcggcggggcgatcaatgcgcattgcgaacctcagctgcgcgagctggtggaaaaactgaagctgccggtggcctcatccttgatgggacttggcgctttcccggcgacacactcgcaggcgctggggatgctggggatgcacggcacctatgaagccaacatgactatgcaccactcggacgtgatttttgccgtcggcgttcgctttgacgaccggaccaccaataacctggccaagtattgtccgaacgcgacggtactgcatattgatatcgatccgacttcaatctcgaaaaccgtgccggcagatgtgccgatcgtcggcgatgcccggctggtgctggagcagatgctggagctgctggagcaggaggaagcgcagcagccgctggacgacattcgcgactggtggcaacagatcgagcagtggcgtgcccgtcattgtctgcgctacgacgaccagagcgataaaatcaaaccgcaggcggtaattgaaactatctggcggctgacccagggcgatgcctacgtcacttccgatgtgggtcagcatcagatgttcgccgccctgtattaccccttcgataaaccgcggcgctggattaactccggtggtctcggcaccatgggctttggcctaccggctgcgctgggggtcaaaatggctctgccggacgaaatggtggtctgcgtgaccggtgacggcagtatccagatgaacattcaggaactctccactgcgctgcagtatgagctgccggtcctggtgcttaacctcaacaaccgctatctcgggatggtgaagcagtggcaggatatgctctattccgggcgtcactcgcagtcctatatggaatcgctaccggactttgtccgtctggcggaagcctatggccacgtcgggatccgcatcagcgagccgcaggagctggagacgaagcttgctgaagctctggagcaggtgcgccagcgtcggctggtgtttgtcgatgtgaccgtcgacggcagtgagcatgtgtaccccatgcagatccgcggcggcggcatggatgaaatgtggttgagcaaaacggagaggacctga

SEQ ID NO: 5164 - DNA, 1035 bp, Klebsiella pneumoniae
ctgatgattaaactttccaatatcaccaaagtattcctgcaggggaatcgcagcattcaggcgctgaataacgtcagcctgcatgtccctgccggacagatttacggcgtcatcggtgcctccggcgccggtaaaagtacgctgattcgctgcgtgaacctgctggagcgcccgaccgagggcagcgtacaggttgacggtcaggaactgactgccctgtcggagaaagagctaacccgcgctcgccgtcaaattggcatgattttccagcattttaacctgttggcctcgcggaccgttttcggcaacgtggcattacccctggagctggataacacgccgcaggctgaaatcaaacgccgtgtcacggagctgctggatcttgtcggcctgggtgataagcacgacagctacccggccaacctctccggcggccagaaacagcgcgtggcgattgcccgcgcgctggccagcaatcctaaagtattgctgtgcgatgaagccaccagcgccctggatccggccactacccgttccattctcgaactgctgaaagacattaaccgtcgtctggggctgaccatcctgttgatcacccatgaaatggacgtggttaaacgtatctgcgactgcgtggcggtcattagtaatggtcaattgatcgagcaggacaccgtgagcgaagtcttctcccatccgaagacgccgctggctcagcagtttattcagtccactctgcacctcgatattccggatgactatcaggcgcgcctgaaacctaccgccacagcggatagcgtaccgatgctgcgcatggaatttaccggccactccgtcgatgcgccgctgctctctgaaaccgcgcgtcgcttcaacgtgaataacaacattatcagcgcgcagatggattatgccggcggggtgaagttcggcatcatgctcaccgaaatgcacggtacacaggaagacactcaggcggccatcgcctggctgcaggaacatcatgtaaaagtagaggtattgggttatgtctga

SEQ ID NO: 5165 - DNA, 504 bp, Klebsiella pneumoniae
aaaactaataaaatatcattattcatatattgcaaaataaaaagcacccttctagaatccggtaaaaatatacctacttcatggactgaaattgtgaatatctcgctgactcttcgtgttatcccactcgccgcgctgttagtagccggctgtagcaatacctcttcccgccagccggttaaaccgatcgccacgccgctgacgtcacagcagcaggcagagcaggagcgggcggccagcgaacaagcgcgcattgaatcctgtcgccaggcgttggattcgctaaaagaggttaacccacagcaagccactaaactcagcaatgactttaacgctttagtgcgcgcggcgtcacaatataatagcgtgcgcgagaaagtggcggatcctacccggcttggcattgactccatgtatcagtttaaatccatcaaactgtgcgccgatatccagaaaacgctgatcgatagcctggtacagcgtggtgaaagcaaacagccatga

SEQ ID NO: 5166 - DNA, 870 bp, Klebsiella pneumoniae
ctcacaaataacgttattggcagacaacactcattcttacaggaaggaaataacatggcctttaatttcaaaacttttgcggcagttggcgcgttaatcggttctctggcgctggtgggttgcggtcaggatgaaaaagatccgaatcatattaaagtcggcgttatcgtcggggcggaacagcaggtcgctgaagttgcgcagaaagtagcaaaagagaagtatggccttgacgtagaactggtgaccttcaacgattacgttctgccgaacgaagcgctgagcaaaggcgatatcgacgtgaacgccttccagcataaaccgtatctcgatcagcagattaaagaccgcggctataagctggtggctgtcggtaacaccttcgtctacccgatcgcgggttattcgaagaaaatcaaatcgctggacgaactgcagccgggctcgcagatcgccgtccctaacgatccgactaacctcggtcgttccctgctgctgctgcagcaggtaggtctgattaaactgaaagacggcgtgggcctgctgccgacctcgctggacatcgtcgagaacccgaaaaacctgaagattgttgaactggaggcgccgcagctgccgcgttccctggacgatgcgcagattgcgctggccgttatcaacaccacttacgccagccagattggcctgaccccggcgaaagacggcatctttgttgaaggtaaagagtctccttacgtgaacctgattgtggcgcgtgaagacaataaagatgctgagaatgtgaaaaaattcgttcaggcttaccagagcgatgaagtttacgaagcagcgaacaagatctttaacggcggtgccgtgaaaggctggtaa

SEQ ID NO: 5167 - DNA, 1188 bp, Klebsiella pneumoniae
tatgcaaataaagtgagtggatattctctggaggatgttttgattaagtcagcgctattggttctggaagacggaacccagtttcacggtcgggccatcggggcaaccggcacggcggttggggaagtcgttttcaatacttcaatgaccggttatcaagaaatcctcactgatccttcctattcccgccaaatcgtcactcttacttatcctcatattggtaatgtcggcaccaacgccgccgatgaagaatcttctcaggtacatgcgcagggtctggttattcgcgacctgccgctgattgccagcaacttccgcagtactgaagacctctcttcttatctgaagcgccataacatcgtggcgattgccgatatcgatacccgcaagctgacgcgtctgctgcgtgagaaaggggcgcagaacggctgcatcatcgcgggcgacagcccggatgcccagctggcgctggaaaaagcgaaagcgttcccgggcctgaacggcatggacttggcgaaggaagtgaccaccgcagaaacctatagctggacgcaaggcagctggaccctggcgggcgacctgccggaagcgaaagcggaaagcgagctgccgttccacgttgtggcatatgacttcggcgcgaaacgcaacatcctgcgcatgctggttgaccgcggctgccgcctgacggtggtgccggcgaagacctccgccgcggacgtgctggcgctcaatccggacggtatcttcctctccaacggccctggcgacccggcgccgtgcgattacgctatcgaggcgattgaaaaattccttgagaccgatattccggtattcggcatctgccttggccatcagctactggcgctggcgagcggtgccaagaccattaagatgaagttcggccaccacggcggcaaccacccggtgaaagatattgataacaacgtggtgatgatcactgcccagaaccacggtttcgccgtagatgaggcgacgctgccggccaatctgcgcgtgacccataagtcgctgttcgacggcaccctgcaggggatccatcgtaccgacaaaccggcgttcagcttccaggggcaccctgaagcgagcccggggccgcacgatgccgcgccgctgttcgaccactttatcgagttaattgagctctaccgtcagtccgcgaaataa

SEQ ID NO: 5168 - DNA, 537 bp, Klebsiella pneumoniae
aatccagataaaaaccctggaacccgctttcccggatcgttttcgccccctcgcctgcgcccctcaatcccttcacagtgctcctgtcacaacaaggagcgacttatggataaacaacgaggttttaccctgattgaactgatggtggttatcggaatcatcgccattcttagcgccatcggcatcccggcctaccagaactacctgcgtaaagccgccctcaccgacctgctgcagacctttgtcccttaccggacagccatcgaactttgcgcgctcgatcatggcggcctaacgccatgcgacggcggcagcaacggcattccctcgccgacaaccacgcgctacctctccgccatgagcgtggccaaaggggtcgtcaccctcaccggtcaggagagtctgaacggactgggggtcaccctgacgccgacctgggacaatgccgagggcgtcaccggctggcagcgcgtctgcaccatcaccggcaatagcgcgcttcagcaggcctgcgaagacgttttccgggtgaagtga

SEQ ID NO: 5169 - DNA, 1029 bp, Klebsiella pneumoniae
ggctcactcaaaatcctttgccaccccttttttctgaggtgcaaagtgttgaaaaaattactcccgctgctggcgctggtcgccatgcccgctttggctaagcctgttcttaccgtctatacctatgactccttctctgccgactggggccccggcccggcggtcaaaaaagcctttgaagcggagtgcggctgcgagctgaagttcgtcgcgctggaagatggcgtttcgctactgaatcgcctgcgcatggaaggcaaaaacagcaaggccgacgtcgtgcttggccttgataacaacctgctggaagccgcggcgcagagtaaactgtttgccaaaagcaacgtacccgccagcgcggtcagcgtgccgggcggctgggataatgacacctttgttccctacgactacggctatttcgccttcgtctatgacaaaaacaaactggctaatccaccgaagagcctgaaagagctggtcgagggcccgcaaaaatggcgggtcatctatgaagatccgcgtaccagcaccccgggactgggcctgctgctgtggatgcaaaaggtctatggcgatcaagcgcccgaggcctggcagaagctggccgcgaaaaccgttaccgtcaccaaaggctggagcgaagcctatggtctgttcctgaaaggggaaagcgacctggtgttgagctataccacctcgccggcctaccacatgattgaagagaagaaagacaactatgcggcggcgagcttcgccgagggccactatctgcaggtcgaagttgccgcgcgtaccgccgccagcaagcagccggaactggcggaaaaattcctcaaatttatggtatctcctggcttccagaacgccatccctaccggcaactggatgtatccggtgaccaaggtcaccctgccggccgggtttgataccctggtgaagccgcagaccaccctgtcctttaccccgcagcaggtcgccagcgagcgtcaaacctggattagcgcatggcaacgcgccgtcagccgctaa

SEQ ID NO: 5170 - DNA, 405 bp, Klebsiella pneumoniae
caatctgccaacgaaggagagctaaccatgattcattcgccccgggtgtgtgtccaggtacagagcgtctatatcgaatcgcagtcttccccggaagaagagcgctacgtcttcgcttacaccgtcaccattcgcaacctggggcggagtcaggttcagctgcttggccgctactggctcatcactaacggccacggtcgtgagactgaagttcagggtgaaggggtggtcggcgagcaaccgcatattcccgccggcggtgaatatcaatataccagcggcgcagtgattgaaacgccgctgggaaccatgcagggtcattatgagatgatcgatatcgacggcgcgccgttccgtattgagatccctgttttccgtctcgcagttccaacgctcattcattaa

SEQ ID NO: 5171 - DNA, 588 bp, Klebsiella pneumoniae
agacatgacaacatcaactgggagaacaacgataccacgggttcactggtctgggccggcgatacctactggcgcattgccgatgaatggggtctgcgcggggggatccagtacgatacgcgtctggataacgttgccactggtaacggcaccattgaataccgtcgcgatgagaaccgcttagtccagcttaactatcgttacgctagcccggaatatattcaggccacgctgccgtcatattccaccgcggcacaatataaacagggtatttcgcaggtggggatgaccgccagttggccaattgtcgatcgctggtccgtggtcggggcctactactacgatactaatacccggaaagcagcaaaccagatgttgggtgtgcagtataactcctgctgctacgccatccgtcttggctacgaacgtaaagtcaacggctggaacagcaacgacaacggcggcgagagcaaatacgataacaccttcggaatcaatatcgaattgcgcggtctgagctctaactacggcctcggcacccagcagatgctgcgctcgaacattttaccgtaccagagctccctgtga

SEQ ID NO: 5172 - DNA, 1041 bp, Klebsiella pneumoniae
tggttatgtttggcacttcttacccaaggggcaattgtgaaactggatgaaatcgcccggctggccggtgtttcaagaaccaccgcgagctatgtgattaatggcaaagcgaagcagtaccgcgtaagcgataaaacggtcgaaaaagtgatggctgtggtgcgagagcacaactatcacccaaatgcggtcgctgctggcctgcgtgcaggacgcacacgctctatcggtctggtgatcccggatctggaaaacaccagctatacccggattgcaaattatctcgaacgtcaggcgcgtcagcgcggctatcagctgctgattgcctgctcggaggatcagcccgataacgagatgcgctgcatcgagcatctgctgcagcgccaggtggacgctatcattgtctctacttcgctgccgccggaacatccattttatcagcgctgggctaacgacccgtttccgattgtcgccctcgaccgcgccctcgatcgcgagcacttcaccagcgtggttggcgctgaccaggatgacgccgagatgctcgcagctgagctgcggacgtttcctggcgaaacggtgctctatctcggcgcgctgccggagctgtcggtgagcttcctgcgcgaacagggtttccgtaaagcctggcaggacgatccgcgtgaggtgcattatctctatgccaacagctatgagcgcgaagcggcggcccagctgtttgagaaatggcttgaaacccatccgatgccacaggcgctgtttaccacctctttcccgctgctgcagggcgtaatggatgtgaccttgcgtcgcgagggtaaactgccctccgagctggcgatcgccaccttcggtgataatgagctgctcgattttctgcagtgtccggtactggccgtggcccagcgtcatcgcgatgtcgctgagcgggtgctggagatcgtcctcgccagcctcgacgaacctcgcaagccgaagccgggtcttagccgcattcgccgtaatctctatcgtcgcggtagccttaatcgccgctaa

SEQ ID NO: 5173 - DNA, 1308 bp, Klebsiella pneumoniae
tgctgtggcaaggcgcgcgcgcgttcgaaatctggacgggcaaacagatgccggttgattacatcaagagcattctgttctaagaggcgaatgatgaaaaataaatacatccctactgcggcagggctgtatctcaactacctgatccacggtatgggggtgctgttaatcaccctcaacatggcccatcttcaggaacagtggggaacagacaaagccggcgtatcgatcgttatatcttcgttaggtattggtaagttagcgaccatcgtgaccggatttctctcggatcgcttcggtcgcaaaccctttatctatcttgggatcctgagctatctgatctttttcgtcggcatcctgctgaccaaaaatatctatctggcttacgtgttcggcattatggcgggcctggcgaacagcttcctcgactccggtacctatccggcgctgatggaatctttcccgcactctgccagccgcgccaacgtgctaatcaaagccttcgtctctgcagggcagttcctgttgccgttcattatcagcttcctgatatgggcaaatctgtggttcggctggtcgttcgtgattgcggcagcactctttgtactgagcgggatttatctgcttaaaatgccgttccctgacagccaggcggcgaaaaaagaggaagcccctacggcacaggcggaaacagccgtccggccacaggctaataagctggatatggtgatcttcaccctgtacggttatatcggcatggcgaccttctatctggtcagccaatggctggcgcagtacggccagttcgtcgtcggcctgccctatgcctcggcgattaaactgcttagcatctataccgtcggctcgctggtctgcgtctttgtaactgccgccttcgtcaaagaggtgtttagctcggccattgcgatgattatttatactggcctgtcaatgatttcgctgctgttggtgtgcctgttcccgacgccgatgatggtgaccggctttgcttttgtcatcggctttgccgccgctggcggagtgctgcagctgggtgcgacaatcatggcgatgagcttcccgaatggaaaaggcaaagcaaccggcatcttctacactgccggcagtatcgccagcttcacgatcccgttgatcaccgcaaagctttcgcagatcagtattgccagcattatgtggtttgattttctgatcgccgttatcggctttgtgatcgccctgtacatcggctatcgtcaactgcaggctcgggcggcgcaaaaagtgtcacgcaccgcagtcaccgcctga

SEQ ID NO: 5174 - DNA, 1785 bp, Klebsiella pneumoniae
tcccgcaaaaagcggaggaggagcgccatggctgataaaatcgcggtgcttttcggtggaacctccgctgaacgtgaagtgtcgctgaattcaggcgcggcggtgctggccgggctgcgtgaaggcggggtggacgcccatccggtcgacccgcgcgatgttgatattacccagctaaaaaagcagggctttaagaaagcgtttattgccctccacggccgcggcggggaagatggcactctgcaggggctgctggagttaatccagctgccttataccggcagcggcgtgatggcttcggcgatttcaatggataaactgcgcagcaagtggctgtggcagggtgccggattaccggtcgcgccgtgggtggcgctgacccgcgcccagtttgccgccgggctgtctactgacgtcgaacagcaaattgcggcgctgggtctgccggtcatcatcaagccgagccgtgaaggctccagcgtcgggatgtcgaaagtcagcgaaagttgtgatttagcgagtgcattggcgttggcttttcagcatgatgatgaagttttggtcgaaaaatggctcagtggaccggaatttaccgtcgccatagtcggtgaagaaattttaccgtcaatacgtatccaggccgcgggaaccttctatgattatgaggcgaagtatctctctgatgagacgcaatatttctgcccaggatttgaagatcccgcgcgtgagtcagctattcagaacctggtgcttaaagcctggaatgttctgggttgcaaaggctggggccgtattgacgtgatgctggacagcgatggccagttttatctgctggaagcgaatacttccccgggcatgaccagccatagccttgtgccaatggcgggggtgtcaggccagggattgagtttcttccccagcttgttgtacgaattctggacctggcggggtgatatgtcgcaggctgcgctgaatacgcggaaccatgaagaagaggcttcttcttcgcgtcggagtaatggaacgcggctggcagggatcgttttcctgctggcggtgctgtttaccgtgctggtcagcgggtggatggttcttggctggatggaagatgcgcagcgcttaccgctgtcgaagatggtggtgaccggcgagcgccactatacgcgcaatgatgacatccgtcaggcgatcctggcgctgggttcgccgggtacctttatgactcaggatgtgaacatcatccagagccagattgaacgtctgccgtggattaagcaggcgagtgtccgaaagcagtggcccgatgaattgaagattcatctggttgaatatgtgccgattgcgcgctggaatgatcaacatatggtggatgcagaaggaaatgccttcagcgtgccggcggatcgcaccagcaaacagaatttaccgatgttatacggccccgaaggcagcgagaacgaagtgctgcaggggtatcgtgacatggggcaggtgctggcaaaggataaattcacgttgaaagtggcggcgatgaccgcccgtcgctcctggcagttgacgcttaataatgacatcaagctcaaccttggccgtggcgataccatgaaacggcttcagcgctttatggaactctacccggttcttcagcagcaggcgcagaccgacggcaaacggattagctacgttgatttgcgttatgactcgggtgcggcagtgggctgggtacctgctcccgcagaggaaactaatcaacaacagaatcaggcacaggcagaacaacaatga

SEQ ID NO: 5175 - DNA, 1119 bp, Klebsiella pneumoniae
agaaagcgaaagagattggctacccgctggtggtgcgtccgtcttatgtgctcggcggccgggcgatggagatcgtctatgacgagcaggatctgcgccgctacttccagaccgcggtcagcgtctccaacgacgcgccggtgctgctggatcgcttcttcgacgatgcgattgaagtggatgtcgatgcccatctgcgatggcgaaatggtgctgattggcggcatcatggagcatatcgagcaggcaggcgtccactccggcgactccgcctgttccctgccggcctacaccctgagcaaagagattcaggatgtgatgcgcgagcaggtgcagaagctggccttcgagctgcaggttcgcggcctgatgaacgtccagttcgcggtgaaagataacgaagtttatctgattgaggtcaacccgcgtgcggcgcgtaccgtaccgttcgtctccaaagccaccggcgtcccgctggcgaaagtggcggcgcgcgtgatggccggtaagacgctggcgcagcagggcgtgaccaaagagatcatcccgccgtactactcggtgaaagaggtggtcctgccgttcaataaattcccgggcgttgacccgctgttagggccagaaatgcgctccaccggggaagtgatgggcgtcggccgcacctttgccgaagcgttcgccaaagcgcagctgggcagcaactcgaccatgaagaaacagggtcgtgcgctgctctccgtccgcgaaggcgataaagagcgcgtggttgacctggcggcgaagctgctgaagtttggcttcgagctggatgcgactcacggtacggcgattgtgctgggtgaagcgggcattaacccgcgtctggtgaacaaggtgcatgaaggtcgtccgcacattcaggaccgcatcaagaatggcgaatatacctacatcatcaacaccaccgcaggtcgccaggcgattgaagactccaagctgattcgccgcagcgcgctgcagtacaaagtgcattacgacaccaccctgaacggcggctttgccaccgcgatggcgctgaacgctgacgccaccgagaaggtgatttcggtgcaggaaatgcacgcgcaaatcactaaataa

SEQ ID NO: 5176 - DNA, 237 bp, Klebsiella pneumoniae
ggggctggaaacggtgcgtaccgactggacgccgctggcccagcagtttcaacaggagttatacctgcgcatcttccgcaaccagccgtatcaggattatgtgcgggagactatcgccaggctgatgaacggcgagctcgacgaacagctggtttatcgcaaacgcctgcgccggccgctggcggagtatcagcgcaacgtaccgccgcacgtgcgcgccgcccggcttgccgatga

SEQ ID NO: 5177 - DNA, 801 bp, Klebsiella pneumoniae
actaaattgaaaaaattgaagctgcacggctttaacaacctgaccaaaagcctgagtttttgtatctacgatatctgttacgccaaaacggcagaagagcgcgacggctacatcgcctatatcgacgaactctataatgccaatcgcctgacggagatcctgacagaaacctgttctattattggcgccaatatcctgaatatcgcccgtcaggattatgaaccccagggcgccagcgtgaccattctggtcagcgaagagcctgtcgatcccaagctgattgaccagaccgaacatcctggcccgctaccggaaaccgtggtcgcccatctcgataagagccatatctgcgtgcatacctacccggagagccatccggagggcggcctgtgcaccttccgcgccgatatcgaagtttcaacgtgcggcgtcatttccccgcttaaagcgctgaactatctgattcaccagctggaatcggacattgtgaccattgactaccgcgtgcgcggctttacccgcgatatcaatgggatgaagcattttatcgatcatgaaatcaattcgattcagaactttatgtccgacgatatgaagtcgttgtatgacatggtcgacgtcaacgtttatcaggaaaatatcttccataccaaaatgttgctcaaggagttcgaccttaagcactacatgttccatacccgaccggaagagttgactgccgaagagcgcaaggtcattaccgacctgctatggaaagagatgcgcgagatttactacggccgcaatattcctgccgtgtaa

SEQ ID NO: 5178 - DNA, 1086 bp, Klebsiella pneumoniae
  unsure (101),(232),(233): Identity of nucleotide at the above locations are unknown.
aaaaagttgaagacgaagacttcggctactgcgaatcctgcggcgtggagatcggcattcgccgtctggaagcgcgtcccacagcggatctgtgcattgantgcaaaaccgtggcggaaattcgcgaaaaacagatggcgggtaatcccctggtgcttcactttctggcgggagtctctcccgcctggttctgttgtccgtaccatgactgactcacgctatataggcgttnncgccccttccccttccggcgaactccacttcggctctctgatcgccgcgctcggcagctacctgcaagcccgcgcgaaccagggtatctggcgtgttcgtattgaagatatcgacccgccgcgcgaagtccccggtgccgccgataccatcctgcgccagcttgaccactacggtctgcactgggatggcgacgtgctgtggcagtcgcaacggcacgaagcctaccgcgaggcgctgacgtggctgggcgagcaagggctgagctattactgcacttgcacccgcgcgcggatccacgccgtgggcgggatctacgacggccactgccgcgatctcgggctgggggcggaaaacgccgcgctgcgcctgcgccaaacccgtccggtgctgcagtttagcgaccgtctgcgcggcacgctcatcgccaatgagccgctggcgcgtgaggattttattatccaccgtcgcgacgggctgttcgcctacaacctggcggtggtggtcgacgaccactttcaggggatcaccgagattgtccgcggcgcagacctgattgagccgacggtgcggcagatttcgctgtatcagcattttggctggcaggcgccggattacctccatctgccgctggctctcaatggcgacggcaataaactctctaaacaaaaccacgcgccggcgctgccggaaggcgatccgcgccccgaaatcgtccgggcgctccgctttctgaatcaggcgatccccgaggagtggcaggccctgggcatcgatgatttactcgtccaggccgtcgccaactggcagccggcgaaaatcgagcattctcaaatggctcccgctgagctatga

SEQ ID NO: 5179 - DNA, 870 bp, Klebsiella pneumoniae
aagcggttgaagatagcgcttcccccgctggttgccctgctggtgcgcggcgatcacgagctgaacgaagtgaaagcggaaaaactgccgcaggtcgccagcccgctgaccttcgccaccgaagaagagatccgcgccctggtgaacgccggtccgggctccctgggcccggtgaacatgccggttccggtgattatcgaccgtactgtagcagtgatgagcgatttcgccgctggcgccaacatcgatggcaaacactacttcggcatcaactgggaccgcgatgtcgcgacgccggaagtggccgacatccgtaacgtcgtcgccggtgacccgagcccggacggtaaaggtaccctgcttattaagcgcggtatcgaagtgggtcatatcttccagctggggacgaagtactccgaggcgatgaaagccgcggtccagggcgaagatgggcgtaaccagatcctgaccatgggctgctatggtatcggggtgactcgcgtggtagcggcggcgattgagcagaactttgacgatcgcggtatcgtctggccggatgcgattgcgccgttccaggtggcgatcctgccgatgaacatgcacaagtcttaccgtgtgcaggagctggcggagaaactgtacgccgagctgagcgcccagggtattgaagtgctgatggacgatcgtaaagagcgtccgggcgtgatgttcgccgatatggagctgatcggtatcccgcacaccatcgtgctgggcgatcgtaacctcgataacgatgatatcgaatacaagtatcgtcgcaacggtgagaagcagctgattaagaccggggatattgtggaatatctggttaaagcgataaaaggctaa

SEQ ID NO: 5180 - DNA, 828 bp, Klebsiella pneumoniae
tacccaatgaataatcgagtccatcagggccatttagcccgtaaacgcttcgggcagaacttcctcaacgatcagtttgtgatcgacagcatcgtctcggcgattaacccgcagaaaggccaggcgatggttgaaatcggccccggcctggcggccctgaccgagccggtcggcgaacgccttgaccagctgaccgtcatcgaactggaccgcgatctggcggctcgcctgcagacgcatccgttcctcggtccaaagctgaccatctatcagcaggatgcgatgaccatgaactttggcgaactggcggagaaaatgggccagccgctgcgcgtcttcggcaacctgccgtacaatatctcgaccccgctgatgttccatctgttcagctatactgatgccatcgccgatatgcactttatgctgcagaaggaagtggtgaatcgtctggttgccggaccgaacagtaaggcgtatggtcggttaagcgtgatggcgcaatattattgccaggtgatcccggtactcgaagtgccgccgagcgcgtttaccccgccgcctaaggtcgactccgcggtggtacgcctggtgccgcacagcaccatgccgtatccggtcaaagagatccgggtgctgagccgcatcaccaccgaagcgttcaaccagcgccgcaagactatccgcaacagtctcggcaatctgttcagcgtggaagtgctgaccgagctgggcatcgacccggccatgcgcgccgaaaatatttccgtggcgcagtactgcctgatggccaactggctgtctgacaatctgccaacgaaggagagctaa

SEQ ID NO: 5181 - DNA, 1611 bp, Klebsiella pneumoniae
aaggatgtgaatatgcaacgtcgagacttcctcaaactgaccgccgcggtcggcatggccagcgcattgccgttatggagccgggcggtctttgccgccagtcgcccggctctgccgataccgtcgctgttagccgccgatgcgcgcaaccgcatcgcgctcaggatccaggcgggcaaaacgcggtttggcgccctgaatgccactacctggggctacaacgggtcgctgctgggccctgcgctgcagttgacgcaggggaagaccgtcacggtggatattactaaccagctggcggaagagaccacgctgcactggcatggtctggaggtaccgggcgaggtcgacggggggccacagggggttatcgcgccgggcgccacccgcacggtaagcttcacgccaacgcagcgggcggcgacctgctggtttcatccgcatcagcatgggagcaccggccggcaggtggcgatggggctggccggcctggtgctgatcgaggatgaagagagcgggcgcctgctgctacctaagcagtggggaatcgatgatgtgccggtgatcgtccaggataagaagttcaccgccgccggcgagatcgactatcagctggatgtgatgagcgccgccgtcggctggtttggcgatacgctactgaccaatggggccctctatcccgaacatgccgcgccgcgcggctggctgcgcctgcgcttgctgaacggctgtaatgcccgttccctcaattttgccaccagcgataagcgcccgctgtacgtggtggccagcgatggcggtctgttggccgagccggtcaaggtcgatgaattgccggtcttgatgggggaacgctttgaggtgctggtggacaccagcgacggtaaacctttcgatctggtgaccctgccggtgagccagatgggcatggcgattgcgccttttgataaaccacagccggtactgcgcgtccagccgctggtcattcccgcctccggcaagctgctggatactctggccgctctcccggcattaccgtccctgacggggctgacgcagcgtcagctccagctgtcgatggatccgatgctcgaccggatgggcatgcaggcgctgatggagaagtatggcgaccaggcgatggccggaatggatcacggcatgatggggcatggcgacatgagcgacatggggaatatgcatcacggcgacatgagcatgaaccacggatccggcatggagcatggcatgtcgtcaggcaagggctttgatttccataacgccaaccgcatcaacggcaaagccttcgacatgaatgagccgatgtttgccgccgccagaggccagtatgagcgctgggtgatttcaggtaagggcgacatgatgttgcatccgttccatatccacggcacccagttccgtatcctcagcgaaaacggcaagccgccagcggcgcatcgtcgcggctggaaagacaccgttcgtgtggaaggggacgtgagtgaagtattagtgaagtttgatcatccggcgccgaaggagtttgcctatatggcccactgccacctgctggaacatgaagacaccgggatgatgttggggttcacggtttaa

SEQ ID NO: 5182 - DNA, 390 bp, Klebsiella pneumoniae
cgcattgcccttgcagaggaaaagactatggattacgaatttctgcgcgatattaccggagtggtaaaggtgcgaatgtcgatggatcacgaggcgatcggccactggttcaacgaggaggtgaaaggcaatcttgctctgctggacgaagtggagcaggctgcgcgcaccgtgaagggcagcgagcgttcctggcagcgtgccgggcatgaatatacgctgtggctggatggcgaagaggtgatgatccgcgccaatcagctggagttttccggcgacgaaatcgaggaggggatgagctactacgacgaagaaagtctctctctgtgcggtgttgaggatttcctgcaggtggtcgccgcctatcgtgagtttatgcagcagcgttaa

SEQ ID NO: 5183 - DNA, 1245 bp, Klebsiella pneumoniae
ccagcctcgaagaggtggtgcgggtgctggggatcccccatggcgactaagcgtctctggcgctggcgcggtattgatgtgcagggcgccccctgtcaggggatgctatggcaaaccaagcgtctggaggtcctgcagcaccttcaacagcagcgagtcataccgctggccgtacgccgctgtgcggtgaagcagagcctctggcacccgcgctacagttgcgaaacgatccgccagctggcgtccctgctgcaggccggcctgccgctggcggaagggttatcgctgctggcgcagcagcagtcgcatgcccagtggcaggcgctgcttgaggcgctgggccgcgagctggcccagggcgtggcgttctctgccgcgctggcgcagtggccccaggcttttccgcccctatatctggcgatgattagcaccggcgaactgacgggcaagctcgatatctgctgcctgcagttggcaaatcagcagcaggagcagcagcggctcgccagcaaagtcaaaaaagcgctgcgctacccgctgatcgtgctctctctggcgctgttggtggtgctggggatgctctattttgtcctgcccgagttcaccgccatctaccagacgttcagtacgccgttaccgctgttgacgcggatggtcgttgcggcaggcgacatgctaagtcgcggctggccgctgctgctggccttgctgctgagcccgctgctgctcaaccagctgatccggcggcgcagcgactggttgctgcgccgccagcggttgcttaacgcgcttcctctcattggctccctgatcggcggacaacagctgagcctgatcttcaccatcctggcgttaacccaaagcgccggtattagctttctgcaggggctgcaaagcgttgaaaagtccctgtcgtgcccgctatggcgccagcgtctggcgcaggcccgcgcgctgatcgttcagggggagccgatttggcaggcgttaagccgctgcggcggttttacaccgctgtgcctgcagctcatccgcacgggggaaagcgcgggagcgctggatcagatgctggaaaacctggcgcatcaccatcgccagcaaacctatcagcgagccgatagtctggctgcgcatcttgaacccatgatgctggtgataaccggctcgctggtcgggattctggtggtggcaatgtatttgcccgtttttcacctgggcgatgccattggcggggcgggaggatga

SEQ ID NO: 5184 - DNA, 321 bp, Klebsiella pneumoniae
aggccgccgaaagccccgacgccgcaccggtcgccaacagcgtatgccgcgcttccggactgcgcatgcggaaaacgtccagcaccatgcgcccaatgttgccgccaagctgtaccatcggtccttcacgacccagcaccatcccggcgccaagggtccccatgccgccaacgaatttcaccggcagcacgcgccaccagcgcaccggccgcagctcctccagcgcgccttcaatttccggaatcccggagccgccggcttccggcgcaaagcgacgcaccagaaaatagccgaccatcgccagcagcgccgacaggataa

SEQ ID NO: 5185 - DNA, 672 bp, Klebsiella pneumoniae
cggaacgcgaacatggcgatggaaaactacaatccgccgcaggatccctggctggtgatcctgtatcaggatgagcacatcatggtggtcaacaagccgagcggcttgttgtccgtccccggtcgtcttgaggagcataaagacagcgtgatgacgcgcattcagcgcgacttcccgcaggccgaatcggtgcatcgcctggatatggccaccagcggcgtgattgtggtggcgctgaataaagccgccgaacgtgaactgaagcgtcagttccgcgagcgcgagccgaagaagcagtacgtcgcccgcgtctggggccatccgcagccggcggaaggcctcgtggatttaccgctgatttgcgactggccgaaccggccaaagcagaaggtgtgctatgaaaccggcaaagcggcgcaaaccgaatatgaggtgctggagtacgcagaggataacaccgcccgcgtgcgcctgaagccgattaccggacggtcgcaccagctgcgcgtgcatatgctggcgctggggcatccgatccttggcgaccgcttctatgccacgccggaggcgctggcgatggccccgcgcctgctgctgcacgccgagacgctcaccatcacccatcctgcctacggcaacgcgatgacctttcgcgcgccgatcgacttttaa

SEQ ID NO: 5186 - DNA, 3012 bp, Klebsiella pneumoniae
tatagcgccctttccattcctggccccaattttgacgcatctccgattgttcatggagatgatcaactattgcctgcaattaaagaactaaagagccgaacatatatgccttttacacttggtcaacgctggattagcgacacagagagcgaactaggattagggacggtggtagcgctggatgcgcgcatggtcactctccttttccccgccatcggcgaaaaccgtctgtactctcgcaacgattccccgatcacccgcgtaatgtttaacccgggcgacaccatcaccagccatgaaggctggcagctccacgttgacaaagtgaatgaagagaacgggctgctgtcctacactggcacccgcctggacacccaggaaacgaacgtcaccctgcgtgaagtgctgctcgacagcaaactggtattcagcaaaccgcaggaccgcctgttcgccggccaaatcgaccgtatggatcgctttgccctgcgctaccgcgcgcgcaagttccagagcgaacagtaccgcatgccgtggagcggcctgcgcggccagcgcaccagcctgatcccgcaccagctgcatattgcccacgatgtgggccgtcgtcacgcgccgcgcgtcctgctggccgatgaagtgggcttaggtaaaaccattgaagccgggatgatcctgcaccagcagctgctctccggcgccgccgagcgcgtgctgatcgtggtcccggaaaccctccagcaccagtggctggtggagatgctgcgccgtttcaacctgcgtttctcgctgttcgacgacgagcgctacgccgaagcgcagcacgatgcctacaatccgttcgaaaccgaacagctggtgatctgctctttagacttcgtgcgtcgcagcaagcagcgcctggagcacctgtgcgacgccgagtgggacctgatggtggtcgacgaagcgcaccacctggtgtggagcgaagaggcgccgagccgtgaatatcaggctattgaacagctggctgagcgcgtgccgggtatcctgctgctgaccgcgacgccggaacagctgggaatggagagccattttgcgcgcctgcgtctgttggatccgaaccgcttccacgattttgaacagtttgtcgaagaacagcagaactaccgtccggtggccgacgccgtcgcgctgctgctggcgggcaacaagctgagcgatagcgaactcaataccctgggcgatctgatcggcgagcaggatatcgagccgctgctgcaggccgccaacagcgatcgcgaagatgcccaggccgcgcgccaggagctgatctcgatgctgatggaccgccacggcaccagccgcgtgctgttccgtaatacccgtaacggcgtcaaaggtttcccgaaacgcgagctgcacaccattcgtctgccgctgccgacccagtaccagacggccatcaaagtgtccggcattatgggcgcgcgcaaaaccgcggaagagcgcgcgcgcgacatgctctatccggagcagatctatcaggaatttgaaggtgataccggtacctggtggaacttcgacccgcgcgtcgagtggctgatgggttacctgaccagccatcgctcgcagaaggtgctggtaatctgcgctaaggccgccaccgccctgcagctggaacaggtgctgcgcgagcgcgaaggcatccgcgccgcggtgttccatgaagggatgtcgattatcgaacgcgaccgcgccgcggcgtggtttgctgaagaagacaccggcgcccaggtgctgctgtgctccgagatcggctccgaaggacgcaacttccagttcgccagcaacctggtgatgttcgacctgccgtttaacccggatctgctggagcagcgtatcggtcgtctcgaccgtatcggccaggcgcacgatatccagatccacgttccgtacctggaaaaaaccgcgcagtcggtgctggtgcgctggtatcacgaagggctcgacgccttcgaacatacctgcccgaccggtcgcaccgtttacgacagcgttcacgatgaactgatcaactatcttgcggcgccggaatccaccgacggctttgacgatctgatcaaatcctgccgccaacagcatgatgccctgaaggcgcagctggagcagggccgcgaccgtctgctggagatccactccaacggcggcgagaaagcccaggccctggcggagagcatcgaagagcaggatgacgacaccagcctgatcgctttctcgatgaacctgttcgatatcgtcggcatcaaccaggacgaccgcggcgaaaacctgatcgtcctcaccccttccgaccatatgctggtgccggatttcccgggcctgccggaagacggttgcaccatcaccttcgaacgtgacgtggcgctgtcgcgtgaagatgcgcaatttattacctgggaacacccgctgatacgcaacggtctggacctgatcctttccggcgataccggcagcagcaccatttccctgctgaagaacaaggcgctgccggtcggcaccctgctactggagctgatctatgtcgtcgaagcgcaggcgccgaagcagctgcagctcaaccgcttcctgccggcgaccccggttcgcatgctgctggataagaacggcaacaacctcgccgcgcaggtggagttcgaaagcttcaaccgccagctgagcgcggtcaaccgccataccggtagcaagctggtcaatgcggtgcagcaggacgttcatgcgattctgcagcagggtgaagcgcagatcgccaaagcggcgcaggggctgatcgacgcggcgcgtaacgaagccgatgaaaagctgacggcggagctgtcgcgtctggaagcgctgaaggcggtgaacccgaacatccgtgacgacgaactggcggcgatcgaaagcaaccgtcagcaggtgatggatgcgctggcgcaggccggatggcgtctggacgcgctgcgtctgatcgtcgtcactcaccagtaa

SEQ ID NO: 5187 - DNA, 480 bp, Klebsiella pneumoniae
ggttatcagaaaaaagccggccgtcaggccggctttttcgattacatcaccaagcggcgaatgtcgctcagggtgttgttaatgatggtaatgaagcgggcaccatcagcaccgtcgatgacgcggtggtcgaaggacagagagatcggcagcatcaggcgcggcacaaactctttaccattccataccggctccatcgcggacttagacacgccgaggatggccacttccggcgcgttaacaatcggcgcgaagtgggtggtacccaggccgccgatgctggagatggtgaagcaaccgccctgcatttcgccagccgtcagtttgccatcgcgcgctttcttcgagatggtggtcaattcacgagacagctcggtgatgctcttcttgttcacgtctttgaagaccggaaccaccagaccgttcggggtatccaccgccacaccgatgttgatgtatttcttcagcgtcaggcgctga

SEQ ID NO: 5188 - DNA, 216 bp, Klebsiella pneumoniae
gacgtccagaagagtggaaacagaataaaaagcaaaacgccgccagcaagcccctacgcagcaactatcggggataaggcggcggcattaggccttcaactaagcgctaaaggctacaaggccagcggtcgcaacgcaatcccgagaattgagcgtacagtcttctgtacggcgtttcagattttactcaggccagagcctgtctggcccgagtaa

SEQ ID NO: 5189 - DNA, 495 bp, Klebsiella pneumoniae
cgctggaggaaaacgatggctaatctgcttatctggtggcggcagcgcacgccgtcggagcagcgcctgttgcttggtctgacagggctgctggcggcatgcgccttctggtatgggctgtggcagccctggcgagcccgcgaggcgcagtggcggcaaaccctggtgaaagagcaggccagcctgcgctggatgacggagcaggctccgcgcctgcagcagctcagccagcagcccgcgccggcggcaaaagaggcgctcaccgcgctggtgatgcgcgaggcggcgagccacggactgacggtcatccgcctgcagccgcaggggaaaacgtctgcagatcacccttcagccctgcgctttccaggcgctgatcgactggctggacgctccggcgatgcgcggcgtcaacgcgatctcgctgtccgtgaccgggcagccgtcgcgacccggctgggtcacggtcaaccatctgctgctggagcgcgacgatga

SEQ ID NO: 5190 - DNA, 1473 bp, Klebsiella pneumoniae
cgggcacttgattcccggacatggtggtattctcgatcgtatcgacagcctgacggcggcggtaccggtcttcgcctgtctgctactgttggtcttcaggacgatttgacggaaggttatatgctgagcgtgctctggaatctggcggcttttatcattgcgcttggcgtactgattacggtgcatgagtttggccatttttgggtggcgcgccgctgcggtatccgggttgagcgtttttctatcggcttcggcaaagcgctgtggcggcggatggataagcagggcacagagttcgtcatcgccctgatcccactgggcggctacgtcaagatgctggatgagcgtgttgaagcggtggcgccggagatgcgtcactacgccttcaacaataaaaccgtcggtcagcgtgcggcggtgattgccgccggccccatcgctaacttcattttcgctatctttgcttactggctggtctttatcatcggcgttcccggcgtgcggccggtggtgggtgaaataacgcccaattcggttgccgcgcaagcacaaattgcaaaaggaacggaacttaaagcgatagatggtatcgaaacgcctgattgggatgcggtgcgtctgcagctggtggccaaaatcggcaacccgcaaacaatagttaccgtcgcccctttcgggaccaatcagcgccaggataaaatcgtcgatctgcggcactggtcgtttgagccagacaagcaagatcccgtgacctcgctggggatccagccgcgcagcgcgcagattgatacggtgctggctgaggttcaggcgggatcggcagcccagaaagcgggtttgcaagcgggcgaccggatcgttaaagtcgatggtcaaccgttaacgcagtggatgacgtttgttaatctggtgcgcgataatccgggcaaagcgctggcgctggagattgaacggcaggggagtgcgctgccgttaaccctgacgccggatgcgaaaacggtgaaaggtaaggcggaagggttcgcaggggtggtgccaaaggtcatcccgctgcctgaagaatacaagacagtacgtcagtacggaccgtttgccgccatcgctgaagccacggataaaacctggcagctgatgtcgctgacggtcaggatgctgggtaaattgataaccggtgatgtcaaactgaacaacctcagtgggccgatctctatcgctcagggggctggaatgtcagcggagtttgggttgatttattatctgatgttcctggcgctgattagcgtgaacctcggaatcatcaacctgttccctctacccgtactggatgggggacatctgctgtttttagcgattgaaaagctgaagggcgggccggtatccgagcgagttcaagactttagttatcgcattggctcaatactgctggtgctgttaatggggcttgcacttttcaatgatttctctcggttataa

SEQ ID NO: 5191 - DNA, 792 bp, Klebsiella pneumoniae
tacgtgattgataaaaccgcttttgttcatcctaccgccattgtagaagaaggcgccgtgattggcgctaacgttcacattggtccgttttgtattgttggcgctaacgtcgaaatcggcgaaggcaccgtgctgaagtctcacgttgtcgttaacggccacaccaaaatcggccgtgacaatgagatctatcagttcgcttccatcggcgaagttaaccaggatctgaaatatgctggcgaaccgacccgggtggaaattggcgatcgcaaccgcattcgcgaaagcgtcaccattcatcgcggcacagtacagggcggtggattaacaaaggtgggcaacgataacctgctgatgatcaacgcccacgtggcgcacgattgtacgcttggcgatcgctgcattctggccaataacgcgacgctcgcgggccatgtttcgctggatgattatgtcattatcggcggcatgacggcggtgcatcagttctgcgtcattggctcacacgttatggttggcggctgctccggcgtggcgcaggacgttccgccgttcgtaattgcccagggcaaccatgcgacgccgttcggcgttaacatcgaagggctgaaacgccgcggcttcagccgggaagcaatcaccgcgatccgcaacgcgtataaactgctgtaccgcagcggcaaaacgctggaagaagccaagccggaaatcgccgaactggctgctcagcatcctgaggttcagccgtttgtcgatttcttcgctcgttctacccgcggcttgattcgttaa

SEQ ID NO: 5192 - DNA, 525 bp, Klebsiella pneumoniae
aatgtggttgagcaaaacggagaggacctgattatgcgccggatattatcggtattactggaaaacgaatcgggtgcattgtcccgcgttatcggcctcttttcccagcgtggctataatatagaaagcctgactgtcgcgccgacggacgatcccactctctccagaatgaccattcagaccgtgggcgatgaaaaagcgattgagcagattgaaaagcaactgcacaagctggtggatgtcctgcgggtcagcgagctggggcagggggctcatgttgaacgcgaaattatgctggtgaaggttcaggccagcggctatggccgtgaagaagtgaagcgcaacaccgaaatcttccgcggacagattatcgacgtgacgccttctatctataccgtccagctcgccggcaccagcgataagctggatgcatttctggcctcgctgcgcgatgtcgctcggattgtggaagtggctcgctccggcgtggtcggcctgtctcgcggtgataaaatcatgcgctaa

SEQ ID NO: 5193 - DNA, 1494 bp, Klebsiella pneumoniae
aatgactctgatagtcacgtacacagcaactttcgttacctgatattgagattgaaactgatgaaaaaaaccacgttagcaatgagtgcactggctctgagtttaggtctggcgttgtccccgctctctgcgagcgcggcagaaacggcatcttcggccactaatgcacagcagatgccaagcctggccccgatgctggagaaggtgatgccgtcggtggtgagcattaacgttgaaggtagcaccaccgttaataccccacggatgccacgtaacttccagcagttctttggcgataattcgccgttctgccaggatgggtctcctttccagagttcgccgttttgccagggcggcggacagggcggtcagcctgacggcggccagcagcagaaatttatggcgctgggctccggcgtcatcattgatgccgccaaagggtatgtggtgaccaacaaccacgtcgtggacaacgccaccacgattaaggttcagctgagcgatggccgtaagtttgatgccaaagtcgtcggcaaagatccgcgctctgatatcgcgctgattcagattcaggatccaaaaaatctgacggcgattaagcttgccgactccgatgcgctgcgcgtcggtgattacaccgtggctatcggcaacccgttcggtctgggcgaaaccgtgacctccgggattgtctccgcgctgggccgtagcggcctcaacgtggaaaactacgaaaactttatccagaccgatgcggcgattaaccgcgggaactccggcggtgcgctggtgaacctcaacggcgagctgatcggtatcaacaccgccattctggcgccggacggcggcaacatcggtatcggttttgctatcccgagcaacatggtgaaaaacctgaccgagcagatggtgaaatatggccaggtgaaacgcggtgagctcggcattatgggcaccgaactgaactctgagctggcgaaagcgatgaaagtcgatgcccagcgcggggccttcgtcagccaggtaatgccaggttcggcggccgcgaaagcgggcattaaagccggcgatgttatcacctccctcaacgggaaagcgatcagcagcttcgccgcgctgcgtgcccaggtcggcaccatgcctatcggcagcaaagttgagcttggtctgctgcgcgacggcaaaccggtgaccgtaaccgtcgaactgcagcagagcaaccagacccaggttgactccagcactatcttcaacgggattgaaggggcggaaatgagcaataagggtcaggataagggcgtggtggtcaataatgtgaaagccggtaccccggcggcacagattggcctcaagaaaggcgacgtcatcgtcggggcgaatcagcagccggtgaaaaacatcgccgatctgcggaaaatcttcgacgccaaaccgtccgtactggcgctgaacattcagcgcggcgacgcctctatctatctgctgttgcagtaa

SEQ ID NO: 5194 - DNA, 951 bp, Klebsiella pneumoniae
  unsure (591),(772),(783): Identity of nucleotide at the above locations are unknown.
agtccgtctgacactacgaggtgcaccatttttacccgagtcgctaatttttgccgtaaggtgctaagccgtgaggagcgcgaggcagaagccgccgtcgaaccaacgcctatgacggtgatcccgcgtgagcagcatgctatttcccgcaaagatatcagtgaaaacgccctcaaggtcatgtaccgcctcaacaaggcgggctacgaatcctggctggtcggcggcggcgtccgcgacctgctgcttggcaaaaagccaaaagattttgacgttaccaccaacgccacgccggatcaggtacgcaagctgttccgcaactgccgtctggttgggcgacgtttccgcctggcgcatgtgatgttcgggccggaaatcattgaggtcgccaccttccgtggccatcacgaagggcataccaccgatcgcgtcacctcccagcggggccagaacggcatgctgctgcgcgacaacatcttcggctcgatcgaggaggatgcccagcgtcgcgacttcactatcaacagcctctattacagcgtggcggactttaccgttcgcgactacgtcggcggcatgaaggatctccangacggcgtgatccgtctgatcggcaacccggaaacccgctatcgcgaggatccagtgcgcatgctgcgcgcggtgcgctttgccgccaagctcaatatgaccatcagcccggaaacggctgaaccgctgccgcgcctggccgccctgctccacgatgtgccgccggcgcctctgttcaaanaagtgctcaanctgctgcaggcccgggtatggtaccaaacctacttgctgctggcgggaatacagcctgttccagccgctgttcccgaccatcacccgctactttaccgagcgcggcgacagcccgatggagcggatcatcagccaggtgctgaagaataccgatacccgcattcataa

SEQ ID NO: 5195 - DNA, 444 bp, Klebsiella pneumoniae
gccattcatgacggcccagcgcgtcgtcggcgtccagcatcgcgcccatgccgttcgccagctggtagcgcccctcctgaccgcggcggcgggcgatgcgatcggcgaaggccgacgccagcagccccgccattagcccggcatcgggctggccgccgcggcgggccaggcgtttcatcagctgctgcgctcgctgctgccagttggcctgctgacgggaaaagacggcccccaaatccaccagtccgccgcgcggcggctcctcgaggatcgccgccagctttgccgctgtcgccgcctcgtcatcggtctgcgcggcggccagcatcgccgccagccgcggctcgttgccaagcgctgccattttgcggccaaacgccgacagccgctcgccgtccagcgccgacagcgcctccagcaggcgacgcgcggcggccagattga

SEQ ID NO: 5196 - DNA, 204 bp, Klebsiella pneumoniae
gcatgtcgtgagggccccgcgccaaccgggatcgccgtccgctatactgtttgttttaatcaagcaaatcaaatggttaaaaacaatactccggcaggggaaggcataggcgcctttttctccattcaccaggtaaatttatacgattgtagcgtaaaaaaagtgaaaatcgcagtcttgcgcgggcctgattcgcgcgtatga

SEQ ID NO: 5197 - DNA, 375 bp, Klebsiella pneumoniae
agcgtcggtgatctaatggtagaaaaaatgaagacgcttttcagaacaatggtactcggcagcctgcttgctctctccgccaacagctacgcgctcagcgaatccgaagcggaagatatggctgatttaaccgcggtttttgtgtttctgaaaaacgactgtggctaccagaacctgcccaacacgcagatccgtcgcgcgctggtgttctttgcccaacagaaccagtgggacctgagcaactatgacagctacaacatgaaagcgcttggcgaagacagctatcgcgatcttagcggcattaacattccgacggcgaaaaaatgtaaagcgctggcccgcgattcgctcagcctgctggcttacgttaaataa

SEQ ID NO: 5198 - DNA, 279 bp, Klebsiella pneumoniae
aacaacatcgagaccggacgctgcgccggcggcgtcgcgttatgcacctcgccgttaatcagcaggctgccgctggcgggtggcagaaacccggcgatcagattcagcagggtgctctttccggcgccgctgggaccgagcaccgcgatgcgctccccgcgcgcgacgtcgagggtgaagcgcatcggcagatgctggtatagccaggtcacatcattgagttttagcatcacgccccggaagtttttcaatcagcgtaaacaacaagaaacagagtag

SEQ ID NO: 5199 - DNA, 264 bp, Klebsiella pneumoniae
acagggatcgatgctgctgtttctgcccggcgtcggcgagatccagcgcgttctggaacaactgacggagcgcgtggcggaggatgtcattctctgcccgctgtatggcgcgttgcccttaagcgaacagcgcaaagcgatcctcccggcgccggccgggaagcgcaaagtggtgctggccaccaatattgccgagaccagtttgaccatcgaggggatccgcctggtggtcgacagcgcccaggagcgggtcgcccgctttga

SEQ ID NO: 5200 - DNA, 1677 bp, Klebsiella pneumoniae
cagggtgccgaccggcagcgccttgttcttcagcagggaaatggtgctgctgccggtatcgccggaaaggatcaggtccagaccgttgcgtatcagcgggtgttcccaggtaataaattgcgcatcttcacgcgacagcgccacgtcacgttcgaaggtgatggtgcaaccgtcttccggcaggcccgggaaatccggcaccagcatatggtcggaaggggtgaggacgatcaggttttcgccgcggtcgtcctggttgatgccgacgatatcgaacaggttcatcgagaaagcgatcaggctggtgtcgtcatcctgctcttcgatgctctccgccagggcctgggctttctcgccgccgttggagtggatctccagcagacggtcgcggccctgctccagctgcgccttcagggcatcatgctgttggcggcaggatttgatcagatcgtcaaagccgtcggtggattccggcgccgcaagatagttgatcagttcatcgtgaacgctgtcgtaaacggtgcgaccggtcgggcaggtatgttcgaaggcgtcgagcccttcgtgataccagcgcaccagcaccgactgcgcggttttttccaggtacggaacgtggatctggatatcgtgcgcctggccgatacggtcgagacgaccgatacgctgctccagcagatccgggttaaacggcaggtcgaacatcaccaggttgctggcgaactggaagttgcgtccttcggagccgatctcggagcacagcagcacctgggcgccggtgtcttcttcagcaaaccacgccgcggcgcggtcgcgttcgataatcgacatcccttcatggaacaccgcggcgcggatgccttcgcgctcgcgcagcacctgttccagctgcagggcggtggcggccttagcgcagattaccagcaccttctgcgagcgatggctggtcaggtaacccatcagccactcgacgcgcgggtcgaagttccaccaggtaccggtatcaccttcaaattcctgatagatctgctccggatagagcatgtcgcgcgcgcgctcttccgcggttttgcgcgcgcccataatgccggacactttgatggccgtctggtactgggtcggcagcggcagacgaatggtgtgcagctcgcgtttcgggaaacctttgacgccgttacgggtattacggaacagcacgcggctggtgccgtggcggtccatcagcatcgagatcagctcctggcgcgcggcctgggcatcttcgcgatcgctgttggcggcctgcagcagcggctcgatatcctgctcgccgatcagatcgcccagggtattgagttcgctatcgctcagcttgttgcccgccagcagcagcgcgacggcgtcggccaccggacggtagttctgctgttcttcgacaaactgttcaaaatcgtggaagcggttcggatccaacagacgcaggcgcgcaaaatggctctccattcccagctgttccggcgtcgcggtcagcagcaggatacccggcacgcgctcagccagctgttcaatagcctgatattcacggctcggcgcctcttcgctccacaccaggtggtgcgcttcgtcgaccaccatcaggtcccactcggcgtcgcacaggtgctccaggcgctgcttgctgcgacgcacgaagtctaa

SEQ ID NO: 5201 - DNA, 2355 bp, Klebsiella pneumoniae
cccagccacgagcaggatttttactcacccgtcactggcgggacactccgcagggcaccgagctctccttctggctggccaccgacgacggtccgctgcaggtcaccctcccgccgcaggagtccgtcgcctttattcccgaagcgcagcgggcgcaggctgaacggctgctgcaggggggagaaagggctccgcttcgccccgctggccctgaaagatttccaccgtcagccaattgttggcctctactgccgcgcccatcgccagttgatgcgtctggagaagatgctccgcgacagcggcgtcaccgtttacgaaggcgatatccgcccgccggagcgctatctgatggagcgctttatcaccgccccggtgtgggtggaaggcgaaacgcgcggctcgcagctggtcaacgcgcgcatgaagccgaaccctgactatcgtccgccgctgaaatgggtgtcgctggatatcgaaaccagccgccacggcgagctgtactgcatcggtctggaaggctgcggccagcgggtggtctacatgctgggccccgaaccggaaacgccgccagacgtcgacttcgagctggtcttcatcgccagccgtcccctactgctggaaaagctcaacgcctggtttgccgaacacgaccccgacgtgctgatcggctggaacgtagtgcagttcgatctgcgcgttctgcaaaagcacgccgaacgctatcgcatcccgctgcggctcggccgcggcaacagcgagctggagtggcgtgagcacggctttaagaacggcgtctttttcgcccaggccaacgggcggctgattatcgacggcatcgacgcgctaaaatcggcgttctggaatttctcctccttttcgctggaggcggtggcccgcgagctgctgggagaaggcaaagctatcgacaacccatgggatcggatggatgagatcgagcgccggtttcatgaagacaaaccggcgctggccatctataacctgcaggattgcgagctggtgacgcggatcttccacaaaacggagatcatgccgtttttgctcgaacgggcgacggtcaacggtctgcccgccgaccgccacggcggctcggtcgccgccttcagccatctctatttcccgcgcatgcaccgcctgggctacgtggcgccgaatctcggcgacgtaccgccgcaggcgagccccggcggctacgtgatggactcccgccccggcctgtatgactcggtgctggtgctggactataaaagcctgtatccgtcgattattcgtacctttttaatcgatccggtcggcctggttgaagggctggcgcaacccgatgaccagcacagtatcgagggcttcctcggcgcccgcttctcgcgagataagcactgcctgccggggattgtcagccagatctggcacggccgggatgaagccaaacgccagcacaataagccgctctcccaggcgctgaagatcattatgaacgccttttacggcgtgctggggaccagcgcctgccgcttcttcgacccgcgtctcgcctcgtcgatcaccatgcgcggccacgcgatcatgcgccagactaaagcgttaattgaagccaaaggctatgacgttatctacggcgataccgactccaccttcgtctggctaaagcgcccgcacagcgaagcccaggcggcggagatcggccgcgagctggtcagcgatgtcaacgcctggtgggcgcaggagcttagcaaaagccagcttaccagcgccctggagctggagtatgaaacccacttctgccgctttttaatgccgacgatccgcggcgccgataccggcagcaagaagcgctatgccgggatgattcaggagggcgatgcccagcgcatggtgtttaaggggctggaaacggtgcgtaccgactggacgccgctggcccagcagtttcaacaggagttatacctgcgcatcttccgcaaccagccgtatcaggattatgtgcgggagactatcgccaggctgatgaacggcgagctcgacgaacagctggtttatcgcaaacgcctgcgccggccgctggcggagtatcagcgcaacgtaccgccgcacgtgcgcgccgcccggcttgccgatgaacacaacctgaagcttgggcgggcgcagcagtatcagcagcgcggcaccatcaaatacgtctggaccaccagcggcccggagccggtggattaccagcagtcgccgctcgattacgatcactatttaacaaagcagttgcagccggtggcggaagggatcctgcccttcgtcaacgatgactttgctacaatagtgacaggacagttggggctattttga

SEQ ID NO: 5202 - DNA, 1644 bp, Klebsiella pneumoniae
aacccgcgccttggcgcgggtttttttatgctcgtcaacaaggcgccaggacacagactaaggatccaaaccatgagccagcaagtcattattttcgatacgaccttacgtgatggcgaacaagcgttacaggcaagcctgagtgtcaaagagaagctgcagatcgcactggcccttgagcgaatgggggtcgacgtaatggaagtcggtttcccggtatcctcgccgggcgattttgaatcggtgcaaaccatcgcacgcaccattaaaaacagccgcgtgtgcgctctggcgcgctgcgttgagaaagatatcgacgtggcggcggaatcgttaaaagtggccgaggctttccgtattcatacctttattgccacctcgccgatgcatatcgccaccaaactgcgcagtacgctggatgaggttattgagcgcgcgatctatatggtgaagcgggcacgcaactacactgacgacgttgagttctcctgtgaagacgccggccgtacgccgattgccgatctggctcgcgtcgtggaagcggcgatcaacgccggcgccaccaccattaatatcccggataccgtcggctataccatgccgttcgaatatgccaacatcatcagcggcctgtatgatcgcgtgccgaatatcgacaaagcaattatttccgtccacacccatgatgatctgggcatcgctgtcggtaacgccctcgccgcggtccacgccggtgcgcgccaggtagaaggtgcgatgaacggtatcggcgaacgcgccggcaactgcgcgctggaagaagtgatcatggcgatcaaagtgcgcaaagacatcatgaacgtgcacaccaacattaatcatcatgaaatctggcgcaccagccagaccgtcagccagatctgcaatatgccgatcccggcgaacaaggccatcgtcggcaccggcgccttcgcccactcctccggcattcaccaggacggcgtgctgaagaaccgcgaaaactacgagatcatgaccccggaatctatcggcctgaaccaggtgcaactgaacctgacttcccgctccggccgcgcggcggtgaaacaccggatggaagagatgggctaccaggagagcgattacaacctggatcatctgtacgacgcattcctgaagctggcggacaaaaaaggccaggtcttcgattacgatctggaagcgctggcctttatcaacaagcagcaggaagagccagagcatttccgcctggattacttcaacgtccaatccggatccagcgatatcgccaccgcctcgatcaaactggtctgcggggatgagatcaaaaccgaagccgccaacggcaacggtccggtcgatgctatctaccaggcgattaaccgcgtcaccgactacaacattgaattagtgaagtatggcttaagcgcgaaaggccacggcaaagacgccctgggccaggtggatatcgtcgttgactacaatggccgccgcttccatggcgttggtctggcaacggatatcgtagagtcgtcagccaaagcgatggttcacgtgctgaacaacatctggcgcgccgccgaagtcgaaaaagaattgcaacgcaaagctcagaataaagagaacaataaggaaaccgtgtaa

SEQ ID NO: 5203 - DNA, 822 bp, Klebsiella pneumoniae
cgacggcgcgatggcttcggagaatccgggcttcgttttttaaccgggtacattatgcaagcattgctcgaacactttattacccaatccacggtctactcattgttagccgtgatgctggtggcctttctcgagtcgctggcgctggtggggcttatcttacccggcacggtgatgatggctggccttggggcgctcatcggcggcggcgaagttaacttctggcaggcgtggctggcggggattgtcggctgcctgctgggcgactggatctcattctggctcggctggcgctttaagaagccgttgcaccgctggtcgtttatgaagaaaaaccgcgccctgctggagaaaaccgagcatgcgctgcatcagcacagcatgatcaccattctgattggccgctttgtcggaccgacgcgtccgctggtgccaatggtcgccgggatgctcgacctgccggtggccaagttcgtgctaccgaatattatcggctgcctgctctggccgccgctctatttccttccgggcattctcgccggggcggcgattgatattccggctgatgaaaacagcgccagctttaaatggctgctattgggggcggcgctgctggcctggctggcgggatggctgtgctggcggctgtggcggagcgcgaaaacctcaggcgatcggctgacccgctggctgccgcgcggccgactgctgtggctgtcgcctctgatggtcgcgctggcggctacagcgttaacatttgtcttccgccatccgctgatgccggtctatctggcgatcctgcataaagtcatcgcgcgctga

SEQ ID NO: 5204 - DNA, 693 bp, Klebsiella pneumoniae
cccatttcagacatcacggtacggacgtccgcgaagtcgacgttcatcagacccggacgggtgatcagttcggcgataccctgcaccgcgcctttcaggacgtcgtttgccgcgccgaatgcgtcgagcagggaaattccacgccccaggaccttcagcagcttgtcgttcgggatggtgatcagtgagtcaacgtgcttggacagttgggtgatcccctgctcagcgaacgccatgcgcttcttaccttcaaaattaaacggcttagtgaccaccgcaacggtgaggatccccagatccttcgccacttccgcgactacgggagccgcgccggtaccggtaccgccgcccatgcctgccgcgatgaacaccatgtctgcgccatcaagggctgcgcgcagcgcttcacggtcttcatcagccgcgttacggccgacttccgggttcgcgcccgcgcccagacctttggtaataccgctaccgatctggatagtctggccaaccgccgtcttacgcagcgcctgcgcatcggtatttaccgcgaagaattcaacaccctcaatgcgctcgcgcaccatgtgttcaacggcgttaccgccgccgccaccgacgccgatgactttaatcaccgcgtcgttggtcagttccataggttcaaacatagtttctctccgtcttgtgcctgtcgcctga

SEQ ID NO: 5205 - DNA, 1437 bp, Klebsiella pneumoniae
agattaccagatcgtcggcaaccgccgtctggattattccgaccgcgtgaccgtcgcgcgtctgctgggagcggtagcatgattcgctttacgttaagtcaacttgccgcgatcgcccatggcgaatggcagggtagcgatgtcgctatcgacgaggtgaccaccgatacccgtaaagtgacggcgggctgcctgtttgtggcgctgaaaggggagcgtttcgacgcccatgattttgccgaacaggcgaaagcggcgggcgccggcgcgctgctggtgagtcgtccgctggcctgcgatctcccgcaggtgattgtgaacgatacccggcaggctttcggtgagttagccgcctgggtgcgtcagcaggtgccgactcgcgtcgtcgccctgaccggctcgtccggtaaaacctcggttaaagagatgaccgcggcgatcctcagccagtgcggcaacacgctgtataccgccggcaacctgaacaacgatatcggcgtcccgatgacgctgctgcggctgaccaaagagcatcagtacgcggtgatcgaactcggcgccaaccaccagggcgaaatcgcctggaccgtcagcctgacgcgtccggaagcggcgctggtcaacaaccttgctgcggcgcacctggaaggtttcggttcgctggcgggcgtggcgaaggcgaagggcgaaatctataccggtctgccggaaaatggcatcgccatcctcaatgccgacaataacgactggctgaactggcaggcggtgattggcgatcgcaaagtgtggcgcttctcgccgaacgcggcgaacagcgatttcacggcgaccaacgtgcagatcaccagccacggcaccgaatttacgctgcagaccccaaccggcaacgttgacgtactgctgccgctgccgggacgccacaacatcgctaatgcgctggccgccacttcgctggcgatggcggtaggcgccgatttggcggcggtgaaagccggactggcgcagctgcaggccgttccgggacgtctgttcccgatccggctgaccgagagccagctgctgctggatgattcctataacgctaacgttggttcgatgaccgcggcggtgcaggtgctgtcagagatgcccggctttcgcacgatggtggtcggcgatatggcagagcttggcgcggagagcgcggcctgccatcgcgaagtcggcgaagcggcgaaagcggcggggctggattgcgtcctcagcgtcggcgccttgagcgcggatatcagccgcgccagcggcgtgggcgaacattttaacgataaagccgccgtggtggctcgcctgcgcgagctgctggcggagcacaaaataatgaccattttagtgaagggttcacgtagtgccgccatggaagaggtagtacgcgcattacaggagactgggacatgttag

SEQ ID NO: 5206 - DNA, 267 bp, Klebsiella pneumoniae
tcatcgccagatataggggcggaaaagcctggggccactgcgccagcgcggcagagaacgccacgccctgggccagctcgcggcccagcgcctcaagcagcgcctgccactgggcatgcgactgctgctgcgccagcagcgataacccttccgccagcggcaggccggcctgcagcagggacgccagctggcggatcgtttcgcaactgtagcgcgggtgccagaggctctgcttcaccgcacagcggcgtacggccagcggtatga

SEQ ID NO: 5207 - DNA, 642 bp, Klebsiella pneumoniae
tcaacaacagaatcaggcacaggcagaacaacaatgatcaaggcgacggacagaaaactggtagttggactggagattggcaccgccaaggtggccgctttagtaggggaagttctgcccgacggcatgatcaatatcatcggcgtgggcagttgcccatcgcgtggtatggataaaggcggtgtgaacgacctcgagtcggtagtgaaatgcgtacagcgcgccatcgaccaggccgaactgatggcggattgccagatttcatcagtttatttggcactttcgggtaaacatataagctgtcagaatgaaatcgggatggtaccgatttcggaagaagaagtgacgcaggacgacgtcgagaacgtggtccacaccgcgaagtcggttcgcgttcgcgatgaacatcgtgtcctgcacgtgattccgcaggaatatgctatcgactaccaggaagggattaaaaacccggtagggctgtccggcgtgcgtatgcaggcgaaggtgcatctgatcacctgccataacgatatggcaaaaaacattgttaaagcagtggaacgttgtggtctgaaagttgaccaacttattttcgccgggttagcggcccagttattcggtattaacagaagacgaacgtga

SEQ ID NO: 5208 - DNA, 978 bp, Klebsiella pneumoniae
atttgccaagaatttccttgccgaagcgggcgacatccgcgccgcggtgcggcagtatattgccgaagtcgaatccggagtctatccgggcgaagaacacagtttccattaaggagtcttgttgtgctgattattgaatccgtactgctgctgcggcagcatatccgccgtctgcgtcaggaaggtaagcgtatcgcgttggtcccgacaatgggcaacctgcatgatggtcatatgaagctggttgatgaagccaaagccagtgcggacgtggtggtggtcagtattttcgtcaatccgatgcagtttgaccgcgtcgacgacctggcgcgctacccgcgcaccttacaggatgattgcgaaaagctgaacaaacgtcatgtcgactttgtcttcgcgccgacgccggcggaagtgtacccccagggcactgaaggccagacctacgtcgacgttccgggattatccaccatgctcgaaggcgccagccgcccgggccatttccgcggcgtgtcgaccatcgtcagtaagctgttcaaccttgttcaaccagacgtcgcctgcttcggcgagaaagacttccagcagttggcgctgatccgcaagatggtcgccgatatgggctacgacattgagatcatcggcgtgccgatcgtccgcgcgaaagatggcctggcgctgagttcgcgtaacggctacctgaccgccgaccagcgcaaaatcgcgcctggtctgtataaagtgctgagcgcggtggcggaaaagctggccgccggcgatcggcagctcgatgagatcatcgctatcgctgaacaagagctgaatgagaaaggcttccgcgccgacgacattcagatccgcgatgccgacaccctgcttgagctgaccgatgccagccagcgcgcggtgatcctgatggccgcctggctggggcaggcccgcctgatcgacaaccggatcgtcacgctcgctcagtag

SEQ ID NO: 5209 - DNA, 420 bp, Klebsiella pneumoniae
tctgcagcggacgctgggcaggcgacagcagctccagcaccagcggcacctgcccctcggcgatcaccggcgtcgtggcctcgccgaacatctcctgcatacgcaccgccagcgctggcgggttctccgcatggtatcggatcgccaggcggctgccggtcggcacggtatagtgcgtcggcagctcgcgatccagcttttggcgcagcggccatggcagccagtcctgtagcgcctgacgcagatccagcgccttcagcgcccgcagggaatgaacgccgttcatctgcggcagcagccatgtctccagcgaggccagcagcgaagcgtcatccactgcgggccatgcctcttccggcagccactgcgccgcacagtgcagccgcaggcgcagctgctcagcctctggcgtccagttga

SEQ ID NO: 5210 - DNA, 855 bp, Klebsiella pneumoniae
cgtattttttttagtgaatggaaagaaacaatgcagcagttacagaacgttattgagtccgctttcgagcgtcgcgccgacattacgccggctaatgtggataccgtgacccgcgaagcggttaaccaggttatcgcccttcttgattccggcgcgctgcgcgtcgctgagaagatcgacggtcagtgggtgacgcatcagtggctgaagaaggcggtactgctctctttccgtattaacgataaccaggttatcgatggtgcggaaagccgctacttcgataaagtgccgatgaaattcgctgactacgacgaagcgcgtttccagaaagaaggtttccgcgtggtaccgccggccgccgtgcgccagggcgcgttcatcgcccgcaacactgtgctgatgccgtcctacgttaacatcggcgcctacgttgacgaaggcaccatggttgacacctgggccaccgtcggctcctgcgcacagatcggtaaaaacgtgcatctgtccggcggtgtcggcatcggtggcgtactggagccgctgcaggcgaacccgaccatcatcgaagataactgcttcatcggcgcgcgctctgaagtggttgaaggggtgattgtcgaagaaggctccgtcatctccatgggcgtttacctcggtcagagcaccaaaatctacgatcgcgaaaccggcgaagtcttctacggccgcgtaccggctggctcggtggtggtctcaggcaacctgccgtcgaaagatggtaaatacagcctgtactgcgcggtgattgtgaagaaagtcgatgccaaaacccgcggcaaggtcggcattaacgagctgctgcgcaccatcgactaa

SEQ ID NO: 5211 - DNA, 744 bp, Klebsiella pneumoniae
cagtctcaggaaagaaacatggctaccaatgcaaaacccgtctacaaacgtattctgctgaaattaagtggcgaagcgctgcagggctcagaaggcttcggtattgatgcaagcatacttgaccgcatggctcaggagatcaaagagctggttgagctgggtattcaggttggcgtagtaattggtggcggtaacctgttccgtggtgctggtctggcgaaagcgggtatgaaccgcgttgtgggcgaccacatgggcatgctggcaacggtcatgaacggcctggcaatgcgtgatgcgctccaccgcgcctatgtgaacgctcgtctgatgtccgccatcccgctgaatggcgtatgcgacaactacagctgggcagaggcaatcagcctgctgcgcaacaaccgcgtagtgatcctctccgctggtaccggcaacccgttctttaccaccgattccgcagcctgcctgcgcggtatcgaaattgaagccgatgtggtactgaaagccaccaaggttgacggcgtattcaccgctgacccggcaaaagatccttctgccaccatgtacgatcagctgacctacagcgaagttctggaaaaagagctgaaagtcatggatctggcggccttcaccctggcgcgtgaccataaattaccgattcgcgtcttcaacatgaacaaacctggcgccctgcgtcgcgtggtgatgggcgaaaaagaaggcacattgatcacggaataa

SEQ ID NO: 5212 - DNA, 969 bp, Klebsiella pneumoniae
acacgtaaggaaagcctgatgaacaactggccaaacccctttattgaacagcgtgcagacccctttatcctgcgccatcttagctactactactttattgcctcggtgccggaatacgaccggctggagatccggcgcgcagtaacccttgaaggattacgcgatgctgagccggtcgtggtttggcgcgcgccgcaaagcgggcccatgagccagctgatttgggcgccggagctgcatgaaatagacggtaagtggtatatctattttgccgccacccatactcacgatctggatgcgctggggatgttccagcatcgcatgttcgttctcgagtgcgctgacagcgatccgctgaccggccgctggcaggaaaaaggccaggtggtcacgcctttcgatacattcgccctcgatgccaccacttttacccatcaggggaaacgctggtatctgtgggcgcaaaaatccccgcatatcgaaggcaactcaaacctgtatctcgccgaaatggctaacccgtggacgttaaaaggcgagccggtcatgctgagcaagccggagttcgactgggagtgccggggatttaaggtcaacgaagggcctgcggtactgatgcatggcgataagctatttatcagctattccgccagcgccaccgatgaaaactactgcatggggttgttatggatcgaccggcaggccgatccgctgcagccggcaaactggcataaagctccgcagccggtgttccgcaccagctatgaaaaccgccagtatggcccaggtcataatagttttacccaaacgccggaaggggaagatgtgctggtgtatcacgcgcggaattacaccgagatagaaggcgacccgctgtatgatcccaatcgccatacgcggttaaagctggtcagctggcgggaagacgggatgcccgacttcggtattccaccggcggatacgctgtag

SEQ ID NO: 5213 - DNA, 1329 bp, Klebsiella pneumoniae
actttaaaggaactcgctatgagtatgtcaaactctcaggaagtcctcacttccacatcgggggcgaaaaaaagaagccgcgtacggatagttattctgctgctactctccgtcggaacgatgatcaattatctcgaccgtaccatcctgggtattgtagcgccacagttaagcaaagaaatccatatcgatccggcgatgatgggcatcatcttctccgccttcgcctggacttatgcgctggcgcagatccccggcgggatgtttttagaccgctttggcaacaaactgacctatgccctgtcaattttcttctggtcgctgtttaccctgctgcaaagtttcaccctcggcctaaaatccctgctgcttctgcgcctgggactcggcgtcagcgaagcgccctgctttccggccaacagccgcatcgtcagcacctggttccctcagcatgagcgcgcgcgggcaacggcaacatatacagttggtgaatatatagggctggccgctttctcgccgctgttatttttaattctcgaacatcatggctggagaacgctttttttcctcaccggcggattaggtattttatttactttagtgtggtggcgtttttatcatgaaccgcatgaatcgcgcacggctaatcaagcggagctggagtatatcggcgaaaacagcattaacaataaaatccagaacgttccatttaactggcgtgacgccagacgcctgctgggctgtcgccagatcctcggcgccagcctgggtcagttcgctggcaacaccacactggtctttttcctgacgtggtttcccagctacctcgccaacgagcgccatcttccatggctgcacgtcggcttcttcgccacctggcccttccttgccgccgcgattggcatcctcttcggcggctggatctccgaccggttgttgaagcgaaccggctccgtcaacatcagtcgaaagttaccaataatttccggtttattgctgtccagctgtattatcgcggcgaattgggtaagcgccaatagcaccgtaattattatcatgtcggtggctttttttggccaggggatggtcggtctgggctggaccttaatttctgatattgccccggaaaatatggcaggcctcaccggcggcatatttaatttctgtgccaatatggcctcgattatcgcaccactgataattggtgtgattatttccgccacgggtaatttcttttacgcgctgatctacatcggcctgacggcgctgattggggtgattgcctacatttttatcattggcgacattaagcgtatcgaactcaagtag

SEQ ID NO: 5214 - DNA, 1656 bp, Klebsiella pneumoniae
acggttcgggaagttacgggtagaggtggaaaccaccgtcgcgccgtcggccacgcgcgcctggttacccatacacagggaacagccagggatttcgatacgcgccccgctcttaccaaacacgctatagtagccttcttcggtcagctgcgcggcatccatacgggttggcggcgccacccacaggcgagtcggcagttggcctttgtggctgtccagcagcttaccggcggcacggaagtggccgatgttggtcatgcaggagccgatgaacacttcgtcgatcttctcgccctgcacatcagacagcaggcgggcatcgtccggatcgttcggcgcgcacagaatcggctctttgatatccgccagatcgatgtcgatcactgccgcgtattccgcgtcagcatcggcttccagcagctgcggatccgccagccatttttccatgccctggatacgacgctccagggtacggcggtcgccgtagccttcggcgatcatccacttcagcagaacgatgttggagttcagatactcaacgatcggctctttattcagtttgatggtgcagccggcggcagaacgctcagccgaggcatcggtcaactcgaacgcctgctcgactttcagatccggcagaccttcgatctcgaggatgcgaccagagaagatgtttttcttacctttcttctccacggtcagcaggccctgcttgatggcgtacagcgggatggcgtggaccaggtcacgcagggtgatccccggctgcattttacctttgaaacgcaccagcaccgattccggcatatccagcggcatcacgccggtcgcggcggcgaaggccaccagaccagagcccgccgggaaggagatgccgattgggaaacgggtgtgggagtcaccgccggtacccacggtatccggcagcagcatgcggttcagccaggagtgaatcacgccatcgcccggacgcagagaaacaccgccgcggttcatgatgaagtccggcagagtgtggtgcgtggtaacgtcaaccggcttcgggtaggccgcggtgtggcagaaggactgcatcaccaggtctgcagagaagcccaggcacgccaggtctttcagctcatcacgggtcattggaccggtggtgtcctgagaaccgacggaggtcattttcggttcgcaataagcgcccggacggataccggcaacgccgcaggcgcggccaaccattttctgcgccagcgagaagccgcgggtgctttccgccacgtctttcgcctgacggaagacatcgctgtgcggcaggcccagcgcttcacgcgctttggtggtcagaccgcgaccgatgatcagcggaatacggccgccggcgcgcacttcgtcgatcagcacatcggttttcagctcgaagctggccagcagttcgttggtctcgtggttacgcacttcgcctttgaacgggtaaacgtcgattacgtcgcccatgttcaggttagacacatcaacttcgataggcagcgcgcccgcatcttccatggtgttgaagaaaattggcgcgattttaccgcccagacacaggccgccgccgcgcttgttcggcacgttcgggatatcgtcgcccataaaccacagcaccgagttggtggcggatttacgtga

SEQ ID NO: 5215 - DNA, 2463 bp, Klebsiella pneumoniae
gccggcagggaacaggcggagtcgccggagtggacgcctgcctgctcgatatgctccatgatgccgccaatcagcaccatttcgccatcgcagatgggcatcgacatccacttcaatcgcatcgtcgaagaagcgatccagcagcaccggcgcgtcgttggagacgctgaccgcggtctggaagtagcggcgcagatcctgctcgtcatagacgatctccatcgcccggccgccgagcacataagacggacgcaccaccagcgggtagccaatctctttcgctttctctaccgcctgctcaatggcggtgacggtggcgttcgccggctgcttcagcttcagacggtcaaccgcgtgctggaagcgctcacggtcttccgcccggtcgatagcgtccggactggtaccgataaccggcacgccggcagcttccagggcacgagccagtttcagcggggtctggccgccgtactggacgataacgccttttggcttctcgatgcgcacgatttccagcacgtcttccagggtcaccggctcaaaatacagacggtcggaggtgtcgtagtcggtagagacggtttccgggttacagttgaccatgatggtctcgtaaccgtcctcgcgcagcgccagcgaggcgtgtacgcagcagtagtcgaattcgataccctgaccgatacggttcgggccgccgccgaggaccatgattttatcgcggtcaacggacgggttggactcacactcttcttcataagtggagtacatgtaggcggtatcggtagcaaattccgcagcgcaggtgtccacgcgcttgtagaccgggtgcaggtcatactggtcgcgcagcttgcggatttccgcttcccgcacgcccgccagcttcgccagacgcgcatcggcaaagcctttacgcttcagggtgcgcaggaagtcagcgtcgaggccgttgatgcccacttccgccactttctcttccagacggaccagctcttcaatctgtaccaggaaccagcggtcgatgttggtcaggttgaagacgccgtcaaccgagaggcccgcgcggaacgcgtcagcgatataccagatacgctcagcgccggcatctttcagctcgcggcggattttggtcagcgcttccgggtcgtcgaggctcactttcggttcgaagccggtagcgcccacttccagaccgcgcagcgctttctgcaaggattcctgctgggtacgaccaatcgccatcacttcgccgacagacttcatctgggtggtcagacggtcgttggcgccggcgaatttttcaaagttaaagcgtgggattttagtgaccacgtagtcgatggacggttcaaaggaagccggggtgcggccgccggtgatgtcgttcatcagctcgtcaagggtataacctaccgccagcttggctgccactttagcaatcgggaagccggtggccttagaggccagcgccgaggagcgggagacgcgcgggttcatttcgataacgatcaggcgaccgtttttcgggttgaccgcgaactgcacgttagagccgccggtttcgacgccgatttcacgcagcaccgccatcgaggcgttacgcatgatctggtactctttgtcggtcagggtctgcgccggggcaacggtgatggagtcaccggtgtggatccccatggcgtcgaagttttcgatggagcagacgatgatgcagttatcgttcttatcgcgcaccacttccatctcgtactctttccagccgatcagcgattcatcgatcagcagttcgctggtcggagagagatccaggccgcgttcgcagatttcttcgaactcttcgcggttataggcgataccgccgccggtgccgcccatggtgaaggacggacggatgatgcacgggaaaccaacgtcggcggcaaccgccagcgcctcttccatcgtgtgggcgataccagagcgcgcggtgtcgaggccgatttttttcattgcgatatcgaaacggcgacggtcttcggctttatcaatcgcatcggcggtggcgccaatcatggtcacgccgaattcagccaggaccccctgacgctccagctcgagcgcgcagttcagcgccgtctggccgcccatggtcggcagcaccgcatccgggcgctctttttcgatgattttacgcaccacttcccagtgaatcggctcgatgtaggtggcatcggccatttccgggtcggtcatgatggtcgccgggttagagttcaccaggataacgcggtagccctcttcgcgcagcgctttacaggcctgggcgccggagtagtcaaactcacacgcctgaccgataacaatcgggcccgcgcccagaatcaggatactttttatgtctgtacgttttggcattgctttcttctccgaagaacctgtttatggtcgtcgcgagcgatgggtagacaaggaaaaaatttgtga

SEQ ID NO: 5216 - DNA, 843 bp, Klebsiella pneumoniae
acagttggggagtctatgcagtatttgggtaaagtgattggcgtggcagtggctttgctgatgggtggtgggttctggggcgtggtgcttggctttctggtcggccatatgtttgaccgggcgcgcagccgccggttaaatctcttcgccaatcagcaggagcgtcagtcgctcttcttttccaccaccttcgaagtgatggggcacctgaccaaatccaagggccgcgttaccgaagcggatattcatgtcgccaatgtgctaatggatcgcatgaacctgcatggcgcctcgcgcaccgcggcgcagcaggcgtttcgcgacggtaaggccgacaactatcccctgcgcgagaaaatgcgtcagctgcgcagcgtctgctttggccgtttcgatctgattcggatgtttctggaaattcagctgcaggcggcgttcgctgatggcgaactgcatcctaacgaacgtgaagtgctgttcgtcattgccgacgagctcggcatctcccgcgcccagttcgatcaattcctgcggatgatgcagggcggcgcccagtttggcggcggttcgcagcagcgctcttatgggcagcatggcggcaacgccggctggcagcaggcgcagcgtgggccgaccctcgaagatgcctgcaatgtgctgggagtaaaacctaccgacgacgcggcgacggtgaagcgcgcctatcgcaagctgatgaacgaacatcatccggacaagctggtagcgaaaggtctgccgccggagatgatggagatggccaaacagaaggcccaggagatccagaaggcctgggagctgatcaaagagcagcgcggcttctga

SEQ ID NO: 5217 - DNA, 2001 bp, Klebsiella pneumoniae
tgcccaggggagaccggcatgaatacgcgtctctcgccgttagctattatcctgctggccgggctgctgggcgtcgccttcgcgctgagcatcgtcaacctcaatgtcgccttgccctatgcgcagtggcggcaggcgctgtggcagccggatgtcgatgatatcgcccaaatgttgtttcattacagtttgttaccgagactggctgttgcgctgctggtgggcgccgggctgggactggttggcgtcctgttccagcaggtgctgcgtaatccgctggcggaaccgaccacccttggcgtcgccaccggcgcgcagctggggataacggtcaccacgttatgggctattcccggcgtgctggcgtcgcaattcgccgcgctggccggggccagcctggtgggcgcgctggtgtttggcgtctcgtggggcaagcgcctgtcgccggtaacgctgatcctggcggggctggtggtcagcctttactgtggcgcgcttaaccagctgatggtgattttccatcacgaccagctgcaaagcatgttcctgtggagcaccgggacgctgacgcagaccgactggagcgtggcgcagcgcctgtggccgcagctgcttggcggggcaatactcaccttgctgctgctgcggccgctgaccctgatggggctcgatgacggggtggcgcgtaacctcgggctggcgctgtccctggcgcgcctcggcgccctgacgctggcgatcgtcatcagcgcgctgctggtgaacgcggtagggattatcggctttatcggcctgttcgcgccgctgctggcgaaaatgcttggcgcccgtcggctgctggcgcggctgctgctggcggcgctgatcggcgcgctgctcctgtggctttccgatcaggtgatcctctggctgagccgggtatggcgggaagtctccactggctcggtcaccgccctgattggcgcgccgctgctgctgtggctgctgccgcggttgcgcagcatcagcgccccggtgatgaacggcggcgataatgtgcagcctgagcgctattatgtgcaatggtttgttctcgcaggcgtcgcgttgctgctgctggcggtgagcgtggcgctggcctttggtcgcgatgcccacggctggctgtgggcccacggcgatctgctggagcaactcctgccctggcgctggccgcgggtgctgtcggccctgttcgccggggtcatgctggcggtcgccggctgtattatccagcgcctgaccggcaacccgatggccagcccggaagtgctgggcatcagctccggcgcggcttttggcgtggtgctgatgctgttcttcgtgcctggcgacgcctttggctggctgctgccggccggcagccttggcgcggcggccaccttgctgatcattatgctcgccgccgggcgcggcggcttctcgccgcatcggatgctgctggcggggatggcgctgagcaccgccttcactatgctgctgatgatgctgcaggccagcggcgatccgcgtatggcgcagatcctgacgtggatctcggggtcgacatatagtgcgacgccggagagggtagtgcgtagcggcgcggtaatgctggcgctgctggcgctggcgccgctctgtcgtcgctggttaaccatcctgccgctgggcggggaggcggcgcgagcggtgggcatggcgctgacgtcatcgcggattgttctgctgctgctggcggcctgcctgacggcggcggcgacgctgaccatcggcccgctgagctttgtcgggctgatggcgccgcatatcgcgcggatgatgggcttccggcgaaccctaccgcatatggtgatttcagggctgactggcgggctgctgctggtcttcgccgactggtgcggacggatgatgatgttcccgtatcagatcccggcggggctactgtcgacctttatcggcgcgccttactttatttatttgctgagaaagcagagtcgctaa

SEQ ID NO: 5218 - DNA, 846 bp, Klebsiella pneumoniae
caggacttactctattattgtcgaaaatatcgacactgctggacatactccatggctatctctattaagacatctgaagacatcgaaaaaatgcgcgttgccggccgcctggccgccgaagtgctggaaatgatcgaaccctacgtcaaaccgggcgtcagcaccggcgaactggaccgcatctgtaacgactatatcgttaacgagcagaaggccatttccgcctgcctcggctatcacggctatccgaaatccgtctgcatttcggtcaatgaagtggtctgtcacggtatccctgatgacggcaagctgctgaaagatggcgatatcgtcaatatcgacgtgaccgtcattaaagatgatttccatggcgatacctccaaaatgtttatcgtcggcaaaccgacgattctcggcgagcgcctgtgccgcatcactcaggaaagcctgtacctggcgctgagaatggtgaagccaggcatcaacctgcgcaccatcggcgcggcgatccagaaatttgtggaagcggaaggtttctccgtggtgcgcgagtactgtggccacggcatcggccgcggcttccatgaagaacctcaggtactgcactacgattcgccggagaccaacgtcgtactcaaaccaggcatgaccttcaccatcgagccgatggtcaacgccggtaaaaaagagatccgcagcatgaaagacggctggacggtgaaaaccaaagaccggagcttgtctgcgcagtacgagcatactattgtggtgacagacaacggctgcgaaattctgacgctacgcaaggatgacaccatcccggcgataatctcgcacgatgaatga

SEQ ID NO: 5219 - DNA, 870 bp, Klebsiella pneumoniae
tgggggtcacttttgctgaagtatcgcctgatatctgctttcgtcttaatccccatcgtcattgcggcattgtttttattgccgccgatgggctttgctatcgtcaccctggtggtctgtatgctcgccgcctgggagtggggacaactgagcggttttacctcgacgtcgcagcgggtttggctggcggtgctgtgcggccttctgctggcggcgatgctttttctgctgcctgaataccattatgacgttcatcaaccgatggttgaagggtcgctatgggcctcttttgcctggtggatcgtcgcgttactgctggtgctctcatacccggcgtcggcggcattctggcgccactctaaggtgctgcgcctcatcttcggcattctgaccatcgtcccgtttttctggggcatgctggcgctgcgcgcctggcactatgccgataaccactatagcggcgcgctgtggctgctgtacgtcatgatcctggtgtggggcgcagactctggcgcctatatgtttggtaaaatgtttggcaagcacaagctggcgccgaaggtctcaccgggtaaaacctggcagggcttttttggcggtttgctgaccgcggcagtgatttcctgggcctacggcgtgtgggcccatcttgacgtcacgccgacggtgctgctggtctgttcggtggtggcggccctggcttcggtgctgggcgacctgacggaaagtatgtttaagcgcgaggccggcattaaggatagcgggcacttgattcccggacatggtggtattctcgatcgtatcgacagcctgacggcggcggtaccggtcttcgcctgtctgctactgttggtcttcaggacgatttga

SEQ ID NO: 5220 - DNA, 582 bp, Klebsiella pneumoniae
ctgtctacactcttgctgattacgacaagagcaaacgcaggccaatcaatgattctgataatttatgcgcatccttatccgcagcattctcatgcgaataagcgaatgcttgaacaggcagggacgcttgaaggcgtagagatacgctccctctatcaactctatcccgactttaatatcgatgttgccgccgagcaggcggcgctggcccgtgccgatctggttatctggcagcaccctatgcaatggtatagcgtaccgccgctgctcaagctgtggatggacaaggtgctgtcgcacggttgggcctatggccataacggtattgccctgcgcggtaaatcgctgatgtgggcggtcactaccggcggcggtgaaagccactttgatatcggttcgtttcccggtttcccggtgctggcgcagcctctgcaggcaaccgcgctttactgcgggatgaaatggctgccgccgttcgctatgcactgcacctttatctgcgatgatgaaacgctgcaggcgcaggcccgccgctatcgtcaacgcttaatcgactggcaggaggcacaccagaatggatag

SEQ ID NO: 5221 - DNA, 225 bp, Klebsiella pneumoniae
attaacctttgggcccggtcatttgatcgggctttttattttattgcggagaaaattgcgatctcacgcacaaaaaccaattttaatttgctgattgtcagaccttaccgccaccctgccctaccgcctaaagaagaattattccgctttcctccccttctccagcactgcttatgtattttccctgcactgcaagtaaaaataaggcacgagtatttaatataa

SEQ ID NO: 5222 - DNA, 561 bp, Klebsiella pneumoniae
ttcatcatttggtcacatgacatttccggcctgttgcattcgctaaaagattgccgcaggccgtgttattattgccttttagtacatttagacaggaagagtattttgactactgacactcatactctgcacattgaaaagattgtggaacttctgcctcaccgttacccgttcctgctggtagaccgcgtgctggattttgaagaaggtcgttttctgcgcgcagtaaaaaatgtttctgtaaacgagccgtttttccaggggcacttccctggtaagccgattttgccgggcgtcctgattctggaagcaatggcgcaagccaccgggattctggcgttcaaaagcgtcggaaaactggaaccaggcgagctgtactacttcgcgggtatcgatgaagcacgcttcaaacgcccggtagtaccaggcgatcagatgattatggaagtcactttcgagaaaacccgccgcggcctgacccgtttcaaaggcgttgcgctggttgacggtaaagtggtttgcgaagcgacgatgatgtgtgcgcgtagccgggaggcctga

SEQ ID NO: 5223 - DNA, 1794 bp, Klebsiella pneumoniae
accgaccgctgcagattgtcgcctccgatcagtgctgcgcgctgggggcggctatcttcgccgccgtcgccgccggcgtctatgaggatattccagccgcccaacagcggatggcaagccaggtggaaactaccctgcagccgcgtccggcgcaggcacagcgtttcgaacaactctatcagcgctaccagcaatggtcggtcagcgcggaacaacactatctcccttcggctgcaaaggcggaaaaagccccgcaatctcaggcagcgctcacctattaaggatacgaaaatgacgatttttgataactatgaagtatggttcgttattggcagccaacatctgtacggcccggaagccctgcgccaggtgacgaagcatgccgaacatgtggtgaacagcctgaatgcggaagccaaactgccgtgcaaactggtccttaagccgctgggcaccaccccggacgagatcacccatatctgccgcgacgccaactacgatgacaaatgcgccgggttagtggtctggctgcataccttctcgccggcaaaaatgtggatcaacggcctgaccatcctcaataagccgctgctgcagttccatactcagtacaacgccgcgctgccgtgggacagcatcgatatggactttatgaacctgaaccagaccgcgcacggcggccgcgagttcggcttcatcggcgcccgcatgcgccagcaacacagcgtggtcaccggccactggcaggataaagaggcccaccagcgtatcggcggctggatgcgtcaggcggtctccaaacaggatacccgtcatctgaaagtgtgccgtttcggcgataacatgcgcgaagtggcggtgaccgacggcgataaagtcgccgcgcagattaagtttggcttctcggtgaacacctgggcggtcggcgatctggtgcaggtggtgaacagcatcagcgacggcgatatcagcgccctggtcgatgaatatgagagcagctaccgtctgaccccggcagcgcaggttcacggcgagaagcgccagaacgtgctggacgccgcgcgcattgagctggggatgaaacgcttcctcgaacagggcggtttccacgcctttaccaccacctttgaagatctccacggcctgaaacagctcccgggtctcgccgtacagcgcctgatgcagcagggctacggctttgccggcgagggcgactggaaaaccgccgctctgcttcgcatcatgaaggtgatgtcaactggtctgcagggcggcacctcctttatggaggattacacctaccacttcgacaatggtaacgatctggtgctcggctcgcacatgctggaagtgtgcccgacgatcgccaccgccgagaaaccgatcctcgacgttcagccgctgggcatcggcggcaaagcggatccagcgcgcctgatcttcaatactcaaaccggcccggcgatcgtcgccagcctgatcgacctgggagaccgcttccgtctgctggtcaataccatcgaaaccgtcccaacgccgcacgatctgccgaagctgccggtggccaacgccctgtggaaagcgcagccggatctgcgtaccgcgtcggaagcctggatcatcgccggcggcgcgcaccataccgtcttcagccatgcgctgaacctcgacgatatgcgccagttctccgagctgcatgatatcgagctgaccgtcatcgacaacgatacccgtctgccgtccttcaaggacgcgctgcgctggaatgaagtgtattacggttcaaaacgctaa

SEQ ID NO: 5224 - DNA, 1419 bp, Klebsiella pneumoniae
cgacgccgctgtccctttacgctgaaaatgaataataacgacagggctgaatttatgagcaccacagacaatgcattctctgcaacccttgaaccgatcgatacgccgaaaaccacgctcaagcagcgctggtggcatattatggataactggaaggtggggatcgtcccgctgccgctgtttctgctggccggaggactgattgccctcgactgccttggcggcaaactgccgagcgatatcgtggtgatggtggccaccctggctttctttggcttcgcctgcggcgagtttggtaaacgcctcccggtgctggggaaactcggtgcggcggcgatctgcgccacctttattccttccgcgctggtccactatggtctgctgcctgacgtggttattgaatccacgaccaaattctataaatccactaacattctctatctctatatctgctgcatcattgtcggcagcatcatgagtatgaaccgcaccacgctgattcagggctttctgaagatcttcttcccgatgctgtgcggcgaagtggtcggcatgctggtgggcatcggcgtcggcacgctgctgggcatggagccgttccaggtgttcttctttatcgtgctgccgattatggccggcggcgtgggagagggggcgatcccgctgtcaatgggttatgccgcgctgatgcatatggagcagggcgtggccctgggccgggtattgccgatggtgatgcttggcagcctgacggcgatcctcatctccggctgcctcaaccagctcggcaagcgcttcccgcatctgaccggcgaagggcaactgatgccgaaccgcagccatgaaacccgcagcctcagcgagagcgaaggcgtgagcggtaagaccgacgttgggaccctcgcctccggcgcgctgctggcggtactgctgtatatgatggggatgctcggccacaaactgattggtctgccggcgccggtaggcatgctgttcctcgcggtgctgttaaagctggctaacgtggtgtctccgcgtctgcaggaggggtcgcagatggtgtataaattcttccgcaccgcggtcacctacccgatcctctttgccgtcggcgtggcgatcactccgtggcaggaactggtaaacgccttcactttaaccaacctgctggtgatcgtcagtaccgtctccgcgctggtggcgaccggtttcctggttggtaaaaagatagggatgcacccgatcgatgtggcgattgtttcctgttgccagagcgggcagggcggcaccggcgatgtggcgatcctgaccgccggcaaccgcatgagcctgatgccgttcgcgcagatcgctacccgcatcggcggggcgataaatgtctcgctggggttgctgttcctcagccactatctggcgtga

SEQ ID NO: 5225 - DNA, 936 bp, Klebsiella pneumoniae
ttatcgaagtggccgaccgcggcgtcggcatccgccccgatatccgcgagcgcatttttgaacgcggcgtcaccaccaaaacccgtggcgatcacggcattggtctgtatcttattgaacattatgtcactcaggcgggcggcaccatcgaagtcgccgataacgcgccgcggggaacgatcttcaccctatttatcccggccgacgcgcacgcctgtccgcaaccggaggcccacgatgcatcatgacctggtcgatgtgctaatcattgaagatgagagcgaactggcgcgcctgcacgccgagcttgtgcaaaaacacccgcgactgcggctggcaggcatggcggcctccctcgcccaggcgcggcagctgcttcacgccacgccgccgcagctggtgctgctggataactatttaccggacggcaaaggcgtcacgctgatgaccgacccggcgctggcgaccagccaatgctcggtgatctttatcaccgccgccagcgatatggaaacctgcagccaggccatccgcaacggcgccttcgactatatccttaagccggtatcatggaagcggctgagccagtcgctggagcgcttcatccagttctacgatcagcaacgggagtggaaaatcgtcgatcagcaaaacgtcgattccctctatcaactgcaggcgaagaactatcgcgtggatagcggcagcaaggggattgaagagaaaacgctggcgctggtgcagggactgtttagcgaccgggaagcgcactgtttttccgttgatgaagtggtcagcgccgccgggctcagcaaaaccaccgcccgtcgctatctggagcacggcgttgagaccggttttctggaagtggagatgctgtacggaaaaattggccatccgcggcggctgtatcgccgcgctaaggtcaaaagttaa

SEQ ID NO: 5226 - DNA, 2562 bp, Klebsiella pneumoniae
attcccccccgcgcctggaaaaagggcgaaacgctggaaagcctgatccctgaagctttcgccgtcgttcgcgaagccagtaagcgcgtattcggcatgcgccacttcgacgtccagctgctgggcggtatggtgcttaacgatcgctgcatcgccgagatgcgtaccggtgaaggtaaaaccctgaccgcgaccctgccggcgtacctcaacgcgctaaccggcaaaggcgttcacgtagtgaccgtcaacgactatctggcccagcgtgacgccgaaaataaccgcccgctgtttgaatttctgggcatgacagttggcatcaacatgtccggcctgccggcgccggcgaagcgtgaagcttacgctgccgatatcacctatggcaccaacaacgaatacggcttcgactacctgcgcgacaacatggccttcagcccggaagagcgcgttcagcgtaaactgcactatgcgctggtggatgaggtggactccatcctgatcgatgaggcgcgtacgccgctgatcatttccggcccggcggaagacagctctgaaatgtaccgcaaggtaaacaaaatcatcccgcatctgatccgccaggaaaaagaggattcggatactttcactggcgaaggccacttctcggtggatgaaaaagcgcgtcaggttaacctgaccgaacgtggtctggtgctgattgaagagctgctggtacaagaaggcattatggatgaaggtgagtccctgtactctccaaccaacattatgctgatgcaccacgttaccgccgcgctgcgcgcccatgcgctgttcacccgcgacgttgactacattgtcaaagatggcgaagttatcatcgtcgatgagcacactggccgcacgatgcagggccgccgctggtccgatggtctgcaccaggccgttgaggccaaagagggcgtggagatccaaaacgagaaccagactctggcctctatcaccttccagaactacttccgtctgtacgagaagctggcggggatgaccggtacagccgataccgaagcctttgaatttagctctatctataagctggacaccgtggttgtaccgaccaaccgtccgatgatccgtaaagatatggcggatctggtctatatgaccgaagcggaaaaaattcaggcaattatcgaagatatcaaaactcgtaccgctgccggtcagccggtgctggtggggactatctcgatcgaaaaatctgaagtggtttcccgcgaactgactaaagccggcatcaagcacaacgtcctgaacgccaaattccacgccagcgaggcggatatcgtcgcccaggcgggctacccttccgcggtgaccatcgccaccaacatggcgggtcgtggtaccgatattatgctcggcggtagctggcaggcggaagtcgctgcgctggaaaacccaacgccagagcagattgagaaaatcaaagccgactggcaggtacgccacgatgcggtactggccgcaggcggtctgcacatcatcggtaccgagcgtcatgaatctcgccgtatcgataaccagctgcgcggccgtgctggtcgtcagggggatgccggttcttcccgcttctacctgtcaatggaagatgccctgatgcgtatcttcgcctccgatcgcgtgtctggcatgatgcgtaaactgggaatgaaaccaggtgaggcgattgagcacccgtgggtcaccaaggcgatcgccaacgcccagcgtaaagtggaaagccgtaacttcgatatccgtaagcagctgctggaatatgatgatgtggccaacgaccagcgccgggcgatctacacccagcgtaacgagctgctggacgtgtctgacgtcagcgaaaccatcaacagcatccgcgaagacgtctttaaggcgacgatcgatgcccatattccgccgcagtcgctggaggagatgtgggatatcgaaggtctgcaggagcgtctgaaaaacgacttcgacctcgacctgccaatcaaagagtggctggataaagagccggagctgcatgaagagaccctgcgcgaacgtattctgcagagcgcggtagaaacctaccagcgtaaagaagaagtggtcggcgccgagatgatgcgccacttcgagaaaggcgtgatgctgcagactctggattcgctgtggaaagagcacctggcggcgatggattacctgcgccagggtatccacctgcgcggctatgcgcagaaagatccgaagcaggagtacaagcgcgaatcgttctcgatgtttgccgcgatgctggagtcactgaagtatgaagtgatcagcaccctgagcaaagtccaggtgcggatgccggaagaagtcgaggcgatggaacagcagcgtcgtgaagaggccgagcgcctggcgcagatgcagcagctcagccatcagagcgatgatgaagccgcagcccaggatctggcggcgcaaaccggcgaacgtaaagtgggccgtaacgatccgtgcccgtgcggctccggcaaaaagtacaaacagtgccacggccgtctgagctaa

SEQ ID NO: 5227 - DNA, 732 bp, Klebsiella pneumoniae
  unsure (81),(92): Identity of nucleotide at the above locations are unknown.
ccatcagcccggaaacggctgaaccgctgccgcgcctggccgccctgctccacgatgtgccgccggcgcctctgttcaaanaagtgctcaanctgctgcaggcccgggtatggtaccaaacctacttgctgctggcgggaatacagcctgttccagccgctgttcccgaccatcacccgctactttaccgagcgcggcgacagcccgatggagcggatcatcagccaggtgctgaagaataccgatacccgcattcataacgatatgcgcgtcaatccggccttcctcttcgcggtgatgttttggtatccgctgctggagacggcgcaaaaaatcgctcaggagagcggcctggcgtactacgacgccttcgccctggcgatgaacgatgtgctggacgaagcctgccgtacgctggcgatccctaagcgcatcaccacccttattcgtgatatctggcagctgcagctgcgcatgtcccgtcgtcagggcaaacgcgcctggaagctgatggagcatccgaaattccgcgccgcctatgacctgctggagctacgcgccggcgccgagaacaaccacgaactgcagcgcctgaccaaatggtggggcgaattccaggtcgccgcgccgccggcgcaaaaagatatgctcaacgaccttggggacgatccggcgccgcgccgtcgtcaccgtcgtccgcgcaagcgcgcgccgcgccagggtagcgcatga

SEQ ID NO: 5228 - DNA, 354 bp, Klebsiella pneumoniae
gccggccaccggctcttccaccaccatttcgcccagctgacgcatgatcaggaaagcgataaaaccggcgatagcgtaaccaagaatgatacccgggccggcggactgaatgacggacgcgctccccagaaacaggccggtgccgatagccccgcccagcgcgatgagctgaatgtgacggtttttcaggccgcgcttcagccgatcgccgtgctgttgaccttccatatgaaacctcgtgtgtggttattttttgtgtacgtcatccgtcaggttgctgcttcactgctgtccctgcctgaaagcatagccagcgaaaatttgggcgaagtggcccactttttacctgagtga

SEQ ID NO: 5229 - DNA, 396 bp, Klebsiella pneumoniae
cccgcgcaccggcctgacccggctggtgacgcagcgcatcagccaggcatcgatgacgcagcgtgccggacgcgccggtcgtctctccccggggatctgcctgcatttgctcggcaaagaacaggcggaacgggcggcggcgcagagcgagccggagatcctgcacagcgatctgtcggcgctgttgctggagctgctgcagtggggctgccacgatccggccgcgctggcctggctggatcagccgcccgcggtcaatctggccgccgcgcgtcgcctgctggaggcgctgtcggcgctggacggcgagcggctgtcggcgtttggccgcaaaatggcagcgcttggcaacgagccgcggctggcggcgatgctggccgccgcgcagaccgatga

SEQ ID NO: 5230 - DNA, 807 bp, Klebsiella pneumoniae
ccgggcagccgtcgcgacccggctgggtcacggtcaaccatctgctgctggagcgcgacgatgaaggctaactggatcgcgggcggactgctgctggtcctctatctgttgtggctcaccgccaccgctccggcgcgcctgctggctcccatgctgccgcccggcgtacaggtggggcaatttagcggcagcgtctggcgcggcgcggcgcaaccggtctactggcatggggaacggcttgaacgactggcgtggtcgctgaccctggcgggctggcaggtctctctcagcgatccccgcggcgtgatgggtcaggcccggctgtggggccttcgcgatctgcgcctacaggaggggcggctcaccgcccccgccagcctgctcagccgctggttgatgtcgactatgcccgtcaaggccgcgggggaggtcaccttcagcctgaccgaagggcggttcagcgacggacgctgccggcatatcatcgccggaggcgcgcagtggcggcaggcccgactgcactccccggtcggcagcctggagctggcccaggttaatggcaccttccgctgtacggaggacggcgccgtggcgctgactctccgtcaggactctcatcagctgagcctcagcggccaggggactctgtcgcccgatggccgctatctgtttcgcggcacgctacagccccggcaggggatgccgccgctgctggcgctgctggtcacgcgcccgacagcgaataacgccccgggcccgacgccgtggcagctgcagggaaaatggttaccacaggagcaaaaatga

SEQ ID NO: 5231 - DNA, 858 bp, Klebsiella pneumoniae
agtgtattacggttcaaaacgctaagaggccgtcccctcacccttcccctctccccgttggggagaggggaccgaccgggcgccatgccgcctttctccctctcccgccgggagagggtcggggtgagggatacccgactcgcctgctattcggagcacactatgttagaagatcttaaacgccaggtgctggaagctaacctggccctgccaaagcataatctggtgaccttaacctggggcaacgtcagcgccgtcgaccgcgagaaaggggtgttcgtgatcaaaccctccggcgtggattaccgcgtgatgaccgccgacgatatggtggtggtcagtctggagagcggcgaagtggtagagggtaataaaaagccctcgtcggataccccgacccatcgcctgctgtatcaggctttcccgacgctgggcggcattgtgcatacccattcgcgccacgccaccatctgggcgcaggccgggcaatctattcccgcgaccggcactacccatgccgactacttttatggcccggtgccctgcacccggttaatgaccgatgcggagatcaacggcgactatgagtgggaaaccggcaacgtgattgtcgaaaccttccgccagcagggaatcgacccggcgcagatgcccggcgtgctggtccattcccacggcccgttcgcctggggcaagaacgccgaagacgcggtgcataacgccatcgtgctggaagagatcgcctatatggggattttctgccgccagctggcgccgcagctgccggctatgcagcaaaccctgctggataagcactatctgcgtaagcatggggccaaagcctactacggccaataa

SEQ ID NO: 5232 - DNA, 438 bp, Klebsiella pneumoniae
atttcggtacgcagaatcataggaatttcccgcgccagcacgtcgcgaataatcccgccgccgacgccggtcaccacccccatgcacaccgcgaccagcgggccgctgccagcgagaaaagctttattgacgccaatgccgacaaacaccgccagaccgacggcatcaagaacgggcaggatccatttcggcagccggcgaggctggcggaccagcaggatggtcagcatgctggtgaccatcgccaccaccagatcggtgggatctttgacccagaataccgggccattcgccagcgccatgtcgcggatggtcccgccgcctaccgccgtcactacccctaacaccagcacgccgaatgggtccatacgcagttttccggccagcagtacgccggagatcgcgaagacagctgtgccaataatatccagccaatag

SEQ ID NO: 5233 - DNA, 2091 bp, Klebsiella pneumoniae
ctaaggacacgcctgggccccgcatatcggcctcccggcctcctgtggagagaagagatgagccactatccgcaccttttcagtccgttgaccatcaacggtatgacgttaaaaaaccgcattattatgccccctatgggcaccaatatggccacgctcaatggcgaggtgtcgcaggaacagctggaatactacgaactgcgggccaaaggcggcaccgggcttatcaccatcgaaaatatttgtattgatttccccttcgcctccaacggcaccacccaactgcgcatcgataacgatcaatatattccacggctgtttaaattaaccgagaccctgcataaacatggcgcctgcgtatccattcagttaaatcatgccggcgcttccgcttatgcctaccgactggaaggccagacgccgctctcctcttctacaacgccgtcgaagaagcacggtaatattccgcgtccgatgacccatgaggaaatttatcatgcggtagagaaatttggtgacgccgcggagcgcgttcggcgcgcaggttttgactgcgtcgaaattcatgccggtcactcctatttaattagccagtttttatcgccgctgtttaataagcgcactgatgaatttggcggcagcgtcgaaaatcgcactcggatactgagtctgattgtcgataaggttcgcgcctgcgtggggccgcgttttccggtcagcctgcgcatcagcgccgacgacttcctcaagggcggcaataccctcgaagattccctgcgtattcttgagctctgccaggagaaggtcgatatcatcaacgtctctgcggcgcagaacgacaacctgaatctgcaaatcgatcagatgtcgctggaggatggctggaagcgctatctctcccgcgcggtgcgcgataaattccataaacccacggtcatcgccggcaatattcgcactccgcaggtagccgaagatatcctcgccagcggcgatgccgatcttatcgccattggccgcggtctgattgccgagccggagtgggtgcagaaagtgcaaggcggaaaagagcgactgatgcgcaaatgtatctcctgcaacatcggctgcgccgaccatcgcatcgctcgctcgcgcccgctgcgctgttcgattaacccggatattattcacggtgacgcctataaaatgcggcgcgtgaatcgcgacactaacgtggtggtcatcggcgccggcaccgccgggatggaagccgcctgcaccgcggcggaagtgggttgccatacctggctgctggaagcgaaaaaccacgtcggcggcctcgccagggaaatctcccgcctgccggagaaaaaacgcatcgctgatttcccgcagtttatgaaaaatcgtatcgcctcgctggacaacctgatgctgcagatcggcaagcgggccgacgtggcttcagtttccgccctgcgtccgcatctgattgtcaacgccaccggctcaacgccgctgctgccgcccattgaaggcttgcgggaaaacattgacgtcgagaacggcaagatcttttccattaccggcatgatcgacaatctggcgaaatttaccgatatcaagggcaaacgcatcgccgtagtcggcgccggcgccgttggccttgacgttatcgaatactttaccgctcgcggcgcacaggcggtgctaatcgagatgcaggacgccgccggtcgcgatctcgacatcattaccaaaaatgccatgttgaccatgctcgacgagcaccaggtcgaacagcacatgaatacccaactgatggcggtcgctgccgaccatttccaggtgaaaaatacacagcaaaccttcgatattcccttcgactacggctttgtctgtctcgggatgcgcgccaaccgcacgggtctcgacgagatcgagcgctgggccaatgccaataacgtcaaaatcatgaacatcggcgacagcgtgatggcgcgacgcattatcgatggcgtccgcgaaggccgcaacgtactggatgcactggaagacatgggtgcgctgggcagccgcgaagcacaacgaattccctttctaacttattga

SEQ ID NO: 5234 - DNA, 225 bp, Klebsiella pneumoniae
gtcagaacgctgacaggagggcatgtggaccactattgtgagttaatacgcaagcggtatgcggaaatagccagcggagacttagggtatatcccggatgcgctgggttgcgtgttgaaagtattgaatgagattgcggcggatgaggccctttcggagtcagtcagggaaaaggccgcttatgcggcagcaaacttactggtgagcgattatgtcaatgaatga

SEQ ID NO: 5235 - DNA, 1596 bp, Klebsiella pneumoniae
atttactcgcgatgtgtcaggtttagttgcatagtctatcatgcgcttaaggggaagcgtattgctcgcgcgggagaggctatggcaaagattgattttcgcaacaagataaactggcgtcgacgcttccgttcgccgccgcgggtggagacggagcgcgacatcctgcggatctttgaaagcgatcggggacggatcgtcaactcgccggcaatccgccgcctgcagcaaaaaactcaggtcttcccgctcgagcgcaacgcggcggtgcgcactcgcctgacccactcgctggaggtgcagcaggtggggcgctatatcgccaaagaggtgctgagccggctgaaagagctgaggctgctggaagagtatggcctggaagagctgaccgggccattcgagagcgtggtggagatggcctgcctgatgcacgatatcggcaatcccccgtttggccattttggcgaagcggcgattaacgactggttccgtcagcgcctggcgcccggcgatgcgctcgggcagccgctgaccgacgatcgctgcgaagtgcaggccttacgcctgcatgacggagagacatcgcttaatgcgctgcgccgtaaagtgcgccaggatctctgcagctttgagggcaacgcgcagggcattcgtctggtccatacgctaatgcgtatgaacctgacctgggcgcaggtgggatgtatcctgaaatatactcgtccggcgtggtggtctgaggagacgccggccagccacagttatttaatgaagaaacctggctattatttagccgaagaagagtatgtcgcgcgtttgcgtaaagaactggatctcgcgccttacaatcggtttccattaacctggattatggaggctgcggatgacatctcatattgcgtcgcggatctcgaggacgcggtggaaaaacgtatttttagcgcagaacagctctatcagcatctttacgacgcctggggcagtcatgaaaaaggctcgttattttcgcaggtagtagaaaatgcctgggagaaatcgcgagccaattatctgaagcagagcgcggaagatcagttttttatgtatttgcgggtgaatacgctgaataagctggtgccctacgcggcgcgccgatttattgacaacctgccggcaatcttcacgggggactttaatcatgcgttgctggaggacgacagcgattgcagtcagctactggagctctataaaaatgtggcgatgaaacaggtctttagccatccggatgttgagcagctggaattgcagggctaccgggtgatcagcggcctgttggatatctatcagccgctgctgaaattatcgctggaggatttcagcgaattagtagcgcaggagcgggtacgacgtttacccattgcctcccggctgtatcagaaactttcgacccgtcaccggctggcctatgttgaagcggtaaataaactggcgcgtacggcgcccgaatttgcgctgatggaatactattatcgctgccgtctgattcaggactatatcagcgggatgacggatttgtatgcgtgggatgaatatcggcgactcatggcggtggaatag

SEQ ID NO: 5236 - DNA, 561 bp, Klebsiella pneumoniae
gcgataacgcgtttatcgcctcgccacgcaaataacggtacccctgggtactcatgggatggtaaggagtttattgtgaaaaagtggttattagctgcaggtctgggtttggcaatggtaacttccgctcaggcggcagataaaattgccctggtgaacatgaacagcctgttccaacaggttgcccagaaaactggcgtttccaacacgctggaaaacgagttcaaaggccgcgctagcgaactgcagcgtatggaaggcgacctgcaatccaaaatgcagcgtctgcagtccatgaagccgggcgccgaacgtaccaaactggaaaaagacgtgatggctcagcgccagaccttctcccagaaagcgcaggcgtttgaacaggatcgcgcacgtcgttccaacgaagagcgtggcaaactggttacccgtatccagactgccgtacagagcgtagcgaaagatcagagcatcgatctggtggttgacgcgaatgccgttgcatataacagcagcgatgtaaaagacatcaccgctgatgtgctgaaacaggttaaataa

SEQ ID NO: 5237 - DNA, 786 bp, Klebsiella pneumoniae
agtacaacgcgaaaaataatggatacctacatgacaaatgcagtaaccgtaaagaacatcacctttcaggaaggggaaaccctcatttgtgtaccgctgatcggtaaaaccctggatgagatactgggtaacgcccacggcctggtcgatgccggcgccgatattatcgaatggcgcgttgaccactttgcccaggtcagagagatggcccaggtgatggccgcgctggcggaaatccgtggcgcgctgaaagcgcttccgctgctgtttaccttccgcagtaagaaagaaggtggcgaaaccgagctcagcgacgaagcctattttgcgctcaaccgcgaggccgcacgcagtggactggttgatgttattgatatcgaactgttcaataatgaagcgcagatccgcgcgctggttgacgatgcgcatgccgcgggcgtcaaggtgatcatgagtaatcatgatttccataagacccccgctcaggaagatattatctatcgcctgcgccgcatgcaggatctgggggccgatctgccgaagatcgcggtgatgccgcagtcgccgcaggacgtactcaccttgctcgccgccacgctgaccatgaaagagaagtatgcgacgcgtccgctgatcaccatgtcgatgggcaaatccggtggcgttagccgggtcaccgggcgcttgttcggttcggcgatgaccttcggtaccgttggtcagtcctccgcgccggggcagatcgccatcgctaagctgcgtgaagtgatggatattctctcctga

SEQ ID NO: 5238 - DNA, 564 bp, Klebsiella pneumoniae
accatctggcgttttgccgcgagcatggcaaagggatggtcatcggcaccaccggttttgacgacgctgacaaacaggcgattcgcgatcccgcgcaggacattgccattgttttcgccgcataactttagcgtgggcgtcaatgtcctgttgaagctgctggaaaaggcggcgaaggtgatgggcgactataccgacatcgaaattatcgaagcgcaccaccggcataaagtggatgcgccgtcaggcaccgcgctggcgatgggcgaagcgatcgccggggcattgaacaaagatcttaaggactgcgcggtctacagtcgtgaaggctacactggcgaacgcgtcccgggcaccatcggcttcgcgaccgttcgcgcgggggatattgtcggggagcatacggcaatgtttgccgacatcggtgagcgtattgaaatcacccataaagcgtccagccgcatgacctttgcaaatggcgccgttcgttcagcgttatggctgaaagacaagaaaaatggcctgtttgatatgcgtgatgtgctggatctgaatagtttataa

SEQ ID NO: 5239 - DNA, 741 bp, Klebsiella pneumoniae
aggcgtcggcgaacgggtgaaatggatgataaggaaagcaaagtgaagaaaatcgtattctccctgatagcggcctgttcgctgttcgcgctgtttggttgtaaccatcgcgccgagactgacacggtccagccagcggcgatggaagagctcaagccgatgcagcaaagctggcgaggcgtgctgccttgcgcggattgcgaaggtatcgacacctcgctgttcctggaaaaagacgggacctgggtgatgaatgagcactaccagggcgcccgtcgtgagccgtcatcctttgcctcgtacggcacctgggcacgtaccgcggataagctggtgctgaccaacagcaagggcgaaaaatcttactttcgcgcgaaaggcgacaagctggagatgctcgaccgcaacggaagccccattcagtctcctctcaactataccctggagccagtgaaggccagcctgccgacgacgccgatggtgatgcgcggcatgtatttctatatggccgatgcggcaacctttaccgattgcgcgaccggtaaacgcgtcgcggtggcgaacaatgcccagcttgagcgggattatgccgccgcgcgcgggaccgatactcgcccggtactgctggtggtagaagggcactttactctcgaagcgaacccggataccggcgagatgatgaaaacgctgatgacggatcaagccggcaaatttattcccggtaaagactgcagccattga

SEQ ID NO: 5240 - DNA, 1320 bp, Klebsiella pneumoniae
acaacggggcgagatgtttgcccgtctggcgaaggagttaggttgatgcgtttctctctcccacgcctgagaatgccgcagctgagcctgcctcggctgagactgccgcgactgccggggatgtttattttcgcctggctattcgctgcgctgaaaggctgggtgatgggctcgcgcccgaaagataacgacagtctggtgatgtatgaccggatgctgctatggctgaccttcggcctggcggcgatcggctttattatggtgacctcggcgtcgatgccggtcggacagcgcctggcgaacgatcctttcctcttcgccaagcgtgacggcctgtacattgtgctggccttcgcactggcgatgattacgctacgtctgccgatggatttctggcagcgccacagtaccgcgatgctgatcgcctcgatcgtcatgctgctgatcgtactggtagtaggcagctcggtaaacggcgcatcgcgctggatagcccttggtccgctgcgtattcagccggcggagttcaccaagctgtcgctgttctgctacatcgccaactatctggtgcgtaaagccgacgaagtgcgtaacaacctgcgcggcttcttaaaaccgatgggcgtgattttcgtactggccatcctgctgctggcgcagcctgacctcggtaccgtggtggtcctgttcgtcaccacgctggcgatgctgtttctcgccggcgcgaagctgtggcagttcatcgccattatcggcatgggtatttcggcggtggtcctgctgatcctcgccgaaccataccgtattcgccgcgtgacctccttctggaacccgtgggaagacccgttcggcagcggctaccagctgacccagtcgctgatggctttcggccgcggcgagatgtgggggcagggcctcggcaactcggtgcaaaaactggagtatttaccggaagcgcacactgactttatcttcgccattatcggcgaagaactcggttatatcggtgtggtactggcgcttttaatggtattcttcgtcgctttccgcgccatgtcgattggccgtaaagcgctggagatcgatcatcgcttttccggcttcctcgcctgtgcgattggtatctggtttagcttccaggcgttagttaacgtcggcgcggcggcggggatgctgccgacgaaaggtctgacgctgccgctgatcagttatggtggttccagtctgttgattatgtcgacggccattatgttgttgttgcgaattgattatgaaacgcgtctggaaaaagcccaggcgtttacacggggtgtgcgatga

SEQ ID NO: 5241 - DNA, 1212 bp, Klebsiella pneumoniae
gcgtctgagcttcgatcagcaggatccgctgaccggcagccagccgacggtccgggtgctgctgcgcgaggtcacggcgtttcgcctgcggttttacgccgacgggcgctggcaggaaacctgggaccgcccgcagaggctgccgcaggggctggagatcaccctgacgctggcgaacagcggggagataacccgcctgtttttactcaccccgggaggcggccagtgataaatcggcaacgcggcgtcgcgctcctgatggtgctgttcatcctcgccctgatgatgatcctcgccagcgccatgaccgagcgcaccgcggtcatgtatcagcataccgccgtgaccctcgataatttgcaggccagatggtacgccctggcggcggaaaacatggccgccgcgctgctgcaacgcgatgcgctggactcgcccagtcaaacgaacctggcgcaaacctgggcgcaggaggggcgccgctttaccctcgacgatggcgaaatccgcgccacgatccgcgacgggcacgcctgcttcaacctcaatgctattgaccatcgcgcggatgaggctggcgacggaacgccctacccgaccgacgtcttcgttcggctgctggcgctgctcggcgagccgccgctgcgcgccagccagatcgccgccgcccttggcgactggacggacagcgacggccagccgcggctgaacggggcggaggacgaggtctatatggcgcaaaccccgggctatctcgccgccaaccagccgatgcaggatgtcagcgagttgcgcctgctggccgggatggacgccgcgctctatcagcgcctgctccccttcgtctgcgtccagccggatgacgcgctgcaggtcaatgtcaacaccctgcgcccctcccaggccgccctgctggtggccctccttcccggcgatctgacgctgcaggaggcgcaacagctgctgcacaaccgcccgcgaaccgggtggagcagcgtcgccgcctttctcgcgcagccgacgctgcagaaaaccgataccacgcttgcccgtccctggctgacggtgcacagcgcacgctttatcgccgcttttaccgtggtgactggcaatctccgctttcagctgcacagcgtcctgcaacaggaggggcgcacgtttaccgtcgtccagcggcgatatggactctctatggtggtcgatgaacaagattaa

SEQ ID NO: 5242 - DNA, 1269 bp, Klebsiella pneumoniae
ttgctgcgtaggggcttgctggcggcgttttgctttttattctgtttccactcttctggacgtctcatgaagcaattaaccgttctcggttcgaccggctccattggctgtagcacgctggacgtggtgcgccataaccctggtcgcttttccgtcgccgcgctggtcgcggggaaaaacgttgaccgtatggttgaacaatgcctggaatttaccccccgttacgcggtgatggacgatgcgcaaagcgctgagcggttgcgcacccgtctgcatgagcatggctgtcgcaccgaggtgctaagcggccagcaggcggcggccgaggtcgcggcgctggatgaggtcgatcaggtcatggcggcaatcgtcggcgcggcgggactggtgccgacgctggcggcgatccgcgccgggaaaacggtattgttagcgaataaagaatcgctggtgacctgcggtcgcttattcatggaggcggtgcaacagtcgggggcgcgattgctaccggtcgatagcgagcataacgctatttttcagagtatgccggagacaattcagcagcatctgggatacgctgatcttgcccggaatggcgtctcgtcaatcctgctgaccggctccggtgggcctttccgcgagacggccgtggctgaactggcggcgatgaccccggatcaggcctgccgtcatcccaactggtcgatggggcgcaagatctccgtcgattcggccacgatgatgaacaaaggcctggaatatattgaagcgcgctggctgtttaacgcctcggcccagcagatggaagtgctgatccatccgcagtcggtgatccactcgatggttcgctatcaggatggcagcgtgctggcccagcttggggagccggatatgcgcacgccgatcgcccataccatgggctggccgcagcgactgaattccggcgttaaaccgctggacttctgtcagttgagcaatctgagcttctccgcgccggactatacgcgatatccgtgcctgaagttggcgatggacgcgtttgacgtcggccaggccgcgaccacgacgctgaatgcggctaatgaagagtcggttgccgcgtttctgcatggcgatatccgctttaccgatattgcggcggttaacctggcggtgctggataagatggacctgcaggagccgcaaagcattgatgatgttctggttatcgacgccgaggcgcgcgcaatcgctcaccagcagctgcagcggttggttgcgcaggcgtaa

SEQ ID NO: 5243 - DNA, 420 bp, Klebsiella pneumoniae
cgtggctggcttaacagaaggagtttaaccatgctgggtttgaaacgggttcaccatattgccatcattgcgaccgactacgcccgcagtaaagcgttctattgcgatattctggggtttacgctgcaaagtgagttttatcgcgccgagcgcgattcctggaaaggcgatctggcgctcaacggcgagtatgtgattgagttgttctcgttcccgtttccgccagcccgccccagtcgtccggaagcctgcgggctgcgtcatctggcctttagcgtggatgatatcgacgccgcggtagcccatctcaccgcgcatggcgtggagtgcgaagcgattcgtgtcgatccctttaccggtaaacgctttaccttctttagcgatccggacgacctgccgctggaaatatatcagcagtaa

SEQ ID NO: 5244 - DNA, 240 bp, Klebsiella pneumoniae
ccaccaaacagaggccaccgggccgcgctggatacgcatttttatccggtgccggggctgcagccaatcgcagagaacaaccaaaagctttacgcaaaaaagccgtgttttgtcacggccaccgtaatctttaacaacaaaatgcaacgatcgggtggcgcagactatatcaccgaagccttgcgcccacaaatatcaccgcgttacgcctgcgcaaccaaccgctgcagctgctggtga

SEQ ID NO: 5245 - DNA, 1680 bp, Klebsiella pneumoniae
gttttgcgcaggagttccccttttatgtcttccggccgtctgcaacaacagttcattcgcctatggcagtgctgcgacggcaagtcgcaggagaccacccttaacgagctggcggaaatgctgagctgctcgcgccgccatatgcgcaccctgctcaatatgatggagtcccgcggctggctgacctgggaagcggaggcaggccgcggcaagcgttcgcggctaacctttctctataccggcctcgccctgcagcagcaacgtgccgaagatctccttgagcaggatcgcatcgatcagctggtgcagttggtcggcgataaggctgccgtccgccagatgctggtctcgcatctcggccgcagcttccgccaggggcggcacatcctgcgcgtgctctactaccgaccaatgaagaatttgctgcccggtagcgcgctgcggcgttcggaaacgcatattgcccggcagattttcagcgccctgacgcgggtaaatgaggaaaatggggaactggaagccgatattgcccaccactggcagcagttgtcgcccacccactggcgctttttcctccgcccgggcatccattttcaccatggccgtgagctggagatggccgatgtgatcgcctctctgcagcgcagcaatgccctgccgctctattcacatatcgaacgcatcgaatcgcccaccgcctggaccctggatattcatctgcgccagcccgaccgctggctgccctggctgctggggcaggtgccggcgatggtgctgccgcaggagtggcagaccatgaaccacttttcctccatgccggtcggcaccggcccctatgccgtggtgcgtaacaaccagaatcagctcaagatccatgcctttgaggactattttggctaccgggcgctgatcgatgaggtgaacgtctgggtgctgccggagattagcgaagagcccaacggcggcctgacgctgcagggcaataccgaaagcgaaaaagcggtagagagtcgcctggaagagggctgctattacctgctgttcgactcgcgaagcccgctgggggccaacgacgcggtgcgccgctggctaagctatctgtttcagcccgccaacctgctctaccatgcgggcgaacactaccagggcaactggtttcccgcctacggcctgctgccgcgctggcatcacgccagcaaccacgcctgcgagaagccggcggggctggagacagtcacccttacctactaccgcgatcacgtcgaacatcgggtgatcggcgggatcatgcgcgacctgctggcggcgcatcaggtaaagctggagatccaggagctggagtacgatgcctggcatcgcggcgaggtggtcagcgatatctggctcaacagcgtgaacttcaccttaccgatcgaattttcgctcttcgcctatctgtacgaagtcccgctgattcagcgctgcattcccattgactggcaggcagacgcctgccgctggcgagcaggagagtttaatccggccacctggagccagcggctgctggccgggcaacatatcgtgccgctgatccaccactggctgatgattcagggtcagcgcagtatgcgcggcgtgaggatgaataccctcggctggttcgattttaaatccgcatggtttgcgccgccggagccgtaa

SEQ ID NO: 5246 - DNA, 432 bp, Klebsiella pneumoniae
tcgactggcaggaggcacaccagaatggatagccatacgctgatacaggcgttgatttacctcggcgccgcggcgctgattgtgcccatcgccgtccgtctggggctggggtcagtgctgggctatctcatcgccggctgtattatcggcccgtgggcgctgcggctggtgaccgatgccgaggcgattctgcactttgccgaaattggcgtggtgctgatgttgttcgtcattggtctggagctcgatccgcagcgcttatggaagctgcgcgcctcggtgtttggcggcggcgcactgcagatggtggccctgcggggtgttgatcggcctgttctgcatgctgctgggcctgcgctggcaggtggccgagctgattggtatgactctggcgctttcctcaaccgcgatcgctatgcaggcgatgaatga

SEQ ID NO: 5247 - DNA, 1416 bp, Klebsiella pneumoniae
actgaaaggctggccggagccgcgcgttatcgtgcgcttctggattatttcgctgatgctggtgctgattggcctggcgacgctgaaggtacgttaatcatggcagattatcagggtaaaaaagtcgtcataattgggctgggcatgaccggcctgtcatgcgtggactttttcatggcgcgcggcgtaaccccgcgcgtgatggacacccgcgtcgcgcctccggggctggataaattacccgaatcggtcgaatgccatgtcggcggactcaatgatacctggctgctggcggcggacctgattgtcgccagtccgggaattgcgctggcccatccttcgctcagcgcagcggccgacgctggcgtagagatcgttggcgatatcgaactgttctgccgcgaagcgcaggcgccgattatcgccattaccggttctaacggtaaaagcactgttactaccctggtgggcgagatggcgaaagccgctggagttaacgtcggcgtgggcggcaatatcggcctgccggcgctgatgctgctggacaccgatcgagagctgtatgtgctggagctctccagcttccagctggaaaccacctccagcctgcaggcggtggcggcaaccatcctcaacgtgactgaggaccatatggaccgctacccgctggggctgcagcagtatcgcgcggcgaagctgcggatttacgagaatgcgaagacctgcgtggtgaacgcggacgatgcgctcacaatgccggtacgcggggcggacgaacgctgcattagctttggcgtcgatgtcggtgactaccaccttaaccgccagcagggcgaaacctggctgcgcgttaaaggtgagaaaatcctcaatgtgaaagagatgcctctcaccggtcagcataactacagcaacgccctggcggcgctggcgctggccgatgccgcaggtctgccgcgggccagcagcctgaaggcgctgaccacctttaccggtctggcgcaccgtttccagttggtgctggaacacaacggcgtacgctggattaacgactcgaaggcgaccaacgtcggcagcaccgaggcggcgctgaacggcctgcagctggacggcacgctctatctgctgctgggcggcgacggcaagtccgctgattttaccccgctgaagcgctacctcggcggcgatcgtattcgcctgtactgctttggtcgcgatggcgccgagctcgctgagctgcgtcctgaggtggcggtacaaactgagactatggaacaggcgatgcgtcagattgctcccctggtgaaagcgggggacatggtgctcctgtcgccggcctgcgctagcctggatcagtttaagaactttgaacaacggggcgagatgtttgcccgtctggcgaaggagttaggttga

SEQ ID NO: 5248 - DNA, 543 bp, Klebsiella pneumoniae
  unsure (432): Identity of nucleotide at the above locations are unknown.
tgcgtgttaaggagaagcaacatgcaagaagggcaaaaccgtaaaacatcgtccctgagtattctcgccatcgctggggtggagccgtaccaagagaaaccgggcgaagagtatatgaacgaagcccagctggcgcacttcaagcgtattcttgaagcatggcgtaatcaactcagggatgaagtggatcgcaccgtatcgcacatgcaggatgaagcagctaacttcccggacccggtagaccgtgccgcccaggaagaagagttcagcctggaactgcgtaaccgcgaccgcgaacgtaaactgatcaaaaagatcgagaaaacgctgaaaaaagttgaagacgaagacttcggctactgcgaatcctgcggcgtggagatcggcattcgccgtctggaagcgcgtcccacagcggatctgtgcattgantgcaaaaccgtggcggaaattcgcgaaaaacagatggcgggtaatcccctggtgcttcactttctggcgggagtctctcccgcctggttctgttgtccgtaccatgactga

SEQ ID NO: 5249 - DNA, 441 bp, Klebsiella pneumoniae
aacaaacaaaggcgcagagttctgcgccttttttatggagcgcattcaatgaaaaaactgcaaatcgccgtcgggataattcgcaatccgcaaggcgaaatctttattacccagcgcgccgccgatgcccatatggcgaataagctggagttcccgggcgggaagattgaatctgatgagacgcctgagcaggcgctaatccgcgaactgcaggaggaagttgggattacggtcaccacctcttcgctctttgataagctggagtatcagttccccgatcgccatattacgctgtggtttttcctcgtggaaagttggcaaggcgagccgtggggtaaagaagggcagccgggtcggtggatggcgggaccaacgttggatccggcggcgtttcctccggcgaatgaaccggttatcagcaaacttatcgcccagggctga

SEQ ID NO: 5250 - DNA, 402 bp, Klebsiella pneumoniae
tggctcaaaaggtccggttattctttaaccggccggaagtatcaatgggagcagaaaatgagtgatgacgtagcgttgccgctggagtttaccgaagccgcagccaataaagtaaaacacctgattgcggatgaagataatccgaacctgaaactgcgcgtgtatatcaccggcggcggttgcagcggtttccagtatggcttcacctttgacgatcaggtgaacgaaggggatatgaccattgagaaacagggcgtcggcctggtggttgacccgatgagcctgcagtatctggtcggcggctcggtcgactataccgaagggctggaaggttcgcgctttatcgtgaccaatccgaacgcgaaaagcacctgcggctgcggctcctcgttcagcgtttaa

SEQ ID NO: 5251 - DNA, 615 bp, Klebsiella pneumoniae
ggacacaaaaggctccgggggttaacattcaggggttcgcattgtagcatccccctaattcattaccgagtctctatcatgtctgagccgaaaaggctgttttttgcgcttgaactgccgtctgccgtccagaagcagattgtccagtggcgggcaacacacttccccgaagatgccggcaggcccgtcgcggcggataatcttcatctgacgctggcgtttctcggcgaggtgagcgcggaaaaacagcgggcgctggccgctctcgctggccggctgcgccagccgggctttaccctgacgctggacgatgccggacagtggctacgttcgcgagtggtatggctcggaacccgccagccgccgcgcggcctgctgcagctcgccagcatgttgcgcgctcaggcggcgcgcagcggctgctatcagagcccgcagccgtttcacccgcatattaccctgtggcgcgatgctcgccgggcggtgccgatcccggcccccggctttcgctggacatttccggtgaacgagttcgtgctctatgagtccagctttagccgggggcgcacgcgctacacggcgctggaacgttatccgtttgataaggaaagttga

SEQ ID NO: 5252 - DNA, 585 bp, Klebsiella pneumoniae
gttcgcgaaaggagatcccgcatgcagttgaacgaggggtggttggtcggcgcgcgtcgggttccctcgccgcaccatgactgccgtccggatgaagagaccccttccttactggtggtgcataacattagcctgccaccgggggaatttggtggtccgtggattgatgcgctgttcactggtaccctggatccgcacgcgcatcctttctttgccgagattgctcatctgcgcgtttcggcgcattgtctgattcgccgtgatggcgaaatcgtgcagtatgtgcctttcgataagcgggcgtggcatgcgggcgtctcctgttatcagggacgcgaacgctgcaatgacttttccatcggcatagagctggaaggcaccgatactctggcgtataccgacgcgcagtaccggcagctggcggcggtgacggatctgctgatcgcgatttatccggctatcgccgaaaacattgcgggccacagcgatatcgcgcccgtgcggaaaaccgatccaggaccggcctttgactggataaaataccgtgcgctgctcagcgccccgtcagaaaaggagacctcatga

SEQ ID NO: 5253 - DNA, 189 bp, Klebsiella pneumoniae
ccggcaggaagcgcgccgttttttatgttattaaaaaacatactctttcccatcttgttacgtgcgcaggaggtaaaatgctggttaagaatgtcgcattttagtgctatcctgtatgccctgaacattacgtgctatgttctgacttattctgccgatgatgcgtttaacacaatgattttatggtga

SEQ ID NO: 5254 - DNA, 885 bp, Klebsiella pneumoniae
gtttttttgagctgttttaattccagagcaatggtcattaaatatctcttctcgtgtcgtgacacgtcattaacccgcctgactcacgtttgcgctggaccggcgctgacgccgccaacgcatctgcagcctgaagtatcacgggttaagatggttttaaaaaaggtgagcttaccctatattagcgcaacgcacttacttggttacaggccgataacgtccatgaatgatatagatacactcatcagcaacaatgcactatggtcaaaaatgctggtggaagaggaccccggcttttttgagaaactgtcgcagacgcagaaaccgcgcttcctgtggattggctgttcggacagccgcgttcccgctgagcgactcaccggcctggagcctggcgaactgttcgtgcatcgtaacgtagcgaacctggtgatccacaccgatctcaattgtctgtcggtggtgcagtatgccgtcgatgtcctggaagtcgagcacattattatctgcggccactacggctgcggcggcgtgcaggcggcggtggagaacccggagctggggcttatcgacaactggctgctgcatatccgcgatatctggtttaagcacagctcgctgctcggtgaaatgccagaggagcgccgtctggataccctttgtgaactgaacgtgatggaacaggtgtacaatctgggacattcgacgattatgcaatccgcgtggaagcgcggacagaaggtgaccatccacggctgggcttacgggattcacgacggactgctgcgcgatctggatgtcaccgctgtgagcagggaaaccctcgaacagcgctatcgccacgggatctccaacctcaagatcaagcacatcaaccacagatag

SEQ ID NO: 5255 - DNA, 1488 bp, Klebsiella pneumoniae
gccggggtgagatatgtggagttgtgggggcggtcacagaacgaaaaaagcccctgccctcggcgagggaaggggctgggaagcgagcgctggcggttactgcaacagcagatagatagaggcgtcgccgcgctgaatgttcagcgccagtacggacggtttggcgtcgaagattttccgcagatcggcgatgtttttcaccggctgctgattcgccccgacgatgacgtcgcctttcttgaggccaatctgtgccgccggggtaccggctttcacattattgaccaccacgcccttatcctgacccttattgctcatttccgccccttcaatcccgttgaagatagtgctggagtcaacctgggtctggttgctctgctgcagttcgacggttacggtcaccggtttgccgtcgcgcagcagaccaagctcaactttgctgccgataggcatggtgccgacctgggcacgcagcgcggcgaagctgctgatcgctttcccgttgagggaggtgataacatcgccggctttaatgcccgctttcgcggccgccgaacctggcattacctggctgacgaaggccccgcgctgggcatcgactttcatcgctttcgccagctcagagttcagttcggtgcccataatgccgagctcaccgcgtttcacctggccatatttcaccatctgctcggtcaggtttttcaccatgttgctcgggatagcaaaaccgataccgatgttgccgccgtccggcgccagaatggcggtgttgataccgatcagctcgccgttgaggttcaccagcgcaccgccggagttcccgcggttaatcgccgcatcggtctggataaagttttcgtagttttccacgttgaggccgctacggcccagcgcggagacaatcccggaggtcacggtttcgcccagaccgaacgggttgccgatagccacggtgtaatcaccgacgcgcagcgcatcggagtcggcaagcttaatcgccgtcagattttttggatcctgaatctgaatcagcgcgatatcagagcgcggatctttgccgacgactttggcatcaaacttacggccatcgctcagctgaaccttaatcgtggtggcgttgtccacgacgtggttgttggtcaccacataccctttggcggcatcaatgatgacgccggagcccagcgccataaatttctgctgctggccgccgtcaggctgaccgccctgtccgccgccctggcaaaacggcgaactctggaaaggagacccatcctggcagaacggcgaattatcgccaaagaactgctggaagttacgtggcatccgtggggtattaacggtggtgctaccttcaacgttaatgctcaccaccgacggcatcaccttctccagcatcggggccaggcttggcatctgctgtgcattagtggccgaagatgccgtttctgccgcgctcgcagagagcggggacaacgccagacctaa

SEQ ID NO: 5256 - DNA, 1389 bp, Klebsiella pneumoniae
ccacacacgaggtttcatatggaaggtcaacagcacggcgatcggctgaagcgcggcctgaaaaaccgtcacattcagctcatcgcgctgggcggggctatcggcaccggcctgtttctggggagcgcgtccgtcattcagtccgccggcccgggtatcattcttggttacgctatcgccggttttatcgctttcctgatcatgcgtcagctgggcgaaatggtggtggaagagccggtggccggctcatttagccactttgcttacaaatactggggcggttttgccggcttcgcctccggctggaactactgggtactgtatgtcctggtggccatggcggaactgaccgccgttggcaaatatatccagttctggtggccggaaatccctacctgggcctcggcggcggtcttcttcatcgccatcaacgccattaacctgaccaatgtcaaagtgttcggtgaaatggaattctggttcgcgattatcaaagtggtcgccgtagtggcgatgattttgttcggcggctggctgctgttcagcggcaacggcggcccgcaggcgacggtacgtaacctgtgggaccaggggggcttcctgccgcacggcttttacgggctggtgatgatgatggcgatcatcatgttctcctttggcggcctggagctggtggggatcaccgccgcggaagcggataatccggagcaaagcattcctaaagccaccaatcaggttatttaccgtattctgatcttctatgttggttcgctggcggtgctgctctccctgctgccgtggacccgcgtcaccgcggacaccagtccgttcgtcctgatcttccatgaacttggcgatacgctggtggcaaacgctctgaacgtggtggtgctgacggcagcactgtcggtttataacagctgcgtgtactgcaacagccgtatgctgttcggccttgctcagcagggcaacgcgccaaaagcgctgctcagcgtcgacaaacgcggcgtgccggtgaataccattctcgtctcggccctggtcactgcgctgtgcgtgctgatcaactacctggcgcctgaatctgctttcggtctgctgatggcgctggtggtctcagccctggtcatcaactgggcgatgatcagcctcgcgcatatgaaattccgtcgcgccaaaaagcagcagggcgtggtcacgcgtttcccggccctcttctatccgctgggcaactggctgtgcctgctgtttatggcggcggtgctggtgattatgctgatgaccccggggatggcgatttccgtctggctgatcccggtatggattgcggtgctgggcgtgggctacctgtttaaagagaaagccgccgccaccataaaagcacaataa

SEQ ID NO: 5257 - DNA, 717 bp, Klebsiella pneumoniae
cacatcgcgagtaaatctatgaaaattggcattattggcgctatggaagaggaagttacccttctgcgcgacaaaatcgaaaaccgccagaccatcaccattggcggaagcgaaatctataccggccaacttcacggcgttgacgtcgctctgctgaagtctggtatcggaaaagtagcggcggcgatgggcgcgaccctgctgctggagcgctgccagcctgacgtgatcattaataccggttctgccggcggcctggcgtcgacgctgaaggtcggcgatatcgtcgtctccgatgaagcgcgctaccacgacgccgacgtcaccgccttcggctatgaatacggccagctccctggctgcccggcgggttttaaggcggatgaaaaactggtggccgccgcagagagctgcattaaagcgttagatctcaacgccgttcgcggcctcatcgttagcggggatgccttcattaacggctctgtcggtctggcgaagatccgccataatttcccgcaggcgatcgccgtggaaatggaagcgaccgccatcgcccacgtctgccataactttaaggttcctttcgtagtggttcgcgctatctccgacgtggccgaccagcagtcccacctcagctttgaggagttccttgcggtcgccgccagacagtccaccctgatggtggagaatctggtacagaacctggcacgtggctaa

SEQ ID NO: 5258 - DNA, 2568 bp, Klebsiella pneumoniae
acgttgcggagaaaaagcatggcgggagatgaccgcgagcctatcggacgtaagggaagaccctcacgtccgactaaacagaaagtcacccgtcgccgggtccgggaagaggactacgacgacgagtatgatgacgatgattatgaggatgagaaaccggtgccgagaaaagccaaaggcaaaggtggcaagcctcgtcggaagcgcagctggctgtggctgctggtcaagctggggattgtcttcgcggtgctgattgccgcctatggcgtctacctcgaccagaaaatccgcagccgcattgacggtaaagtctgggagctgccggccgcggtctatggccggatggtcaaccttgagccggacatgcagatcagcaaaaacgagatggtgcgtctgctcaacgccacgcagtatcgccaggtcagcgcgatgacgcgccccggcgaatataccgtgcaggctaacagcatcgagatgatccgtcgtccgttcgatttcccggacagtaaggaagggcaggtgcgcgcgcgtcttactttcgacggcgaccatcttgagaccatcgagaatatggataataaccgccagttcggtttcttccgcctcgatccgcgtcttatcaccatgctgcagtcgccgaacggcgagcagcgcctgttcgtgaagcgcagcggcttccccgatctgctggtggataccctgctggcgaccgaagaccgccacttctatgagcacgatgggatcagtctctactccatcggccgcgcggtgctggcgaacctgacggcaggccgaacggtgcagggggcgagtaccctgacccaacagctggtgaaaaacctgttcctctccagcgaacgctcctactggcgtaaagccaacgaagcgtatatggcgctgatcgtcgacgcccgctacagcaaggatcgcatccttgagctgtatatgaacgaggtgtacctcggccagagcggcgataacgaaattcgcggcttcccgctggccagcctgtattacttcggccgtccggtggaagagctgagcctcgaccagcaggcgctgctggtggggatggtgaaaggggcgtcggtctataacccgtggcgtaacccgaaactggcccttgaacgacgcaatctggtgctgcgtctgctgcagcagcagcaggttatcgaccaggagctgtacgacatgctcagcgcacgtccgctgggcgtgcagccgcgcggcggggtgatttcaccgcagccggcgtttatgcagatggttcgtcaggaactgcaggcgaagctgggcgataaagtgaaagatctctccggcgtgaagatcttcaccactttcgactcggtggcgcaggatgcggcggaaaaagcggcctccgaagggatcccggttctgaagaaacagcgtaagctggcagacctggaaaccgccatggtggtggttgaccgcttcaccggcgaagtgcgggcgatggtcggcggcgcggagccgcagttcgccggttataaccgcgcgatgcaggcccgccgatcgattggttctctggccaagccggcgacctatctgaccgcgctgagccagccgaatcagtatcgcctgaatacctggatcgccgatgcgccggtgacgattcgtctgtccaacggtcagacgtggtccccgcagaacgacgatcgtcgtttcagcggtcaggtgatgctggtcgatgccctgactcgctcgatgaacgtcccgacggttaacctcgggatggcgctgggcttgccggcggtagtcgatacctggactaaactgggggcgccgaagaatcagctcaacgcggtgccgtcgatgctgcttggcgcgctgaacctgacgccgattgaagtggcccaggccttccagaccatcgccagcggtgggaaccgtgcgccgctttccgcgctgcggtcagtgattgccgaagatggcactgtgctctaccagagctatccgcaggcggagcgcgcggtgcctgcccaggcggcctacatgacgctgtggactatgcagcaggtggtgcagcgcggtacggggcgtcagctgggggcgaagtatccgggcctgcatctggcggggaaaaccgggaccaccaacaataacgtcgatacctggttcgccggcatcgacggtagtcaggtgaccatcacctgggtggggcgcgacaataaccagccgaccaaactgtacggcgccagcggcgcgatgtcgatttaccagcgctatctggcgaaccagacgccaacgccgctggtgctgacggtgccggaagacgtggttgatatgggcgtggacagcaacggcaacttcgtctgcagcggtggtatgcgttcgctgccggtctggaccacgcagccggatgcgctgtgccgtcagggcgaaatgatgcaacagcagcagttgcagcaacaggaagcgaaaaatccgtttaatcagtccgggcagcagcagcaacagcagcaacagcagcaacagccgccgaagcagcaggaaaagagcgacggcgtcgcgggctggatcaaggatatgttcggcagtaactga

SEQ ID NO: 5259 - DNA, 789 bp, Klebsiella pneumoniae
gcgaaaaggagaatcagcatgatgcagctttattgggtcgcgctgaaaagcatctggaccaaagagatccaccgttttatgcgcatctgggtacagacgctggtgccgccggtgatcaccatgaccctgtatttcgtgatttttggcaacctgatcggctcgcgcattggtgagatgcatggttttacctatatgcagtttatcgtcccgggcctgatcatgatggcggtgatcactaacgcttacgccaacgtcgcctcatccttcttcagcgccaagtttcagcgcaatattgaagagctgctggtggcgccagtgccgacgcatgtgattatcgccggctacgtgggcggcggggtagcgcgaggactgtgcgtaggtatcctggtgaccgcggtgtcgctattctttgtgccgttccaggttcactcctggctgtttgtcgccctgacgctgctcctcaccgcggtgctgttctcgctggccgggctgctgaacgcagtgtttgccaagaccttcgatgacattagcctgatcccgacctttgtgctgacgccgctgacctatctcggcggggtgttctactcgctgaccctgctgccgccgttctggcaggggctgtcgcatctgaaccccatcgtctacatgatcagcggttttcgcttcggcttcctcggtatcaacgacgtcccgctggcgaccaccttcgccgtgctggtggtgttcattgtcgccttctatctgctgtgctggtcgttaattcagcgcggtcgcggcctgcgtagctga

SEQ ID NO: 5260 - DNA, 879 bp, Klebsiella pneumoniae
cgaaggaggagccttatcgtggccgataatccactgtggcatgaaacgctgcatgaccattttggtcagtattttagcgttgataacgtgctgtaccacgaaaaaaccgatcatcaggatctgatcatctttgataaccgcgcctttggccgggtgatggcgctggatggcgtcgtacaaaccaccgaacgcgacgagttcatctatcacgaaatgatgacccatgtgccgctgctggctcacggcaacgcgaagcatgtgttaatcattggcggcggcgatggcgcgatgctgcgcgaagtctctcgtcaccgtagcatcgaaaccatcaccatggtggaaatcgacgccggggtagtttcattctgccgccagtacctgccgaaccacaacgccggcgcctatgacgatccgcgctttacgctggtgattgatgatggcgtcaattttgttaatcagacgacgcaaacgtttgacgtgatcatttcggactgtaccgaccctatcggcccgggagaaagcctgttcacctcggctttttatgaaggctgcaaacgctgcctgaacccgggtgggatctttgttgcccagaatggcgtctgcttcctgcaacaggatgaagcggtaggcagccatcgcaagctaagccactattttcgcgacgtcagcttctaccaggcggcaattccaacctattacggcgggatcatgacctttgcctgggcgagcgacaatgaggcgctgcgccatctctccagcgaaatcattcaggcgcgctttcacaaagccaacctgacctgccgttactacaatccggcaatccatacggcggccttcgccttaccacaatatctgcatgatgctctgtccgcaccgtga

SEQ ID NO: 5261 - DNA, 1017 bp, Klebsiella pneumoniae
gaatcgattggaagttgggcatctgcgctctttgtgctaaactggcttcccgatagtggtgtacacttcggttggataggtaaattggtgagattatacgatgatcaaacaaaggatcttaaacgtatcgttcaggcgactggcgtcggtttgcataccggcaagaaagtcacactgacgttacgccctgcgccggcatataccggggtcatctatcgtcgcaccgacttgaatccaccggtagattttccggctgatgccaaatctgtgcgtgataccatgctctgtacttgcctggttaatgagcatgacgtgcggatttctacggttgaacacctgaacgccgcattggctggcctgggtatcgacaacattattgttgaagtcgatgcgccggaaatcccgattatggacggcagtgcggctccgttcgtttatctgttgctggatgccggcattgatgaactgaactgcgccaagaaatttgtacgtatcaaagagacggttcgcgtcgaagatggcgacaaatgggctgaattcaaaccgtacaatggtttttcgctggacttcaccatcgattttaaccatccagcgattgatgccagcacccagcgctatacgctgaacttctcggccgatgcgttcatgcgtcagattagccgtgcgcgtaccttcggttttatgcgcgatatcgaatatctgcagtcccgcggcctgtgcctgggcggcagcttcgattgtgccatcgttgttgacgattatcgcgtactgaacgaagacggtctgcgctttgaagacgaatttgttcgccacaaaatgctggatgcgatcggtgacctgtttatgtgtggtcacaacattatcggcgcattcacggcgtacaaatcgggtcacgcgttgaacaacaaactgctgcaggcggttctggcaaaacaggaagcctgggagtatgtgaccttcgaagacgacgcaaaactgccaatggcgttccgcgcaccgtcgatggttctggcgtaa

SEQ ID NO: 5262 - DNA, 513 bp, Klebsiella pneumoniae
actccttctggtgggaatttgtggggtaaagtggcgaaaaggggtgaggctggcatgttccgtggagcaacgttagtcaatctcgacagcaaaggccgcctggccgtgccaacgcgctatcgcgaagggctgatcgaggacgctgccggtcaattggtatgcaccattgacattcatcacccgtgcctgctgctttatccattgcctgaatgggaagtcatcgagcagaaattgtcgcgtttatcgagcatgaatcccgttgagcggcgcgtacagcgtttgcttttgggtcatgccagcgaatgtcagatggataatgccggccgcttgctgattgcgccggtgttacggcagcatgccgggctgacaaaagaagtgatgctggtcgggcagtttaataaatttgaactgtgggatgaaacgacctggtatcaacgggtcaaggaagatatcgacgctgagcagtccgcgaccggtgaactgtcggagcgcctgcaggatttgtccttataa

SEQ ID NO: 5263 - DNA, 1929 bp, Klebsiella pneumoniae
cccgcgtctggcgtaagaggtaaaagaataatggctatcgaaatcaaagtaccggacatcggggctgatgaagttgaaatcaccgagatcctggtcaaagttggcgacaaagtagaagctgaacagtcgctgatcaccgtagaaggcgacaaagcctctatggaagtcccgtctccgcaggctggcgtcgtgaaagagattaaagtctccgtcggcgacaaaaccgagactggcaaactgattatgattttcgattccgccgaaggtgcagccgccgctgcacctgcgcaggaagagaagaaagaagccgctccggccgccgctgctccagcggctgccgcggcagcgaaagaagttcacgtcccggatatcggcggcgatgaagtcgaagtcaccgagatcatggttaaagtgggcgacaccatcgccgctgagcaatccctgatcaccgtagaaggcgataaagcctctatggaagttccggcgccgttcgccggtaccgtcaaagagatcaaaatcaataccggcgataaagtttccaccggctccctgattatgatcttcgaagtggcgggcgctgcgcctgcagccgctccggcacaggctgccgcgccggctgctgcggctccggctgccgcagcaggcgtgaaagatgttaacgtcccggacatcggcggcgacgaagttgaagtcaccgaagtgatggttaaagtcggcgataaagtcgcggcagaacagtccctgatcaccgtagagggcgacaaagcctctatggaagttccggcgccgttcgcgggtaccgttaaagagatcaaaatcagcaccggcgataaagtcaaaaccggttccctgatcatggtcttcgaagtggaaggcgctgcgcctgccgccgctccggctcaggctgctgcaccggcaccagctgctgccccggctcaggccgctaagcctgccgctgcgccggctgcgaaagcagaaggtaaaagcgaattcgctgaaaacgatgcctacgttcacgcgaccccgctgattcgccgcctggcgcgcgagttcggtgttaacctggcgaaagtgaaaggcaccggccgtaaaggtcgtatcctgcgcgaagacgttcaggcctacgtgaaagacgcggttaaacgcgctgaatccgcaccggctgctgccgcaggcggcggtatcccgggcatgctgccgtggccgaaggttgacttcagcaagtttggcgaagtcgaagaagtggagctgggtcgtatccagaaaatctctggcgccaacctgagccgtaactgggtgatgatcccgcacgttacccacttcgacaaaaccgatatcaccgatctggaagcgttccgcaagcagcagaatgccgaagctgagaagcgtaaactggacgtgaaattcactccagtggtcttcatcatgaaagcggttgccgctgcgcttgagcagatgccgcgcttcaacagctcgctctccgaagatggtcagcgcctgacgctgaagaaatacatcaacatcggtgtggcggtggataccccgaacggtctggtggttccggtcttcaaagacgtgaacaagaagagcatcaccgagctgtctcgtgaattgaccaccatctcgaagaaagcgcgcgatggcaaactgacggctggcgaaatgcagggcggttgcttcaccatctccagcatcggcggcctgggtaccacccacttcgcgccgattgttaacgcgccggaagtggccatcctcggcgtgtctaagtccgcgatggagccggtatggaatggtaaagagtttgtgccgcgcctgatgctgccgatctctctgtccttcgaccaccgcgtcatcgacggtgctgatggtgcccgcttcattaccatcattaacaacaccctgagcgacattcgccgcttggtgatgtaa

SEQ ID NO: 5264 - DNA, 1113 bp, Klebsiella pneumoniae
aacgcgtctggaaaaagcccaggcgtttacacggggtgtgcgatgagcggtcaggaaaagcggttgatggtgatggcgggcggtaccggcgggcatgtgttcccgggactggcggtcgcgcaccatttaatggaccagggctggcaggttcgctggctgggtaccgccgatcgtatggaagcggatttagtgccgaaaaacggcatcgaaattgattttatcctcatctccggcctgcgtggcaaaggtatcaaagcgcagctactggcgccggtgcgtatctttaacgcctggcgtcaggcgcgggcgatcatgaagcgtttccagccggacgtggtgctgggcatgggcggctatgtttccgggcctggcggtctggcggcgtggtcgctggggatcccggtggtcctccacgagcaaaacggcattgccggcctgactaacaagtggctggcgaagattgcgaagaaagtgatgcaggcgtttcccggcgcgttcccgcatgcggacgtcgttgggaacccggtgcgcaccgatgtactggcgctgccgctgccaggtcagcgtctggttggccgtcagggaccgattcgcgtgctggtggtcggtggctctcagggcgcgcgcgtcctgaaccagacgatgccgcaggtggcggcgaagctcggcgctacggtgaccatctggcatcaaagcggcaaaggcggccagcaaaccgtgcagcaggcctatgccgccgccggacagccgcagcataaagtgacggaatttattgatgacatggccgcggcgtatgcctgggcagatgttgtggtttgccgttccggcgcgctgacggttagcgaaatcgcggccgcaggtttaccagcgctgtttgtcccgttccagcacaaagatcgtcagcagtactggaatgcgctgccgctggagaaagccggcgcggcgaaaattcttgaacagcctgagttcacggtagaggcggttgcctctaccctggcgagctgggatcgggaaaccttgctggatatggcggaacgagcgcgtggcgcttcgattccggacgctaccgagcgggtagcagaagaggtcagcgccgtagctttggcgcgctaa

SEQ ID NO: 5265 - DNA, 1809 bp, Klebsiella pneumoniae
atgaagcctgggtgttcccgcaccggcgacctgaaacagccgaacgatccgggtgaaatcactaacgaagtgacgccgattaaagtcggcgatacgctcttcctgtgtaccgctcaccaacgcctgtttgcgctggacgccgccaccggtaaagagaagtggcattttgacccgcagctgaacgccgatccgtcgttccagcacgtcacctgccgcggtgtttcttatcacgaagcgaaagcggataacgcccctgccgacgtcgtcgccgactgtccgcgccgcattatcctgccggtgaacgatggtcgcctgttcgcggtaaacgccgacaacggtaagctgtgcgaaacctttgctaataaaggtattctcaatctgcagaccaacatgccggtcaccacgccgggcatgtatgaacccacttcaccgccgatcatcaccgataaaaccatcgtgattgccggcgcggtcaccgataacttctctacccgcgagccgtcaggcgtgatccgcggctttgatgtgaataccggtaaactgctgtgggccttcgatccgggtgcgaaagatccgaacgccatcccgagcgatgaacatcacttcacgctcaactcgccgaactcatgggcgcctgccgcctacgacgctaagctggatctggtctatctgccgatgggcgtgaccactccggacatctggggcggcaaccgtacgccggagcaagagcgttatgccagctcgattgtggcactgaacgccaccaccggtaagctggcctggagctatcagaccgtccatcacgatctgtgggatatggacatgccttcccagccgacgctggctgatattgaggtcaacggcaaaaccgtaccggtcatctatgccccggcgaaaaccggcaacatcttcgtgctggatcgtcgtaacggcgagctggtggtcccggcgccggaaaaaccagtaccgcagggcgctgccaaaggtgattacgttaccaaaacccagcccttctccgatctgagcttccgtccgaagaaagatctgaccggcgcggacatgtggggcgccactatgttcgaccagctggtgtgccgcgtgatcttccaccagctgcgctatgaaggtatcttcaccccgccgtctgagcagggcacgctggtgttcccgggtaacctggggatgtttgaatggggcggtatctccgtcgatccgaaccgtcaggtggctatcgccaacccgatggcgctgcctttcgtctcaaaactgatcccgcgcgggccaggcaatccgatggagccgccgaaagatgcgaaaggctctggtaccgagtccggcgtgcagccgcagtacggcgtcccgtacggcgtaacgctgaacccgttcctgtcgccgttcggcctgccgtgcaaacagccggcctgggggtatatctccgccctggatctgaaaaccaacgaagtggtatggaaaaaacgtatcggtactccgcaggacagcctgccgttcccgatgccggttaaactgccgtttaccatggggatgccgatgctgggcggtccgatctccacggccggtaacgtcctgttcatcggggcgactgcagataactacctgcgcgcgtacaatatgagcaacggcgagaagctgtgggaagcccgtctgccagccggcggtcaggcgactccgatgacctacgaagtgaatggcaaacagtatgttgtcatctctgccggcggtcacggctcgttcggtaccaaaatgggcgattatattgtcgcctatgcgctcccggatgacgccaaataa

SEQ ID NO: 5266 - DNA, 540 bp, Klebsiella pneumoniae
gcctctgctggtggtcaccatggccggcatggtgctgtttatcgtgctggccatcctgcagccgatcctgcaactgaacacccttatgagtatgtaactgtattaatggagaaaactatgcaacggcaacgcggtttcacgttactggaaattatggtggtgatcgtcattctcggcattctcgccagcctggtggtgcctaaccttatgggcaacaaggagaaagcggaccgccagaaagtcgtcagcgatctggtggcgctcgagggagcgctggacatgtataaactcgacaatagccgctaccccaacaccgagcagggactgcaggcgctggtgaccgctccggccgccgagccgcacgcccgcaactacccggaaggcggctatatccgccgtctgccgcaggacccgtggggaaatgagtatcagctgttaagcccgggtcagcatggcgccatcgacgtcttcagcgtcggcccggacgggatgcccgacaccaatgacgatatcggcaactggaccctcgggaagaaatag

SEQ ID NO: 5267 - DNA, 2499 bp, Klebsiella pneumoniae
agcgccgctggctgcggaagcgatgggcattatcgccccgcgtctgaaagagctgaagctgatcgattctatcgttccggaaccgctgggcggcgctcaccgcaacccggaagcgatggcggcaagcctgaaggcgcagctgctggcagacctggcagacctcgatctgctcagcgaagaagagctgctgaaccgccgttatcagcgtctgatgagctacggttacgcttaactttttcgtcaggactaaacactaagggccggattttccggccctttttttatgtgcgatgcgcccgggggattgctatgatgcttgacttaggtgaataccaggaggaaagcgtgaatatcatcgccatcatggggcctcacggcgtctaccacaaagacgagccgatcaaagaactggaagcggcgctgcagcgccagggcttccagaccatctggccgcaaaacagcgccgacctgctgcagtttatcgagcacaacccgcgcatctgcggggtgatcttcgactgggatgaatacagcgtcgatctgtgcagcgatatcaatcagctcaatgaataccttcctctgtacgcctttattaacgcccactcgacgatggatgtcagcagtcaggatttgcgcatgacgctgtggttcttcgaatatgcgctgggactctccgaagagatcgccacccgcattgggcagtacacccgcgagtacctggagaatatcactccgccgtttacccgcgcgctgttcaactatgtccaggagggaaaatataccttctgtacgccgggccatatgggcggcagcgcctatcagaaaagcccggtgggctgcctgttctatgatttttttggcgggaatacgctgaaggcggatgtctcgatttcggtcaccgagctgggctccctgctggatcataccggcccgcacctggaggcggaggagtatatcgcgcgcgcctttggcgccgagcaaagctatatggtgaccaacggcacctcgacgtccaataaaattgtcggcatgtactcggcgcccgccggcagcaccctgctgattgaccgtaactgtcacaaatcgctggcccacctgctgatgatgagcgatgtagttcccctgtggctgaagccgacccgcaacgcgctggggatcctcggcggtatcccccggcgcgaatttacccgcgacagcattcagcagaaagtgcgcgacacgggcggggcgcagtggcccgtgcatgcggtgatcaccaactccacctacgatggtctgctctataacaccacctggcttaaggagacgctcgatgtcccgtcgatccatttcgattccgcctgggtgccctatacccatttccatccgatatatcaggggaaaagcggtatgagcggggagcggatccccgggaaagtcatcttcgagacgcagtcgacgcataagatgctggccgcgctgtcgcaggcctcgctgatccacattaaaggcaactatgatgaagagacctttaacgaagcctttatgatgcatacctctacgtcgccgagctaccccatcgtcgcgtcgattgagaccgcggcggcgatgctgcgcggcaactccggtaaacgtctgatccagcgctccattgagcgggcgctggacttccgcaaagaggtgcagcgactgcgcgaggagtcggacggctggttctttgatatctggcagccggaagccgtagataaagccgagtgctggccggtagcgccgggcgaggactggcacggtttcaaagatgccgatgcggatcatatgtatctcgatccggtgaaggtcaccattctgacgccgggcatggacgagcaggggaatatggatgaagaggggatcccggcggcgctggtggcgaagttcctcgacgagcggggcgtggtggtagagaaaacaggcccctacaatctgctgttcctgttcagtatcggcatcgataaaacccgggcgatggggctgctgcgcggcctgaccgagtttaaacgcgcctacgatctcaatctgcgggtgaaaaatatgctgccggatctgtacgccgaagatcccgacttctaccgcaacatgcggatccaggatctggcgcaggggatccaccgcttgatccgtcagcatcagctgccgcagctgatgctcagcgcctttgacgtcctgccggaaatgaaaatgacgccgcatcacgcctggcagcgccagatcaagggggaggtggaaactattgaactggagaacctggtggggcggatttcggccaacatgatcctcccttatccgccgggggttccgctgctgatgccgggagagatgatcaccgaggaaagccgggcggtgctcgattttctgctgatgctttgctctatcggccgtcattacccgggctttgagaccgatattcacggcgccaagcgcgatgaggacggtgtgtatcgggtacgagtcttaaaaaatgacgaaaggcttgcgcgttaa

SEQ ID NO: 5268 - DNA, 1032 bp, Klebsiella pneumoniae
tgccgccatggaagaggtagtacgcgcattacaggagactgggacatgttagtatggctggccgaacacttggtcaaatattattccggctttaacgtcttttcttatctgacgtttcgcgccatcgtcagcctgctgaccgcgttgttcatctcgttgtggatgggcccgcgcatgatcgcccgtctgcaaaaactcgcctttggccaggtcgtacgtaacgacggcccggagtctcatttcagtaaacgcggtactccgaccatgggcgggatcatgatcctcaccgcgatcaccgtttccgttctgctgtgggcctatccatctaacccgtacgtctggtgcgtactgacggtattaatcggctacggcatcatcggtttcgttgatgattaccgtaaagtcgtgcgcaaagataccaaaggcctgatcgcccgctggaagtatttctggatgtcggtgatcgccctgggcgtggccttcgcgctgtatctggcggggaaagataccccggcaaccgagctggtggtgccgttctttaaagacgtaatgccgcagctggggctgttctatatcttgctggcctacttcgttatcgtcggtaccggcaacgccgtcaacctgaccgacggcctcgacggcctggcgattatgccgaccgttttcgtcgcggcaggctttgcgctggtggcctgggccaccggtaacatgaatttcgccaactatctgcatatcccgtatctgcgccacgccggcgagctggtgatcgtctgtacggcgattgtcggggcggggctgggcttcctgtggttcaacacctacccggcgcaagtctttatgggcgacgtcggttcactggcgctcggcggcgcgttgggcattatcgccgtgctgctgcgtcaggagttcctgctggtgatcatgggcggggttttcgtggtggaaacgctgtcggttattctgcaggtcggctcctttaagctgcgccggtcagcgcatcttccgcatggcgccgattcaccaccactatga

SEQ ID NO: 5269 - DNA, 423 bp, Klebsiella pneumoniae
ttattcaatggttatgatgctatcaaaggtaccgttatgtacgataatctgaaaagtcttggcattaccaaccctgatgagatcgatcgctatagcctgcggcaggaagctaacaacgacattctgaaaatctattttcagaaagacaaaggcgaattcttcgccaagagcgtgaagttcaaatatccgcgtcagcgcaaaaccgtcgtcgccgacggcgtcggccagggctacaaagaggtccaggagatcagccccaatctgcgctacgttatcgacgagttagatcagatctgccagcgcgatcgcactgaaatcgatctcaagcgtaaaatcctcgacgatttacgccatctggaaagcgtggtcaccaataagatcagcgaaatcgaagccgatctggaaaagctcacccgtaagtaa

SEQ ID NO: 5270 - DNA, 750 bp, Klebsiella pneumoniae
aaccaccgtggaggccgccgggacgcgctggtttgtccgctggcagggagtggaaaccgcgctgccgcagctgcgggcgctggacgtggaggtccggcggcaaaaaagcgatcccgcgccgctggccaccctgcgcacctgggtgacgccgccatgataacgaaaatgcgcggtttcactctgatcgaaacgctgcttgcgctggctattctcgccgtcctcagcgccgccgccgtgatggtgctgcagaacgtcatccgcgccgatggcctgacccgcgagaaaagccagcagatcgcggccctccagcgcgcctttcgccagatcgccgacgatgtcacccacatcattccccgtcgcgccagaaacagcgacacgtttttcttcgccggacgtttccagttgcagagcgacgactggggactggccttcagccgcagcggctggccaaacccgctggggatcctcccgcgctcggagatccagaacgtcagctaccgtctgcgccagcagcagcttgagcgtctgagcttcgatcagcaggatccgctgaccggcagccagccgacggtccgggtgctgctgcgcgaggtcacggcgtttcgcctgcggttttacgccgacgggcgctggcaggaaacctgggaccgcccgcagaggctgccgcaggggctggagatcaccctgacgctggcgaacagcggggagataacccgcctgtttttactcaccccgggaggcggccagtga

SEQ ID NO: 5271 - DNA, 270 bp, Klebsiella pneumoniae
ccactgtccggcatcgtccagcgtcagggtaaagcccggctggcgcagccggccagcgagagcggccagcgcccgctgtttttccgcgctcacctcgccgagaaacgccagcgtcagatgaagattatccgccgcgacgggcctgccggcatcttcggggaagtgtgttgcccgccactggacaatctgcttctggacggcagacggcagttcaagcgcaaaaaacagccttttcggctcagacatgatagagactcggtaatgaattag

SEQ ID NO: 5272 - DNA, 1269 bp, Klebsiella pneumoniae
tggtataacggtttgatgcgtatgcttgcccgatttttgaccctgcttcttttcctgacctcactcagcgcctccgccagcctgcttagccagcagggcaaggctgtgcgctatatgcaaaccaccgaagacgcggtcatctgggcgcaggtgggaaaccatgtggtcagcgtcggcaatgttcgtgccgggcagatcctcgcagtcgtcccgacggctgctcactactatgagtttcgtttcggctttggcaccgggtttattgataaagggcatctcgagccggtgcagggcaagcagcgggtggaggaccgtttgggggatcttaataaaccgctgagtaaccaaaatttactcacctggaaagatacaccgctctatgacgctccctcggtaagcagcgcgccgttcggcacgctggccaacaatctgcgctatccgatcctcagcaagctgaaggaccggctcaatcagacctggtttcagatccgcattggcgaccggctggcgtgggtcagtagtctggacgcgcaggaggatcacggtattcccgtgctgacctatcaccatattctgcgcgatgaagagaacacccgttttcgtcatacgtcgaccaccacctcggttcgcgccttcacgaatcagatgacctggctgcgcgatcagggctataccacgctgaccctgtatcagctggaaggctatgtgcgtaataaaatcaatctcccggcgcgggcggtggcgatcactttcgatgatggcttgaaatcggtgaaccgctacgcctatccggtgctgaaacagtacggtttccatgccaccgcgtttattatctcctcgcgtattaagcgccatccgcagaagtgggatccgaaatccctgcagtttatgagcatttccgagctacgccagatccaggacgtctttgatattcagtcgcatactcacttcctgcatcgggttgacgccggccggcggccgattttattcagtcgcaattaccataatattctgtttgatttcgcccgctcgcgccgggcgctgagccagtttaatccgcacgttctctacctttcctatcccttcggcggctataacgctacggcggtgcaggcggcgaatgacgccgggtttcatatggcggtaacgacggtgcgtgggaaggtgaagccgggggacaatccgtttctgttaaagcggttatatatcttacgcacggattcgctggagacgatgtcgcggctgatcagtaaccagccgcaggggtaa

SEQ ID NO: 5273 - DNA, 2133 bp, Klebsiella pneumoniae
acaacaaacggcaaacgattttgtcctttgttgctgataatccccaacagcctgaggttatcagaaaaaagccggccgtcaggccggctttttcgattacatcaccaagcggcgaatgtcgctcagggtgttgttaatgatggtaatgaagcgggcaccatcagcaccgtcgatgacgcggtggtcgaaggacagagagatcggcagcatcaggcgcggcacaaactctttaccattccataccggctccatcgcggacttagacacgccgaggatggccacttccggcgcgttaacaatcggcgcgaagtgggtggtacccaggccgccgatgctggagatggtgaagcaaccgccctgcatttcgccagccgtcagtttgccatcgcgcgctttcttcgagatggtggtcaattcacgagacagctcggtgatgctcttcttgttcacgtctttgaagaccggaaccaccagaccgttcggggtatccaccgccacaccgatgttgatgtatttcttcagcgtcaggcgctgaccatcttcggagagcgagctgttgaagcgcggcatctgctcaagcgcagcggcaaccgctttcatgatgaagaccactggagtgaatttcacgtccagtttacgcttctcagcttcggcattctgctgcttgcggaacgcttccagatcggtgatatcggttttgtcgaagtgggtaacgtgcgggatcatcacccagttacggctcaggttggcgccagagattttctggatacgacccagctccacttcttcgacttcgccaaacttgctgaagtcaaccttcggccacggcagcatgcccgggataccgccgcctgcggcagcagccggtgcggattcagcgcgtttaaccgcgtctttcacgtaggcctgaacgtcttcgcgcaggatacgacctttacggccggtgcctttcactttcgccaggttaacaccgaactcgcgcgccaggcggcgaatcagcggggtcgcgtgaacgtaggcatcgttttcagcgaattcgcttttaccttctgctttcgcagccggcgcagcggcaggcttagcggcctgagccggggcagcagctggtgccggtgcagcagcctgagccggagcggcggcaggcgcagcgccttccacttcgaagaccatgatcagggaaccggttttgactttatcgccggtgctgattttgatctctttaacggtacccgcgaacggcgccggaacttccatagaggctttgtcgccctctacggtgatcagggactgttctgccgcgactttatcgccgactttaaccatcacttcggtgacttcaacttcgtcgccgccgatgtccgggacgttaacatctttcacgcctgctgcggcagccggagccgcagcagccggcgcggcagcctgtgccggagcggctgcaggcgcagcgcccgccacttcgaagatcataatcagggagccggtggaaactttatcgccggtattgattttgatctctttgacggtaccggcgaacggcgccggaacttccatagaggctttatcgccttctacggtgatcagggattgctcagcggcgatggtgtcgcccactttaaccatgatctcggtgacttcgacttcatcgccgccgatatccgggacgtgaacttctttcgctgccgcggcagccgctggagcagcggcggccggagcggcttctttcttctcttcctgcgcaggtgcagcggcggctgcaccttcggcggaatcgaaaatcataatcagtttgccagtctcggttttgtcgccgacggagactttaatctctttcacgacgccagcctgcggagacgggacttccatagaggctttgtcgccttctacggtgatcagcgactgttcagcttctactttgtcgccaactttgaccaggatctcggtgatttcaacttcatcagccccgatgtccggtactttgatttcgatagccattattcttttacctcttacgccagacgcgggttaactttttctgcatcgatgtcgaatttcgcgatagcgtcagccaccactttcttatcgatttcaccacgtttagccagttcgcccagcgctgctacgaccacatag

SEQ ID NO: 5274 - DNA, 636 bp, Klebsiella pneumoniae
gcaggcggcggacgccgtactggagttagcaaaacaatgatggagttcgtctatccgcatacccatctggttgccggcgtcgatgaggtcgggcgtggccccctggttggcgcggtggtgaccgcggcggtgatcctcgatccggcgaagccgattgtgggtctgaatgattccaaaaaactcagcgagaagcgtcgtctggcgctgttcgatgagattaaagagaaagcgctgtgctggagcctggggcgcgccgagccgcacgaaatcgacgagctgaatattctgcatgccactatgctggcgatgcagcgcgccgtcgccggcctgagcattgttcctgagtttgtcctgatcgatggcaaccgctgtccgttgctaccgatgccctcccaggcggtggtgaaaggcgacagccgggtggcagaaatcagcgcagcgtctattctggcaaaagtcactcgtgacgccgaaatggccacgctggacctcgcatttccccactacggatttgcccagcataaaggctatcccaccgctgttcacctgcagaagctgcaggaacacggcgcaacagagcatcaccggcgcagttttggcccggtgaagcgtgccctgggcctggcgtccaactaa

SEQ ID NO: 5275 - DNA, 2643 bp, Klebsiella pneumoniae
agacgtgtaggccgcattatgacaatgagagcgaggagaaccgtcgtgctagaagaataccgtaagcacgtagctgagcgtgccgccatggggattgttgccaaacccttagatgcaacccaaatggccgcgctggtagaactgctgaaaaacccgcctgcgggcgaagaagaattcctgttagacctgctgattaaccgtgtaccgccgggcgtcgacgaagccgcctatgttaaagctggattccttgccgcaatcgccaaaggcgaagcgacctcccccctggttacccctgaaaaagccgttgaactgctgggcaccatgcagggcggttacaatatccatccgctgatcgatgcgctggacgacgcgaaactggcgccgattgccgcgaaagcgctctcccataccctgctgatgttcgataacttctacgacgtggaagagaaagccaaagcgggtaacgagcatgctaaacaggttatgcaatcctgggctgacgccgagtggttcctgaaccgtccgcagctggcagagaaaatcactgttaccgtcttcaaggtcaccggcgaaacgaacaccgatgatctctctccggcgccggatgcgtggtcgcgtccggatatcccgctgcatgcgctggcaatgctcaaaaacccccgcgaaggcattgagccggatcagccgggcgtggttggcccaatcaaacagatcgaagccctgcagcagaaaggctacccgctggcctacgtcggcgacgtggtcgggaccggttcttcacgtaaatccgccaccaactcggtgctgtggtttatgggcgacgatatcccgaacgtgccgaacaagcgcggcggcggcctgtgtctgggcggtaaaatcgcgccaattttcttcaacaccatggaagatgcgggcgcgctgcctatcgaagttgatgtgtctaacctgaacatgggcgacgtaatcgacgtttacccgttcaaaggcgaagtgcgtaaccacgagaccaacgaactgctggccagcttcgagctgaaaaccgatgtgctgatcgacgaagtgcgcgccggcggccgtattccgctgatcatcggtcgcggtctgaccaccaaagcgcgtgaagcgctgggcctgccgcacagcgatgtcttccgtcaggcgaaagacgtggcggaaagcacccgcggcttctcgctggcgcagaaaatggttggccgcgcctgcggcgttgccggtatccgtccgggcgcttattgcgaaccgaaaatgacctccgtcggttctcaggacaccaccggtccaatgacccgtgatgagctgaaagacctggcgtgcctgggcttctctgcagacctggtgatgcagtccttctgccacaccgcggcctacccgaagccggttgacgttaccacgcaccacactctgccggacttcatcatgaaccgcggcggtgtttctctgcgtccgggcgatggcgtgattcactcctggctgaaccgcatgctgctgccggataccgtgggtaccggcggtgactcccacacccgtttcccaatcggcatctccttcccggcgggctctggtctggtggccttcgccgccgcgaccggcgtgatgccgctggatatgccggaatcggtgctggtgcgtttcaaaggtaaaatgcagccggggatcaccctgcgtgacctggtccacgccatcccgctgtacgccatcaagcagggcctgctgaccgtggagaagaaaggtaagaaaaacatcttctctggtcgcatcctcgagatcgaaggtctgccggatctgaaagtcgagcaggcgttcgagttgaccgatgcctcggctgagcgttctgccgccggctgcaccatcaaactgaataaagagccgatcgttgagtatctgaactccaacatcgttctgctgaagtggatgatcgccgaaggctacggcgaccgccgtaccctggagcgtcgtatccagggcatggaaaaatggctggcggatccgcagctgctggaagccgatgctgacgcggaatacgcggcagtgatcgacatcgatctggcggatatcaaagagccgattctgtgcgcgccgaacgatccggacgatgcccgcctgctgtctgatgtgcagggcgagaagatcgacgaagtgttcatcggctcctgcatgaccaacatcggccacttccgtgccgccggtaagctgctggacagccacaaaggccaactgccgactcgcctgtgggtggcgccgccaacccgtatggatgccgcgcagctgaccgaagaaggctactatagcgtgtttggtaagagcggggcgcgtatcgaaatccctggctgttccctgtgtatgggtaaccaggcgcgcgtggccgacggcgcgacggtggtttccacctctacccgtaacttcccgaaccgtttaggtaccggcgctaacgtctatctggcctctgccgaactggcagcggtggcttcgctgctcggcaaactgccgacgccggaagagtaccagaccttcgtggcgcaggtggataagacggcggaagatacctaccgttatctgaacttcaaccagctggatcagtacactgaaaaagctgacggcgtgatcttccagaccgcggtgtaa

SEQ ID NO: 5276 - DNA, 623 bp, Klebsiella pneumoniae
tctttttcaggagcaaaccggtggcaaagtcagtacccgcaatttttcttcgaccgtgacggcactattaatgtcgatcatggctacgtccacgaaatcgacaattttgaatttatcgatggcgtcattgacgcgatgcgcgaactaaaagagatgggctacgcgctggtgctggtcactaaccagtccggtattgcccgcggtaaatttaccgaagcccagtttgaaacgctgaccgaatggatggactggtctctggcagaccgcggcgtcgacctcgacggtatctactattgcccgcatcacccgcagggtgcggttgaggagtaccgccagacctgtgattgtcgtaaaccgcatccggggatgctgatttccgcccgcgactatctgcatatcgatatggctgcttcttatatggtaggggacaaactggaagatatgcaggcggcagcggctgcggatgtcgggactaaagtactggtgcgcaccggtaagcccctgactgaagaagcggaaaaagcggcggattgggtgctaaatagcctggcagagctgccggcggcgattaaaaagcagcaaaaatccttttcaccacatggccaggagccgcataggggatg

SEQ ID NO: 5277 - DNA, 198 bp, Klebsiella pneumoniae
cccccatcaggcatgactgccacccggctcagtgccgccgaaacgacgctctcgattaacaaaggcatggagtgcaccttcaaagtcctgttcagcaaaatcgggccaaagaacatccgtaaagtaaagttcggcataggcaatttgccaaatcagaaagttacttattcggtgctctcccccggtcctaataactaa

SEQ ID NO: 5278 - DNA, 861 bp, Klebsiella pneumoniae
attagcaaaggaattaaaatgccagtttctgtgatgaggttaacaaatataaataaagggataattaaattattaccacaaattgtgacgctcatcatattaataaccgctatcccacagctggcgaaattaacctggcgagtggtattccctgtgagtcctgaggatatttccgccctaccgttaaccatgcctccggcggcagatccggaattaaaaaatgtgcggcccgcatttaccctgtttggcctggcggtgaaaaatagccccacgccaacggatgctgccagtctcaatcaggtgccggtttccagcctgaagctacgcctggccgggctactcgccagcagcaacccggcgcgctccatcgctattatcgaaaagggaaatcagcaggttagccttagcacgggcgatcccctcccagggtatgatgcgcggatcgccgccattctgcctgaccggatcattgtcaactatcaggggcgcaaagaggccattttattatttaacgacagtcgcgcgccgtcgccgccgcccaccgccgcgggcaacccgcccctcgtgaagcgactccgcgaacagccgcaaaatatcctcacttatttatctatttcgccggtactcagcggcgacaaactgctgggttatcgactaaacccaggcaaagacgcctcgctgtttcgccagtccggcctgcaggcaaatgatttggcgattgccttaaacggcatcgatttacgcgaccaggagcaagcgcaacaggcgctgcagaatctggccgacatgaccgaaataacgctaaccgttgagcgggaaggccaacgacacgatattgctttcgcgctgggggatgaataa

SEQ ID NO: 5279 - DNA, 624 bp, Klebsiella pneumoniae
ttcggcggaggcgcaccgcatgatggccgacatcggcaacgagctcgacctctataccctcgccgaagagctgccggacaccgacgatctgctcgacagcgaggacgacgcgccgatcatccgcctgatcaacgccatgctaaccgaggccatcaaagagaaagcctcggatattcatatcgaaacctacgagcgccatctgcagatccgctttcgcgtcgacggcgtgctgcgggaaattctgcgcccgcagcggcggctggccgccctgttaatttcccgcatcaaggtgatggccagcctggacattgccgaaaagcgggtccctcaggatggccgcatggcgctgcgcatcggcgggcgagcaatcgacgtgcgcgtctccaccctgccctccagccacggcgaacgcgtcgtcctgcgtctgctggacaaaaacagcgtcaacctggatctgctgacgctgggcatgccgcccgccctgctcgatcgggtcgatgcgctgatcgcccgcccgcacggcatcatcctggtcaccggtccgaccggctccgggaaaagcacgacgctctacgccgccctcagccgcctcgacgcccgggagcgcaacatcatgaccattga

SEQ ID NO: 5280 - DNA, 843 bp, Klebsiella pneumoniae
ccacctacgggcgcggttcgccgcgccctctatcaggttatcgctatgcaggaacagactccgcacgcagaaaccaccttcgcgctggatcgcgtcactttccgtgtgcctggtcgcacattgctccatccgctctcgctcaccttcccgtccggaaaagtcacaggcctgatcggccataatggctccggcaaatcgacgttactgaaaatgcttggccgtcatcagccgccctccgcaggcgaagtgctgctggacgggcagccgctggagagctggggcagcaaagcctttgcccgcaaagtggcctatctgccgcagcagctgccgccggccgaaggtatgacggtgcgcgagctggtggcgatcggccgctatccatggcacggcgcgctgggtcgctttggcgcagcggaccgtgagaaagtagaagaggcgattgcgctggtggggctgaagccgctcgctcatcgtctggtggacagcctctccggcggtgaacgccagcgggcgtggatcgccatgctggtggcgcaggacagtcgctgcctgctgctcgatgaacccacctcggcgctggatattgctcatcaagtcgatgttctggcgctggtgcatcgtctcagccagcagcgcggcctgacggtgatcgccgtcctgcacgatattaatatggcggcccgctattgcgactatctggtggccctgcgcggtggagaaatgattgcccaggggacgccggcggaactgatgcgcagcgacactctggaacagatctacggcatcccgatggggatcctgccacacccggccggtgcggcgccggtaagctttgtctattga

SEQ ID NO: 5281 - DNA, 210 bp, Klebsiella pneumoniae
tcatgggcggggttttcgtggtggaaacgctgtcggttattctgcaggtcggctcctttaagctgcgccggtcagcgcatcttccgcatggcgccgattcaccaccactatgaactgaaaggctggccggagccgcgcgttatcgtgcgcttctggattatttcgctgatgctggtgctgattggcctggcgacgctgaaggtacgttaa

SEQ ID NO: 5282 - DNA, 432 bp, Klebsiella pneumoniae
cgccgcgaggggcatcaacgtcgacgcccagggcgacagccagccgctggcggcgcgggagcagccatgaagcgtgaagccggaatgacgcttatcgaagtgatggtcgcgctggtgattttcgccctcgctggcctggcggtgatgcagtccaccctgcagcagacgcgccagctcgggcgtatggaagagaaaatcctcgccagctggctggcggataaccagctggtgcagctgcggctggagaaacgctggcctgccctcagctggtctgaaaccaccgtggaggccgccgggacgcgctggtttgtccgctggcagggagtggaaaccgcgctgccgcagctgcgggcgctggacgtggaggtccggcggcaaaaaagcgatcccgcgccgctggccaccctgcgcacctgggtgacgccgccatga

SEQ ID NO: 5283 - DNA, 789 bp, Klebsiella pneumoniae
ttaatccttattatggacttaaaacgcgtgatgttgtctgctaatcaaactgtcagcgaaatatcgcccacccatggctgccgtcatgtcgccattattatggatggcaacggccgttgggcgaaacggcaaggtaaaattcgcgctttcgggcataaggccggggcgaaatccgtgcgtcgcgcggtctccttcgcggcgaataatgggattgaggcgttaacgttatacgcgttcagcagcgaaaactggaaccgtccggctcaggaagtcagtgcgctgatggaactgttcgtctgggcgctggatagcgaagtcaaaagcctgcaccgacacaatgtgcgtctgcggattattggcgataccacgcgcttcaatgcgcgcctgcaggagcggatccgcaaagcggaagcgctaaccgcaaacaataccggcttaacgctgaatattgcagccaattacggcggtcgctgggatattacccagggcgttcgtttgctggcgaaacaggtacaggacgggacgctgctgcctgagcagatcacggaagacatgctgagtcagcaggtctgcatgcatgaactggctcccgttgatttagttattaggaccgggggagagcaccgaataagtaactttctgatttggcaaattgcctatgccgaactttactttacggatgttctttggcccgattttgctgaacaggactttgaaggtgcactccatgcctttgttaatcgagagcgtcgtttcggcggcactgagccgggtggcagtcatgcctga

SEQ ID NO: 5284 - DNA, 1968 bp, Klebsiella pneumoniae
ccattattcttttacctcttacgccagacgcgggttaactttttctgcatcgatgtcgaatttcgcgatagcgtcagccaccactttcttatcgatttcaccacgtttagccagttcgcccagcgctgctacgaccacataggaagcatcgacttcgaagtggtgacgcaggttttcacggctgtcggaacgaccgaagccatcggtacccagtacgcggtaatcatcagccggtacgtaagtacgaacctgctcagcgaacagtttcatatagtcagtggatgccactgccggagcgtcgttcattacctgagcgatatacggcacgcgcggggtttccagcgggtgcagcatgttccagcgttcgcaatcctggccatcacgcgccagttcggtgaaggaggtaacgctatacacgtcggaacccacgccgtagtctttcgccaggatctgcgctgcttcacgcacgtgacgcaggatagaaccggagcccagcagctgaactttacctttgctaccttcgatggtttcgagtttgtagatacctttacggataccttcctcggcgccttccggcatggccggcatgtggtagttttcgttcagcgtagtgatgtagtagtaaacgttctcttgcgcttcgccgtacatacggaccagaccatcatgcatgatgacagccacttcataggcgtacgccgggtcgtaagagatacagttcgggatagtcagcgactgaatgtggctgtgaccatcttcgtgctgcagaccttcgccgttcagggtagtacgaccggaagtcccgccaatcaggaagccgcgagcctgctgatcgccagccgcccagcacagatcgccgatacgctggaagccgaacatcgagtagtagatatagaacgggatcatcggcaggttgttggtgctgtaagaggtcgcagcagccagccaggatgcgcctgcgcccagctcgttgatcccttcctgcagaatctggcctttctcgtcttctttgtagtaagcaacctgctcacggtcctgcggggtatactgctggccgttcgggctgtaaataccgatctgacggaacagaccttccataccgaaggtacgcgcttcgtcggcgatgatcggcaccagacgatctttgatcgacttgttcttcagcatcacgttcagggcgcgaacgaaagcgatagtggtagagatttctttgttttgctcttccagcagcgcgctgaagtcggccagggtcggcagctcgagtttctcagtgaacttcggctgacgagtcggcagatagccgttcagcttctgacgctgagcgtgcaggtaagtgtgctcttcggaaccttccgggaaggttacgtacggcagtttttcgagatcggcatccgccaccggcacattgaaacgatcgcggacgtagcgaacaccgtccatgttcattttcttaacctggtgcgcgatgttcttaccttcagcggtatcgcccataccataacctttaatggtatgcgccaggatcacggtcggctgacctttggtctcctgcgctttcttcaatgcagcgtagactttcttcggatcgtgaccaccgcggttcagagcccagatctgctcgtcagtccagtcagcgaccagggcagcggtttccggatatttgccgaagaagtgctcacgaacgtaagcgccgtctttggatttgaaggtctggtagtcgccgtcaacggtttcgttcatcagctgaatcagcttaccgctggtgtctttacgcagcagctcatcccaacggccgccccagataaccttgataacgttccagccagcaccaccgaagatgccttccagttcgttaatgattttgccgttaccggtgaccgggccgtccagacgctgcaggttgcagttgatgacgaagaccaggttgtccagtttttcacgggtggcgatggtgatagcgccttttga

SEQ ID NO: 5285 - DNA, 918 bp, Klebsiella pneumoniae
atcttatctatctggagctttatcatgtcgcctcgtcgttacaaccccgaccgccgccgtgacgtgctgctggaacgtattaatctcgatattaccgatgctgtcgcacactccctgcgggaagatctgggcggcgaagtcgacgccaacaacgatattagcgcgcaattattgccgcaggatgcacgctcccatgcggtggtcattactcgtgaagatggcgtcttctgtggcaaacgctgggtggaagaggtctttattcagctcgccggtgacgacgtgaatatcacctggcacgtggccgacggcgatgcggtcaaagccgaccagccgctgttcgaattggaaggcccgtcgcgtattctgctcaccggcgaacgcacggcgctgaactttgtgcaaaccctctccggcgtcgccagcgtcgtccgtcgctatgtcgacctgctcgccggcaccaaaacccaactgctggatacgcgcaaaacgctgccagggctgcgtaccgcgctgaaatacgcggtactctgcggcggcggcgccaaccatcgactaggcctgttcgacgcgttcctgattaaagaaaaccacattatcgcctccggatcgatccgtcaggcagtggaaaaggcgttctggctgcatcctgatgtgccggtggaagtggaagtggaaaccctggatgaactggagcaggcgttaaaagccggggctgatatcattatgctcgataacttcaccaccgatctgatgcgcgaggcggtgaaaattaccgcaggccaggcggcgctggaggtctccggcaacgttacctttgacaccatccgcgaattcgccgataccggcgtcgactatatttccgtcggcgccctgaccaaacatgtgcaggcgctcgacctgtcgatgcgcttccgctga

SEQ ID NO: 5286 - DNA, 282 bp, Klebsiella pneumoniae
gctttgtctattgatgatgaacccaactctgataacccgacgccgcctgctgatcgcgatggcgctctcgccgctgctgtggcagatgcgcggcgcgcaggcggccgacgtcgacccgcagcgcgtggtcgccctggagtggctgcccgcggagctgctgctggcgctcggcgtgacgccctatggcgtggccgatattcccaactatcgcttgtgggtgaacgaacccgcgctgcccgactcggtgatcgatgttggtctgcgtaccgaacccaaccttga

SEQ ID NO: 5287 - DNA, 417 bp, Klebsiella pneumoniae
ggaaatactatgcgtgctttaccgatctgtttgttagcactcatgttaagcggttgttccatgctaagcagatctcccgttgagcctgctcaaagcactgcaaccccgccggttaaatctgagccgagcaaaccgcgcgccacccgcccggccccagtacgtatttacaccgatgcgtcagagctggttggtaaaccgttccgcgatctgggtgaagtatctggcgagtcctgccaggcttcgaatcaggattctccgccgaatatccccaccgcgcgcaagcgcctgcaaattaatgccgcgcgtatgaaagccaatgccgtcctgcttcaccgctgcgaagtgaccagcggtacgccaggctgctaccgtcaggccgtttgcctgggttcagcgcttaacgtctcggcgcaatga

SEQ ID NO: 5288 - DNA, 327 bp, Klebsiella pneumoniae
agggacgctatccgaaacacgtctggccggacgatccggccaacgccgccccgacccgccgcagcaaaaaatactcgtagccgccgctgccgggcggcatcctgcccggccagtcggttcgcaaacgctagaccatctgctgccagagaaaaatactcccgccggccagcgccagccaggggccgaaggccagcggctgctgcagcgactgccgggtccacaggcgttgcagcagggtccacaccagcccgctggccgaagcgagcaacagcacctgcggcagaacctgccagccgcaccaggcgcccagcgccgccagcagcttaa

SEQ ID NO: 5289 - DNA, 486 bp, Klebsiella pneumoniae
aaccaggctataatcaggcctggttttttatcggcgagaatacccgtgacccagccacgagcaggatttttactcacccgtcactggcgggacactccgcagggcaccgagctctccttctggctggccaccgacgacggtccgctgcaggtcaccctcccgccgcaggagtccgtcgcctttattcccgaagcgcagcgggcgcaggctgaacggctgctgcaggggggagaaagggctccgcttcgccccgctggccctgaaagatttccaccgtcagccaattgttggcctctactgccgcgcccatcgccagttgatgcgtctggagaagatgctccgcgacagcggcgtcaccgtttacgaaggcgatatccgcccgccggagcgctatctgatggagcgctttatcaccgccccggtgtgggtggaaggcgaaacgcgcggctcgcagctggtcaacgcgcgcatgaagccgaaccctga

SEQ ID NO: 5290 - DNA, 1959 bp, Klebsiella pneumoniae
atacaacgtatgaaaaaacgtattcccagcctcctggctacgatgattgccagcgccttgtatagccaacaaggcctcgctgccgatctcgcaacgcaatgtatgcttggcgtgccaagctatgatcgtccgctcgtggaaggtcgtcctggcgatctgccggtgacgattaacgccgatcatgcgaagggcaactacccggacaacgccgtctttaccggcaacgtcgatattaaccaggggaatagtcgcctccgcgccgacgaagttcagctgcaccatcagcaggccgcgggccaggcgcaaccggtgcgcacggtggacgcgctgggcaacgtgcattacgacgataaccacgtgatcctcagagggccaaaagcctggtcgaatctgaataccaaagataccaacgtctggcagggcgattatcaaatggtcggacgccagggacgcggcaccgccgacctgatgaaacagcgcggtgaaaaccgctataccattctcgaaaacggcagctttacctcctgtctgccgggctccgacacctggagcgtcgtcggcagcgaagttatccacgatcgcgaagagcaggttgccgagatctggaacgcccgcttcaagcttggctctgtgccgattttctatagcccctacctgcagctgccggtgggcgataagcgtcgttcaggcttcctgatcccgaacgcgaaatacagcaccaaaaacggcgtggaattctccctgccgtactactggaacatcgcgccaaacttcgatgccactattactccgcactatatgaacaaacgcggcggcgtgatgtgggaaaacgagttccgctatctgacccagctcggcagcggcttaactgaattcgactacctgccgtcggataaagtctacgaagacgaccactcgagcgacagcaacagccgccgctggctgttctactggaaccactcaggggttatcgatcaggtatggcgtctgaacgctgactacaccaaggtcagcgatcctgactacttcaacgacttcagctcgaaatatggttccagtaccgacggctatgcgacgcagaaattcagcgccggttacgtcaaccagaactttgacgccacggtatcgaccaaacagttccaggtctttgaccgcgaatcgagcaactcctattcggctgagccgcagctcgacgtcaactactaccagaatgatgtcggtccgttcgatacccatctctatggacaggttgcccattttgttaactcgaataacaacatgccggaagcgacccgcgttcacttcgaaccgacgatcaacctgccgctgtccaacggttggggcagtctgaataccgaagccaagctgctggcgactcactaccagcagagcaacctcgataagtacaatgccgccaacggcactgactataaagagtccgtcagccgcgtaatgccgcagtttaaagtcgacggcaaaatggtctttgaacgcgacctgcaggagggattcacccaaacgctggaaccgcgcgtgcagtatctgtacgtgccgtaccgcgatcagagtgaaatcggcaactacgactccacgctgttgcagtcggattacaccggtctgttccgcgaccgtacctatagcggtctggaccgcatcgcgtcggctaatcaggtcaccaccggcctcacctcgcgcgtgtacgatgccgccgcggtggaacgttttaatatttccgtgggccaatctactattttaaccgatcaacgcaccggtgaagacatgacaacatcaactgggagaacaacgataccacgggttcactggtctgggccggcgatacctactggcgcattgccgatgaatggggtctgcgcggggggatccagtacgatacgcgtctggataacgttgccactggtaacggcaccattgaataccgtcgcgatgagaaccgcttag

SEQ ID NO: 5291 - DNA, 1113 bp, Klebsiella pneumoniae
ttcgcgcgtatgataacgtcactggagttgtgctctcacattcatgccattaaccccaggaattcgcacatgcgtattgaagaagatctgaagcttggtttcaaagacgttcttatccgcccgaaacgctctaccctcaaaagccgttctgatgttgagctggaacgtgaattcacctttaaacattcaggcctgacctggtccggcgtgccgattattgcggctaacatggataccgtcggcaccttcagcatggctaaagcgctggccacttttggtattctgaccgcggtacataagcactacaccgctgaagaatggctggcgtttacccagggcgcatccgcagacgtactcaagcatgtgatggtttccaccggcacgtccgatgcggatttcgaaaaaacccagcagatcctctctcagaacccacagctgaattttgtgtgtatcgacgtcgccaacggctactccgagcactttgtacagttcgtggcgaaggcgcgcgaagcctggccgcaaaaaactatcatcgccgggaacgtggtcaccggtgaaatgtgcgaagagctgatcctctccggcgccgatatcgtcaaagttggcatcggcccgggatccgtctgcaccacccgcgttaagaccggggtcggctatccgcagctctccgccgtgattgagtgtgccgatgcggcgcacggccttggcggccagatcatcagcgacggcggttgcaccatgccgggcgatgtggcgaaagccttcggcggcggcgctgatttcgtgatgcttggcggcatgctggcgggccatgaagagagcggcggaaccatcgttgaagagaacggagagaaattcatgctgttctacggcatgagctccgagtcggcgatgacccgccatgtgggcggtgtcgcgaaataccgcgcggcggaaggcaaaaccgttaagctgcctttgcgtggaccggtggagaataccgcacgtgatattctcggcggcctgcgttctgcctgcacctacgttggcgcctcgcgtctgaaagagctgaccaagcgtacgacctttatccgcgttcaggaacaagagaaccgggtattcaatagcctgtaa

SEQ ID NO: 5292 - DNA, 516 bp, Klebsiella pneumoniae
ccgcttatctttgactcccatcaccgatacgtcatcttcaccttgctacattattcgctggctaaggagggaagcatgctcggatgggtcattacctgtcacgatgagctggcgcaggagatgctggatcgtcttgaacaaaagtttggtccgctggcccagtgccgggcggtcaattactggcgcaatctcagcagcaatatgttgagccggatgatgtgcgatgcgctgcatgccaccgactccggggacggggtcatttttctcactgacaaaaccggtgcggcgccttatcgggccgcggcgctgatgagccacaaacatacccactgcgaagtgatctccggcgtcagctatccactccttgagcgaatgtatctcctgcgaggcacgttaagcagcgtggcgtttcgccaggcgatcgtcagcgcgggcgggccggtggtgagcagcctgtggcatcagcagcagaagaaccccccgttccggttgcgccatgatgcctggggaaattaa

SEQ ID NO: 5293 - DNA, 981 bp, Klebsiella pneumoniae
agggaattcatcgtgacggcggaattagatatgttaattgaaactccagaatataaatcagcccccggacaggaagtcgttaaacctcaactacggatggttgatctcaatctgcttaccgtttttgatgcggttatgcaagagcagaatattactcgtgccgcccatacgctcggcatgtcacaacccgcggtgagcaatgcggtttcacgactgaaagtgatgtttaatgacgagctttttgtgcgctatggccgcggtattcagccgacggcgcgcgcctatcagctgtttggctcggtacgccaggcgctgcagctggtccaaaacgaattgccaggctccggttttgaaccgctgagcagtgagcgcgtgttccatctgtgcgtctgcagcccgctggataacatcctgacgtcggttatttttaataaagttgcagagatagcacccaatattcatttagtctttaagtctgcgttgaatcaaaatacggaacatcagctacgttatcaggaaacagaattcgtaatcggttatgaagagttccgtcgccctgagtttgcctgcgttccgttatttaaagacgaaatggtcctggtcgccagtcgcaaccatccgcgtatttccgggccgatgatggaggcggatatttatcgcgaggagcatgccgccgttgctctcgaccggtatgcctcatttagtttgccgtggtatgacacggccgataaacaagcgcgtatcgcctatcagggtaatgcgatggtcagcgtattaaacgtagtatcgcaaacccagatggtggccattgccccgcgctggctggcagatgaatttgctgacaagcttgccctgcaaatattacctttgccgttgaaggtcaacagtcggacctgctatctctcctggcacgaagccgctggtcgtgataaaggccaccagtggatggaagagctgctggtggacatttgcaagcgctga

SEQ ID NO: 5294 - DNA, 1194 bp, Klebsiella pneumoniae
ggacattccatgctgtggttgatgacgatgggacgacggcttaacggcgtctatgccgcctttatgctggttgcttttatgatgggcgtggcgggcgcgttgcaggcgccgacgttgagtttgtttctcagccgcgaagtgggggcgcaaccattctgggtgggcctgttctataccgtaaacgccatcgccgggatcctggttagcctgtggctggccaagcgctccgatagccgcggcgaccggcggcggttgattatgttctgctgtctgatggcggtgggtaatgcgctgctgtttgccttcaaccgccactatctgacgctgatcacctgcggcgtgatgctggcatccattgccaacgccgccatgccgcagctcttcgcgctggcgcgggagtacgccgacagctcggcgcgggaagtggtgatgttcagctcggtcatgcgcgcccagctgtcgctggcttgggtgattggcccgccgctggcctttatgctggcgctcaactatggcttcaccaccatgttctccattgcggcgggcatttttgtcattagcctcgctctgattgccatcaaactgccttcggttccgcgtgtggaacagccctcggaggaggcggcggcgctagcgcaggccggcggctggcaggacaagaacgtgcgtatgctgtttatcgcctccaccctgatgtggacctgcaacaccatgtacatcattgatatgccgctgtggatcagcagcgatctcgggcttcccgacagcctggccgggatcctgatgggcactgccgccgggctggagataccggcgatgatcctcgccggctactacgtaaagcgctttggcaaacgtaaaatgatggtggcggcggtggccgccggcgtgctgttttatgccggactgatcctgtttcatggtcgcacggcgctgctggctctgcagctgttcaatgccatctttatcggcattatcgccgggataggcatgctgtggttccaggatttaatgccgggacgggcgggagcggcgaccaccctgttcaccaacagtatttccaccggcgtgatccttgccggcgtgatgcagggggcgctgtcccagagctatggtcacgccagcgtctactggacgatcgcggccatttcgctggtgacgctgtttttaaccagcaaggtgaaggatatctga

SEQ ID NO: 5295 - DNA, 1983 bp, Klebsiella pneumoniae
ttgccaaccatgaaaagcctgcgaaaaatgctgcctgcgctgctgatattaaccccattgctattttctccggccgccgcggaggaattttccgccagttttaaaggcaccgatatccaggaatttatcaataccgtcagcaaaaacctgaataaaacggtgattatcgatcccagcgtacgcggtactatcaccgtgcgcagttacgatatgctcaatgaagaacaatattatcaattcttcctcagcgtgctggatgtatatggcttcgccgtgatcaatatgaataacggcatgctaaaagtggtccgcgccaaagacgccaagacctcggccgtgccggtcgccagcgcggccgcgccgggcgaaggcgatgaagtggtcacccgggtggtgcccctgaccaacgtcgccgcccgcgatctcgccccgctgctccgccagctgaacgataacgctggcgccggcagcgtggtccattatgagccctccaacgtactgctgatgaccggccgcgcggcggttatcaaacgtctgctgaccattgtcgagcgcgtcgacaacgccggggatcgcagcgtggtgaccgtgcccctttcctgggcctccgccgcggaagtagtcaaactggttaccgagcttaataaagataccagcaagtcggcgctgccgggctcgatggtggcgaacgtggtggccgatgagcgcaccaacgcggtactggtgagcggcgaaccaaactcgcgccagcgcatcatcgccatgatcaaacagctcgaccgccagcaggcggtacaaggtaacaccaaagtgatctacctgaagtacgccaaagccgccgatctggtggaagttctgaccgggatcagcagctcgctgcagagcgacaagcaaagcgccaggccagtggccgcgatcgacaaaaatattattatcaaagcccacggccagaccaacgccctgatcgtcaccgcggcgccggacgtgatgaacgatcttgagcgggtgatcgcccagctcgatatccgccgcccgcaggtgctggtggaggcgattattgccgaagtgcaggatgccgatggccttaatctcggtatccagtgggcaaacaaaaacgccggcatgacgcagttcaccaacagcggtttgccgatatcgacggctatcgccggcgccaaccagtacaacaaagacggtaccatcagcagctcgctggccagcgccctcggctcgtttaacggtatcgccgccggcttctatcaggggaactgggcgatgctgctcaccgccctctccagcagtaccaagaacgatattctggccacccccagcatcgtcaccctcgataacatgcaagccacttttaacgtcggccaggaagttccggtattaaccggctcgcaaaccacctccggcgacaacatcttcaataccgtcgagcgcaaaaccgtcggcattaaactgaaggtgaagccgcagattaacgaaggcgatgcggtgctgctggagattgagcaggaggtatcgagcgttgccgactcggcctccagcaccagcagcgatctcggggcgaccttcaatacccggacggtgaataacgccgtgctggtcggcagcggcgaaacggtggtggttggcgggctgctggataaaaccgtcaccgataccgctgacaaagtgccgctgctcggggatatcccggtgatcggcgccctgttccgctccgacagcaagaaagtgtcgaaacgcaacctgatgctgtttatccgcccgaccatcattcgcgatcgcgatgagtaccgccaggcttcttccggccagtacaccgccttcaacaatgcgcaaactaaacagcggggtaaagaaagcagcgaagcgtcgctcagcaacgacctgctgcatatctatccgcagcaggagacccaagccttccgccaggtcagcgccgccattgacgccttcaatctcggaggccgcccatga

SEQ ID NO: 5296 - DNA, 204 bp, Klebsiella pneumoniae
ggagataacatgtcagaagagactatcgtcaactgcccgacctgcggcaaaactgtggtgtggggcgagcagagtccgtttcgtccgttctgtagcaagcgctgccaactgatcgatctgggagaatgggctgcggaagagaagcgcatccccagcgcgggggatctctccgatagcgatgactggagcgagcagcaaccctga

SEQ ID NO: 5297 - DNA, 936 bp, Klebsiella pneumoniae
cgtcagtgcatttattcttatattatacgggtaaaaataatgaacctaaagcaactttattattttaaacgtctgtctgaaactgagcattacaccgaagccgcctccagtctgtgcatcacccagccctcgctaagccacgcgatatcggagctggagaaggagttaggggtcgcgctattcgccagacaggggcggaacgtaaaaattacccaaaacggcaagcgttttttgccgtatgttgaagatgcgctggcctcgctggagaacggacgcatgatattgcaaaaaaatggcgctgagaataaagagaatattcgcatcgcctttatttacacgatgggggagtatgttgttccacagttaattaataaatattctctttcacctgaatgtcacaatgtgactttttcttttactcaagggacatcgctgacgctgttgcaggagctgaaggccggaaaagtcgatctggcgatctgctcttatattgccgatgaacccgatatcgattttattccggtgatccagcaggaactggtggtggtcacggcaaaggatcatccgctggcccggctatatgaacatgaagtcgatctggtggagacgattcattatccgtatatctatttttcagaaaatagcggcttacgtccgtttatcgataatgtatttatgcagcaaaagctggtgccggagatcgcctgctatgtggatgaggatacggcgatggccgggctggtgagtattgactacgggatcgcgattatgccgcgcatcaccgcgctctcctattacaatgtccatatcctgaagattaaaaacaccatccccccccgctatatctatctggcgaccatgaaagacaaggggctctctccggcgctggagtcatttaaaaatgtggttatccacgatagccagaagatctgttaa

SEQ ID NO: 5298 - DNA, 2448 bp, Klebsiella pneumoniae
gaagaacgcataataacgatggcgatgaaaaagttgctcatagcgtcgctgctgtttagcagcgcgactgtatacggtgctgaagggttcgtggtgaaggacattcatttcgaaggcttgcagcgtgtcgctgttggtgcggccctcctcagtatgccagtgcgtcctggcgatacggtgaccgacgatgatatcagtaacactattcgcgcgctgtttgccactggcaacttcgaggacgtccgcgtcctgcgcgatggtgataccctgctggtgcaggtgaaagagcgtccgacgatcgccagcatcactttctccggcaacaagtcggtgaaagatgacatgctcaagcagaaccttgaggcctcaggcgttcgggtgggcgagtcgcttgaccgcacgaccatcgcggatatcgagaagggtcttgaagacttctactacagcgtcggtaaatacagcgccagcgtcaaagcagtcgttacgccgctgccgcgtaaccgtgtcgatttgaagctggtcttccaggaaggcgtctccgcaaaaattcaacagatcaacatcgtcggcaaccatgcgttttcgaccgatgagctgatctcccacttccagctgcgcgatgaggtgccgtggtggaacgtggtcggcgaccgtaaataccagaagcagaagctagcgggcgaccttgaaaccctgcgcagctactacctggatcgcggctatgcccgtttcaacatcgattctacccaggtcagcctgacgccggataagaaagggatctacatcaccgtcaacatcaccgaaggcgatcagtacaagttttccggagtgcaggtgacgggcaacctcgctggccattccgcggaaatcgaagcgctgactaaagttgagccaggcgaactgtacaacggcgcgaaagtgaccaagatggaaaacgacatcaagaaactgttgggtcgttatggttacgcctatccgcgcgtgcagtcgcagccggagatcaacgacagcgataaaaccgttaagctgcacgttaacgtcgacgcaggcaaccgttattacgtgcgtaaaattcgcttcgaaggcaacgacacctctaaagatgccgtactgcgccgcgaaatgcgccagatggaaggcgcatggctggggagcgacctcgtcgatcagggtaaagaccgtctcaaccgtttaggtttctttgaaacggtggatactgatacccagcgcgtgccgggcagcccggaccaggtcgacgttgtctacaaggtgaaagagcgtaacaccggtagcttcaacttcggtatcggctacggcaccgagagcggcgtcagcttccaggcgggcgttcagcaggataactggttaggtactggctatgctgtcgggatcaacggtaccaaaaacgactaccagacctataccgagctgtcggtgaccaacccgtacttcaccgtagacggtgtaagcctcggcggtcgtgtcttctataatgactttgatgcgaacgatgcggatctgtctgactataccaacaaaagctatggtacagacattacgctgggcttcccggtcaacgaatacaacacgctgcgcgccggcgtcggttatgtgcataactccctgtccaatatgcagccgcaggtggcaatgtggcgttaccttaactcgatgggccagtatccggacaacaccaacgaccggaactcgttcagtgcgaatgacttcaccttcaactacggttggacctataacaagcttgaccgcggcttcttcccaacggaaggttcgcgcgtcaacctgaacggtaaggtgaccattccgggctcagacaacgagtactacaaagcgacgctggataccgcgacctacgtgccgatcgacaacgatcatcagtgggtagtactgggtcgtacgcgctttggttatggcgatggtatcggcggcaaagagatgccgttctatgagaacttctatgccggtggttccagcaccgtgcgtggcttccagtcgaacaccattggtccgaaggcggtgtacttcccggcaagcagtcgtcatgatgatgacgatagttacgataatgaatgtaagagcaccgaatccgcaccgtgtaaatccgatgatgcggtgggcggtaacgcgatggcggtggccagccttgagctgattaccccgacgccgtttattagtgacaaatatgcgaactcggtccgtacttccgtcttctgggatatgggtaccgtatgggatactcactgggattcgagcgcgtacgctggttatccggattacagcgatccgagcaacatccgtatgtctgcgggtattgccgtacagtggatgtcgccgttggggccgttggtcttctcctacgcccaaccgttcaaaaagtacgatggagacaaagccgaacagttccagtttaacattggtaaaacctggtaa

SEQ ID NO: 5299 - DNA, 207 bp, Klebsiella pneumoniae
gatgtgttaattccggcgacattgtatgtcgcatttcagcgcggccactataagcagttggctgaatttacaaaatgggcgcaaaaagaagccgccctcaggcggctcctttttttaaaaattaagactgcttggacatcgcagcaacttctgctgcaaagtcagtctcaactttctcaatgccttcgcccacttcaaagcggatga

SEQ ID NO: 5300 - DNA, 243 bp, Klebsiella pneumoniae
ccattactaatgaccgccacgcagtcgcagatacgtttaaccacgtccatttcatgggtgatcaacaggatggtcagccccagacgacggttaatgtctttcagcagttcgagaatggaacgggtagtggccggatccagggcgctggtggcttcatcgcacagcaatactttaggattgctggccagcgcgcgggcaatcgccacgcgctgtttctggccgccggagaggttggccgggtag

SEQ ID NO: 5301 - DNA, 906 bp, Klebsiella pneumoniae
ctggataaaataccgtgcgctgctcagcgccccgtcagaaaaggagacctcatgacgctgtttacgacgctgttggtgcttatcgccgaacggctgtttaagctgggcgaacactggcagcttgatcatcggctggaggtggcgtttcgccggataaaacatttctcgctaccgggcacgctgctgatgacgctggtggccgtcgcggtcgtgtatatcattcagcgtctgctgcaggggcagctgtttaacataccgctgctggtgttctggattttactgggcctgctatgcattggcgccggcaaagttcggctgcactaccatgcctatctgaaagcggcgtcgcgcaatgacagtcgcgcctgcgatgccatggccagtgagctgacgcttattcacggcgtgccgccgggctgtgatgagcgtgagtaccttagcgaactgcaaaatgcgctgctgtggattaactatcgatactatctggcgccgcttttctggtttgtcgtggggggcgcctggggcccgctgacgcttatcgcctacagcgtactgcgcgcctggcagacatggctggcgcgctaccagacgccgcaccaccggttgcagtccgggatcgatggtatcctgcatattgtggactggctgccggtgcgtctggtgggggtggtctatgccctggtgggccatggtgaaaaagcgctcccggcgtggtttgcttcgctgggcgaccgccattcgtcgcagtatcaggtgttgacccgcctggcgcagtattccctggcccgtgagccgcacgtggataaagtagcgacgccgaaggctgcggtatcgatggctaagaagacttcgctggtggtagtggtgattatggcgctgctgacgatttacggtaccctggtttaa

SEQ ID NO: 5302 - DNA, 357 bp, Klebsiella pneumoniae
tccataaaaataaaaacagcaccacgagttaactgtaacttaagcaataataaagtattttatttttccctccataaaattaacaaatccttatcattgaaaaatagtccgctagcgttcgaatacattcacaggaaaaataaatttaatattttcatccagataccgttttttgtcccttcattggcgacacctgttcgacgatgccttgaatgcaaagcactttttcaaatgaaacaattggggataaaccgccttcggtccaaaataggaacttcggcaaaatggggcttacatcagcacattttgctaattcatttagtcagcccaaaacgctttttccatgccaggggttga

SEQ ID NO: 5303 - DNA, 765 bp, Klebsiella pneumoniae
tggtggagaatctggtacagaacctggcacgtggctaagtcgctatccttcgcgcttgccgcgctgctgttactcgccccggcgtggctgctggccgcgccgcgggtgatcaccctctcccccgccaataccgaactggcctttgccgccgggatcacgccggtcggcgtcagcagctattccgattatccttcgcaggccaaaacgatcgaacaggttgccagctggcagggaatgaacctggaacgcatcgtggcgctcaagccagacgtggtgctggcctggcgcgggggcaatgccgaacgccaggttaaccagctgcagtctctgggtattcatgtcctgtgggtacagacctcgaccatagaagagatcatcgctaccctgcgtgagctggcgcagtggagcccgcagccggaaaaagcacagcaggcggcgcaggcgatgcagcaggaatacgatgcgttgaaagcgcgctatgccaacgcgccgaagaaacgcgtcttcctgcagttcggctccgcaccgctgttcaccagcggccccggttcgattcaggatcaggtgctaaggctttgcggcggcgagaatatcttcgccaccagccgcgttcccctggccgcaggtgagccgcgaacaggtgctggcccgccagccgcaggcgatcgtggtgaccggggatgccagccgcattgccgaagcgcagcgcttttggcaacatcagctcaccatttcgttgattgcgttacacagcgactggtttga

SEQ ID NO: 5304 - DNA, 726 bp, Klebsiella pneumoniae
ggaaagttgatgcagtttgatccgccgttgcagcccgccattttgcttaaacgttacaaacgatttcttgctgacgtggtcacccccgatggccgcgagctgacgctccactgcccgaataccggggcgatgaccggctgcgccgccccgggcgacaccgtctggtattccacctcagacaatgcgaagcgcaaatatgcccacacctgggaattaactgaaacccagcagggcgcagttatttgcgtcaatacgctgcgcgcgaattctttggcgaaagaggcgatttccgccggaataattcctgaactttcaggctataaccagctgaaaagcgaagtgaaatatggcgaagagaatagccgtatcgatattatgttacaggcagatgaccgacaaaactgctatattgaagtgaaatcggttacgttggcggagaaagaatacggttattttcccgatgcggtgactacgcgcggtcagaagcacctgcgggaactgatggccgtcgcggcaaatggcgaccgcgcggtgattttatttgccgtcctgcattcggcaattgaccgtttttctcccgcgcatcatattgatgccagatacgcacagctgttaacagaagcccaggacaagggggtggaaattctcgcctggaaagcggaactttctacgacgaggatgactctgaataagccgatcgccgtggtgttaaaccccggtaaataa

SEQ ID NO: 5305 - DNA, 408 bp, Klebsiella pneumoniae
cggccagtgattcattattttgattactctatgatgcgtattccgcttatatttccgctttgcatggtagcccttctctctggctgccaacaaaaacctgcctcaacgctcagcccggccatcagcagccaggcacagctcgagcagctctcgtccgtggcggccgggacgcgctatctcaagaataaatgtaatcgtagcgatctccccgctgatgaaacgatatatcgggcagcggtgaatatcggtaaagcgcgcggatggggaaatattgacgtggcgacgttaagccaaaatagcgaccggctttaccaacagctattacaggacagtaccccggaagccacacagtgcagtcaatttaatcgtcagctcgcgccatttattgccagcttgcgcagcgactaa

SEQ ID NO: 5306 - DNA, 363 bp, Klebsiella pneumoniae
cgggccaggatgttcggtctggtcaatcagcttgggatcgacaggctcttcgctgaccagaatggtcacgctggcgccctggggttcataatcctgacgggcgatattcaggatattggcgccaataatagaacaggtttctgtcaggatctccgtcaggcgattggcattatagagttcgtcgatataggcgatgtagccgtcgcgctcttctgccgttttggcgtaacagatatcgtagatacaaaaactcaggcttttggtcaggttgttaaagccgtgcagcttcaattttttcaatttagttcacccccttatttcgcgtcacggtgcggacagagcatcatgcagatattgtggtaa

SEQ ID NO: 5307 - DNA, 723 bp, Klebsiella pneumoniae
ttgaaaaacttccggggcgtgatgctaaaactcaatgatgtgacctggctataccagcatctgccgatgcgcttcaccctcgacgtcgcgcgcggggagcgcatcgcggtgctcggtcccagcggcgccggaaagagcaccctgctgaatctgatcgccgggtttctgccacccgccagcggcagcctgctgattaacggcgaggtgcataacgcgacgccgccggcgcagcgtccggtctcgatgttgtttcaggagaataacctgtttaaccatctgaccattcgacaaaatatcagcctcggcatccacccaggccttaaactgaaccgcgagcagcaggcgcaggtcacggcgatagctggacagatgggaattgatgcgctgctggaacgtctgcccggcgagctctccggcggtcagcggcagcgcgcggcgctggcccgctgtctggtgcgccagcagccggtgctgctgctggatgaacccttctcggcgctcgatccggcgctgcgccaggagatgctgtccctggtcgccgatgtctgcgagcagcagcagctcaccctgctgatggtctcccacagcgtagaggacgccgcgcgcatcgcgccgcgctcgatggtggtcgccgaagggcgcattgtctgggatggcgccaccgccgagctgttaagcggccacagcagcgcctcgcatttgatggggatcagcgcgcgatga

SEQ ID NO: 5308 - DNA, 1674 bp, Klebsiella pneumoniae
cagaaaaatgttagagtgccggtatggttaatacgtcgtccggggcctatgaaattatcttttcaatataagctgtttatttctctggtcgcttttttctcggtcctttttatcgcgctgggcatttattattattttgacgccagccgccagctttatcaggagatgagcgcccgggccaaaatacaggccgaagagatagccctgatgccgaatttacgtcaacaggtcagccggcacgacccacaggcgattcaggcgtttatgcagcaaatcgccgcccatagcgacgccagctttatcgtcatcggcgaccgtcagggagttcatctgtttcattccgtccatccggagtgggtcggcacccgactggtcggcggcgacaaccaggcggtactggaaggaaaatccatcaccaccattcgcaaaggcggcctcggggtctcgctgcgcagcaaaacgcccatcgttgatgacgcagggcgagtgatcggtattgtctccgtcggctacctcaccagctatctcgacagcattactctgactaaagtgatcaatatttttatcgccgccgtcctgctgctcatcgccctgtttatcttctcctggtactttacccgcagtatcaagaagcagattttttcgctcgagccgcgggaaattggcctgctggttcgccagcaaaaggcgatgatggagtcgatctttgagggggtgatcgtcatcgatcgccagcggcgtattgaggtgataaaccatgccgcccgcagcctgctggggctcagccagcccgcccgccagctgcgcggtcagtcgatcgacagcgtcatttcgccgcagccctttttcgccagcggcgacatgctcgaacgcgatacccacgatgagctgtgccgcttcaaccagttgaccgtgctcgccagtcgggtgcgcattatgctggagaataccctgcagggctgggtgatcacattccgtgaccgcaatgaaatcaatgccctcaccgcccagctgagccaggtgaagcgctatgtcgacaatctgcgcatcatgcgccacgagcagctcaaccggatgactaccctctccggcctgctgcatatgggccattatgacgaagcgatccgctatattcaggcccagtcggaacatgctcaggagctactggattttatctcctcgcacttccactcgccgacgctatgcggtctgctgctcggcaaagccacccgcgcccgcgaaaaaggcgtggcgctgagcttcgacccggcctgccgcatcgaccgccccctgccgtcgctgatggaatccgagctgatctccatcatcggcaacctgctggataacgccatcgaagccacgcagcgtgccgagctgccgcatgagccggtggaagtcctgatccagctcaacgcccgggagttgattatcgaagtggccgaccgcggcgtcggcatccgccccgatatccgcgagcgcatttttgaacgcggcgtcaccaccaaaacccgtggcgatcacggcattggtctgtatcttattgaacattatgtcactcaggcgggcggcaccatcgaagtcgccgataacgcgccgcggggaacgatcttcaccctatttatcccggccgacgcgcacgcctgtccgcaaccggaggcccacgatgcatcatga

SEQ ID NO: 5309 - DNA, 1104 bp, Klebsiella pneumoniae
ggaaaccgtgtaatgtcgaagaattaccatattgccgttttgccgggtgatggcattggcccggaagtgatgaaccaggcgatgaaagtactggaagtcgtgcgccaacgttttgccatgcacattaccaccagccagtatgacgttggcggggcggccatcgaccgtcagggaactcccctgccgcaggcgaccgtcgccggatgcgagcaggcggatgcgatcctgttcggctccgtcggcggtccgaaatgggagcacctgccgccggcggaacaaccagagcgtggcgcgctgctgccgctgcgtaaacactttaaactgttcagcaacctgcgcccggccaaactgtatcaggggctggaagagttctgcccgctgcgcgccgacatcgctgctaacggcttcgacattctctgcgtacgcgaactgaccggcggcatctacttcggccagccgaaaggccgcgaaggcagcggtcagcatgagaaagcctttgataccgaggtgtatcaccgctttgagatcgagcgtatcgcgcgcatcgcttttgaatccgcccgcaagcgtcgtcacaaagtgacttccatcgataaggccaacgttctgcagtcctccatcctgtggcgcgaaatcgtcagcgagatcggcaaggagtatccggacgttgagctggcgcatatgtatatcgataacgccaccatgcagctgattaaagatccgtcccagttcgacgtgctgctgtgctccaacctgtttggcgacatcctctccgacgagtgcgcgatgatcaccggctcgatgggtatgctgccgtccgccagcctcaatgaacaaggttttggcctgtacgagccggcgggcggttccgcaccggatatcgccggcaaaaatatcgccaacccgatcgcgcagatcctctccctggctctgctgctgcgctacagcctcgacgctgacgaagcggcgaccgccattgaaaacgcgatcaaccgcgccttagaagaaggggttcgaaccggcgacttagcgcgcggcacggcggcggtcagcactgatgaaatgggcgatattattgcccgctatgtcgcagaaggggtgtaa

SEQ ID NO: 5310 - DNA, 1206 bp, Klebsiella pneumoniae
ggttcagccgtttgtcgatttcttcgctcgttctacccgcggcttgattcgttaatggctgaacagcgtcccctgacgattgccctggtcgccggagaaacctccggcgatattctaggcgctggtctcatccgcgcgcttaaagcacgcatcccgaatgcgcgctttgtcggcgtggcggggccgctaatgcaggcggaagggtgcgaagcctggtatgaaatggaagagctggcggtgatgggcattgttgaagtgctcggtcgcctgcgtcgcttactccatattcgcgccgatttgacccgccgcttcggcgagctgcgtcccgatgtcttcgtcggcatcgacgcccctgactttaatatcaccctcgaaggaaatctgaaaaagcagggcatcaaaaccattcactacgtcagcccgtcggtctgggcctggcgacaaaaacgcgttttcaaaatcggcagatccaccgatctggtgctggcctttctgcctttcgaaaaagcgttttatgacaaatttaacgtcccctgccgctttattggccataccatggcggatgcgatgccgctggatcctgacaaaggcgctgcgcgcgaccggttagggatcccgcacagcgtgcgctgcctcgctctgctacccggcagccgcggcgcggaagtcgaaatgcttagcgccgacttcctgaaaaccgcgcagcttctgcgcgccacctatcccgatctgcaggtggtggtgccgctggttaatgctaaacggcgggagcagtttgagcgtattaaagctgagacggcgccggatatgatcgtgcatatgctggacggtcaggcgcgcgatgcgatgatcgccagcgacgccgcgctgctggcctccgggacggcagcgctggagtgtatgctggcgaaatgcccgatggtggttggctaccggatgaagccgttcaccttctggctggcgaagcggttggtaaaaaccgactacgtctcgttaccgaacctgctggccggtcgcgaactggttaaagagctgctgcaggatgagtgcgagccccaggcgctggcagccgctctgcagccgctgctggccgatggcaaaaccagccatgagatgcatgagacgttccgcgccctgcatcagcagatccgctgcaacgccgatgagcaggcggcggacgccgtactggagttagcaaaacaatga

SEQ ID NO: 5311 - DNA, 1152 bp, Klebsiella pneumoniae
ctctatgacgtggatgggaaagcctatatcgattatgtcggttcctggggtccgatggtgctgggccacaaccacccggctatccgcaatgcggtgatcgaggcggcatcccgcggcctgagctttggcgcgccgaccgaaatggaagtgaaaatggcggccctggtgaccgagctggtgccgaccatggatatggtgcggatggtgaactccggtaccgaagccaccatgagcgccattcgcctggcgcgcggcttcaccggtcgcgacaaaatcattaagttcgaaggctgctaccacggccatgccgactgcctgctggtgaaagccggttccggcgcgttgaccctcggccagccgaactcgccgggcgtcccggccgatttcgccaaacataccctgacctgcacttataacgacctcgcctcggtgcgcgcggcgttcgagcagtatccgcaggagatcgcctgcatcatcgtcgagccggtggccggaaatatgaactgcattccgccgcagccggaattcctgccgggcctgcgcgccctgtgcgacgaatttggcgccctgctgattatcgacgaagtgatgaccggcttccgcgtggcgctggcaggcgctcaggcttactacggcgtggagccggatctgacctgtctggggaaaatcatcggcggcgggatgccggtaggtgccttcggcggccgccgtgaggtaatggacgctctggcgcccaccggtccggtctatcaggcgggcaccctctccggcaacccgatcgccatggcggctggcttcgcctgcctgaacgaagtggcgcagccgggggtccatgaaaccctgactgaactgactaaccagctggcgcaaggcctgctggatgcggcgcgtgacgctgggatcccgctggtggtcaataacgtcggcggcatgttcggcatcttctttaccgatgccgaaaccgtcacctgctatcaggacgtggtgaagtgcgacgttgaacgcttcaagcgcttcttccatctgatgctggaggaaggcgtgtacctggcgccgtcagcgtttgaggccggctttatgtccgtggcccacagcgaagaagatatcgacaacaccatcgacgccgcgcgtcgggtatttgccaagctgtaa

SEQ ID NO: 5312 - DNA, 1437 bp, Klebsiella pneumoniae
ggtcgtggcgtaatcgtaacggccgcccagggtcatcacccatttatcccactccatctgatcctgcgcgtacaggccggtctgctccatccggttgaggaccgcgtacgggaaggtgacctgaatattcggattgccgtactgcggattgctcatgctgataggatccgccgtcccgtagtcggcatccacatcgttacgcatccgcgagtagtccacgccggtcagcagcgtatggctgaccgcgccggtggcgaaatcagactgcagctgggtatcgacggtgaaggtgttcaggtgctcgtcggagcgcacgtaggcgcgattcatgtagcccggcgcgacatagccgttgccgtatacggaacgatagagcgtatgcacatcggcatagcgcaggttctgccgcacggtaaaggtgtcatcgaactgatgggagaagctgtagcccaccatcttctggcggcgggagattttattatcggactcgccttcgttgaaatcggtcggcagcttgtgcgccttaccgttggcgtcgtaatacggcaccacggtgccttcgcgcggcagccagccgtagtagcccgcatccgggtcattctggaagttgctcaggaaggtgaagtcagttttatcgtccggacgccagctaaaggagggcgccaccgcgtagcgggtcgatttcgccatctgctgctgggcatcctgactgcggccaaggccggtcaggcgatacgaccagacgccggcatcatcaatggcgtcgctaaagtcaaacccggtctgccacagattgtcggtgcccatcttaaactgcacttctttcagcggctcggtagtcgggcgcttgctgaccatgctgacgataccgcccgggttgctgttgccgtacagcaccgaggttggcccgcgcatcacttccacacgctcgaggaagtaaggatccatggagacttcagagtagttattcccttgcagcttcatgccgtccagatactggttggtgttgacggtcgtcgaggtggtgaagccgcgaatggtgaccacgtcataggtggtcgaactgccgcgagtggagaagacgcttggcgtataggagagcgcctcttttaccgtcgtcggctggcgcatctccatctcctggcgcgtcaccaccgacacagactgcggcgttttttcaatcggggtatcggttttggtcgccgtggcggagcgttttgccgcgatagtcggcgccggtccccaggcgctttcctgggcggccggggcggcaacgacggtgatggtttcttcttgcttcggttgttctgctgcctgtgcgtagacagacatgccgctaaccgccgtggctactacagctgcgactttacgcagcgagtgatttggctgagcagtttttggacgcgccatgggtatatctctgatgaaagtgaatga

SEQ ID NO: 5313 - DNA, 207 bp, Klebsiella pneumoniae
gcggggggcgtaggaagccgggggagtaaatcaataaagggaatgacgacccgaaaccgcaaactgattatgattcgccacgcttatcgccactctccggcaataaataattcaaaagccaataatcacctacctgtttcggtagggtattacgccaacgtgcagaaaattaaattagcaaaggaattaaaatgccagtttctgtga

SEQ ID NO: 5314 - DNA, 543 bp, Klebsiella pneumoniae
  unsure (118): Identity of nucleotide at the above locations are unknown.
cgtgagtcagtcatggtacggacaacagaaccaggcgggagagactcccgccagaaagtgaagcaccaggggattacccgccatctgtttttcgcgaatttccgccacggttttgcantcaatgcacagatccgctgtgggacgcgcttccagacggcgaatgccgatctccacgccgcaggattcgcagtagccgaagtcttcgtcttcaacttttttcagcgttttctcgatctttttgatcagtttacgttcgcggtcgcggttacgcagttccaggctgaactcttcttcctgggcggcacggtctaccgggtccgggaagttagctgcttcatcctgcatgtgcgatacggtgcgatccacttcatccctgagttgattacgccatgcttcaagaatacgcttgaagtgcgccagctgggcttcgttcatatactcttcgcccggtttctcttggtacggctccaccccagcgatggcgagaatactcagggacgatgttttacggttttgcccttcttgcatgttgcttctccttaa

SEQ ID NO: 5315 - DNA, 462 bp, Klebsiella pneumoniae
aggtcgacagtagccccgccgggatctgatacgggaacatcatcatccgtccgcaccagtcggcgaagaccagcagcagcccgccagtcagccctgaaatcaccatatgcggtagggttcgccggaagcccatcatccgcgcgatatgcggcgccatcagcccgacaaagctcagcgggccgatggtcagcgtcgccgccgccgtcaggcaggccgccagcagcagcagaacaatccgcgatgacgtcagcgccatgcccaccgctcgcgccgcctccccgcccagcggcaggatggttaaccagcgacgacagagcggcgccagcgccagcagcgccagcattaccgcgccgctacgcactaccctctccggcgtcgcactatatgtcgaccccgagatccacgtcaggatctgcgccatacgcggatcgccgctggcctgcagcatcatcagcagcatag

SEQ ID NO: 5316 - DNA, 393 bp, Klebsiella pneumoniae
agggtagaagttatgatgcgtaatatgctgcagggcaagctccaccgcgtaaaagtcacgcaggcggacctgcactatgaaggttcttgcgccattgaccaggacttcctggatgcggccggtattctggagaatgaaactattcacctctggaacgtcaccaacggcaaccgtttctccacctacgccattgccgccgagcggggctcccggatcatctccgttaacggcgccgccgcgcactgcgccagcgtcggcgatattttgatcatcgccagcttcgttaccatgtcggacgaagaggcgcgcagctggcagcctaacatcgcctacttcgaaggcgacaacgaaatgaagcgccaggcgaaagctattccggtacaggtcgcctga

SEQ ID NO: 5317 - DNA, 276 bp, Klebsiella pneumoniae
cacgatctggtccatgatcagtctttcgaggatttgatggcgcagggtggcgtcatccggcagctgttggccagcctgaccagcattgagcttaaccgattgcatcaaaccatcgacgtcgctttccagcacgacgccattattgacgacggccgctactttatcgaccacctggggggcagcgaaactggtattcgcgatcatggcgataccgagaagcagcgttttccagttcttcatactttttccatttcgattaaccgcaaatgcggatga

SEQ ID NO: 5318 - DNA, 264 bp, Klebsiella pneumoniae
gcggtaatggtggcaaagcgcttcttttcctgtttgcatttctgcagcagggcaatggtggtcggtttcataacatttcctgatgatgaaagtcatattaaccggcattctaacagcagcattcagaggggcaatgattttgggcaaccgattacgacgatcgccgcaaatgctaaaaaagggagaggggattaccagctggcgggctttgccgcgccgagattatccagcacggcgcgcagcgccaagccgtcaggaaagtga

SEQ ID NO: 5319 - DNA, 555 bp, Klebsiella pneumoniae
aatcaaatggttagtattatgaaacatactgtagaagtgatgatcccggaatccgagatcaaagcgcgtatcgcggaactgggtcgtcaaatcaacgaacattatcagaacagcggcagcgaaatggtgctggtggggctgctgcgcggctcgtttatgttcatggccgacctgtgccgtgaagtgcaggtgccgcatgaagtcgattttatgaccgcctccagctacggcagcggcatgtccaccactcgtgatgtgaaaatccttaaagatctggatgaagacatccgtggtaaagacgttctgatcgtggaagacatcatcgactccggcaataccctgtctaaagttcgcgaaatcctcagcctgcgcgagccgaaatcgctggccatttgtacgctacttgataaacccagccgccgcgaagtgaacgtcccggttgaatacgtcggtttcgcgattccggatgagttcgtggtgggctacggtatcgactatgctcagcgctaccgccatctgccgtatatcggcaaagtcaccctgctggacgagtaa

SEQ ID NO: 5320 - DNA, 1206 bp, Klebsiella pneumoniae
cggcgccaggtacacgccttcctccagcatcagatggaagaagcgcttgaagcgttcaacgtcgcacttcaccacgtcctgatagcaggtgacggtttcggcatcggtaaagaagatgccgaacatgccgccgacgttattgaccaccagcgggatcccagcgtcacgcgccgcatccagcaggccttgcgccagctggttagtcagttcagtcagggtttcatggacccccggctgcgccacttcgttcaggcaggcgaagccagccgccatggcgatcgggttgccggagagggtgcccgcctgatagaccggaccggtgggcgccagagcgtccattacctcacggcggccgccgaaggcacctaccggcatcccgccgccgatgattttccccagacaggtcagatccggctccacgccgtagtaagcctgagcgcctgccagcgccacgcggaagccggtcatcacttcgtcgataatcagcagggcgccaaattcgtcgcacagggcgcgcaggcccggcaggaattccggctgcggcggaatgcagttcatatttccggccaccggctcgacgatgatgcaggcgatctcctgcggatactgctcgaacgccgcgcgcaccgaggcgaggtcgttataagtgcaggtcagggtatgtttggcgaaatcggccgggacgcccggcgagttcggctggccgagggtcaacgcgccggaaccggctttcaccagcaggcagtcggcatggccgtggtagcagccttcgaacttaatgattttgtcgcgaccggtgaagccgcgcgccaggcgaatggcgctcatggtggcttcggtaccggagttcaccatccgcaccatatccatggtcggcaccagctcggtcaccagggccgccattttcacttccatttcggtcggcgcgccaaagctcaggccgcgggatgccgcctcgatcaccgcattgcggatagccgggtggttgtggcccagcaccatcggaccccaggaaccgacataatcgatataggctttcccatccacgtcatagagttaagcgccatccgcgcgttagataaacagcggtgtgcctccgacgccggtgaaagcgcgcaccggcgagttaactccgccgggtatcagttcgcgcgcagcgtgatacagattttcagatttgctcatggccagggtcctggttcgtga

SEQ ID NO: 5321 - DNA, 516 bp, Klebsiella pneumoniae
caaagaaaggtaatgaacgtgagtggattgctgacgcgctggcgacagtttggcagacggtatttttggccgcatctcctgttggggatggtcgcggccagcctcggcctgcctgcgctaagcaacggtcacgagaccgcggcgccagcgaaggcgaccgccagcaatcacaatccgagcaaggttaatttctctcagctggcgctgctggagacgaatcgccggcccagctttaccgtcgactactggcatcagcacgccattcgcaccgttattcgtcatctctccttcgccatggcgccgcaggcgctgccggtggcggaagaaacttccccgctgcaggctcagcatctggcgctgctcgacaccctcagcgcgctgctgacgcaggacagcacgccgccggtggtgatccgccaggcgggttacatcccttcttcatattctgccttccgcgtcagcgcctggataagccaggtggcggggatccgcgcagggcctcaacgtctcagctga

SEQ ID NO: 5322 - DNA, 744 bp, Klebsiella pneumoniae
tctatagaggttttaaacatggcaactgtttccatgcgcgacatgctcaaggctggtgttcacttcggtcaccagacccgttactggaacccgaaaatgaagcctttcatcttcggcgcgcgtaacaaagttcacatcatcaaccttgagaaaaccgtaccgatgttcaacgaagctctggctgaactgaacaagatcgctgctcgtaaaggtaaaatccttttcgttggtactaagcgcgctgcaagcgaagcggtaaaagacgctgctctgagctgcgatcagttcttcgtgaaccatcgctggctgggcggtatgctgactaactggaaaaccgttcgtcagtccatcaaacgtctgaaagacctggaaactcagtcccaggacggtactttcgacaagctgaccaagaaagaagcgctgatgcgcactcgtgagctggacaagctggaaaacagcctgggcggtatcaaagatatgggcggcctgccggacgcactgttcgttatcgacgctgaccacgagcacatcgctatcaaagaagcaaacaacctgggcatcccggtatttgctatcgttgataccaactctgatccggacggcgtagacttcgttatcccgggtaacgacgatgcaatccgcgcagtaagcctgtacctgggcgctgttgctgctaccgttcgtgaaggtcgctctcaggacctggcttctcaggcggaagaaagcttcgtagaagctgaataa

SEQ ID NO: 5323 - DNA, 1440 bp, Klebsiella pneumoniae
attacagaggtcatgatgagtactgaaatcaaaactcaggtcgtggtacttggggcaggccccgcaggttactctgcagccttccgttgcgctgatttaggtctggaaaccgtcatcgtagaacgttacagcaccctcggtggtgtttgtctgaacgtgggttgtatcccttctaaagcgctgctgcacgtggcaaaagttatcgaagaagcgaaagcgctggccgaacacggcatcgttttcggcgaaccgaaaactgacattgacaagatccgcacctggaaagaaaaagtcatcactcagctgaccggtggtctggctggcatggccaaaggtcgtaaagtgaaggtggttaacggtctgggtaaatttaccggcgctaacaccctggaagtggaaggcgaaaacggcaaaaccgtgatcaacttcgacaacgctatcatcgcggcgggttcccgtccgattcagctgccgtttatcccgcatgaagatccgcgcgtatgggactccaccgacgcgctggaactgaaatctgtaccgaaacgcatgctggtgatgggcggcggtatcatcggtctggaaatgggtaccgtataccatgcgctgggttcagagattgacgtggtggaaatgttcgaccaggttatcccggctgccgacaaagacgtggtgaaagtcttcaccaaacgcatcagcaagaaatttaacctgatgctggaaaccaaagtgactgccgttgaagcgaaagaagacggtatttacgtttccatggaaggtaaaaaagcaccggcggaagcgcagcgttacgacgcagtgctggtcgctatcggccgcgtaccgaatggtaaaaacctcgatgcaggtaaagctggcgtggaagttgacgatcgcggcttcatccgcgttgacaaacaaatgcgcaccaacgtgccgcacatctttgctatcggcgatatcgtcggtcagccgatgctggcgcacaaaggtgtccatgaaggccacgttgccgcagaagttatctccggtctgaaacactacttcgatccgaaagtgatcccatccatcgcctacactgaaccagaagtggcatgggtcggtctgaccgagaaagaagcgaaagagaaaggcatcagctacgaaaccgccaccttcccgtgggctgcttccggccgtgctatcgcttctgactgcgcagatggtatgaccaaactgatcttcgacaaagagacccaccgtgttatcggcggcgcgattgtcggcaccaacggcggcgagctgctgggtgagatcggcctggctatcgagatgggctgtgacgctgaagacatcgccctgactatccacgctcacccgactctgcacgagtccgttggcctggcggcggaagtgttcgaaggcagcatcaccgacctgccaaacgccaaagcgaagaaaaagtaa

SEQ ID NO: 5324 - DNA, 666 bp, Klebsiella pneumoniae
aggtattgggttatgtctgaggcaatgatgtggctgctgttgcgcggcgtatgggaaacgctggcaatgacttttgtctctggcttcttcggttttgtcctcggcctgccggtgggcgtgctgctgtacgttacccgtccggggcaaatcgtcgccaatgccaaactgtaccgtacgctctcggcgctggtgaatattttccgctccatcccgttcattatcctgctggtctggatgattccgtttacccgcgtgatcgtcggtacctctatcggcctgcaggcagcgattgtgccattaacagttggcgccgcgccgtttatcgcccgcatggtggagaacgccctgctggaaatccccaccggccttattgaagcctcccgcgcgatgggtgccacgccgctgcagatcgtgcgcaaagtcctgctacctgaagcactgccgggtctggtcaacaccgccaccatcacgctcatcacgctggtgggttattccccaatgggcggctcggtgggcaccggtggactaggtcaaattggttatcagtatggctatattggatataacgccaccgtgataaataccgtactggtaatgctggttgttctggtttatttaattcaattctctggcgatcgcatcgtccgggctgtgactcacaaataa

SEQ ID NO: 5325 - DNA, 972 bp, Klebsiella pneumoniae
gtcaggcgggttaatgacgtgtcacgacacgagaagagatatttaatgaccattgctctggaattaaaacagctcaaaaaaacctatcccggcggggttcaggcgctgcgggggatcgacctgcaggtcgaagcgggggatttttatgccctgctgggcccgaacggggccggaaaatccacgaccatcggcatcatcagctcgctggtgaacaaaacctctggtcaggtcaatgtctttggctacgatctggagaaagacgtcgtcaatgccaagcgccagcttggcctggtgccgcaggagtttaacttcaacccgttcgaaaccgtgcagcagatcgtcgttaaccaggcgggctactacggcgttgagcgtaaagaagccctttcccgcagtgaaaagtatttaaaacagctcgacctgtgggaaaaacgcaacgaacgcgcgaggatgctctccggcgggatgaagcgccgtctgatgatcgcccgcgcgttgatgcatgagccgaagctgctgatcctcgacgaaccgaccgccggcgtcgatattgaactgcgtcgctcgatgtggggctttctcaaggatctcaacgatcgcggaaccaccattatcctgaccacccactatctcgaagaggccgaaatgctatgtcgcaacatcggcatcatccagcacggcgagctggtggaaaacacctcgatgaaagcgctgctgtcgaagctgaagtcagagacctttattcttgacctcgcgccaaaaagcccggtgccgaagctcgaaggctaccagtaccagctggtcgatacctcgacgctggaagtggaggttctgcgtgagcagggaattaacagcgtcttcgcgcagctgagcgcccagggggtgcaggtactgagtatgcgtaacaaagctaaccgtctggaagagctgtttgtcacgctggtgcatgagcgaaaaggagaatcagcatga

SEQ ID NO: 5326 - DNA, 267 bp, Klebsiella pneumoniae
cgatacctattgatgaaaagacaggaggatacaatgcggaacaatattctggtggcatccgcactggcagcggcggcaatcatgttcgtggccggctgctcatcgaatcagtcgatcaaaaccaccgacggcaagaccattgtcaccagcggcaaaccgcaggtggatgatgacaccggccttgtctcatacaaaaatgccgaaaccggccgcgtggagcagattaaccgcgaccaggtgaagtccatggacgagctggataactaa

SEQ ID NO: 5327 - DNA, 1233 bp, Klebsiella pneumoniae
accactttttttgtttcaggctgggcaaccagcctgttccgctcgtttaactggaaccgttacaacatgcgtactagccaatatctgctctccactctgaaggagacacctgccgacgccgaggtaatcagccatcagctgatgctgcgcgccgggatgatccgcaagctggcctccgggttatacacctggctgccgaccggcgtgcgcgtcctgaaaaaagtcgaaaacatcgtgcgtgaagaaatgaacaacgccggtgcgatcgaggtgttaatgccggtcgttcagccatctgaactgtggcaggagagcgggcgctgggagcagtacggcccggaactgttgcgcattgccgatcgcggcgatcgtccgttcgtcctcggcccaacccacgaagaggtcattaccgatctgatccgcaacgagctgaactcctataaacagctgccgctgaacttctatcagatccagaccaaattccgcgacgaagtacgcccgcgtttcggggtgatgcgctcccgtgaattcctgatgaaagatgcctactctttccatacttcgcaggaatcgctgcaggaaacctacgacgcgatgtatgccgcttacagcaaaatcttcagccgtatggggctggatttccgcgcggtactggctgacaccggttctatcggcggcagcgcctctcatgaattccaggtgctggcgcagagcggcgaagacgatgtgatcttctccgacagctccgactacgcggcaaacatcgagtttgcggaagccgttgcgccgaaagagccgcgcgcagccgccacccaggagatgaccctggtcgatacgccgaacgccaaaaccatcgccgagctggtggagcagttcaacctgccgatcgaaaaaaccgtgaaaactctgctggtgaaagcggttgaagatagcgcttcccccgctggttgccctgctggtgcgcggcgatcacgagctgaacgaagtgaaagcggaaaaactgccgcaggtcgccagcccgctgaccttcgccaccgaagaagagatccgcgccctggtgaacgccggtccgggctccctgggcccggtgaacatgccggttccggtgattatcgaccgtactgtagcagtgatgagcgatttcgccgctggcgccaacatcgatggcaaacactacttcggcatcaactgggaccgcgatgtcgcgacgccggaagtggccgacatccgtaa

SEQ ID NO: 5328 - DNA, 2688 bp, Klebsiella pneumoniae
atagttttttcttatggtgacgcgatgagcaactcattacctgacacagcctcccctctcctgcccgtcccgccggaacacccggtgagttggccgcagggcgatctgaactgtgccgcaatcaaggcgcacatcgataccttccagcactggctgggcgaggcgtttgactccggcatcgtcgcggagcagctcatcgcggcgcgcaccgaatttatcgaccagttgctgcagcgattatggagcgcctgcggttttgaatctgtcagcgacctggcgctggtcgccgtcggcggctatggccgtggcgaactgcacccgctctcagacgtcgatctgctgatcctcagtcgtaaaaaactgccggacgaccaggcgcaaaaagtcggcgaactgctcaccctgctgtgggacgtcaagctggaggtgggccacagcgtacgcaccctcgaagagtgcctgctggaaggtctctcggatctgaccgttgccaccaacttaatcgaatcgcgcctgctgatcggcgacgtcgcgctgttccttgaactgcaaaaacatatttttagcgacggcttttggccatcggaaaagttcttcgccgccaaggtcgaagagcagaacgtccgtcatcagcgctatcatggcaccagctataacctcgagccggacgtgaaaagcagccccggcggcttgcgcgatatccatacgctacagtgggtggctcgccgccatttcggcgccacctcaatggatgagatggtcggcttcggctttctgaccgaagccgagcgcaatgaactcaatgagtgtctgcatcagctgtggcgcatccgtttcgcgctgcatctcgaactcacgcgctatgacaaccgtctgcttttcgaccgccagctcagcgtggcccgccggctaggctatgaaggcgacggcaaccagccgattgagcatatgatgaaggacttcttccgcgttacccgccgggtgagcgagctgaatcagatgctgcttcagctgtttgaggaggctatcctcgccctgaccgaggatgaaaaaccacgcccgatcgatgatgatttccagctgcgcggcacccttatcgatctgcgtgacgacacgctgtttattcgcgaaccgcaggccattctgcgcatgttttatatcatggtgcgcaatagcaccatcaccggcatctactcaacgacgttgcgccatctgcgccacgcccgccgtcatctcacccagccgctgtgctatatcccggaggcgcgcacgctctttcttagtatgctgcgccatcagggggcggtaagtcgcgggctgctgccgatgcatcgccacagcgtactgtgggcctatatgccgcagtggtcgcatatcgtcggccagatgcagttcgacctgtttcacgcctacaccgtcgatgaacacaccgtccgggtgatgctcaagctggaaagctttgccaaagaagaaacccgcagccgccacccgctgtgcgtggagctgtggccgcgcttaacgcacccggagctgatcttaattgccgccctgttccacgacatcgccaaagggcgcggcggcgaccactcgatcctcggcgcgcaggatgtgctgaagtttgccgagctgcacgggctgaactcgcgcgaaacgcagctggtcgcctggctggtgcgtcaccacctgctgatgtcggtcaccgcccagcggcgcgatattcaggatccggaggtgattaagcagttcgccgaggaggtgcaaacggaaaatcgtctgcgctatctggtgtgtctgaccgtcgccgatatctgcgccaccaacgaaaccttgtggaacagctggaagcagagcctgctgcgtgaactctatttcgccaccgagaagcagctgcgtcgcggcatgcaaagcaccccggacatgcgcgaacgagtgcgtcaccatcagctgcaggcgctggccctgctgcggatggacaatattaatgaagaggcgctgcatcagatctggaaccgctgccgcgccaactatttcgtgcgacatacgccgacgcagctcgcctggcacgcccgcaacctgctgcgccacgatctgaataaaccgatgatcctgctgagctcgcaggccacccgcggcggtacggagatttttatctggagcccggatcgcccttacctgttcgccgcggtgtgtggcgaacttgaccgtcgcaacctcagcgtccacgacgcgcagatcttcaccacccgcgacggtatggcgatggatacctttatcgtccttgagcccgacggcagccccctttccgccgaccgccacgaggcgatccgccaggggctggagcagaccatcactcagcgcagctggcagcctccggccccgcgtcgtcaggcggcaaagctacgccatttttccgtggacaccgaggtgaatttcctgccgacccataccgaccgaaaatcgtttctggagctgatagcgctcgaccagcccgggctgctcgcccgcgtcgggcaggtgttcgccgaccttgggatatcgcttcacggggcgcgaattacgacaattggtgagcgagtagaagatttatttataatcgccaccgccgaccggcgtgcccttaataatgagctgcaacaagaagtgcaacaacggttgacagcggccctcaatccaaacgataaagggtga

SEQ ID NO: 5329 - DNA, 582 bp, Klebsiella pneumoniae
gacaagctttcaaggattcgtaacgtgattagcgatatcagaaaagatgctgaaatccgcatggaaaaatgcgtcgaagcattcaaaaaccaaatcagcaaaattcgcacgggtcgtgcttctccgagcctgctggacgggattgttgttgaatactacggtactccgaccccgctgcgccagctggccagcgtcaccgtcgaagactcccgtaccctgaaaatcaacgtctttgaccgttctatgtccgcggccgttgaaaaagcgatcatggcgtcagacctcggtctgaacccaagctctgccggcagcgatattcgtgtcccgctgccgccgctgaccgaagagcgtcgtaaagatctgaccaagatcgtgcgtggtgaagccgagcaggcgcgcgttgccgtgcgtaacgttcgccgtgacgccaacgataaagtcaaagcgctgctgaaagaaaaagagatcagcgaagatgacgatcgccgttctcaggacgacgtgcagaaaatgactgacgccgccatcaaaaaagttgacgcggcgctggcagacaaagaagcggaactgatgcagttctaa

SEQ ID NO: 5330 - DNA, 2529 bp, Klebsiella pneumoniae
acaggttcttcggagaagaaagcaatgccaaaacgtacagacataaaaagtatcctgattctgggcgcgggcccgattgttatcggtcaggcgtgtgagtttgactactccggcgcccaggcctgtaaagcgctgcgcgaagagggctaccgcgttatcctggtgaactctaacccggcgaccatcatgaccgacccggaaatggccgatgccacctacatcgagccgattcactgggaagtggtgcgtaaaatcatcgaaaaagagcgcccggatgcggtgctgccgaccatgggcggccagacggcgctgaactgcgcgctcgagctggagcgtcagggggtcctggctgaattcggcgtgaccatgattggcgccaccgccgatgcgattgataaagccgaagaccgtcgccgtttcgatatcgcaatgaaaaaaatcggcctcgacaccgcgcgctctggtatcgcccacacgatggaagaggcgctggcggttgccgccgacgttggtttcccgtgcatcatccgtccgtccttcaccatgggcggcaccggcggcggtatcgcctataaccgcgaagagttcgaagaaatctgcgaacgcggcctggatctctctccgaccagcgaactgctgatcgatgaatcgctgatcggctggaaagagtacgagatggaagtggtgcgcgataagaacgataactgcatcatcgtctgctccatcgaaaacttcgacgccatggggatccacaccggtgactccatcaccgttgccccggcgcagaccctgaccgacaaagagtaccagatcatgcgtaacgcctcgatggcggtgctgcgtgaaatcggcgtcgaaaccggcggctctaacgtgcagttcgcggtcaacccgaaaaacggtcgcctgatcgttatcgaaatgaacccgcgcgtctcccgctcctcggcgctggcctctaaggccaccggcttcccgattgctaaagtggcagccaagctggcggtaggttatacccttgacgagctgatgaacgacatcaccggcggccgcaccccggcttcctttgaaccgtccatcgactacgtggtcactaaaatcccacgctttaactttgaaaaattcgccggcgccaacgaccgtctgaccacccagatgaagtctgtcggcgaagtgatggcgattggtcgtacccagcaggaatccttgcagaaagcgctgcgcggtctggaagtgggcgctaccggcttcgaaccgaaagtgagcctcgacgacccggaagcgctgaccaaaatccgccgcgagctgaaagatgccggcgctgagcgtatctggtatatcgctgacgcgttccgcgcgggcctctcggttgacggcgtcttcaacctgaccaacatcgaccgctggttcctggtacagattgaagagctggtccgtctggaagagaaagtggcggaagtgggcatcaacggcctcgacgctgacttcctgcgcaccctgaagcgtaaaggctttgccgatgcgcgtctggcgaagctggcgggcgtgcgggaagcggaaatccgcaagctgcgcgaccagtatgacctgcacccggtctacaagcgcgtggacacctgcgctgcggaatttgctaccgataccgcctacatgtactccacttatgaagaagagtgtgagtccaacccgtccgttgaccgcgataaaatcatggtcctcggcggcggcccgaaccgtatcggtcagggtatcgaattcgactactgctgcgtacacgcctcgctggcgctgcgcgaggacggttacgagaccatcatggtcaactgtaacccggaaaccgtctctaccgactacgacacctccgaccgtctgtattttgagccggtgaccctggaagacgtgctggaaatcgtgcgcatcgagaagccaaaaggcgttatcgtccagtacggcggccagaccccgctgaaactggctcgtgccctggaagctgccggcgtgccggttatcggtaccagtccggacgctatcgaccgggcggaagaccgtgagcgcttccagcacgcggttgaccgtctgaagctgaagcagccggcgaacgccaccgtcaccgccattgagcaggcggtagagaaagcgaaagagattggctacccgctggtggtgcgtccgtcttatgtgctcggcggccgggcgatggagatcgtctatgacgagcaggatctgcgccgctacttccagaccgcggtcagcgtctccaacgacgcgccggtgctgctggatcgcttcttcgacgatgcgattgaagtggatgtcgatgcccatctgcgatggcgaaatggtgctgattggcggcatcatggagcatatcgagcaggcaggcgtccactccggcgactccgcctgttccctgccggcctacaccctgagcaaagagattcaggatgtgatgcgcgagcaggtgcagaagctggccttcgagctgcaggttcgcggcctgatgaacgtccagttcgcggtgaaagataa

SEQ ID NO: 5331 - DNA, 1029 bp, Klebsiella pneumoniae
gtaatgccttcaattcgactggctgatctcgcgcagcagttggatgcagaattacacggtgatggcgatatcgtcatcaccggcgttgcgtccatgcagagcgcgaaaacgggccaaatcactttcatggtcaaccctaagtaccgtgagcacctggccgcttgccaggcttctgccgttgtgatgacgcaggatgatttaccttttgcccatagcgccgcgctggtagtgcgtaacccctacctgacctacgcgcgcatggctcaaattcttgataccacgccgcagccggctcaggatatcgcgccgagcgcggtcatcgatccgtcggcgaagctgggtagcaacgttgccatcggcgccaacgcggttatcgaatccggcgtagtgctgggcgataacgtagttatcggcgcaggctgcttcgttgggaaaaatacgaaaataggcgccggctcgcgtttgtgggctaatgtgaccgtttaccatgagattgagatcggcgagaattgcctgattcagtccagcacggtgattggcgcggatggcttcggctacgctaacgatcgcggtaactgggtaaagatcccgcagttgggtcgcgtcattattggcgatcgcgtggagattggcgcctgcaccacgattgaccgtggtgcgctggacgataccgtgattggcaacggggttatcattgataaccagtgccagattgcgcataacgtggtgattggcgacaataccgcggtcgctggcggcgttatcatggcgggcagcctgaaaattggccgctactgcatgattggcggcgccagcgtgattaacggccatatggaaatctgcgataaggtcaccgtcacggggatggggatggtgatgcgtcctatcagcgaacctggcgtatattcctccggtattccgctgcagccgaacaaggcgtggcgtaaaaccgctgcgctggtgatgaatatcgacgagatgagcaagcgcctgaaagcgattgagcgcaaggttaatcaacaagactaa

SEQ ID NO: 5332 - DNA, 450 bp, Klebsiella pneumoniae
tctggaaattcagcttaccgcctggcaagcgtcggcatgattactattagccgcagcgtagccctcgccgacgacgagatcgtcttgtcaggcattcgcgcccagggagcaggggggcagcatgtgaacaaagcgtcgacggcgatccatctgcgctttgatattaaagcttcaagcctgccggagttttacaaagagcgcctgctcgccgccagccaccacttaatttctgctgacggtgtggttatcattaaggctcaggaataccgcagccaggagatgaaccgtgaagcggcgatcgcccggctggtggcccttattaaagaattaaccgcagtgcaaaaaagtcgccgggagacgcgaccgactcgggcatcgaaagagcgacgccttgcttccaaggcacagaagtcctcagtcaaggcgctgcgtgggaaagttcgccagtga

SEQ ID NO: 5333 - DNA, 846 bp, Klebsiella pneumoniae
ttagcttgttccgtaaagcggaaaagcgctggttgcagcatatcaaaccttcttcgacgcattgagaacgccatgtccgacaataaattaaacgttatcgatctgcataaacgctatggggaacacgaggtgctgaagggcgtctcgctgcaggcgaaagccggggacgttatcagcatcatcggttcatcgggttccggaaaaagtacctttttgcgctgtattaacttccttgaaaaaccgagcgaaggcacgattgtcgtcagcggccaaaatattggtctggtacgggataaagacggccagctgaaggtggccgacaagaaccagttgcgcctgctgcgcacccggttgaccatggtgtttcagcatttcaatctgtggagccatatgacggtgctggagaacgtcatggaggcgccgattcaggtgctgggcttaagcaaacaggaagcgcgcgaacgggcggtaaaatatctggccaaggtcgggatagacgaacgtcagcaggcgaagtatccggtgcatctttccggtggccagcagcagcgtgtctctattgcccgcgcgctggcgatggaaccggaagtgctgctgtttgatgagccgacctccgcgctggatccggaactggtgggcgaagtgttacgcattatgcagcagctggcggaagagggaaaaaccatggtggtggtgacccatgaaatgggctttgcccgccacgtctcttcacatgtcatttttctgcatcagggtaaaattgaagaagaagggcatccggatgcgctgtttggcgcgccgaaaagcccgcgcctgcagcagtttctgaaaggttcgctgaaataa

SEQ ID NO: 5334 - DNA, 708 bp, Klebsiella pneumoniae
agcgtaacctcggctttgcccatctgggagataattaacgattttaccgctgtttcaatggccattccgatgctgaaagctgagcaccttattcagtttggcggcagtgcgccggtagcgggcaaaccgatcgccgtttatggcgccgggaccgggctcggcgtggcgcatctggtccacgttgataagcgttgggtcagcctgccgggcgaaggcggtcatgttgattttgccccgaacagcgaagaagaagggatcattctggaagagctacgcgccgagctggggcatgtttccgcagaacgcgtgctctcaggtcccgggctggtcaacctgtatcgcgcgattgtcaaatcggacggccgactgccggagaacctgcagccgcgtgaggtgaccgagcgagcgctggcggacagctgcaccgactgtcgtcgggcgctgtcgctgttctgcgtcattatgggacgcttcggcggtaacctggcgctgaccctcgggacgtttggcggggtgtatatcgccggcggcatcgtgccgcgcttcctggagttctttaaagcctctggtttccgcggcggttttgaagacaaaggccgttttaaagcttatgttcaggatatcccggtttacctgattgtgcatgataacccaggcctgttgggctccggcgcgcatctgcgtcagacgctgggccaggtgctttaa

SEQ ID NO: 5335 - DNA, 1365 bp, Klebsiella pneumoniae
gccaacctgtcccgcggtcaggccttcagagataaccagcggcagacgcagggtctggccttccacgctaaaggagagcattgcgcctgggttgacgccaagcttcgcggcatccgccgggttcagcttgatgtacggctcaggcatccggctctggaacaccggcgcgcgctgagacagctcatcgctgccgaacagatggtagtacggcgcaattcgccatttgccctcttccgcctggaagctggccggcaccgccgtgaagtactccagtccgctggcggacgcttcaaacagacgaacgcccggatcgccgtggcgcagtttcccgcccacttcatcctggaacttgttccatgcctgcggggagttccagcccggcgcccaggcgaacgggatctgcgaacgcggggcggacggctggttgttcccttccatggagaaggcgaacatcgtgtctttatcctgcggctgacgcggctcgtgcacgctgatgttagcgcgcatcgccgtgcggccgctgtagcggtgcggttcacgcgccagcttctggccgcggatgcggaaggtcgcatccggcgcggcgtctttaatgcccgccagctgcggcagcgccgcaatcgccgcatcaatgacgtggtccagctgagtccagtcaacctgacggttgttgacggtgctgtgcagcgaatgcagccagcgccagctttccagcattacggttttcgcgtcgtagtaagccggatcgtaaacctggaagaaacgttgggcgcggccttcgttgttcaccacggtaccgtcgctttccgcaaagcttgccgcggagagcaccaggtgcgctttgtccataatcgcggtgcgctgatgatccaccaccatcaccagcggcgctttcgccagcgcagcgtcaacgcgcgcggcggaagcatgacggtgaaggtcgttttccagcacgataaccgcgtctgcggcgccgctttccagttcgtccagcgcctcttcaagcgagccgccgccgatcatgcccagtccgacgctgttaaccgcccgggcgaccatggtcaccccgacatcggcgccgcggcctttcagagctttcgccacgttagcggcggcctggatgatctccatgctgccggcgttggtcccggagatgatcagcggttttttcgccccggccagcgcctgaacgataacgtcgactttaccctgcaggtcctggctcaggccgtcaaccgccggcgcgctgtcgtccagcgcatgggcaatagcaaagccgagacgcgcctgatcttctaccggcgcgcggtaggtccacgccgcgatgtcatccaggcgggtgtcatcgacgttggtgacgaatag

SEQ ID NO: 5336 - DNA, 612 bp, Klebsiella pneumoniae
ttaagggtccctatgagtcagagtcatttctttgcccacctctcccgcctgaaactgattaaccgctggccgctgatgcgcaacgtgcgcaccgaaaatgtctccgaacacagcctgcaggtggcgatggtcgcccacgcgctggcggcgattaaaaaccgcaaatttggcggccaggtcaacgccgagcgtatcgccctgctggcgatgtaccatgacgcctcggaagtactaactggcgacctccctactccggtgaaatatttcaattcgcagattgcccaggaatataaggcgattgaaaaaattgctcagcaaaagctggtggatatggtccctgacgagctgcgcgatattttcgagccgctgattgatgagcatcactacagtgaggaagagcagtcgatcgtaaaacaggctgacgccctctgcgcttacctgaagtgcctcgaagagctgtctgcaggcaataacgaatttctgctggccaaaggtcggctggaaaagaccctggcatcgcggcgcagcgcggagatggattactttatgcaggtgttcgtcccaagcttccagctgtcgctggacgaaattagccaggattcgccgctgtaa

SEQ ID NO: 5337 - DNA, 255 bp, Klebsiella pneumoniae
cgaaaaaacccgactcggcttgccggaggtacagcttggcctgctgccgggttccggcgggacgcagcgtttaccgcggctgatcggggtcagcaccgcgctggatatgatgctcactggcaagcagctgcggccgcggcaggcgctgaaggccggtctggtggacgaggtggtgccgcaggcgattttactgcaggcggcggtggagttggcgctgaagggacgaccgaccagccgggaggtgcctgttcgtga

SEQ ID NO: 5338 - DNA, 1710 bp, Klebsiella pneumoniae
cgcggcgcacccatgcacgaaatctttactatgatgctggcggtctatgatcgtgcggccctgatgcttatttgcctctttttccttattcgcctgcgcctgttccgcgaactgttgcataagtcggcccatactccgaaagagctgctggcggtgacagccattttctcgctgttcgcgctatttagtacctggtccggcgtcccggttgaggggtccctggtgaacgtccgcattatcgccgtgatgtccggtgggatcctgtttggtccctgggtgggcgcgattgtcggggcgattgccggcgtgcaccgctatttgattgatatcgacggcgtgaccgcagtgccctgctttatcaccagcattgtcgccggcctgctgtcggggttgattaatcgtaaagtggcccgcgaacaacggtggaaaatcggcattctggcggggatgatgtgtgaaactctgaccatgatcctggtggtggtctgggcgccttccctgagtctcggcgtagatattgtttcgaaaattggtattccgatgatcctcggcagcgtctgcatcggctttatcgtgctgctggtgcagagcgttgaaggggaaaaggaggccagcgcggcgcggcaggcgaaactggcgctcgatatcgccaacaaaaccctgccgctgtttcgacacgttaacagcgattctctgcgccaggtttgcgagattatccgccgcgacattaccgccgacgcggtggcgatcaccaataccgagcacgtgctggcctacgtgggcgtcggtgaagccaactatcaacgccacgacgatatgattagccccaccacccggcaggcgattcgttatgggaaaatcatcataaaaaacaatgacgaagcccaccgtaccccggagatccactccttgatggtgatcccgctgtgggaaaaaggggtggtgaccggcacgctaaaaatctattactgccacgcccatcgcatcacttcgacgctgcaggagatggcgattggcctgtcgcaaataatctccacccagctggaagtctcccgcgccgaacagttgcgggagatggccaacaaagcggagctgcgcgccctgcaaagcaaaattaacccgcattttttatttaatgcgctgaacgcgatctcctcctcgattcgccttaatccggacaccgcgcgccagctcatttttaatctgtcgcgctacctgcgctataacatcgaattaaaagacgatgagcagattgatatcaaacgagagctgtatcagatcaaagattatatcgctattgaacaggcgcgattcggcgacaagctgacggtcatctacgatattgacgacgacgtcagctgcgtgatcccgagcctgcttatccagccgctggtggaaaatgccatcgttcacggtattcaaccctgtaaaggcaaaggcgtggtgacgatcggcattaacgagtgcggcaatcgggtacgcatcagcgttcgcgatacgggcaacggtatcgatcccgccgtggtcgcccgcgtggaagccgatgagatgccgggtaacaaaatcggcctgctcaatgtgcatcatcgggtgaaacttctctacggcgagggtttgcatatccgcaatctgacgccgggaaccgaaattgccttttatgtccccaataactctacgccgcaggcgctgacggagtcgctgttgtcatga

SEQ ID NO: 5339 - DNA, 1227 bp, Klebsiella pneumoniae
ttagaggaacctatggctgaatccagtcctgaacgccgttttacgcgtatcgatcgtctccctccgtacgtttttaacattactgctgaactgaaaatggctgcgcgtcggcgcggcgaagatattatcgatttcagtatgggtaatcccgatggcgcgacgccgccgcatatcgtggaaaaactctgcaccgttgctcaacggcctgacacccatggttactctacctcgcgggggatcccgcgcctgcgtcgcgccatttcacgctggtatgaagaacgctataacgtcgatatcgatccggaatcggaagcgatcgtcaccattggttcgaaagaggggctggcgcacctgatgctggcgacgctggatcatggcgacaccgtactggtgccgaaccccagctatccgattcatatctatggtgcggtaatcgccggggcgcaggtgcgctcagtgccgctggtggaaggggtggatttctttaacgagctggaacgcgccatccgcgagagctatccgaagccgaagatgatgatccttggctttccctcaaatccgaccgcgcagtgcgtcgaactggatttctttgaaaaggttgtcgctctggcgaagcagtatgacattctggtcgtccacgatctggcctatgccgatatcgtgtatgacggctggaaagcgccctccatcatgcaggtgcccggcgcgcgagatgtcgccgtcgagttctttaccctgtcgaaaagctataacatggccggctggcgcattggctttatggtgggtaataagactttggtgaatgccctcgctcgtatcaaaagctatcatgactacgggacttttactccgctgcaggtggcggcgatagctgcgctggagggtgatcagcagtgcgtgcgcgatattgccgaacagtataagcgccgtcgcgatgtgctggtcaaagggcttcatgaggccggctggatggtggagtgtccgaaagcgtctatgtacgtgtgggcgaaaataccggaaccttacgccgccatggggtcgctggagtttgcgaaaaagctgcttaatgaagcgaaggtttgcgtctcgccggggattggctttggcgactatggtgatacccacgtccgcttcgcgctgatcgagaaccgggaccgtacgcgccaggcgatccgcggtatcaaggcgatgttccgcgcggatggtctgctggcctccgcgagctag

SEQ ID NO: 5340 - DNA, 2148 bp, Klebsiella pneumoniae
ataatggatactgtttccgcttttaagcttgaggtccgtgcggacaaaatcgcggtgatcaccattgatgccccgggtgaaaaaatgaataccctgaaagccgaatttggcagtcaggtacggggattgatacgccatttacgtgacgataagtcagtgcgcggcgtagtatttatctccgccaaagcggataactttatcgccggcgctgatatcaacatgattgcccgctgccgcagcgcgcaggaggcggaagcgctggcgcgccagggacagcagattatggctgagatccatggcctgtcgatcccggtgattgccgctatccacggcgcctgccttggcggcggtctggagctggcgctggcctgtcatggccgtatctgtatcgatgacgaaaaaacccgactcggcttgccggaggtacagcttggcctgctgccgggttccggcgggacgcagcgtttaccgcggctgatcggggtcagcaccgcgctggatatgatgctcactggcaagcagctgcggccgcggcaggcgctgaaggccggtctggtggacgaggtggtgccgcaggcgattttactgcaggcggcggtggagttggcgctgaagggacgaccgaccagccgggaggtgcctgttcgtgaacgcgtactggcagggcccctggggcgccatctgttattccagtttgtcggtaaacaaacgcagcgcaaaacgcagggaaattacccggcggtgaagcgaatcttgcaggtcgtcgagaatggtctggcccatggctgcagcagcggatacgctgaagaggcgcgcgcatttggcgaactggcgatgagcccgcagtcgcaggcgctgcgatcgatcttctttgccagtaccgatctgaaaaaagaccctggcgccgaggcgggccccggtccgctgagaagcgttgcagtactgggcggtggcttgatgggcggggggatcgcctatgtgaccgcctgtaagggtgggctgccggtgcggattaaagatatccagccgcgtggcatcaaccacgccttaaagtacagctgggatctgctgaataaacaggttcgtcagcgtcgactgcgcccagtggagcgcgatcgtcagatggcgctgatctccggcactaccgactatcagggctttgctcatcgcgatgtggtgatcgaggcggtatttgaagacctggctctcaaacagcggatggtcagcgaagtggaacaatacggcgggccgcagaccatctttgcgtcgaatacctcatcgttgccaatcggcgatattgccgctcacgccagccgcccggggcaggtaatcggcctgcattttttcagtccggtggaaaaaatgccgctggttgaggtgatcccgcacaagggaaccgacccgcagactatcgccaccgtggtgcagctggctaaacggcaggggaaaacgccgattgttgtcgcagataaagcggggttctatgtgaaccgtatcctcgcgccgtatatcaatgaagcgatgcgcctgctggtggaaggcgaaccgattgaagtcattgataacgcgttggttaaattcggttttccggtggggccgattcaactgctggatgaggtgggtatcgataccggcaccaaaattatccccgtgctggagagcgcgtttggagaacgttttagcccgcctgcaaacatcattgacgcgattttgaaggacgatcgcaaaggcagaaaaaataatcgtggtttctatctttatgagacaaaagggcgtaaaagcaaaaaacggcccgacccggcagtctatccgctgctcggcatcggccgcccgcagtcgcggctctccgcgcagcaggtggcggagcgctgtgtgatgatgatgcttaacgaagcggcgcgctgctttgatgagcagattatccggagcgcgcgcgatggcgatatcggcgccgtctttggtatagggtttccgccatttcttggcggcccgttccggtatatggatactatcggcgcgggtgaagttgccgcgatcctgcagcgcctggccgcccagttcggcccacgttttacaccctgtgacactttattacgcatggccgaacaggggaccaccttttggccagcggatgaacggctgacctaa

SEQ ID NO: 5341 - DNA, 351 bp, Klebsiella pneumoniae
cggcgaaacactttccgtggccggaagacctgcactaaggccgcacattacatgacaagaggtaagatgatgatcgcggagtttgaatcacgcattctggcgctgattgacaacatggtagaccacgccagtgatgatgaactgtttgccggcggttatctgcgcggccacctgacgctggcggtggctgagctggaaggtgagggcgagcattctgctgacgcggtacacagcagagttagccagagcctggagaaagccatcagcgctggcgaactgtcgccgccggaccaaattctggtgcaggggatgtggcataacctgtatcaacaggcgaaaaatcaggcctga

SEQ ID NO: 5342 - DNA, 237 bp, Klebsiella pneumoniae
gtcaataaaaccggccaggatggcgacaaagaagagtaccaccagcaccagcggcgatacggcaaacaactcgataaaactatccattacagcacatgctcatccagtagcgcctggcaggaaggcggcagcggcggcggcgtcttcttcacagggggggtagacccgggtttaggtggttcgaaccagctctgcagctccgctccgcagccatcgccgggcggcggcggcgcctga

SEQ ID NO: 5343 - DNA, 1947 bp, Klebsiella pneumoniae
acgcggcgaacgtattgcagtgaccaatctgcggacgccggacgagatttaatttgcgcctgcgggcgggagaaccacttcgcaaatcaatctacaacagcgcgaagtctcgccggcagtcaccacggaccttttgcaatggtgaacaatatgaccgatttaaccgcgcatgacgccgcaccagcctggcaaacccgcgatcaccttgatgacccggtgattggcgaactgcgcaaccgctttgggccggatgcctttaccgttcagccaacccgtaccggcgtaccggtggtatgggtgaagcgtgaacagctgctggaggtgggtgatttcctgaagaaattgccgaagccttacgtgatgctgtttgacctgcacggcatggacgaacgtctgcgcacgcaccgcgatggcctgcccgccgcggatttttccgttttctatcacctgatctccatcgatcgcaaccgcgacatcatgctcaaggtggcgctgtcggaaaacgatctgcatctgccgaccttcaccaaactgttccccaacgccaactggtatgagcgtgaaacctgggaaatgtttggcattaccttcgatggtcacccgaacctgcgtcgcatcatgatgccgccgacctgggaaggtcacccgctgcgtaaagattatccggcgcgtgccaccgagttcgacccgtttgagctgaccaaagccaaacaggatctggagatggaggcgctgacctttaaaccggaagagtggggcatgaagcgcggcaccgacaacgaggacttcatgttcctcaacctcggtccgaaccacccatcggcgcatggtgcgttccgcattattctgcaactggacggcgaagagatcgtcgactgcgtaccggatatcggttatcaccaccgcggcgccgagaagatgggcgagcgtcagtcctggcacagctacatcccatataccgaccgtattgaatatctcggcggctgcgtcaacgagatgccgtacgtgctggcggtggaaaaactggctgggatcaccgtaccggatcgcgtgaacgtgatccgcgtgatgctctccgagctgttccgcatcaacagccacctgctgtatatctcgacctttattcaggacgtcggcgcgatgacgccggtcttcttcgcctttaccgatcggcagaaaatttacgatctggtggaagcgattaccgggttccgtatgcacccggcgtggttccgcatcggcggcgtcgcgcacgatctgccgcgtggctgggatcgcctgctgcgtgagttcctcgagtggatgccgaagcgtctggactcctatgagaaggccgccctgcgcaacaccattctgaaaggccgttccgtcggcgtggcagcctataccgccaaagaggcgctggagtggggcaccaccggcgcaggcctgcgcgccaccggtatcgacttcgacgtgcgtaaatggcgtccttactctggctatgaaaacttcgacttcgaagtcccgaccgggggtggcgtctctgactgctacacccgcgtgatgctgaaagtagaagagctgcgccagagcctgcgcattcttcagcagtgcctcgataacatgccggaaggcccgttcaaagcggatcacccgctgaccacgccgccgccgaaagagcgcacgctgcagcatatcgaaaccctgatcacccacttcctgcaggtatcgtggggcccggtgatgccggccaacgaatctttccagatgattgaggcgaccaaagggatcaacagttactacctgaccagcgacggcagcaccatgagctaccgcacccgcgtgcgtacgccgagctttgcgcacctgcagcagatcccgtcggcgatccgcggcagcctggtatccgacctgatcgtctatctgggtagtatcgattttgttatgtcagacgtggaccgctaa

SEQ ID NO: 5344 - DNA, 318 bp, Klebsiella pneumoniae
gcgatcgtgacaattacggtaactactgggacggtggcagctggcgcgaccgtgattactggcgtcgtcactatgaatggcgtgataaccgttggcatcgtcatgacaacggctggcacaaaggctggtataaaggcagagataaagcctgggagcgcggctatcgtgctggctggaacgaccgcgatgaccaccgcggcggctggggacgcggcccgggtgggcgcggtcacggtcatggacatggccatcactaacaaacgaaaaggggagcccatcggctcccctttactttattcagcatcaggaatcaattaa

SEQ ID NO: 5345 - DNA, 1119 bp, Klebsiella pneumoniae
ccctttactgcgccgatgaggctccagcgcagggcgcctccggcaatcgccaggggcgcgctgtatccgctgttaagtcagcacgatccggcgctggcgcgcttttttccggccgcctttaccttcgcccgccgaatgtatgacgcgctgccggtgatgttcgatcaccaatggtgcggtgttacccagctcggctgggatgagaaaagcacgcataaaatcgcccagatgctggcgctgaatttacccccggacatcgcctgcgcggtgacggcggaacaggttgccgggctgaccggcgtcgataccggctgcggcggcatcacctatccggccggcggctggctgtgcccgcagcagctcaccgccgagctgctggcgctggcggccacgcgcggactgcacgtgcactatggttatcccgtcgaaacgctcagcgcggagggcgatggctggctgctcaatcagcagcgctatcatcaggcggtggttctggcgaacggccaccgcatcactggttttgggcaaaccgcccaactgccggtctacccggttggcggccaggtcagccatattcccaccaccccgcggcttgccgccctgcgccaggtgctgtgctacgacggctacctgacgccacagaatccgcaaaatcagcagcactgcattggcgccagctaccaccgcgggaaaaccgacaccaccttcagcgaagaagatcagcagcacaaccggcaacggctgatcgactgcttcccgggcgcggagtggccgcaggacgtggatatcagcgccaacgacgctcgctgcggcgtgcgctgcgccacccgcgatcatctaccgatggtcggcaacgtgccggactacgcggcaacattgacgcaatacgccagcctccacgaacaaccggatatcgccgatagcgcgccggtctgtcgtaacctgtttatgcttggcgcgctcgggtcgcgcggactttgcaccgcgccgttaagcgctgagctgctggcggcgcaaatgagcgcggaaccgctgccgctggatagcgacaccctggcggcgctgaatccgaatcggctgtgggtgagaaaactgctgaagggaaaagcggtgaaataa

SEQ ID NO: 5346 - DNA, 729 bp, Klebsiella pneumoniae
tttaccggtgctgccaatgggcccgctgtttctggcggactaatagggtcattaagggtaaagacaaacatggacttgattcactttttaattgatttcatcctgcatattgatgtgcaccttgccgaactggttgcccagtatggcgtctgggtttatgccattctgtttttgattctgttctgcgaaaccgggctggtggtgacgccattcctgccgggcgattccctgctgttcgtcgcgggcgcgctctcggccttgccaaccaacgatctcaatgtccacctgatggtactgctgatggtcatcgcggccatcgtcggcgatgcggtcaactacaccattggccggctgttcggcgaaaagctgttcagcaatccgaactcaaagatattccgtcgcagctatctggataaaacccacagcttctacgaacgtcacggcgggaaaaccattatcctggcgcgctttgtgccgatagtccgaacctttgcgccgtttgtggcgggaatggggcatatgtcctatcgtcattttgcagcctataacgtggttggggcgctgctgtgggtgctgctgttcacctatgccggctatctgtttggcgatttgccggtggtgcaggagaacctgaagctgctgatcgtggcgatcatcgtgctttccgtcctgccgggcgtgattgagattattcgccacaagcgggcggcggcgaagcaggcgaagtag

SEQ ID NO: 5347 - DNA, 732 bp, Klebsiella pneumoniae
cgactcgtcgcctggctgccgggtcgcttgcggaatttctcccgggtggcgcagcttcacctatactcgaacagtttgcgacccacgacggcgggaaatattatgatcgatctttactatgcacccaccccaaacggccacaaaatcaccctgttcctcgaagaggcggagctagcctatcggctaattcgggtcgatatcggcaaaggggaacaatttcatccgcagtttctggcgatttcgccgaataataaagttccggctatcgtcgaccacatgcctgctgacggcggggcgccattgagcgttttcgagtccggcgccatcctgctctatctggcggaaaaaagcggtaagctgctgagcggcgagctgcgggaacgctacgtcacgctgcagtggctgttctggcaggtcggcgggctggggccgatgctggggcaaaatcaacatttttcccactccgcgccgcaaaccgtgccctacgctattgaacgttttcaggtggaaacccaacgactgtatggggtgctaaatcagcgcctgggatgcagcccgtggcttggcggcgaccactacagtatcgccgacatcgccgcctggccctgggtgaactgccatgtccgacagagtatcgatctggcgaactatccggcggtgcacaactggtatgagcgcattaagcagcggccggcaacggcggaagcgatgttaaaaattcagctttattaa

SEQ ID NO: 5348 - DNA, 291 bp, Klebsiella pneumoniae
gcatactatttcatgagtaaatgtatgggaattagctgcccatgttatagcatccttttacgtgaaaaggtgacctgtttaacttctgactgcgataaggctcgcaatgtcagcaagttgcctgctttttcagcgattgaatcgggaaggataattttgccgttgacacctgagcgaggaattcatattatgccgcccgtcaacacgacacgctttacgttacggggctatagctcagctgggagagcgcttgcatggcatgcaagaggtcagcggttcgatcccgcttag

SEQ ID NO: 5349 - DNA, 1179 bp, Klebsiella pneumoniae
tgcatgtccgcagttactgaaacaacatccaattcttcggcgaatttttcgcttttccgtattacgtttgccgtctttttgacctatatgaccgttggtttgccgctgccggtgatcccgctctttgtccatcaggagctgggatttggcaacaccgtggttggcgtggcggtagggatccagttcctcgccaccgttctgacccgggggtacgccggacgtctggcagaccagtacggcgctaaacgttccgtcctgcaggggatgctggcctgcgccctggcgggcgcggcatggctggccgctgcgctgctgccgctgccggtgctcgccaggctcggcctgctgctgctgggccgcttgatcctcgggtttggcgaaagccagctgctgaccggaaacctgagctgggggatgggcctggtgggaccggcccgttccggcaaagtgatgtcatggaacggcatggcgatgtacggctcgctggcggtgggcgccccgctgggattattgatctatagccattttggcgtggcggtgctggcctgtgtcaccatgggactaccgctcgtcgcctggcttattaacggtaccgtgcgcaaagtggcggcccacggaggcgagcggccttcactctggagcgtcatcggcatgatctggcggccgggtattggcctgggcctgcagggtgtcggctttgcggtgatcggcaccttcgtctccctctatttcgccagccatagctggccgatggccggctttaccctgacggcgtttggaggcgcctttgtgctgatgcgggtgctgttcggctggatgccggatcggtttggcggcgttaaggtggcgatggtctcgctgctgatagaggcggttggtctgacgctgctgggactggcgccgaatgcctggctggcgctggccggtgcggcgctgaccgggtgcggctgttcgcttattttcccctcacttggcgtggaagtagtgaagcgcgtcccggcgcaggtgcgcggcaccgcgctcggcggctatgcggcctttcaggacatctcctatggcctgaccgggccgctgaccggcctgctggcgacctcgctgggctactcgtcggtgttccttgccggcgccctctgcgcggcgctggggatcctcgtcacccttatctcatttcgccgctag

SEQ ID NO: 5350 - DNA, 1914 bp, Klebsiella pneumoniae
ctgcagaccgctgcggccgcagcgacggtactccatcgtttgatatcgcgtggtgcttgcctggtaaaccattcttcctccgccgacaaaacaggatgtgtatacgtttacactaaacaatgttctgcgtggagtacactgctttttctgcgtaattattgctttacactgccattatcacctcccatctggacaggcggatcgcttattcaatactcaaattacacctgcaccaaaatgaggataatggatatgcaaccgacctacactattggggattatctgctggatcgccttgtcgactgcggtattgaccgcttgttcggcgtgccgggagattacaacttacagtttctcgatcgcgtcatcgcgcacagcgccttggggtgggtcggctgcgccaacgagctgaatgcggcatatgccgctgacggctatgcgcgcatcaaaggggccggtgcgctgctgaccacctacggcgtcggcgaattgagcgcgctgaacggcattgcgggtagctatgcggaacatattccggtattgcatattgtcggtgcgccctctaccggcgcccagcagcgcggcgaactgctgcaccataccctcggcgatggcgattttcgccatttcgcccgcatgagcgagcagatcacctgtagccaggcgctgctgaccgccggcaacgcctgccatgaaatcgaccgtgtgctgcgcgatatgttgacgcatcatcgccccggctatttgatgctgccagccgatgtcgccagagcggcagcgattgccccagcccagcgcttgctggtagagcccgctccggcggatgaaaaccagcttgccgggttctgcgaacatgccagccgcctgctgcggggcagccgacgcatttccctgctggcggacttcctggcgcaacgttatggcctgcagaagacgctccgggagtgggtggcgaaaacgcctgtcgcccatgcgacgatgctcatgggcaagggattgttcgatgagcagcagagcgggtttgtcggcacctacagcgggattgccagcgcgccgcagacccgggaggcgattgaaaacgccgacaccatcatctgcattggcacgcgcttcaccgacaccatcaccgcaggatttacccaacatctggcgcgggaaaagactattgagatccagcccttcgccgtcagggtgggcgatcactggttcagcggggtcccgatggataaggctttggccgcgctgatgacgctttccgccccgctggcggcggagtgggctacgcctcaggtcgtggcgccggaggctgaggagggcgctgaaggcgagttgacccagaaaaatttctgggcgacggtgcagggcgccctgcgtccgggggatattattctcgccgatcaggggacggccgcctttggtattgcggctctgaagctgccctctgaagcatcgctgatcgtccagccgctgtggggctcgattggttttactctcccggccgcctatggcgcacaaaccgcggcggcggagcggcgggtggtgctaattgtcggcgatggcgcggcccaactgaccattcaggagatgggctccatgctgcgtgataagcaaaagccgcttattctgctgctgaataacgaagggtataccgtggaacgggcgattcatggtccagagcagcgctacaatgacatcgctctgtgggactggcagcggctgccggaagccttcgcccctgacgttgcttcgcgctgccggcgggtcactcagacgtctgaactgcgggaggcgatgacggagagcatcacctccgataccctcaccctggtagaagtgatgctgccgaaaatggatatccccgatttcctgcgcgcggtgacgcaggcccttgaggagcgaaacagccgcgtttaa

SEQ ID NO: 5351 - DNA, 789 bp, Klebsiella pneumoniae
ctctacgccgcaggcgctgacggagtcgctgttgtcatgagcggagaaaagatgaaagttatcattgtggaggatgagtttctggcccagcaggagctctcctggcttattaacacccatagccagatggagatcgtcggcagctttgacgacggcctggacgtgctgaaatttctccagcacaacaaggtcgacgccatctttctcgatatcaatattccgtcgctcgacggggttctgctggcgcaaaacatcagccagtttgcccataaaccttttatcgtctttatcaccgcgtggaaagaacatgcggtggaagcctttgagctggaagcctttgactacatcctgaaaccctaccaggaatcgcgcatcatcaatatgctgcaaaagctgaccaccgcctggcagcagcaaaataacgctgcttcaggattagccagcgcggcgccacgggaaaacgacaccatcaatctgatcaaagatgagcggatcatcgtcaccagtattcatgatatttattatgccgaggcgcatgaaaagatgacattcgtctatacccgccgggagtcattcgtcatgccgatgaacattactgaattctgcagcaaactgcccaccgcgcatttctttcgctgccaccgctcatattgcgtaaatctcagcaaaattcgggaaattgagccgtggttcaacaacacctatgtgctgcgcctgcgtgacctggagtttcaggttccggtcagtcgcagtaaagtgaaagagtttcgccagctgatgaatctgtag

SEQ ID NO: 5352 - DNA, 1227 bp, Klebsiella pneumoniae
actttatcagcgctgggcggaacggcagtcatgacacaagcgctgcgacagaacctgacgctggcagtcctggtactgactgggatcaatatgcggccgctgcttacctccattggtcctttgctgccggacatccgcgcagccagcggcatgagctataccctggccgcactcctgaccgcgctgccggtgatcgcgatgggggtgctggcgctggccgctggctgggtcgatcgctatatcggtcaaaagcgcagtattgcgctgagcctgctgattatcgcggcaggcgccctgctgcgggaaatcgccccgaatagtggcttactgctcaccagcgctctggccggaggaattggcatcggcattattcaggccgccattccggcggtaattaagcacctctttccccgacggacgccgctggtgatgggactatggtcagcggcgctgatgggcggcggcgggttaggcgccgcgttcaccccatggctggcgtcacatagcgcggcctggcatgatgcgctagcctggtgggcgctccctgcgctcctggctctgctcagctggctggcgatatgtcggcaattgcctcgcgcaccgcatcagaccagcgcttccccccgggtcgcgattattggccagcgccgcgcctggacgctgggactctatttcggactgatcaatgccggttacgccagcctgatcgcctggctgcctccttactacatccagctaggcgatagcgcccagtacagcggttcgctgctggcgctgctgaccgtcgggcaaaccgccggcgcgctgctgctcccggcactggctcgccaggaggatcggcgccagcttcttctgctagcgctggcgctacagctgattggcttctgcggctttatctggctgccagagcatttctctgcgctctgggccattgcctgcggcgtggggttgggcggcgcgtttcctctgtgcctggtgctggcgctggatcacgccggacaaccggcggtggccggcaggctggtagcctttatgcaggggatcggatttatcatcgccggtctgtcgccctggctttccggcctgctgcgtagcctgagcgggaactacacgcttgactggtcctggcatgcgatctgcgtcctgctactcatggcgctgacgctgcgctttatcccggcacactacccggccgagtggcgacagcgcgcctcagacctgccctga

SEQ ID NO: 5353 - DNA, 339 bp, Klebsiella pneumoniae
atccgcccagctgccgctgcaaacgtggcttgccgatgcgatggcgggtccgacgccggtctctgcgctgatccacgccgcgaccatggtcaccgcgggcgtctatctgatcgcccgtacccacggcctgttcctgatgacgccggaagtgctgcatctggtcggtatcgtcggggcggtcaccctggtgttggcgggcttcgccgcgctagtgcagaccgatatcaaacgcgttctcgcctactctaccatgagccagattggctacatgttcctcgcgctgggcgtgcaggcatgggacgcggcgattttccacctgatgactcacgcgttctttaa

SEQ ID NO: 5354 - DNA, 594 bp, Klebsiella pneumoniae
tgctggaaagctggcgctggctgcattcgctgcacagcaccgtcaacaaccgtcaggttgactggactcagctggaccacgtcattgatgcggcgattgcggcgctgccgcagctggcgggcattaaagacgccgcgccggatgcgaccttccgcatccgcggccagaagctggcgcgtgaaccgcaccgctacagcggccgcacggcgatgcgcgctaacatcagcgtgcacgagccgcgtcagccgcaggataaagacacgatgttcgccttctccatggaagggaacaaccagccgtccgccccgcgttcgcagatcccgttcgcctgggcgccgggctggaactccccgcaggcatggaacaagttccaggatgaagtgggcgggaaactgcgccacggcgatccgggcgttcgtctgtttgaagcgtccgccagcggactggagtacttcacggcggtgccggccagcttccaggcggaagagggcaaatggcgaattgcgccgtactaccatctgttcggcagcgatgagctgtctcagcgcgcgccggtgttccagagccggatgcctgagccgtacatcaagctga

SEQ ID NO: 5355 - DNA, 1356 bp, Klebsiella pneumoniae
cctgctggagcagtacaaatgaaaaccgtaattcgtactgcggaaacgcatccgctcacctggcgcctgcgcgacgacaagcagccggtgtggctggacgagtatcgcagtaaaaatggctatgaaggggcgcgtaaagccctgaccgggatggccccggatgagattgtcacggcggtaaaagacgctggcctgaaagggcgcggcggcgcgggcttctccactggtctgaagtggagcctgatgccgaaagacgaatccatgaacatccgttacctgctgtgtaacgccgatgaaatggagccgggcacctataaagaccgcctgctgatggagcagctgccgcacctgctggtggaaggcatgctgatctccgcgtttgcgctgaaagcgtaccgcggctacatcttcctgcgcggggaatatattgaagcggcccagcatctgcgtcgcgcgattgctgaagccaccgaagcgggtctgttggggaaaaacatcctcggcaccgggtttgacttcgagctgttcgtgcacaccggggcagggcgctatatctgcggcgaagagacggcgctgatcaactctctggaaggccgccgcgccaaccctcgatccaagccgccgttcccggcgagctccggcgtctggggcaagccgacctgcgtcaacaacgtagaaaccctgtgcaacgtgccagcgatcctcgccaacggcgtcgagtggtaccagaacatttccaccagcaaagatgctggcaccaagctgatgggcttctccggccgggtgaagaatccgggcgtctgggagctgccgttcggcaccactgcccgcgagatcctcgaagattacgccggcggtatgcgcgatggcctgaagtttaaagcctggcaaccgggcggagcagggaccgacttcctcaccgaagcgcacctcgatctgccgatggaattcgaaagcattggtaaagcgggcagccgtctgggcacctcgctggcgatggccgttgaccacgagatcaacatggtctcgctggtgcgtaaccttgaagagttctttgcccgcgagtcctgcggctggtgtacgccgtgccgcgatggtctgccgtggagcgtgaagatcctgcgcgccctggagcgcggcgaaggccagcctggcgatatcgaaacccttgagcaactgtgtcgattcctgggcccgggtaaaaccttctgcgcgcacgcgccgggcgcggtcgagccgctacagagcgcgattaaatatttccgcgaagaattcgaggctggcattaagcagcagttcagcaatacccatgcaatcaacgggattcagccgaacctgcttaagacgcgctggtaa

SEQ ID NO: 5356 - DNA, 552 bp, Klebsiella pneumoniae
ataagtcttttaacttatgaaacaagagacgtaccctcttcgcacgaccctcaacatatttcacctttaacatcgttttatgcaggagtgactatgtccgctcacgatcattatcttcagcgcgcattagtgctggcaaaacaaaacattgctgacggtgggcgccccttcggcgccgtgctggtgcggaatgatgagattgtcgctgaaagcgtcaatacctttcatctgagcggtgacccaacggcgcatgccgaactgaacgccgtacgcgatcttgccgccagactgggaagcgcggtgttgcgcgaatgcgtcatctatgccagcggacagccttgccctatgtgcctgagcgcgctctatttaaccggcgtgcgggaagtgtttttcgccaatagcaatcaggacggggagccttttcagctctcgaccgccgcgatttatcagcagctgcagcagccgctggcccagcaaacgctgccgatccatcatcgcccgcagccggagggaactgaactttatcagcgctgggcggaacggcagtcatga

SEQ ID NO: 5357 - DNA, 1290 bp, Klebsiella pneumoniae
ccgtcaattcttacgggcatcatggaaaaagatcctattcctcaggccacgtcgcccctggctacgtggctttcttatctggaacatctgcacagtaaaaccatcgaccttgggctggcgcgcgtcagcgaggtcgccgggcagatggatatcgttaaaccagcgccgttcgtttttaccgtcgcgggcaccaatggcaaaggcaccacctgccgcacgctggaaaccatcctgatggcggccggttataaagtgggggtctacagctctccgcatctggtgcgctacaccgaacgcgtgcgcattcagggggctgaactgccggaggcggcgcatacggcttcgtttgctgaaatcgaagcggcgcggggtgacatctcgctgacctattttgaatacggcacgctctcggcgctgtggctgtttaagcaggcgcagctggatgtggtgatccttgaggtcgggctcggcgggcgtctcgacgccaccaacatcgttgatgccgacgtcgcggtggtcaccagcatcgccctcgatcataccgactggctggggccggatcgcgaaagtatcggccgggaaaaagcgggcatctttcgcgccggtaaaccggcggtggtgggggagccggatatgccgctcaccatcgcggaagtggctagcgagaagggcgcgctgctccagcgccgcggcgtcgactggcgctatgaggtggaaggcgaaacgtggtccttccgcgatacggcaggggcgttaagccacctgcctctgcctcaggtgccgttgccgaatgcggcgacggccgtggcggcgctgcgcgccagcgggcttgccgtggatgacgctatcctgcgcgcagggatccgcgatgcgatgctcccgggacgctttcagataatcagcgacgccccgcgagtgatcctcgatgtggcgcacaacccgcacgcggcggcctatctcgccgggcgtctcaaaacgttagcgaaaacgggacgcgtgctggcggttattggtatgctgcatgataaggatatcgccggcacgttggccaatctggccccggaagtcgatgcctggtactgcgcgccgctggaaggcccgcgcggcgcgacggcagagcagctggtggaacatttgcgctgcggtacagtctatagcagcgtggcgcaggcgtggcgtgcgcccatggctgacgctaaagtggaagataccgtgctggtgtgtggttcgtttcacaccgtagcgcaggttatggaagagatagacgcggggagaatcggtggcgagtaa

SEQ ID NO: 5358 - DNA, 858 bp, Klebsiella pneumoniae
gcggggccctaccgcctcgacagcaactggagcttcggcttaggctttgacgcggtttacgccaaggcgaagatcgagcgctatgcaggcgatctggggcagattgtcgcaggctctggcgcgctgccgccggcgctggcgggccaggtagcgaagatcccggccgacacgcagatcgcccatcttaatggcaacgcgtggggcttcggctggaacgccgggatcctctatgagctggataagaataaccgctacggtttaacctaccgttctgaggtcaagatcgacttcgacggtaactaccgcagcagcctgccggcggcctataaccagatcctcggcaacttcggcctgccggcgggcaccagcggccagacgaccaatggttcgctaacccttaacctgccggaaatgtgggagctgtccggctataaccgcgtggctccgcagtgggcggtccactatagcctgacctacaccagctggagtcagttccaggagctgaaagccaccggcagcaacggccagacgctgttctataaagaggaaggcttcaaggacgcctatcgtcttgcgctggggaccacctattattatgacgataactggaccttccgtaccggtatcgccttcgatgacagcccggtgccggctaataaccgctctatctctattccggaccaggatcgcctgtggctgagcgcgggtaccacctacgcgttcaataaagatgcctcggttgacgtcggcgtttcatacatgcacgggcagcatgttgaaattaaggaaggcccgtataccttccgttccgaaggaaccgcctggctgtacggcgctaacttcaactaccgcttctga

SEQ ID NO: 5359 - DNA, 1446 bp, Klebsiella pneumoniae
gccatgcgctattgcgtatttcatggtctgtctcggcctttttgctggtggtatataacaaaaactttctcccagggggtgcaaagcgagtattcactctcctttgtgctgtcggttctgatctcctttactatctgtttgttttatatggccgacatctatgcccgcagcgaccgcaacaaacgccgctggcgtagccaggcggaagaagatccgctgaccggcttgcctaacctgcgcgcactggagagccatttacagagctgtcctcagcaggctatctgcagcctgcgtattgataatctcgactttctcagtcggcattatggtctgatgatgggggtggactgtaaacggcagattattcgggcgctgcaaccgctgctgggagcggcggataaagtcttccaggtaccgggcagcgaactgatcctcgtgcttgatggaccggagccgtcgtcccgcttgaaccatatggtcgcggtcctcaaccacaaaaagttcagctggcacaatcagccgctggatttggagtttggcgcggcctggggccgcgatgacggtcagggtgagggactttaccagatgctgggccagctaagctggctttccgaacaggcgggcagtgaacgtcgggtgctggcgctggacgaggagcaggatctggtggtggatcaaactaccgagcaggtgcgcctccttatgcgcgtcaagcaagtgctcaaagatcgcgcgctgatgctctatgcgcaaccgattcagaatccggagggggagggttatcatgagatcctcacgcgcatgcgctgtggcgatagcgtcattatgcccgaccgattcattccgctgattgtgcagtttaacctcagccaacgttttgacatgctggtgctggagaccttgttcagtatgctccataagcatcccggccagcgcttctcggtcaacctgctgcctgcaactctgatgcaaaagaacagcgcagggcagattatcgcgctgtttcaacgctatagcgtctcgccagaacttataactattgaggtgaccgaagagcaggccttctctaatgcggacaccagtcggcaaaatcttgaagcgttgcgcgcgtttggctgcgccatcgctattgatgactttggcaccggctatgcgaactatgaacgtctgaaacatttacaggccgatatcattaagattgacggctgcttcgtccgcgacatcctcacggacccgctggacgccatcatggtgaaatcgattgtcgagatggcgcgggcgaaacagatgagcgtggtggcggaatatgtcgaaagcgaaccgcaaaaagcgcgcttgctggagctgggcgtgaattatctgcagggttatctgatcggtataccacagccgctgggtgaatgtcaggcaaaaaaaagccgggcattgcccggctcagatgactga

SEQ ID NO: 5360 - DNA, 1269 bp, Klebsiella pneumoniae
caaaggctatatttccagaggcagaagatgactagcagtcgcgttgagaatagcagtagtcgcgccgcgcgcaaggtgaagctcgccttaatgggcccggctttcgtcgctgccattggctatatcgatccgggtaatttcgccactaacattcaggccggcgccagctttggctaccagctgctgtgggtcgtggtgtgggctaacctgatggcgatgctgatccaggtgctttctgccaaactgggcattgccaccggcaaaaacctggccgagcagatccgcgaccattacccgcgtcctgttgtctggttttactgggtacaggcggaaattatcgctatggccaccgatctggctgaatttatcggcgccgcaattggttttaagctggtactcggcgtatcgcttctgcagggggcggtgctgaccggggtggcgacttttctgatcctgatgctgcagcggcgcgggcaaaaaccactggagaaggtgatcggtggattgttgctgtttgtcgccgtggcctatgtcgtggagttgatcttttcccagcccgcgctggctcctctgacgaaagggctggtgatccccacgctgcccaacggggaggcggtattcttagccgccggggtactgggtgcgacaatcatgccgcacgttatctacttacattcctcgcttacccagcatctgcatggcggaacgcgaaaagaacgctataacgcgacccgctgggatgtggcgatcgctatgaccattgccgggttcgtcaatctggcgatgatggcgaccgctgcggcggcattccactttaatggccataccggcgtcgccgatcttgatcaggcctacatgacgctggagccgctgctgagccacgcggcggcgaccatctttggcctcagcctgattgccgccggtttatcgtcgaccgtggtgggcactctggcaggtcaggtcgttatgcaggggtttatccgctttcatattccgctgtggtttcgccgggcgatcaccatgctgccgtcgtttgtcgtcattctgctggggctggatcctacgcgcatcctggtaatgagtcaggtgttgctcagctttggcattgcgcttgccctggtgccgctgctgatatttaccagcaatgcgaagctgatgggggacctggtgaatacccgttgggtgagaggcatcggctgggcgatagtcgctattgtggtgagcctgaacggctggttaatagtggggtcgctgctcggggtggattaa

SEQ ID NO: 5361 - DNA, 690 bp, Klebsiella pneumoniae
tcaaattatcaacgcctgagggaggtgcccgtgcagtgtaaaggtttcctgttcgatttagacgggacgctggtggattccttgccggtggtggagcgttcatggtgcaagtggggggatcgtttcgccattgaccatgatgaaattctcagttttattcacggcaagcaggccattacctccattcgccattttatgccggggcgcagcgaggaggatatccaggccgaatttcgctacctcgagcagatagaagccactgatattgagggtatcgttgcgctgccgggggcattagccctgctgaatacgctcaatgaggccgggatcccgtgggcgattgtcacctccggctcgattccggttgcccacgcgcgtcaccgcgcggcgggcctgccgatgcctgaggtgttcgtcaccgccgagcaggtgaaacacggcaaaccggcgccggacgcctatctgctgggcgccgagcggctgggtctgcctgccggggagtgcgcggtggtggaagatgcgccggcggggctcctctccggactggcggccggctgtcgcactatcgcggtcaacgtgcccgccgatgcccctcgcctggatgaagccgacctcgtgctgagcagcctggaagatctggtggttgaacgccagactgacggcgtggtaaatgtgcgtcttaaagcgtaa

SEQ ID NO: 5362 - DNA, 357 bp, Klebsiella pneumoniae
cgacggcaccacatgcttgccatcgctggcgaccaggtccagcgcctgcggcttcaacagctgggacgatgtccagcgcgtttgcggcagctggaggaagatatcgacatcgaggcccgtctggtggctggcgtgcccgccgttaaagcgcccgcccgccggcatccccatgtcgccaatcagcacggttcccattcctttattgtgcacctgattactcaggcgctgaataaactgaaccagatccggatgaccgaagtagcgacgctgatcggtacgcatcacctgatagccgggggcactcagggggagcgcctcggcgccaacgatacagccattggaaaacgcgccgattga

SEQ ID NO: 5363 - DNA, 807 bp, Klebsiella pneumoniae
aatgacagtctgtcgaggatagttatgaaaaaactggcgttgtctctctctttagcgctggccctttccagcgtttccacggtctttgccgccatcccgcaaaaaattcgtatcggtaccgatccgacttatgctcccttcgaatcgaagaatgcgcagggagaattggtcggttttgatatcgatctggcaaaagagctgtgtaagcgtattaatacgcaatgtacctttgttgaaaacccgctggatgcgctgatcccctccttaaaagcgaagaaaatcgacgcgattatgtcttcgctgtcgattactgaaaagcgccagcaggaaattgccttcactgacaagctgtatgcggcagattcgcgtctggtggtgaaaaagggcagcccggtaacgccggatctcgccaccctcaagggtaagcgcgtgggcgtgctgcaggggacgactcaggaaacctatggcaatgagcactgggcgccgaaaggtatcgaaattgtctcctatcaggggcaggacaatatctattccgacctgaccgccggccggatcgacgccgcgttccaggatgaggtcgcggccagcgaagggttcctgaaacagcctattggtaaagattaccagtttggtggcccgtcaatcaaagacgagaaactgtttggtgttggcaccggtatggggctgcgtaaggaagacaacgaactgcgtgaagcgctgaacaaggcgtttgcagagatgcgtaaggacggcacctacgacaagctggcgaaaaaatatttcgattttaacgtatacggcgaataa

SEQ ID NO: 5364 - DNA, 1242 bp, Klebsiella pneumoniae
tgcgacttacagaggtatttaatgaaacgtgcagtgattactggcttgggcatcgtttccagcatcggtaataaccagcaggaagtcctggcatctctgcgtgaaggacgttcagggatcactttctctcaggagcttaaagattcagggatgcgcagccacgtatggggcaacgtcaaactggataccactggcctcattgaccgcaaagtagtgcgctttatgagcgacgcctccatctatgcttacctgtccatggaacaggctgttgccgacgcaggtctggcgcctgaagcatatcagaataacccgcgtgtcggcctgatcgcaggctccggcggcggttccccgaaattccaggtcttcggcgccgatgccatgcgtagcccgcgtggtctgaaagccgtgggcccgtatgtggtcaccaaagcgatggcttccggcgtttccgcctgcctcgctacgccgttcaaaattcacggcgttaactactccatcagctcggcctgcgccacttccgcccactgtattggtaacgcggtagagcagatccagctgggcaaacaggacatcgtctttgccggcggcggcgaacagctgtgctgggaaatggcctgcgaattcgacgccatgggcgcgctgtccactaaatacaatgacaccccggaaaaagcgtcccgtacctatgatgctaaccgtgacggcttcgttatcgccggcggcggcggtatggtcgtggtggaagagctggaacacgccctggcgcgtggcgcgcacatctatgccgaaatcgtcggctatggcgcgacctccgatggcgcggacatggtcgccccgtctggtgaaggcgcagtgcgctgcatgcagatggcgatgcatggcgttgatacgccgatcgactatctgaactcccacggtacctccactccggtcggcgacgtgaaagagctgggcgccatccgcgaagtattcggcgacaacagcccggctatttcggcaactaaagcgatgaccggccactcgctgggcgcggcgggcgtacaggaagccatttactccctgctgatgctggagcacggctttatcgcgccgagcatcaacgttgaagagctggacgagcaggctgccggcctgaacatcgtcaccaaaccgacggacgctaagctgaccaccgtaatgtccaacagcttcggcttcggcggcaccaacgccacgctggtgatgcgtaaatacaacgcctaa

SEQ ID NO: 5365 - DNA, 249 bp, Klebsiella pneumoniae
atttccgtgcacattctatgcaacggctttaaagaaaacgagatcaattgcacactattgcaaggaactgtgaccaatggcaaaaatagtgatccaacatccacttttgttatgttacgtaaaggttttaaaagttgcattcttgtactactcttaatagcgggctggatctcgttttctgacgcccgtatttcatttccggccagctattgttcccttctatcacagcaatcattatctccattctaa

SEQ ID NO: 5366 - DNA, 981 bp, Klebsiella pneumoniae
atcatgacgcacccccttgctgatatgccagaccgtcctccagggcgaggcccatcaggcactgccgccaccggcgaaccttcgctttccatgcagcaacgcaccgttctggagcgactgatcacgcgcctggtggcgctgacctcgcagcagaacgcggaagtgtgggcctgcgtcaaacatgacctcggactgaaaggcgactcgcccctgctggcctgccatttcagcgccgcggaggccagtctaaaccagcgcttagccgccgctcaggataatcatcatcatcgccagaccttagcgcagctcagcgatctgctcggtcagggcaataaccgccaggcggtgagcgattatattcgtcagcattatgggcaaacggcgctgcatgcccttagccagacgcagctggagaccattctgcatctgctgcagcatggccagctgtcgatcccgcagccgcagcagcgcccgccgaccctgcgcccgctgttgccagccgagcataatacgctcaatcagctggtgactaagctggcggccgccaccggcgaaccaagcaagctgatttggcaatccatgctggagctttgcggcgtcaagtccggggagctgatcccggcgacgcacttcctgccgctttcgtactggctgcaggcgcggcaaacgctgagtgcgcaaagcgcgccgacgctcacctcgctgcagggagcgctcaagcagccgctggaggccgcggagtggcagacaattgtcgacttcgccagtcgcagctggcaggtcacgccgcggaccacgctgagcccggcgcagatcctggcgctgctgaacaaggtgtttgtgctgcgggtggcccgcgcccaggagacgctggccatcccgcaggaggagcctgtcgccaggcggacgtggagcgttaagccgtggcagctggcgctgggcgcggttgtcctgctccttgtgctgtggctcctgctgtag

SEQ ID NO: 5367 - DNA, 1263 bp, Klebsiella pneumoniae
cttccacggcagggagtggcgataacagctaaaaggtcaagattcatgtcccccatcgaaaaatccagcaagttagagaacgtctgttatgacatccgcggcccggttctgaaagaagccaaacgtcttgaagaagaaggcaataaggttctgaaactgaacatcggcaacccggcgccattcggcttcgaggcccctgacgagatcctcgtcgacgtcatccgcaatttgcctaccgcccagggttactgcgattcgaaaggattgtactcggcgcgtaaagctatcatgcagcattaccaggcccggggtatgcgcgatgtcacggtggaagacatctatatcggcaacggcgtgtccgaactgattgtgcaggcgatgcaggcgctgttaaacagcggcgatgagatgctggttcccgccccggactacccgctgtggacggcggcggtgtcgctttccagcggcaaagcggtgcactatctgtgtgacgaatcctctgactggttcccggatctggacgacatccgcgcaaaaatcacaccgcgcacccgcgggatcgtgatcattaaccctaacaaccccaccggcgcggtctattccaaagaattgctgcaggagatcgtggagatcgctcgtcagcataatctgatcattttcgccgatgaaatttacgacaagatcctctacgacgaagcccagcatcactctattgccgccctggcgccggacctgctgacggtgacctttaacggattgtcgaaaacctaccgcgttgccggcttccgtcagggctggatggtgctgaatggcccgaaaaaacacgcgaagggctatatcgaagggctggagatgctggcttcaatgcgcctatgcgccaacgtgccggcccagcatgctatccagacggcgctgggcggctatcagagcatcagcgaattcatcatccccggcggacgcctgtatgaacaacgcaaccgcgcctgggagcttatcaacgatattccgggcgtctcctgcgtgaagccaaaaggcgcgctgtatatgttcccgaaaatcgacgccaaacgcttcaatattcatgacgaccagaaaatggtgctcgacttcctgctgcaggagaaagtcctgctggtgcaaggcaccgcctttaactggccgtggccggatcacgtacgcatcgtgaccctgccgcgcgaagacgacctggagatggctatctcccgctttggccgcttcctctccggctatcatcagctttaa

SEQ ID NO: 5368 - DNA, 1077 bp, Klebsiella pneumoniae
tgtcttcttaatgcccctgccggatactccggcggggccgctttatttctggagttaaccaccatgtctgaaggctggaatattgccgtactgggcgcaacgggcgccgtaggcgaagccctgctcgaaactcttgctgaacgccagttcccggtaggagagatttttgctctggcgcgcaacgacagcgcgggcgaacatctgcgttttggtggcaagtcggtgatcgtcaaagacgccgccgaatttgactggacccaggcccagctggctttcttcgccgccggcgtcgaagccagtgcagcgtatgtcgaagaagcgaccaacgccgggtgtctggttatcgatctcagcggcctgtttgcgctggagccggacgtaccgctggtggtgccggacgtgaacccgttcgtattaggcgattaccgcaaccgcaacctgattgcggtgcctaatagcctgaccagtcagctgttgacggcgctcaaaccgctgatcgatcagggcgggttgtcgcgcattagcgtcactaacctgctctctgcctcggggcaggggaaaaaagcggtggatgcgctggcggggcagagcgctaagctgctgaacggcatccctatcgatgaagacgatttctttggtcgccagctggcgttcaacatgctgccgctgctgccggatcgtgaaggtagcgtgcgcgaagagcgccggatcgtcgatgaagcgcgcaaaattcttcaggatgacgggctgatgatctccgcgagcgtcgttcagtcgccggtcttctacggccatgcgcagatggtgagcttcgaagcgatgcgcccgctggcggcggaggaggcgcgcgacgcttttacccgcggcgaggatatcgaactttctgaagagggcgaattcccgactcaggttggcgatgcctcaggcaatgcccgcctctccatcggctgcgtgcataacgattacggtatgccggagcagatacagttctggtcggtagcggataatgtgcgcttcggcggcgcgctgatggcggtgaagatcgccgagaagctgattgaggagtacctgtactga

SEQ ID NO: 5369 - DNA, 408 bp, Klebsiella pneumoniae
tatcaggttaacaggccgcttacggccccgatcgtgaaggagaagagtatgttcaggtcactgattctggcagcagtactgctggccgcagggccactggtcgctaacgctggtgaaatcaccctgctgccatcggtaaaattacaaataggcgatcgtgacaattacggtaactactgggacggtggcagctggcgcgaccgtgattactggcgtcgtcactatgaatggcgtgataaccgttggcatcgtcatgacaacggctggcacaaaggctggtataaaggcagagataaagcctgggagcgcggctatcgtgctggctggaacgaccgcgatgaccaccgcggcggctggggacgcggcccgggtgggcgcggtcacggtcatggacatggccatcactaa

SEQ ID NO: 5370 - DNA, 1095 bp, Klebsiella pneumoniae
tggcagtgtaaagcaataattacgcagaaaaagcagtgtactccacgcagaacattgtttagtgtaaacgtatacacatcctgttttgtcggcggaggaagaatggtttaccaggcaagcaccacgcgatatcaaacgatggagtaccgtcgctgcggccgcagcggtctgcagctaccggctatttcccttggcctgtggcataactttggcgatgaaacgcgagtggaaaccagccggcagatgctcctgcacgcttttgacctcggtataacccatttcgatttggccaacaactatgggccgccgccgggctcggcggaaagcaactttggccgcatcctgaaagagtcgctcctgccttatcgcgatgagttaatcatctccactaaagcaggctacacgatgtgggacggcccttacggcgactggggatcgcgaaaatatctggtagccagccttaaccagagccttaaacgcatggggctggaatacgtcgatattttttaccatcaccggcctgatccacagacgccgctgatggaaacgatgcgtgcgctcgatcatctggttcgtcagggtaaagcgctatatgtcgggatctccaactatcctctggcccaggcgcgggaggcggtgaagatccttaacgacctcggcaccccctgcatcattcaccagcctcgctactcgatgttcgaacgcggcgtggaagaaggattgctggattttctgcagacggaagggattggaagcatagcgttttcaccgctggccggcgggcaacttaccgaccgctatctcaacggcattccggccgactcgcgcgccgccagcagcagtcgttttctgcagccggagcaactgactccagcccgattagaaaaaattcgtcagcttaacaggcaggcggaagcgcgtgggcagaagctgtcgcagatggcgctggcctgggtgttgcgcgaagagaaagtcacctcggtgctgatcggcgccagcaaaaccgcgcaactggatgatgccgtcggcatgctgcagaatcgccatttcaccaccgaggagtgcgcggccatcgacgccatccttgcgctgtaa

SEQ ID NO: 5371 - DNA, 312 bp, Klebsiella pneumoniae
cggagccgtaacggaatgacaaaatttgctttagtaggagatgtcggggggaccaacgcccgcctggcgctatgtgatctggcgagtggagagatctctcgcgcaaagacctattccgggctcgattaccccagtctggaggcagtggtgcgcgtctatctcgaggagcaccaggtaacggtcaacgaaggttgtatcgccatcgcatgcccgattaccggcgactgggtggcgatgaccaaccatacctgggctttctctatcgccgaaatgaagcgtaacctcggctttgcccatctgggagataattaa

SEQ ID NO: 5372 - DNA, 870 bp, Klebsiella pneumoniae
acatcgttcaacgtgctgttacaatcgctcacatctttacgggcggaagcgttgtctttccgtcatggatggcaactcgcgatagccataaaaaccagggagacatctatgaattatcgcctgtcggcgcttgcgcttggcgccacattgctggtgggatgtgccagttccagctctggcgatcggccgcaggggcgctcagacccgttagaagggtttaaccgcacgatgtttaacttcaactttaacgtggttgatccttacgtgcttcgccccgtcgcggtggcatggcgcgactacgtcccacagccggcgcgcaacgggttaagcaattttaccagtaacctggaagagccggcagtgatggtgaactacttcctgcagggcgacccctataaaggtatggtgcattttacccgcttcttcctgaacaccattctcggtatgggtgggcttatcgatgtggccgggatggcgaatccgcagctacagcgggttgagccacatcgtttcggcagtacgcttgggcattatggcgttggctatggcccgtatgttcagttgccgttctatggaagctttaccctgcgcgacgaaggcggcgatatggccgatggcttgtatccggtgctctcctggctgacctggccaatgtcgatcggtaaatgggcggtggaagggattgagacacgtgctcagctgctggattccgacggcctgctgcgccagtcttccgacccttacattctgatgcgtgaagcctacttccagcgtcatgactttatcgccaacggcggtaagctgaccccggcggacaacccgaatgctcaggctattcaggatgagctgaaggatatcgattcacagtga

SEQ ID NO: 5373 - DNA, 213 bp, Klebsiella pneumoniae
ccttttgtcaactttaacaaaagttttcataacattaatttacattggaatcttttcattaacattaaatgcccttttctgcgtaataaccttgcatactgttcggttttagtgttgttgaatcgtgtccgtttccgtcgtaaatcaaaaatcccttctattttgacaggatttagcctcgattcctccccccaaagaggggtattttcttga

SEQ ID NO: 5374 - DNA, 690 bp, Klebsiella pneumoniae
aagcgaggcaataagatggattatacgctcacccgcatagatcctaacggtgagaacgaccgttaccccctgcagaaacaggagatcgttaccgatcctctggagcaggaagtcaataaaagcgtgtatatggggaaactcgaacacgcgctgcatgacatggtgaactggggccgtaagaactcaatttggccgtacaacttcggcctttcttgctgttatgtggaaatggtgacgtcattcactgcggtgcatgacgttgcgcgttttggggcagaagttctgcgcgcctctccgcgtcaggcggacctgatggtggtcgcgggaacctgctttaccaaaatggcgccggttattcagcgtctctacgatcagatgctggagccgaagtgggtgatctccatgggcgcctgcgccaactcaggcgggatgtacgacatctattccgtcgtccagggcgtggataaattcattccggtcgatgtgtacatcccgggctgcccgccgcgtccggaggcctatatgcaggcgctgatgctgctgcaggagtccattggtaaagaacgtcgtccgctctcatgggtggttggcgatcagggcgtttatcgcgccaatatgcagtcggaacgcgagcgtaaacgcggcgaacgtattgcagtgaccaatctgcggacgccggacgagatttaa

SEQ ID NO: 5375 - DNA, 1134 bp, Klebsiella pneumoniae
agactaaaaaaacaacacgccaacataacgaaaaagattggagccgtgatggcaggaaatacaattggacaactctttcgcgtcactaccttcggcgaatcgcacggtctggcgctgggctgcatcgttgacggcgtgccgccgggcatcccgctgaccgaagccgacctgcagcacgacctcgatcgtcgtcgcccgggtacctcgcgttacaccacgcagcgtcgcgagccggatcaggtcaaaatcctctccggcgtcttcgaaggcgttaccaccgggaccagtatcggtctgctgattgagaacaccgatcagcgttcgcaggattacggcgcgatcaaagatctgttccgtccgggccatgccgattacacctacgagcaaaagtatggtctgcgcgactatcgcggcggcggtcgttcttctgcgcgcgaaaccgcgatgcgcgtagcggccggggcgattgccaaaaaataccttgccgcgaagttcggcatcgtcattcgcggctgcctgacgcagatgggcgatattccgctggccatcaaagactgggatcaggttgagcagaaccccttcttctgtccggacccggataaaatcgacgccctggatgaactgatgcgcggcctgaaaaaagagggcgactccattggcgcgaaagtgacggtggtggctgacggcgtaccgccaggcctcggtgagccggtcttcgaccgcctggatgccgatatcgcccacgcgctgatgagcatcaacgccgtgaaaggggtggaaattggcgacggcttcgaggtggtgaagctgcgcggcagcgaaaaccgcgatgagatcactaaagccgggttccagagcaaccacgccggcggcattcttggcggcatcagcagcggccagcagatcgttgccaacatcgcgctgaagcctacctccagtattaccgttcccggtcatacgattaatcgctttggcgaagaagtggagatgatcaccaaagggcgtcacgatccgtgcgtcggcatccgcgccgtaccgatcgctgaggcgatgctggcgatcgttctgatggatcactttatgcgtcagcgcgcgcagaatggcgacgtgacgacgacaattccacgctggtaa

SEQ ID NO: 5376 - DNA, 576 bp, Klebsiella pneumoniae
cagaacgtgaaacgactgattattggcatttccggcgccagcggcgccatttacggcgtgcggatgctgcaggtgctaagagatgtgccggatattgaaacacatctcatcctcagccaggcggcgcgccagacgttggccatggagaccgactactccgtacgtgaggtgcaggcgctagccgatgtggtgcatgacgcccgcgatatcgccgccagtatctcttccggttcgtttaaaaccgccgggatggtgattttaccctgctcaatgaagacgctctcgggcattgtccatagctatacggatggcctgctgacccgggcggcggatgtcgtgctgaaagagcgtcgtccgctggtgctctgcgtgcgggaaacgccgttccatttgggccatctgcgtctgctggttcaggctgcagagctgggggcggtgataatgccgccggtaccggctttttaccaccggccacaaagcctggacgatgtcatcaaccagaccgtcaatcgggtactcgatcaatttgatattagtctggagcacgacttgtttacccgctggcagggggcctag

SEQ ID NO: 5377 - DNA, 219 bp, Klebsiella pneumoniae
acgggttcgaaatgggattgctattgcggcgctgtttatcgtgacgctcatcgttggcgctatcgtgaactatgtgataggccagctggtggagaagaccggtttgtcgggaaccgacagggtattggggatctgcttcggcgcgctacgtggggtgctgatcatcgccgctatcctgttcttcctggacacctttaccgggatggcgaagagcgatga

SEQ ID NO: 5378 - DNA, 201 bp, Klebsiella pneumoniae
acgtcatcgaagctgttgctgttcaccggaatacgcgatggatctaacgatggcgcggcggcatcgcccgcccgcacctcttccgccgccccttccggcggttgcgaaggcaacgcctgggttgccgccggcaacatatccggttcatcgcgatcgcccggtttcggtaccagcgggatcgcggcaaactcatcctggtaa

SEQ ID NO: 5379 - DNA, 1476 bp, Klebsiella pneumoniae
ggtgccgagaaccacgttgtcttccagctgctcacgcgcgaccgcttcggtcatgcctttgttcttacgcagttcgaccaggcgacccacatagctttcgcgaaccacttccggatcgacgatttcaatgccggcgccaagctcaacgccctgggccgcggctacgcggttgatctcatccgggttacccagcaggacgcaggtggcgatcccgcgttcggcgcaaatcgccgccgctttcacggtacgcggttcgtcgccttccggcagaacgacacgtttgccggctttgcgcgccagctcggtcagctggtagcggaaggctggcggagagagacggcggctgcgctcggaggtcgcggtcagcgattcgatccagtcggcgttgatgtagttggccacgtattcctgaactttctcgatacgctcgtgatcgtcaaccggtacttcgaggttaaagctctgcaggctcagggaggtctgccaggtgttggtgttgaccatgaataccggcaggccggtcgcgaaagcgcgttcacacagcttgctgatgcgcgcgtccatttcatagccgccggtcagcagaatggcgccgatttccacgccgttcattgccgccaggcaggccgcaaccagcacgtcaggacggtctgcggaggtaaccagcagagaaccagggcggaagtgttccagcatgtgcgggatgctgcgcgcgcagaaagtcacggatttcacgcggcgggtattgatatcgccttcgttgatgatggtcgcattcagatggtgcgccatgtcgatcgcgcgggtcgcgatcagatcgaagctccatggcactgcgcccagcaccggcagcgtgctgcctttctgcagctgagccgggtcaatcttcacgatttttgctttcgacgagtcgtcgaaaatttccgacaggtcaggacgggtacggccctgatcgtcgacaggggcattcagtttgttgacgataacgccggtgatgctggtatttttggcgccgccaaagctgttacgggtcagttcgatacgctcgttcagctgttctggcgtgtcggtgccctgagacatcacgaagacgatttcagcgttcagcgttttggcgatttcaaagttcagcgcctgggcgaactgatgcttacgggtcggtaccaggccttccaccagcaccacttccgcgtcctgagtattcgcgtggtagttggcaatgatctcttccatcagcacatctttctgattgctggagagcagagactcaacatggctcatcttcagcggttcagcggcggtggtggtggaggagctggcgcgaacgatggtggtggtctggtctggggcatcgccaccggaacgcggctgggcgataggtttaaagacgctcagacgaacgcctttgcgttccatagcgcggatcacaccgaggctgacgctggtcagacctacgctggtaccggtaggaattaa

SEQ ID NO: 5380 - DNA, 720 bp, Klebsiella pneumoniae
cctgtgattgaaattattcaggagtactggaaatcactactgtggaccgacggctatcgctttaccggcgtggcgattaccttatggttgctgatctcttcagtggtaatggggggcatcctggcggtgtttctggccatcggccgcgtctcgagcaataagtttatccagttccccatctggctgttcacttacatatttcgcggcacgccgctgtatgtgcaactgctggttttttactccggcatgtataccctggaaatcgtcaaaggcacggagctgttgaacgcttttttccgcagcgggctaaactgcacggtactggcgttaaccctgaatacttgcgcctataccactgaaattttcgccggcgcgatccgctcagtacccgccggagaaattgaagcagcgcgggcctacggcttctcgtcagtcaaactgtatcgctgcattattctgccttccgcgctgcggattgcgctaccggcctacagtaacgaagtgatcctcatgctgcactctaccgcgctggcgtttaccgctacggtaccggatctgctgaaaatcgcccgcgatatcaactcggccacctatcagccgttcaccgcgtttggcatcgccgcggtgctttatttaattatctcgtatgtgctgattagcttgttccgtaaagcggaaaagcgctggttgcagcatatcaaaccttcttcgacgcattga

SEQ ID NO: 5381 - DNA, 234 bp, Klebsiella pneumoniae
tatgccgttgatttatactgtaatagatatccaaagtttaatcagtgcggcattaatttttacgacgtttctttattatccaatgcggatgattatcagtccgcgctacgcgcgacgtttctggcagcaggaatgtttaccgtggctggcaccgcaatatcgctcctttaccctatattggtttatcgcgttggcggtgatattaacgctattgtgtgcgccgtatcagtctga

SEQ ID NO: 5382 - DNA, 1527 bp, Klebsiella pneumoniae
cgcacagttgaggggcgaaaaaaagcccgccgtcctttcggtacggcaggcccgcgacgcgtgaacggcttaaccctcgttgtgcatctcgaggttttcgacttcgttctgcagctggaccgctttggcatcatcgttacgcagggagtcaagatagtcgaggtactgctggtcgacatcccgggtcacatatacgccgttgaacaccgagcattcaaactgctgaatatccgggttctccgcgcgcaccgcgtcgatcagatcgttgagatcctggaaaatcaggccgtcggcgccaatgatctggcggatctcatccacttcgcggccatgggcgatcagttcgttggcggtcggcatatcgataccgtacacgttcgggaaacgaatttccggcgcagcggaggcgagatacacttttttcgcccctgcttcacgcgccatctcaatgatctgctccgaggtggtgccgcgtacaatggaatcatcgaccagcagcacgttcttatcgcggaattccgcacggttggcgttgagcttacggcgaacagatttacgacgcagctgctgaccgggcatgataaacgtccggccgacgtagcggttcttcacgaagccctgacgataaggtttgtcgagaatgcgggcgatttccagcgcgatgtcgcaggaggtctccgggatcggaataacaacgtcaatatccagatcttcccactcgcgagcaatcttttcgcccagcttagtccccatgttgacgcgggcgctgtagacggaaattttgtcaataaacgagtccggacgggcaaaatagacgtactcgaacaggcacgggttgctgaccggattatcggcacactgacgggtatagagctggcccttctcggtaatatagaccgcttcgcccggcgcgacatcgcgcaggaattcaaaaccaagcgtatcaagggccacgctctccgaggccaccatatactcggtgcgaccgtcgccaacgtcacgtttacccagcaccagcggacgaatgccgttagggtcgcggaaggccaccatgccatgcccgatgatcatcgccacgcacgcgtacgcgccgcgaatcaggcggttggtcgccgcaatcgccgcgaagatgttgtccgcttccagcgggtagtgacggaagttatccagctcactggcgaaaatattgaggaggatttcggaatcagaggtggtattgatatggcggcgtttttcttcaaacagctttttacgcagctcgtgcgcattggtcaggttgccgttatgcgccaatgtgatgccatacggcgagttaacgtaaaacggctgcgcctcggaggcgctggagctgcccgccgtaggataacgcacgtggccaatacccatattgccctgcatacgctgcatgtggcgggcctcgaatacgtcgcttaccagcccgttagccttacgcaaccggaagcagttgttggcatcaatggtgatgatgccagcggcatcctgtccacggtgctggagcaccgttag

SEQ ID NO: 5383 - DNA, 291 bp, Klebsiella pneumoniae
cacctgagcgaggaattcatattatgccgcccgtcaacacgacacgctttacgttacggggctatagctcagctgggagagcgcttgcatggcatgcaagaggtcagcggttcgatcccgcttagctccaccaaattctgcacccagcggatttggttcgtaaagaagtcctgtggggctatagctcagctgggagagcgcttgcatggcatgcaagaggtcagcggttcgatcccgcttagctccaccaaaattcagaaccctcgcttcggcgggggtttttgtttttag

SEQ ID NO: 5384 - DNA, 705 bp, Klebsiella pneumoniae
acgcggggagaatcggtggcgagtaagtttcagaaccgtttagtcgggacaatcgtgctggtggcgctgggggtgattatcctgccagggctgctggacgggcagaaaaagcattaccaggatgagtttgccgcgatcccgctggtaccgaaaccgggcgatcgcgatgaaccggatatgttgccggcggcaacccaggcgttgccttcgcaaccgccggaaggggcggcggaagaggtgcgggcgggcgatgccgccgcgccatcgttagatccatcgcgtattccggtgaacagcaacagcttcgatgacgttcaggagccggtggtggccgcgaaaccgcagcccaagccgcagccgaaaccgcagccgcaacagcaggcctcgacgccaacgccgccgccggctaagccacagcagcaacagccaccgcagcagcaggcggccctgccggcgccgaccggcaaagcctatgtggttcagctgggcgcgttgaagaacgccgataaggtgaatgagattgtcggtaaactgcgggcctcgggtttcaaagtctatacgtcgccttcgacgccggtacagggtaaaattacccgcatcctcgtcggcccggatgcgtcaaaagacaagctgaaaggccagctgggcgatctgcagcaaatctccgggcttagcggggtggtgatgggcttcaccccgaactga

SEQ ID NO: 5385 - DNA, 939 bp, Klebsiella pneumoniae
tgcctattggaatttcttataggtgggccgatgcttctgcgccaactttcctactttatcgttgtggctgaacattgtggcttttcccgcgccgccgcggcgctgcatgtctcccagcctgcgctgtcacagcagatacgccagctggaagcgatgctggaggttcagcttttcgaccgctctggccgacgtattcgcctgaccgatgccggtgagatctggctggagtatgcccgtcgcgcgttacgcgagcttgaggaaggtcggcgcgccttgcatgacgcagaagatctccagcacggtaaactccgcattgctatgacgccaactttcactacctatatgctgggcccgctgatggaggcgtactaccgacgctatcctggagtaaaagtgcttatccaggagatgaaccaggagcggatggaggcgatgctgctggaggatgaactggatgtggggattgcctttgacgattgccggtcacaggaaattgtggttcagccgctactgacggaaacgcttgcgctggtggtgagccgtgcgcatccgctggcaggagagcgcgacttgcaactgcaggctctcgacgcccagccgctaattttactgagcagcgagtttgctacccgcgagcagattgatcgttattgccgccttcatcggctcgaaccagacgtgcggatggaggccaactccatcggggccgttctgtcggttattcgaagcacaacgttagcaacgctgctgccggcggcgatcgccgggcagtttgatgatgtggtggcgattgagctaagacctgcgctgctgcagcgcacggcctgtttattgcagcggcagggcgcctggcagagcgccgcagcgcgcgaattcatcaccctggcccgagagaacgcgataacgattgagcaggaaaaccgccagtcccttgcctga

SEQ ID NO: 5386 - DNA, 582 bp, Klebsiella pneumoniae
ttcactacggaaaacgcatataaaagaaggcgcatgatttatgcgccttctttatttcacgccctaccgtgctacaggagtcacaacatggaaatgaccaatgcgcagcgtctgattttatccaatcagtacaaaatgatgacgatgctcgacccggataatgcggaacgctaccgtcgtctgcaaaccatcatagagcgagggtatgggctacagatgcgtgaactggaccgcgagttcggccagctgacggaagaaacctgccgtaccgttattgatatcatggagatgtaccacgcgctgcacgtctcctggaccaacctgaaagacgcggcgggtatcgatgaacgccgggtcaccttcctcgggtttgatgccgccaccgaagcgcgttatctcggctatgtgcgttttatggtcaacgttgaaggccgctacagccattttgacgccggtacccatggctttaactcgcagaccccgatgtgggagaaatatcagcggatgctgagcgtctggcacgcttgcccgcgccagtatcatctgagcagtaatgaaattaatcaaattatcaacgcctga

SEQ ID NO: 5387 - DNA, 1359 bp, Klebsiella pneumoniae
cctgtaaaggacgcgccggatatcagatgtcaccttaactttatcgtttcagcaccatttgcatcgacggtctccgctgacgaaggcaaagtagtgctccagcacttttacaaggacatttccatgctccatcctcgcgccagaacaatgctgatcctgtcggtgccggccatcctgataggtatcgcctgcagcctgatcctgatcgtggcgatgaaggttgccgcgctgctgcagcgcgtgctgtggagcaatctgcccgcgcagttgggggtgagcgccgacagcccgctgtggatcatcgccatgctgacggcgacagggatcgcggtgggtctggtcattcgttacagccccgggcacgccgggccggatccagcgaccgagtcgttaatcggcgctcccattgccaccggcgcgctgcccggactcctcgccgcgctgatcctcggcctcgccggcggcgtcagcctcggcccggagcatccgattatggtggtgaatatcgcgctggctgtcgccgtcggctcccgactgtttccgcgcgtcagctcgctggactggaccatcctcgcggcctcaggcaccatcggcgccctcttcggtaccccggttgccgccgcgctgattttttcgcaaaccctcaatagcagcaacgatacgccactgtgggatcgcctctttgctcccctcctcgccgccgccgccggcgcgttgacgacgggtctgtttttccatccccatttttcgctgccgatcccgcactatggtcagatgcgcttcgttgatattctcagcggcattatcgtcgccctgatcgctatcgccgtcggcatggtggccgtctggtgtctgccgcgactgcatgccctgatgcatcggttgaaaaatccaatcctgaccctcggcatcggcgggctgctgctggggatcgtggggacgataggcgggcccttaacgctctttaaagggctggatgagatgcagcagctggccttcagccagacgctaaccgccgcggattttttgcttatcgcgctggtcaaactggcagccctggttcttgcctcagccagcggctttcgcggcgggcgaattttcccggcggtgttcgtcggggtagcgctggggctgatgctgcatgctcatgttgacgcggtgccggcggcaatcaccgtttcctgcgcgatcctcggcatggtgctggtcgtcactcgcgacggctggttgagcctgtttatggccgccgtggtggtcccggatacgactctgctgccgctgttgtgtatggtgatgctcccggcctggctgctgctggccgggagaccgttgatgattgccaaacggcataccgattaa

SEQ ID NO: 5388 - DNA, 561 bp, Klebsiella pneumoniae
ggtaggcttttctttctgcgtattgactgctttatgacgaccatcaccacaccacgcctttcgcttacccgctttgttaccgatgactggcccttttttctgcgcctgcgccaggatccacaggtgatgcgttttatgggggaggtgttaagcgaggaggcgctgcgcagcgtcttcgtcagtcgctgtgccgatcccggggtgtttgtattgcgcgataaattcggcgaggcgctgggcgatattgggctccgcatcagtccgaaaaatccgcacgaagctgacgtcggctacgcgctgctgcctcaggctcagggaaaaggctatgccagcgaagcgctgcgggcggtctgcgagtatggtttcaccaccctgggggtgcaggcaatcaatgcctgggtgctgggtgaaaaccgtggctcatcgcgcctgctggagaagcaaggctttgtgcgcacccaggtgctggagaaagcctatcatctgaacggcgtcgattacgatgactggatctatcggctggagcgggaagctcatccggcgtccgcagacgccggatga

SEQ ID NO: 5389 - DNA, 537 bp, Klebsiella pneumoniae
tatcgattttgttatgtcagacgtggaccgctaattatgcacgagaatcaacaaccacaaaccgaggcttttgagctgagtgcggcagagcgtgaggctattgagcacgagaagcaccactacgaagacccgcgtgcggcgtccatcgaagcgctgaaaatcgtacagaaacagcgcggctgggtgccggatggcgcgatctacgccatcgccgatgtgctggggatcccggccagcgacgtggaaggcgtggcgacgttctacagccagattttccgccagccggttggccgtcacgtgatccgctactgcgacagcgtggtatgccacatcaccggctatcagggtattcaggccgccattgagaagaaactgaatatcaagccggggcagaccacctttgatggccgctttaccctgctgccgacctgctgcctgggtaactgcgacaagggaccgaccatgatgattgatgaggatactcacagccatctgacgccggaggcaattcctgacctgctggagcagtacaaatga

SEQ ID NO: 5390 - DNA, 294 bp, Klebsiella pneumoniae
cggttgaaactcatcggaaaaatagtggctgttatcgacctgttcctgcagcaaacgcttaggagcaacctcggtaattttcttgcgctgcgggcggtgaacaatagtgtcctgtttgatcttccgcgtgccggtcatcagctgacggaacagcgcctgatcctcctcgctaagcgatgtcttctttttcattgtccgctctcattcatactttgcgctagtttacccgactcaatatcccttcgggcaaggaaaacctgttttttcccccgccccttatcgcaagaatgctga

SEQ ID NO: 5391 - DNA, 1071 bp, Klebsiella pneumoniae
tttacccgactcaatatcccttcgggcaaggaaaacctgttttttcccccgccccttatcgcaagaatgctgatttatcgccgtcttcatggcacactagccgccgaatttatagcagagtgtgccctggaggatgtcgtggataaaatttttgttgatgaggcagtcaatgagctgcataccattcaggacatgctgcgctgggcggtaagccgtttcagcgctgctaatatctggtacggtcacgggactgataacccgtgggacgaggcggtacagctggtgctgccttcactgtatctgccgctggatataccggaagacatgcgcactgcgcgcctgacctccagcgagaaacaccgcattgtagagcgggtgattcgccgcgtgaacgaacgtattcccgtcgcctatctgaccaacaaagcgtggttctgcgggcatgagttttacgttgatgagcgtgtgctggtgccgcgctccccgattggcgaactgatcaataaccagtttgccggactgattaaccataagccgcagcacatccttgatatgtgcaccggtagcggctgcattgccatcgcctgcgcctatgccttcccggaagcggaagtcgatgcggtagatatctccccggacgcgctggccgtcgccgagcacaacgttgagtcccacggcctgatccatcacgttacgccgatccgttccgatctgttccgcgatctgccgaagctgcagtacgatctgatcgtcaccaatccgccgtatgtcgatgaagaggacatggccgatctgccggaagagtatgagcatgagccggtgctggggctggcctccggaagcgacggcctgaagctaacgcgccgtatcctcggcaacgcgccggattatctcagcgacgacgggattctgatttgtgaagtcggtaacagcatggtacatctgatggagcagtatccggatgtgccgtttacctggcttgagtttgataacggcggcgacggggtctttatgctgaccaaacagcagctgattgacgcccgtgcgcacttcggtatttataaagactaa

SEQ ID NO: 5392 - DNA, 216 bp, Klebsiella pneumoniae
cttgccgactgcctggggctggccagacaaacgatcaattgctgggttcccgagaaacaaggcggcaccgaagcattacccggcgttaagagggggcgaacccccactggtggttatggaccaacccgtaccgcgagttttgaccaacaatccttgccgaagccatttgtttaccgacaattattttcccggaatccccggggcataccctggtaa

SEQ ID NO: 5393 - DNA, 687 bp, Klebsiella pneumoniae
gacaggctatgttggattattgtcctgtctaccacccttgaggaagctatgagccagcctgtcattaccctgtggtccgatgccgattttttctcaccgtacgtgatgtctgtctatgtcgctctgcaggaaaaaagcctgccttttacccttaaaaccgtcgacctgaaccgcggcgaacatctgcaggcgggctggacaggctatgccgccacccgtcgcgtaccgctgctggaggttgatgatttcgcgctaagtgagtcttcggcgattaccgagtatctggatgagcgtttcgcgccgccggagtgggagcgcatctacccgcatgatctgcaaaaacgagcccgcgcccggcagatccaggcctggctgcgcagcgatctgatgccaattcgtgaagagcgatccaccgccgtggtgtttggcggggcgaaaatgccggacctcagcgaggccggcaggcaatctgcggaaaagctgtttgccaccgccaccatgctactggcccacggcgggcaaaatttatttggcgaatggtctattgccgacgcagacctggcgctgatgctcaatcgcctggttctcaatggcgataaggtaccggaggcgctggctgattatgcgtctttccagtggcagcgggcctcaatccagcgttacgtggcgctttccgccaaacgctga

SEQ ID NO: 5394 - DNA, 501 bp, Klebsiella pneumoniae
caaaagcggtgcaatatgcaagtttttattatgcgtcacggcgacgctgccctcgatgcagccagtgactcggttcgtccattaaccgtatgcggttgtgatgagtctcgtcagatggcaacctggctgaaaggtcaaaaagtggatattgagcgcgttcttgtcagtccctatctgcgtgcggaacagacgctggatattgttggggagtgcatgaacctgccgaaacatgtcgacgtgatgccggagctcacgccgtgcggtgatgtgggaatggtgagcgcctatctgcaggcgctggcgaatgaaggcgtggcgacggcgctggttgtctcccacctgccgctggtggggtatctggtctcagagctgtgtccgggggaaacgcccccgatgttcaccacctcggctatcgcctgcgtgacgctggatgccgacggcaaaggtgagttcctctggcagaaaagcccctgcaacctcaagatggccaacgccatctga

SEQ ID NO: 5395 - DNA, 360 bp, Klebsiella pneumoniae
aatagtatgctcaaggaacgaatgacacctgaagaaattgcccatctaaccggctacagtcggcaaactatcaataagtgggtgcggaaagaaggctggcaaacctctccgcgacctggcgttcagggcggcaaaacgcgcctggtccatgtcaatgagcaagtcagggagtttatccgcagcgcccagcgcgtggcggagacgcccggcatctattctccccatgatagcgatctggaatcgctgctgctgaccctcaataaagaactcacccccagcgagcagaagcagcttatgtctttgctgctgcgcgaggggatcaccgggttactgcttcggttagggatccgcgatcggtga

SEQ ID NO: 5396 - DNA, 534 bp, Klebsiella pneumoniae
aatgcgccccgaactggacgacagggcgtaaatcgtgggacgtatatggtctggattgattacgccattatggcggtgctgggtctttcttgcctggtcagcctgatccgcggctttgttcgcgaagctttatcgttagtcacgtggggttgcgcgttttatgtcgccagccattactacgctgacctgtctgtctggtttacgggctttgaggatgaacgggttcgaaatgggattgctattgcggcgctgtttatcgtgacgctcatcgttggcgctatcgtgaactatgtgataggccagctggtggagaagaccggtttgtcgggaaccgacagggtattggggatctgcttcggcgcgctacgtggggtgctgatcatcgccgctatcctgttcttcctggacacctttaccgggatggcgaagagcgatgactggcatcagtcgcagtttattccctattttacccccgtcatcagatggttttttgaatacctgcaaagctcgtcaagtttcttgcctaaagtatag

SEQ ID NO: 5397 - DNA, 2202 bp, Klebsiella pneumoniae
ctggcggtgctgttttgtatcccgcctgatactggcggtaacgaaagaggatataccgtgtcccgtactatcatgttaattcctaccggtaccagcgtaggtctgaccagcgtcagcctcggtgtgatccgcgctatggaacgcaaaggcgttcgtctgagcgtctttaaacctatcgcccagccgcgttccggtggcgatgccccagaccagaccaccaccatcgttcgcgccagctcctccaccaccaccgccgctgaaccgctgaagatgagccatgttgagtctctgctctccagcaatcagaaagatgtgctgatggaagagatcattgccaactaccacgcgaatactcaggacgcggaagtggtgctggtggaaggcctggtaccgacccgtaagcatcagttcgcccaggcgctgaactttgaaatcgccaaaacgctgaacgctgaaatcgtcttcgtgatgtctcagggcaccgacacgccagaacagctgaacgagcgtatcgaactgacccgtaacagctttggcggcgccaaaaataccagcatcaccggcgttatcgtcaacaaactgaatgcccctgtcgacgatcagggccgtacccgtcctgacctgtcggaaattttcgacgactcgtcgaaagcaaaaatcgtgaagattgacccggctcagctgcagaaaggcagcacgctgccggtgctgggcgcagtgccatggagcttcgatctgatcgcgacccgcgcgatcgacatggcgcaccatctgaatgcgaccatcatcaacgaaggcgatatcaatacccgccgcgtgaaatccgtgactttctgcgcgcgcagcatcccgcacatgctggaacacttccgccctggttctctgctggttacctccgcagaccgtcctgacgtgctggttgcggcctgcctggcggcaatgaacggcgtggaaatcggcgccattctgctgaccggcggctatgaaatggacgcgcgcatcagcaagctgtgtgaacgcgctttcgcgaccggcctgccggtattcatggtcaacaccaacacctggcagacctccctgagcctgcagagctttaacctcgaagtaccggttgacgatcacgagcgtatcgagaaagttcaggaatacgtggccaactacatcaacgccgactggatcgaatcgctgaccgcgacctccgagcgcagccgccgtctctctccgccagccttccgctaccagctgaccgagctggcgcgcaaagccggcaaacgtgtcgttctgccggaaggcgacgaaccgcgtaccgtgaaagcggcggcgatttgcgccgaacgcgggatcgccacctgcgtcctgctgggtaacccggatgagatcaaccgcgtagccgcggcccagggcgttgagcttggcgccggcattgaaatcgtcgatccggaagtggttcgcgaaagctatgtgggtcgcctggtcgaactgcgtaagaacaaaggcatgaccgaagcggtcgcgcgtgagcagctggaagacaacgtggttctcggcaccctaatgctggaacaggacgaagtcgacggtctggtatccggcgcggttcacaccactgccaacaccattcgtccgccgctgcagctgatcaaaaccgcgccgggcagctcgctggtctcctccgtgttcttcatgctgctgccggaacaggtttacgtttacggcgactgcgcgatcaacccggacccgacagccgagcagctggcggaaatcgctattcagtccgctgaatccgcgattgccttcggcatcgaaccgcgcgtagcgatgctctcctactccaccggtacctccggcgcgggtagcgatgtcgagaaagtccgcgaagcgacccgtctggcgcaggaaaaacgtcctgacctgatgatcgacggcccgctgcagtatgacgccgcggtgatggctgacgtagcgaagtccaaagcgccgaactcaccggtagctggccgcgcgaccgtgttcatcttcccggatctgaacaccggtaacaccacgtacaaagcggtacagcgctctgccgacctgatctccatcgggccgatgctgcagggtatgcgcaagccggtcaacgacctgtcccgtggcgcgctggtagacgatatcgtctataccatcgcactgaccgcgatccaatcggctcagcagcagtaa

SEQ ID NO: 5398 - DNA, 1272 bp, Klebsiella pneumoniae
cggctcgaccgcgcccggcgcgtgcgcgcagaaggttttacccgggcccaggaatcgacacagttgctcaagggtttcgatatcgccaggctggccttcgccgcgctccagggcgcgcaggatcttcacgctccacggcagaccatcgcggcacggcgtacaccagccgcaggactcgcgggcaaagaactcttcaaggttacgcaccagcgagaccatgttgatctcgtggtcaacggccatcgccagcgaggtgcccagacggctgcccgctttaccaatgctttcgaattccatcggcagatcgaggtgcgcttcggtgaggaagtcggtccctgctccgcccggttgccaggctttaaacttcaggccatcgcgcataccgccggcgtaatcttcgaggatctcgcgggcagtggtgccgaacggcagctcccagacgcccggattcttcacccggccggagaagcccatcagcttggtgccagcatctttgctggtggaaatgttctggtaccactcgacgccgttggcgaggatcgctggcacgttgcacagggtttctacgttgttgacgcaggtcggcttgccccagacgccggagctcgccgggaacggcggcttggatcgagggttggcgcggcggccttccagagagttgatcagcgccgtctcttcgccgcagatatagcgccctgccccggtgtgcacgaacagctcgaagtcaaacccggtgccgaggatgtttttccccaacagacccgcttcggtggcttcagcaatcgcgcgacgcagatgctgggccgcttcaatatattccccgcgcaggaagatgtagccgcggtacgctttcagcgcaaacgcggagatcagcatgccttccaccagcaggtgcggcagctgctccatcagcaggcggtctttataggtgcccggctccatttcatcggcgttacacagcaggtaacggatgttcatggattcgtctttcggcatcaggctccacttcagaccagtggagaagcccgcgccgccgcgccctttcaggccagcgtcttttaccgccgtgacaatctcatccggggccatcccggtcagggctttacgcgccccttcatagccatttttactgcgatactcgtccagccacaccggctgcttgtcgtcgcgcaggcgccaggtgagcggatgcgtttccgcagtacgaattacggttttcatttgtactgctccagcaggtcaggaattgcctccggcgtcagatggctgtga

SEQ ID NO: 5399 - DNA, 1245 bp, Klebsiella pneumoniae
tacgggacacggtatatcctctttcgttaccgccagtatcaggcgggatacaaaacagcaccgccagctatccgtcatatttcaagttgcacgtgcgttggctctacttgctcaccccggtggcgtacgcgctgtacgcggccggggttttgctgtgtcgccgccttcctgcagctcgaattattgcgggtcagggctggcgatgtggaattatgcggtcagacggctggcgtcttgcgcgatgaccagctcttcgttggtcgggataaccacggcaggacgggtgccttctttgttgatgaagccagacttgccgaagcgggcagcaaggttacgctcatggtcaacttcaaagcccagtacgcccagtttgcccagcgacagctcacgcaccatcgcggcgttttcaccgataccaccggtgaaaataacggcgtcaagacggccgtccatcagcgcggtgtaggaaccgatgtatttcgccaggcggtggcagtaaacgtccatcgcgcgtttagcgtcggctttttcctgatagttgtcttccacgtagcggcagtcgctggtgacttcggtcagacccagcaggccggactctttggtcagcattttgttgatcgcgtcaacgctcatgcccagggtgtcgtgcagatggaagatgatggccggatcgatgtcaccggagcgggtacccatcaccaggccttccagcggggtcagacccatggaggtgtcaacgcatttaccgttacggatagcggaaacagaaccaccgttgccgaggtggcaggtgatgatgttcagctcttccaccggcttgttgaggatcttagcggcttcctgagtcacgtagaagtggctggtgccgtgcgcgccgtaacgacgaacgccgtgctctttgtacaggctgtacggcagggcgtagagataggattcttccggcatggtctgatggaacgccgtatcgaatacagccacgtttttgtctttcaggtgcgggaaggatttcagcgcttcagcgatgccgatcaggtgtgccgggttgtgcagcggtgcgaaagacgcggcgtctttaataccctgaattacggactcgtcgatcaccacggagctggtgtatttttcaccgccgtgtacgatacggtggccgattgcggtcagctgagcagacagttctggtttttgtgccagaatagtgttaacgataaagttcagcgcttcactgtgcgcggcgcccgcgcctaa

SEQ ID NO: 5400 - DNA, 597 bp, Klebsiella pneumoniae
gccaatcgacgtcaagagcctgttaccgtaaggagaggggcaatggaattcgctttttatatctgtggcctgatagccatcctcgcaaccttgcgggtcgtcacccacaccaatccggtgcatgcgctgctgtacctgattatttcgctgctggcgattgccggggtgttcttctcgctgggcgcgtacttcgccggagcgctggaaatcatcgtctacgccggggccattatggtgctgttcgtcttcgtggtgatgatgctcaacctgggcggcaccgagatcgaacaggagcgcaagtggctgcagccggggatctggattggcccggccatcctctccgcggtgctgctggtggttatcgtttacgccatcctgggcattaacgaccagggtatcgacggtgcggcgattaacgccaaagaagtgggcattgcgctgtttgggccgtacgtcctggcggtggagctggcctccatgctgctgctggcgggcctggtggttgccttccacattggccgcgaagagcgcgccggcgaggagctgagcaaccgtctgaacgacagcgacaaacgaaaaacggaggaacacgcatga

SEQ ID NO: 5401 - DNA, 708 bp, Klebsiella pneumoniae
atgacagacagggtaggcagcatgctgtatgggttttcacaggttattttgcagggtgcgctcgtcaccctggagcttgcgctcagctcggtcgttctcgccgtcctgatagggctggcgggcgctggcgcaaagttatcgagcaatcgtccactggcgctggtgtttgaaggctataccactctgatccgcggcgtgcccgatctggtgctgatgctgctgattttctacggcctgcagattgcgctaaacagcgttaccgacgcgctgggcatggcccagtttgatatcgatccgatgatcgccgggattattacccttggctttatctatggcgcctattttacggaaaccttccgcggcgcctacctggcggtgccgaaggggcatatcgaagcggctaccgcctttggctttagcggcgggcagacgttccggcgtattctcttcccggcgatgatgcgctacgcgctgccggggataggcaacaactggcaggttatcctcaaggcgacggcgctggtctcgttgctggggctggaggatgtggtcaaagccacgcagctggccgggaaaagcacctggcagccgttctacttcgccatcgtctgcggcctgatttatctggtgtttaccaccgtttctaatggcgtactgctgctgctcgaacgccgctataccgttggcgtgaagagggctgacctgtga

SEQ ID NO: 5402 - DNA, 198 bp, Klebsiella pneumoniae
caccgctgcagtctagatcatcagggcaaaagtaccggcccaaacgatgaccataaaagagaggcccataaagaagtatttcacgactcatcactccacgcgcttgtgcgacgttcaaatgaattaattgttctgtttttcaagggctgtcgccagtgtaacttcaccctgcagcagcccgtaattctgtgcgtttag

SEQ ID NO: 5403 - DNA, 1533 bp, Klebsiella pneumoniae
acgaggaaaagacgtatgtgcggtattgtcggtatcgccggtgttatgccggttaaccagtcgatttatgatgcgctaacggtgctccagcaccgtggacaggatgccgctggcatcatcaccattgatgccaacaactgcttccggttgcgtaaggctaacgggctggtaagcgacgtattcgaggcccgccacatgcagcgtatgcagggcaatatgggtattggccacgtgcgttatcctacggcgggcagctccagcgcctccgaggcgcagccgttttacgttaactcgccgtatggcatcacattggcgcataacggcaacctgaccaatgcgcacgagctgcgtaaaaagctgtttgaagaaaaacgccgccatatcaataccacctctgattccgaaatcctcctcaatattttcgccagtgagctggataacttccgtcactacccgctggaagcggacaacatcttcgcggcgattgcggcgaccaaccgcctgattcgcggcgcgtacgcgtgcgtggcgatgatcatcgggcatggcatggtggccttccgcgaccctaacggcattcgtccgctggtgctgggtaaacgtgacgttggcgacggtcgcaccgagtatatggtggcctcggagagcgtggcccttgatacgcttggttttgaattcctgcgcgatgtcgcgccgggcgaagcggtctatattaccgagaagggccagctctatacccgtcagtgtgccgataatccggtcagcaacccgtgcctgttcgagtacgtctattttgcccgtccggactcgtttattgacaaaatttccgtctacagcgcccgcgtcaacatggggactaagctgggcgaaaagattgctcgcgagtgggaagatctggatattgacgttgttattccgatcccggagacctcctgcgacatcgcgctggaaatcgcccgcattctcgacaaaccttatcgtcagggcttcgtgaagaaccgctacgtcggccggacgtttatcatgcccggtcagcagctgcgtcgtaaatctgttcgccgtaagctcaacgccaaccgtgcggaattccgcgataagaacgtgctgctggtcgatgattccattgtacgcggcaccacctcggagcagatcattgagatggcgcgtgaagcaggggcgaaaaaagtgtatctcgcctccgctgcgccggaaattcgtttcccgaacgtgtacggtatcgatatgccgaccgccaacgaactgatcgcccatggccgcgaagtggatgagatccgccagatcattggcgccgacggcctgattttccaggatctcaacgatctgatcgacgcggtgcgcgcggagaacccggatattcagcagtttgaatgctcggtgttcaacggcgtatatgtgacccgggatgtcgaccagcagtacctcgactatcttgactccctgcgtaacgatgatgccaaagcggtccagctgcagaacgaagtcgaaaacctcgagatgcacaacgagggttaa

SEQ ID NO: 5404 - DNA, 480 bp, Klebsiella pneumoniae
cgccaaagaagtgggcattgcgctgtttgggccgtacgtcctggcggtggagctggcctccatgctgctgctggcgggcctggtggttgccttccacattggccgcgaagagcgcgccggcgaggagctgagcaaccgtctgaacgacagcgacaaacgaaaaacggaggaacacgcatgatccccttaacacatggactgatcctcgcggccatcctgtttgtgcttggtctgacggggctggtgatccgccgcaatctgctgtttatgttgattagcctggaaatcatgattaacgccgccgcgctggcctttgtggtggcgggtagctactggggtcaggcagatggtcagataatgtatatcctcgccatcagcctcgcggctgcggaagcgagtatcggcctggcgctgctgctgcagctccatcgtcgccgccagaacctgaacatcgattcagtaagtgagttgcgtggatga

SEQ ID NO: 5405 - DNA, 915 bp, Klebsiella pneumoniae
ggcgatgctggcgatcgttctgatggatcactttatgcgtcagcgcgcgcagaatggcgacgtgacgacgacaattccacgctggtaaccatgaaaaacaccgttatcgcactgcttgcgctgttggccagcgccggtagcctggccgccacgccatggcagaaaataacccaaccgatcggcggcagcgcccagtcaatcggcgcgttttccaatggctgtatcgttggcgccgaggcgctccccctgagtgcccccggctatcaggtgatgcgtaccgatcagcgtcgctacttcggtcatccggatctggttcagtttattcagcgcctgagtaatcaggtgcacaataaaggaatgggaaccgtgctgattggcgacatggggatgccggcgggcgggcgctttaacggcgggcacgccagccaccagacgggcctcgatgtcgatatcttcctccagctgccgcaaacgcgctggacatcgtcccagctgttgaagccgcaggcgctggacctggtcgccagcgatggcaagcatgtggtgccgtcgctatggagcccgcaaatcagccagcttatcaagctggcggcggaagatagcgaagttacccgcatcttcgtcaacccggcgattaaacagcagctgtgcctggacgcgggcagcgaccgccagtggctgcgtaaagtccgtccctggttccagcatcgcgctcatatgcacgtccgactgcgttgcccggcgggaagtctggagtgcgaggatcaggcgccgccgccgcccggcgatggctgcggagcggagctgcagagctggttcgaaccacctaaacccgggtctaccccccctgtgaagaagacgccgccgccgctgccgccttcctgccaggcgctactggatgagcatgtgctgtaa

SEQ ID NO: 5406 - DNA, 477 bp, Klebsiella pneumoniae
gcagcggccggcaacggcggaagcgatgttaaaaattcagctttattaaccccctgctcgcccgtcgcgctttgttgtatgattgcaggacttacaccacggaggaagcctgcaatgtctcaaccagacgccattattcgtattaagaacctgcgcctgcggacttttattggtattaaagaggaagagatcgccaaccgccaggacgtggtagtgaatgtagctattcactaccctgccgataaagcgcgcgacagcgaggacatcaatgatgcgctgaactaccgcaccattaccaagcgtataatcagccatcttgagaatggccgtttttcgctgctggaaaaattaactcaggatgtgctgaatatcgcatgcgaacatcactgggtcacatatgctgaagtggagattgataaacttcatgcgctgcgctatgccgactcggtgtccatgaccatgagctggcgtcgctaa

SEQ ID NO: 5407 - DNA, 1245 bp, Klebsiella pneumoniae
aatgtgcacggaaatttaacctgcctcatatttggagcaactatggaccgcgtcttgcattttgtcctcgcgatcgttgtggtggctatactggccctgttggtcagccatgaccgccaaaagatccgtattcgttatgttgttcaactgcttgtcattgaagtcctgctggcctggttcttcctcaactccgatattggtctgggttttgtgaaaggattttccgagatgtttgaaaaactcctcgggtttgccaacgaagggacaaacttcgtgttcggcggcatgaacgataaaggcctggccttcttcttcctcaaagttttgtgccctatcgtcttcatttcggctttgatcggcattttgcagcatattcgtatcctgccgattgtcattcgcgcgatcggtaccgtcctgtcgaaagttaacggcatgggcaagctggagtccttcaacgccgtgagctcgttgatcctcggccagtcggaaaactttatcgcgtataaagatattctcggcaaaatgtcgcgcaaccgcatgtacaccatggcggcgacggcgatgtccaccgtgtccatgtccatcgtaggcgcttacatgaccatgctgcagccaaagtatgtcgttgcggcgctggtgctcaacatgttcagcacctttatcgttctgtcattaattaacccttaccgcgtggaagagagcgaagaaaatctgcagatgtcgaatctgcacgaaggtcagagcttcttcgagatgctgggcgagtatattctggcaggttttaaagtcgcgattatcgtggcggcgatgttgatcggcttcatcgcgctgatctcggcgctgaatgccctgttcgccaccgtgaccggttggttcggctatagcatttccttccagggtatcctcggctatatcttctacccggtcgcctgggtgatgggtgtgccggcaagcgaagcgctgcaggtgggcagtattatggctaccaaactggtctccaatgaattcgtcgccatgatggatctgcagaaaattgcctcgacgctctccccgcgcgcggaaggcattatctctatcttcctggtctccttcgccaacttctcatctatcggtattattgccggggcgatcaaaggtctgaacgaagaacagggcaacgtagtttctcgcttcggtctgaagctggtgtacggctccacgctggttagcgtgctgtccgcctcgattgcggcgctggttctgtaa

SEQ ID NO: 5408 - DNA, 1068 bp, Klebsiella pneumoniae
cgaaatcgcggggctcctattctaccggagcgacaaaaatctgacgttaccatttttgcgatttcagagtatgcccagccagacggcagggaaagccgctacgctataactatacagattgatagcgagggccacgaaatggatgaactagacaataacaaattaaaggcagaggatgacgaaagagaagtggaaagtgaggaaaatcagcgtggtgaagagatcgaagtaaatgaagatcgccttccctcgcgggcgatggcgatccatgaacatattcgccaggaaggggaaaaagagatggagcgcgatgcgctggccctgctatggtcagcgattgcggccggcctgtcgatgggggcctccctgctggcgaagggaatttttcacgtcaaactggaggggatcccgggcggttttttgctggaaaacctcggctacaccttcggctttattatcgtaattatggcccgccagcagctgttcactgaaaatacggtcaccgccgttctgccagtgatgcataatcccaccctcggtaacgtcggtttgctgatgcggctatggtcggtggtgctggcgggcaatctcatcggtaccgcggtggccgcatgggccttcaattatatgcctatttttgatgagccaacccgtcaggcctttgtcagcattgccgaagacgtaatgaaaaacagtccgacagagatgttcgctaatgcgattatttccggctggctggtcgccaccatggtctggatgtttcctgtcgccggcgccgccaaaatcgtggtgattattctcatgacctggcttatcgccctggcggataccacccatattgtggtgggctcggtcgagatcctttatctggtgtttaatggaaatctgccctggagcgactttatctggccgttcgccctgccgaccctggcgggaaatatctgtggcgggaccttcatcttcgcactgctgagccatgcgcagatccgtaacgatatgagcagcaagcgaaaagcggaagcccgcgcccaggcggcggagaaagggaaaaaggccgaccggacataa

SEQ ID NO: 5409 - DNA, 999 bp, Klebsiella pneumoniae
ttcactgcaggaggcgaaagcatgagctggttaacgccggatcttatcgacattctgttaagcatcctgaaggccgtggtcattctgctggtggttgtcacctgcggcgcgttcatgagcttcggcgagcgtcgtctgctcggcttgttccagaaccgctacggacctaaccgcgtcggctggggcggttcgctgcagctggtcgccgacatgatcaagatgttctttaaagaggactggatcccgcgcttctccgatcgcgtgatctttactctggcgccggttatcgcctttacctcgctgctgctggccttcgctatcgtgccggttagcccgacgtgggtggtggccgacctgaacatcggcatcctcttcttcctgatgatggcaggcctggcggtctacgcggtgctgttcgccggttggtcgagcaataacaaatactcgctgctgggggcgatgcgtgcttccgcgcagaccctgagctacgaggtatttctcggtctctccctgatgggcgtggtggcgcaggcggggtcattcaatatgaccgatatcgtcaacaaccaggcgcatctgtggaacgttatcccgcagttcttcggcttcgtgactttcgccatcgccggcgtggcggtgtgtcaccgtcacccgttcgaccagccggaagcggagcaggaactggccgatggttaccacattgaatattccggcatgaaattcggtctgttcttcgtcggggaatacatcggtatcgtcaccgtttcagcgctgatcgtcacgctgttcttcggcggctggaatggcccgtggttacctcctttcatctggttcgcgctgaaaaccgcgttcttcatgatgatgttcattttgatccgcgcatcattaccgcgtccgcgctatgaccaggtaatgtcctttggctggaaggtatgcctgccgttaacgctggtcaacttgttggtaacggcggctgtcattctctggcaggcgcaataa

SEQ ID NO: 5410 - DNA, 912 bp, Klebsiella pneumoniae
ccatgtcagggaggtggtatgaagatcctgcttactggtggtaccggcctgattggccgacatctgatacccagattgctggagctcgggcatagcgtcacggtctccacgcgacatccggataccgcccgcgcccgtctcgatccgcgcgtcaccctgtggcgcgatttcgagggccatcaccacctcaatgacattgatgccgtcatcaatctggcgggtgaacccatcgctgataaacgctggacggccgagcagaaacaacgcttgtgccatagccgctgggatctcacgcagcggctggtgggcctgatccacgccagcgacacccctccctccgtgctgatcagcgggtctgccatcggctactatggcgacctcggggaggtggtggtgaccgaagaagagccaccgcacaatgagtttacccataagctgtgcgcccgctgggagcaaattgcctgcgaagcgcaaagcgagcgcacccgcgtctgcctgctgcgcaccggcgtggtactggctccgcgtggcggtattctcggcaaaatgacacccgcctttaagctcggcctcggcgggcctatcggcaacggcagacagtacctggcctggatccatatcgacgatatggttaacggcattctgtggctgctggataacgatctgcgcggtccgttcaatatggtttctccctacccggtgcataacgagcagttcgcccatgcgctgggtcatgcgctccatcgaccggcgattttccgcgttcccgccgccgctatccgcctgttgatgggggaatccgccgtcctggtgctcggcggccagcgcgcgctgccaaagcgtctggaggccgccggcttcgccttccgctggtacgatctggacgaagcgctaaaggatgtgctgagttaa

SEQ ID NO: 5411 - DNA, 2754 bp, Klebsiella pneumoniae
aggttttttatttttggaagcacgcaaatggctacgattcatgtagacggcaaagaatacgaggtcaacggggcggacaacctgctagaggcttgtctctctcttggtcttgatattccctacttttgctggcacccggcgctagggagcgtcggtgcttgccgccagtgtgcggtgaagcaatatcagaacgcggaagacacgcgtggtcgcctggtgatgtcctgtatgactccggcatccgacggcacctttatttctatcgacgacagcgaagcgaagcagttccgcgaaagcgtggtggagtggttgatgactaaccacccgcacgactgcccggtctgcgaagagggcggcaactgccacctgcaggatatgacggtgatgaccggtcatagcttccgccgctatcgtttcaccaagcgtacccaccgcaatcaggatctggggccgtttatttcgcacgaaatgaaccgctgcatcgcctgctaccgctgcgtgcgctactacaaagattatgccgacggcaccgatctgggcgtctatggcgcgcacgacaacgtctacttcggccgcccgaaagatggcaccctggagagcgagttctccggcaacctggtggaagtctgcccaaccggcgtcttcaccgacaaaacccactctgagcgctataaccgtaagtgggacatgcagtttgcgccgagcatctgccagcagtgttccatcggctgtaacatcagcccgggcgaacgctatggcgagttgcgtcgtatcgaaaaccgctataacgggaccgtgaaccgctacttcctctgcgaccgcggtcgtttcggctatggctacgtgaacctgaaagaccgtccgcgtcagccggtacagcgccgcggcgacgatctgatcacccttaacgccgagcaggcgatgcagggggcggcggatatcctgcgccagtcgaagaaagtgatcggcatcggctccccgcgcgccagcattgaaagcaacttcgcgctgcgcgagctggtgggcgccgacaacttctataccggcatcgccaaaggcgaacaagcgcgcctgcagatgatgctgaaagtgctgcgcgagggcgggatccacacgccaagcctgcgcgatatcgaatcctacgatgcggtactggtgctgggcgaagacattacccagaccggcgcgcgcgtggccctggcggtacgccaggcagtgaaagggaaagcacgcgaaatggcggcggcgcagaaagtggccgactggcagatcgccgcgatcctcaacatcggccagcgcgccaagcacccgctattcgtcaccaacgtcgatgacacccgcctggatgacatcgcggcgtggacctaccgcgcgccggtagaagatcaggcgcgtctcggctttgctattgcccatgcgctggacgacagcgcgccggcggttgacggcctgagccaggacctgcagggtaaagtcgacgttatcgttcaggcgctggccggggcgaaaaaaccgctgatcatctccgggaccaacgccggcagcatggagatcatccaggccgccgctaacgtggcgaaagctctgaaaggccgcggcgccgatgtcggggtgaccatggtcgcccgggcggttaacagcgtcggactgggcatgatcggcggcggctcgcttgaagaggcgctggacgaactggaaagcggcgccgcagacgcggttatcgtgctggaaaacgaccttcaccgtcatgcttccgccgcgcgcgttgacgctgcgctggcgaaagcgccgctggtgatggtggtggatcatcagcgcaccgcgattatggacaaagcgcacctggtgctctccgcggcaagctttgcggaaagcgacggtaccgtggtgaacaacgaaggccgcgcccaacgtttcttccaggtttacgatccggcttactacgacgcgaaaaccgtaatgctggaaagctggcgctggctgcattcgctgcacagcaccgtcaacaaccgtcaggttgactggactcagctggaccacgtcattgatgcggcgattgcggcgctgccgcagctggcgggcattaaagacgccgcgccggatgcgaccttccgcatccgcggccagaagctggcgcgtgaaccgcaccgctacagcggccgcacggcgatgcgcgctaacatcagcgtgcacgagccgcgtcagccgcaggataaagacacgatgttcgccttctccatggaagggaacaaccagccgtccgccccgcgttcgcagatcccgttcgcctgggcgccgggctggaactccccgcaggcatggaacaagttccaggatgaagtgggcgggaaactgcgccacggcgatccgggcgttcgtctgtttgaagcgtccgccagcggactggagtacttcacggcggtgccggccagcttccaggcggaagagggcaaatggcgaattgcgccgtactaccatctgttcggcagcgatgagctgtctcagcgcgcgccggtgttccagagccggatgcctgagccgtacatcaagctgaacccggcggatgccgcgaagcttggcgtcaacccaggcgcaatgctctcctttagcgtggaaggccagaccctgcgtctgccgctggttatctctgaaggcctgaccgcgggacaggttggcttaccgatgggcatgccgggcattgcgccggtgctgaccggatcgcgtattgattcactgcaggaggcgaaagcatga

SEQ ID NO: 5412 - DNA, 279 bp, Klebsiella pneumoniae
tatattgttattacaggattttattgttccttttctgccggaaagttacgccagaagagcgattttctcagcatcactgaccgggttcccgcggcgacgtatggcgcctggctggtcgtggtaataaataataatgagaaatacgaacaatatattactccgcagttctgcgcatttgcccagacgagtactttggcatgtaataacgttcgtccagttgtttatccgccgtcagacggtgagcacgaggctcagggaatagccggaaacctggcgtaa

SEQ ID NO: 5413 - DNA, 219 bp, Klebsiella pneumoniae
attaatgttatgaaaacttttgttaaagttgacaaaaggttaaagaaaggggtaaaaagccacggcatctgggcttctcacatcgaccagggacgcttttttgcacggttattttttattcctcccgtgaaacgctgtggcgttcatctgccagtaagagcagagggttttggcgctacacttttttggttaagcaatgcgtatgtcaacatccactga

SEQ ID NO: 5414 - DNA, 792 bp, Klebsiella pneumoniae
gggtactgtatgaagaagacgattctggctctctctttactcgtgggaatgagcagcacggccagcgtgtttgctgctctgccgcagagcattcgcattggcactgacgcgacctatgcgccattttcgtcgaaagacgcgaaaggggactttgttggttttgatatcgatttaggcaatgagttgtgctcccgaattaaggtgaaatgtacctgggtcggcagtgattttgactccctgatcccctccctcaaagcgaagaaaatcgacgccatcatctcttccctctctattaccgagaagcgccagcaagagatcgccttctctgacaagctatatgccgctgactcgcgtctgatcgccgccaaagggtcgccgatccagccgacgctggaggcgctgaaaggcaagcacgtcggcgtgctgcagggttctactcaggaagcctatgctaacgaccgctggcgcagccagggcgttgacgtggtggcttaccagaaccaggatctgatctattcagacctcgcagctggccgtctggatgcggcgctgcaggatgaagtcgccgccagcgaaggcttcctgaaacagcctgccgggaaagatttcgccttcgccggcccgtccgttaaagacaaaaagtactttggcgacggcaccggtatcggcctgcgtaaggacgacgccgagctgaaagccgcgtttgataaagcgctgggcgagatgcgtaaagacggcacctacgacaaaatggcgaagaaatacttcgattttaacgtgtacggcgactaa

SEQ ID NO: 5415 - DNA, 450 bp, Klebsiella pneumoniae
gcaatgcgtatgtcaacatccactgaagtcatcgctcatcattgggcattcgctatatttctcatcatcgctatcggcctgtgctgcctcatgctcgtcggcggctggtaccttggcggtcgcgcgcgcgcgcgtagtaaaaacacgccgtttgaatcggggatcgactccgtcggttcggcccgcttacgtctttctgcgaagttttatctggttgccatgttcttcgttatcttcgacgtggaagccctgtatctctacgcatggtcgacctctatccgcgagagcggctgggtcggctttgtggaagccgcaattttcattttagtgctactggctggtctggtttatctcgttcgcatcggcgcactggactggacgcctgcgcgttcccgtcgcacgctggttaacccggaaacagacagtcccactaaccgtcatatgcagtaa

SEQ ID NO: 5416 - DNA, 945 bp, Klebsiella pneumoniae
atgattgtcattgatgcttttgctcaccatggcgatttattttttcatcgacatacaattcttatgaatattacagaacggaatatctggaagctaaataatttaccgccaatggagtattgctctctggcgcgggcgcaaaaattattaaactgcgaactggaagacattcttcactggcatgatattggcgcaatcaatctatgtcttaagcttaacccaacgccgggaatattaaaaatcgccgtcctctcccatcaggaaaaagaggtaaccagcgcgtttaatccatttacctcagtcgaggcaggagaaacagtctggtcgcaacactcccatatccgcagcattctgcggcttgaaggcgatattccgacgatggaaaccctgcgcggaaatacggtaacccagttcaacgtaaaggtatttgcttcagggctctggcatccacactgtcggaacctaatggcgctgctggaggcgccagatgatattcttttcgaaaaccgcctcagcatgatgctgccggataaaccatttgtttattgtcatttcattccagaggaagacgaacgcccctcgatatcattgaaccgcatctatatcaccagccaggccattgagaaaatatacgcccacagtattagcgcccggcctatggacgtgacgaaaaatccgctactggatcaaacccgttacatccagcaggaattaaccgtcctgccgcaaagtgaggtattgctggaatttatccattatcttgttcagtcccatactgtatttaatgagaagttgcagagtatggctgagccagacaagactcagctctttcatcacgtgctggaaaggcttaaggaagaaggcatgcttatagagaatgcccagcccgatgaaggcgatatcggcagcgaagccagccgtgagtcgcagttcgccggcgagtaa

SEQ ID NO: 5417 - DNA, 465 bp, Klebsiella pneumoniae
ggtaaagccatgtcgacccctgagaaacgccccgttagcttctttagcttgttcaaccgcgggcagcattacgcaaagacctggcctctcgacaagcgcctcgcgccggtgtttattgaaaaccgcattattcgtgccacccgctatgccatccgcatcatgccgccaatcgccatttttaccctctgctggcagatagctcttggcggccagctgggccccgccgtcgctaccgcgctgtttgcgctgagcctgccgatgcagggactctggtggttgggtaagcgttcggtgacgccgctgccgccctccattcttaactggttctatgaagtgcgcggtaaactgcaggaggcggggcaggcgctggcaccggtcgaaggcaagcccgattatcaggcgctggctgacacgcttaagcgcgccttcaaacaactggataaaactttccttgatgatttgtaa

SEQ ID NO: 5418 - DNA, 339 bp, Klebsiella pneumoniae
aataggcacatcatttttctggcaccgaaggtgcatctccagaggaaatctacgatgagtaaatgtagtgctgatgaaaccccggtttgctgctgtatggatgttggcacgattgttgacaacaccgactgcaccgcctcctacagccgcgtattcgccaaccgcgctgaagccgagcaaacgctcgccgcgttaagcgaaaaagcccgcaatgtcgaatctgagccgtgccaaattaacccaaccttcactgacgttgacggcggtgtgcagctggatatcgattttgttttcagctgcgaagcagaatccctgatcttccagctgggcttacgttaa

SEQ ID NO: 5419 - DNA, 975 bp, Klebsiella pneumoniae
ttaacaataatgcttgataaaattaacattaatatcaaaaaaactctattggcctttatcatttgtttagtcgctattccgctggctcgttttatttcaccgcaaacgataattgacggcaaccttatttatattgcctggctgccaatcagcgtgatgttttctgttatttttatctttggccgctatgcaattgcgccattaattctcgcgtttgccatcaccaatagttttctcattaaattaacgctgccgcaggcgtttatcttacttttttgtcaactgttcgccgtgtttgcctcctgcgctattctgcgactgttggtggggaagcgctggcgctgcggtccaacggcaaaacatatgggggcgcggatcttctggggcggcttcttcgcgccggtgctcctgaaaatcaccatgtatctcgccggacaatattttgcgtttccattagctattaccagttactttggtagtatgccgttgatttatactgtaatagatatccaaagtttaatcagtgcggcattaatttttacgacgtttctttattatccaatgcggatgattatcagtccgcgctacgcgcgacgtttctggcagcaggaatgtttaccgtggctggcaccgcaatatcgctcctttaccctatattggtttatcgcgttggcggtgatattaacgctattgtgtgcgccgtatcagtctgaatttattgccggttatttagttccggttatttttattgtctactttatcggtatcagtcgaataggccatgcgctattgcgtatttcatggtctgtctcggcctttttgctggtggtatataacaaaaactttctcccagggggtgcaaagcgagtattcactctcctttgtgctgtcggttctgatctcctttactatctgtttgttttatatggccgacatctatgcccgcagcgaccgcaacaaacgccgctggcgtag

SEQ ID NO: 5420 - DNA, 561 bp, Klebsiella pneumoniae
gagcggacaatgaaaaagaagacatcgcttagcgaggaggatcaggcgctgttccgtcagctgatgaccggcacgcggaagatcaaacaggacactattgttcaccgcccgcagcgcaagaaaattaccgaggttgctcctaagcgtttgctgcaggaacaggtcgataacagccactatttttccgatgagtttcaaccgctactgaataccgaaggctcgacgaaatatgtccgccccgacgtcagccatttcgagctgaaaaagctgcgccgtggagattattcgccggagctgttcctcgatctgcatgggcttacccagcagcaggccaaacaggagctgggcgcgctaattgccgcctgccgccgcgagcatgtgttttgcgcctgcgtgatgcacgggcacgggaaacacatcctcaaacagcaaaccccgctgtggctggcgcaacatccgcatattatggcgtttcaccaggcaccaaaagagtacggcggtgacgccgcactgctgatattgattgaggtcgaggagtggcaaccgccggagctgccgtaa

SEQ ID NO: 5421 - DNA, 1770 bp, Klebsiella pneumoniae
cataacaaaatcgatactacccagatagacgatcaggtcggataccaggctgccgcggatcgccgacgggatctgctgcaggtgcgcaaagctcggcgtacgcacgcgggtgcggtagctcatggtgctgccgtcgctggtcaggtagtaactgttgatccctttggtcgcctcaatcatctggaaagattcgttggccggcatcaccgggccccacgatacctgcaggaagtgggtgatcagggtttcgatatgctgcagcgtgcgctctttcggcggcggcgtggtcagcgggtgatccgctttgaacgggccttccggcatgttatcgaggcactgctgaagaatgcgcaggctctggcgcagctcttctactttcagcatcacgcgggtgtagcagtcagagacgccacccccggtcgggacttcgaagtcgaagttttcatagccagagtaaggacgccatttacgcacgtcgaagtcgataccggtggcgcgcaggcctgcgccggtggtgccccactccagcgcctctttggcggtataggctgccacgccgacggaacggcctttcagaatggtgttgcgcagggcggccttctcataggagtccagacgcttcggcatccactcgaggaactcacgcagcaggcgatcccagccacgcggcagatcgtgcgcgacgccgccgatgcggaaccacgccgggtgcatacggaacccggtaatcgcttccaccagatcgtaaattttctgccgatcggtaaaggcgaagaagaccggcgtcatcgcgccgacgtcctgaataaaggtcgagatatacagcaggtggctgttgatgcggaacagctcggagagcatcacgcggatcacgttcacgcgatccggtacggtgatcccagccagtttttccaccgccagcacgtacggcatctcgttgacgcagccgccgagatattcaatacggtcggtatatgggatgtagctgtgccaggactgacgctcgcccatcttctcggcgccgcggtggtgataaccgatatccggtacgcagtcgacgatctcttcgccgtccagttgcagaataatgcggaacgcaccatgcgccgatgggtggttcggaccgaggttgaggaacatgaagtcctcgttgtcggtgccgcgcttcatgccccactcttccggtttaaaggtcagcgcctccatctccagatcctgtttggctttggtcagctcaaacgggtcgaactcggtggcacgcgccggataatctttacgcagcgggtgaccttcccaggtcggcggcatcatgatgcgacgcaggttcgggtgaccatcgaaggtaatgccaaacatttcccaggtttcacgctcataccagttggcgttggggaacagtttggtgaaggtcggcagatgcagatcgttttccgacagcgccaccttgagcatgatgtcgcggttgcgatcgatggagatcaggtgatagaaaacggaaaaatccgcggcgggcaggccatcgcggtgcgtgcgcagacgttcgtccatgccgtgcaggtcaaacagcatcacgtaaggcttcggcaatttcttcaggaaatcacccacctccagcagctgttcacgcttcacccataccaccggtacgccggtacgggttggctgaacggtaaaggcatccggcccaaagcggttgcgcagttcgccaatcaccgggtcatcaaggtgatcgcgggtttgccaggctggtgcggcgtcatgcgcggttaa

SEQ ID NO: 5422 - DNA, 993 bp, Klebsiella pneumoniae
gaggcaaaaatggcattatgcgccccttacgacaaaactggcatcgaccaggttcaggcagaaaggttatcaatgagctggattgaacgaattaaaagcaacatcactcccacccgcaaggcgagcattcctgagggtgtatggaccaagtgcgacagctgcggtcaggtactctaccgcgccgagctggagcgcaacctggaggtttgtcctaagtgcgatcaccatatgcgcatgtcggcgcgtaatcgcctgcatagcctgttggatgaaggttctctggtagaactgggtagcgaacttgagccaaaagatgtgctgaagttccgcgattcaaaaaaatacaaagaccgcctggcgtccgctcagaaagagacgggcgagaaagacgcgctggtggtgatgaaaggtacgctctacgcgatgccggtggttgccgccgcctttgaattctcctttatggggggatcgatgggttccgtcgtcggcgcacgctttgtacgcgcggtggagcaggcgctggaagataactgcccgctgatctgcttctccgcctccggtggcgcccgtatgcaggaagcgctgatgtcgctgatgcagatggcgaaaacctccgcggcgctggcgaaaatgcaggagcgcggactgccgtacatctccgtgctgaccgacccgaccatgggcggcgtatcggcgagctttgcgatgctgggcgatctgaacattgccgagccgaaagcgctgatcggctttgccggtcctcgcgttatcgagcagaccgtacgcgagaagctgccgccgggattccagcgcagtgagttcctgattgaaaaaggggcgatcgatatgatcgttcgccgtccggaaatgcgtctcaagctggccagcattctggcgaagctgatgaacctgccggcgccggttgccgtttcggaagcgcctcatgaaggcgtggtggtgccgccggcaccggatcaggaacctgaggcctga

SEQ ID NO: 5423 - DNA, 246 bp, Klebsiella pneumoniae
tgcagaaaaatgacatgtgaagagacgtggcgggcaaagcccatttcatgggtcaccaccaccatggtttttccctcttccgccagctgctgcataatgcgtaacacttcgcccaccagttccggatccagcgcggaggtcggctcatcaaacagcagcacttccggttccatcgccagcgcgcgggcaatagagacacgctgctgctggccaccggaaagatgcaccggatacttcgcctgctga

SEQ ID NO: 5424 - DNA, 1140 bp, Klebsiella pneumoniae
actgtgaaaatcctcgttgatgaaaatatgccctatgcccgtgagctttttagccgtttaggcgacgtgcaggcgatcccaggccgtccggtcccggccgatgccctgaccgatgcggatgccctaatggtgcgctcggtcacccgggtcaatgaagcattgctcgccggcaaggccattaagttcgtcggcaccgctaccgccggcaccgatcacgtcgatcaggcgtggctgcagcaggcggggattggtttctctgcggcgcccggctgtaacgccattgcggtggtagagtacgtcttttcatcgctgctgatgctggctgaacgcgacggctttgcgctgcgcgatcgcaccgtcgggatcgtcggcgtcggtaacgttggcgggcgactgcaaaagcgcctggaagcgttggggatcaaaactctgctctgcgacccaccgcgcgccgatcgcggcgacgaaggtgacttccgctccctcgaggcgctggtccaggaagccgatgtcatcaccttccatacgccgctgtataaagaagggcaatataaaaccctgcatctggcggatgaggcgctgataagccgcctgaagcctggaacgattttgatcaacgcctgccgcgggccggtggtcgataacgccgcactgctaaagcggctggaagctggtcagccgctgagtgtggtattggacgtctgggagccggagccggatctaaacgttgagcttctcaagcgagtggatatcggtaccgcgcatatcgccggctacaccctcgaagggaaagcgcgcgggacgacgcaggtttttgaagcctacagcgcctttatcggccatccgcagcaggtagcgctggacactctgctgccggcgccggaatttggccgcattaccctgcatggaccgctcgatcagccgacgctgaaaagactggtccacttggtgtatgatgtgcgccgcgatgatgcgccgctgcggaaggtggccggcgtcgccggtgaattcgacaagctgcgtaaaaattatcaggaacgtcgcgaatggtcttcgctgtatgtgcagtgcagcgatgagcaggcggcgacgctgttgcgccagctcggttttaacgccgtgcatcatcctgttcgttaa

SEQ ID NO: 5425 - DNA, 561 bp, Klebsiella pneumoniae
ggtttcctgatggcggaacagaatcatttggcaagcacagaatgggtcgatattgttaatgaaaacaatgaggtgatagcacagtccagccgcgagcaaatgcgcgcgcagtgcctgcgccaccgggcgacctatatcgtcgttcatgacggaatggggaaaattctggtgcagcgacgcaccgagacaaaagactttcatccgggcatgctggatgccaccgctggcggcgtcgtgcaggctgatgagcagctgctggaatcggcccgtcgcgaggcggaagaggagttaggcatcgccggggtgccgtttgccgatcacggccagttttattacgaagacaaattctgccgcgtctggggaagtctgttcagctgcgtctcccacgggccgttcgccctgcaggaagaagaggtcagcgaggtgtgctggttaacgccggaagagatcaccgcccgctgcgatgagttcacgccggactccctgaaagcgctggcgctgtggatgacccgcaacgccggtaatgagtatgatgatgcggaagaaagcgagcgcgaataa

SEQ ID NO: 5426 - DNA, 933 bp, Klebsiella pneumoniae
agaaagatgattaatacaacacgtcccatactcaacctcgatctcgatctgctgcgtacctttgtcgcggtcgctgatttgaacacttttgccgccgccgccgccgcagtgtgtcgtactcagtccgcggtcagtcagcaaatgcaacgcctggaacagctggtgggcaaagagcttttcgcccgccacggccgcaataagctgctgaccgagcaggggatccagctgctgggctatgcccgcaaaattctccgttttaacgatgaagcctgtatgtcgctgatgtatggcagcctgcagggggctctgagcatcggtgcgtcagaagaaacggctgacaccatcctgccgtttttgttaaaccgcatcggctgtttctatcccagaatgacgttggagatcaaagttcacccccatgccgccatcatggagatgttggccgaggggctggtcgatctggcgttgaccacccatcagcctcccggctttacctcttttaccctgagaacatcacctactctctggtattgcgcagcggaatatgtgctggcgaagggggaatctatccccctgatcctgcacgaagagccaagcccattccgccaggatattatcgccgcgctggaaactgctcgcgtcagttggcatctggcccacggagcttcctcgctatcgggcgtgaaagcggcggtgaaggccgggctgggcgtgacggcgcgcccggtcgaaatgatgagcccggatctacgcgtggctggcatcagtgaggggttaccggcgttgccggacacccggtacgtcgtcagctgcaatccgcggacggtgagcgaactgccgcaggcgatttttcagtctctgagccaggagatccatccctgggaaacgggcacagcacttactccggaagagggagggaataccttggttttgtaa

SEQ ID NO: 5427 - DNA, 570 bp, Klebsiella pneumoniae
ccagtggagatggaacctatgaagctgatgtttgcctccgatattcatggttcgctgcccgccacggaacgcgtgcttgaacggttcgcgcaaagcggcgccaggtggctgatcatactcggcgatgtgctcaatcacggtccgcgcaacgcgctgcctgaggggtatgcgccgggtgaggtggcggagcggttgaacagcgtggcggaacgcattgttgccgttcgcggcaactgcgacagcgaagtggatcagatgctgcttcgttttccaatgaccgcgccctggcagcaggtgcttagcgaacgctatcgcctgtttctgacccacgggcatctctatagtccggataatctgccgccgctggccgctggcgatgtcctggcatatggccatactcatataccggtcgcggaaaaacgcggcgcaatttacctctttaatcccggctcagtgagtatcccgaaagggggatattccgccagctatgggctgctggatcaggggcggctgcaggttttagcactcaatgataatcaggttattgcagaggttgcaatttacccgtaa

SEQ ID NO: 5428 - DNA, 1851 bp, Klebsiella pneumoniae
gttgcgtggatgaacatgcttgccttaaccattcttttgccattgattggctttgtgctgctggccttctcccgcgggcgctggtcggaaaatctttccgccgccgttggcatgggctcggtaggcctggcggcgctggtcaccgcgtacgttggcgtcgactttttcgctaacggcaaacaggcggtcagcgtgccgctgtggacctggatgtcggtcggtgatttcaacatcggcttcaacctggtgttggacggcctgtcgctgaccatgctctccgtagttaccggcgtcggcttcctgatccacatgttcgcctcctggtacatgcgcggtgaagagggatattcccgcttcttcgcctataccaacctgtttatcgccagcatggtggttctggtactggccgataacctgctgctgatgtacctcggttgggaaggcgtgggcctctgttcttacctgctgatcggtttctactacaccgatccgaagaacggcgccgcagcgatgaaagcgtttgtggtgacccgcgtcggcgacgtgttcctcgccttcgcgctgttcattctttataacgaactgggcaccctgaacttccgcgaaatggtggagctggcgccgcagcacttcgctaacggcagcaccacgctgcagtgggcgacgctgatgctgcttggcggcgcggtcggtaaatccgcccagctgccgctgcaaacgtggcttgccgatgcgatggcgggtccgacgccggtctctgcgctgatccacgccgcgaccatggtcaccgcgggcgtctatctgatcgcccgtacccacggcctgttcctgatgacgccggaagtgctgcatctggtcggtatcgtcggggcggtcaccctggtgttggcgggcttcgccgcgctagtgcagaccgatatcaaacgcgttctcgcctactctaccatgagccagattggctacatgttcctcgcgctgggcgtgcaggcatgggacgcggcgattttccacctgatgactcacgcgttctttaaagcgctgctgttcctgtcgtctggttcggtcattctggcctgccatcacgaacagaacatcttcaagatgggcggcctgcgcaaatcgattccgctggtatacgtctgcttcctggtggggggcgcggcgctgtccgcactgccgcttatcaccgcaggcttcttcagtaaggatgagattctggcaggcgcgatggccaatggccatatcaatctgatggtggcaggcctggtcggcgcctttatgacctcgctgtacaccttccggatgattttcatcgtattccacggtaaagagcaaattcacgcgcacgcagggaaggggattacccatcatctgccgctgattgtgctgctggtactatccaccttcgttggcgcgctgattgtgccgccgctggaaggcgtactgccgcagaccactgagctcgcccacggtagcgtgatgacgctggagattgcctccgggatcatcgccattgccgggattctgatcgccgcatggctgtggctgggcaaacgcacgctggtgacctccatcgccaacagtgcgcctggccgcttcttcggtacctggtggttccatgcctggggcttcgactggttatacgacaaggtgttcgtaaaaccattcctcggtattgcctggctgctgaaacgcgatccgctgaactcgttgatgaatatcccggcgatcctttcccgcttcgcaggcaaaggcctgctggtgagcgagaacggttatctgcgctggtatgtggcttcaatgagcatcggcgcggtggtggtgctggcgctgctgatggtattgcgttga

SEQ ID NO: 5429 - DNA, 828 bp, Klebsiella pneumoniae
ggagtacctgtactgatgtctgagatggagcaacagccgatctgtaaaatcgcgctgggcatcgagtacgacggcagcaaatattacggctggcagcggcaaaacgaagtgcgcagcgtgcaggagaagctggaaaaggcgctctcgcaggtggcgaacgaaccgattaccgtcttttgcgccggccgcaccgacgccggcgtccatggcaccggccaggtggtgcatttcgaaacccgggcgcagcggaaagatgccgcctggacgctgggggtaaatgcgaatttacctggtgacatcgcggtgcgttgggtcaaacatgtaccggcggattttcacgcccggttcagcgccacggcgcgccgctatcgctacgtcatctataatcatcgcctgcgtccggcggtattaagtcatggcgtgacgcattttcaccagccgctcgacgccgagcgtatgcagcgcgccgcgcagtgtctgctgggagagaatgactttacctcgtttcgcgcggtacagtgccagtcgcgtaccccgtggcgcaacgtgatgcatattaacgttacccgctacggcgcgtatgtggtggtggatatcaaagcgaatgcctttgtacatcatatggtcaggaatattgtaggcagcctgatggaggtcggggccggaaaccagccggagagctggatggcagaactgctggcagcaaaagacaggacgctcgctgcggcaacggcaaaagcggaagggttgtatctggtgtcggtggattacccggcccactatgatttaccggtgctgccaatgggcccgctgtttctggcggactaa

SEQ ID NO: 5430 - DNA, 822 bp, Klebsiella pneumoniae
gcatgtgctgtaatggatagttttatcgagttgtttgccgtatcgccgctggtgctggtggtactcttctttgtcgccatcctggccggttttattgactcactggcgggaggcgggggcttattgactgtccctgcgctgatggcggccggcatgccgccagcccaggcgctggcgaccaataagctgcaggcctgcggcgggtcgctatcggcgaccctctattttgtccgccgcaaggtggttaatttggccgatcagaagctgaatattctgatgacctttatcggctcaaccgccggagcgctgctggtgcagcacgtgcaatccgatattctgaagcagatcctgccgttgctggtgattggcatcggcctttatttcctgctgatgccgaaactgggcgaagccgaccggcagcgtcggctttacggtctgccgtttgcgctggtcgccggcggtagcgtagggttttacgatggctttttcggccccggcgccggttcgttttacgccctggcttttgtcactctggccgggtttaaccttgccaagtcgacggcccatgccaagctgctgaacgccacctcaaacgtcggcggcctgctgctgtttatcatcggtggaaaggttatctgggccaccggctttgtgatgatggccggccagtttattggcgcccgcgccgggtcccggctggtgctgagtaaagggcagtcgctgatccggccgatgatcgttatcgtctcggcggtgatgagcgcgaaacttctttatgacagccacggggctgagattttgcagtggttgggaattcattaa

SEQ ID NO: 5431 - DNA, 651 bp, Klebsiella pneumoniae
ccaggtaatgtcctttggctggaaggtatgcctgccgttaacgctggtcaacttgttggtaacggcggctgtcattctctggcaggcgcaataaggggtgaattgaacatgaccttaaaagaattattggtggggttcggcacccaggtccgtagtatctggatgattggtctgcatgccttcgccaaacgtgaaacccggatgtatccggaagagccggtctacctgccgccgcgctatcgcggtcgcatcgtgctgacccgcgatccggacggtgcagagcgctgcgtcgcctgtaacctgtgtgcggtagcctgcccggtgggctgtatctcgctgcagaaagcagagacggtagacggccgctggtatccggagttcttccgcatcaacttctcacgctgcatcttctgcggcctgtgcgaagaagcgtgcccgaccacggcgatccagttgaccccggacttcgagctgggtgaatacaagcgtcaggatctggtgtacgaaaaagaggatctgctgatttccggtccgggcaaatacccggaatataacttctaccggatggcgggtatggcaatcgacggcaaagataagggcgaagcggaaaatgaagctaagccaatcgacgtcaagagcctgttaccgtaa

SEQ ID NO: 5432 - DNA, 1323 bp, Klebsiella pneumoniae
caggggagtgttatgagtcaggcattaccgcttatcacccgtcagggcgatcgcattgccattgtcacggggctacgcacgccatttgctcgtcaggctacggcttttcatggcgttccggccattgatttaggaaaaatggtggttggcgagatgctggcgcgcagcgacattcctgccgaagtcatcgagcaactggtctttggccaggtggtgcagatgccggaagcgccgaacatcgcccgggaaattgtgctgggtaccggcatgagcgtacataccgacgcctatagcgtcagccgcgcctgcgccaccagtttccaggccgtggcgaacgtcgctgaaagcctgatggccggcaccatccgcgccggtattgccggcggcgccgactcctcctctgtcctgcccattggggtcagtaaaacgctggcccgcacgctagtggatgccaataaggcacgcacgctgagccaaaagctgaagctgttttcccgtctgcggccacgcgacctgctgccggtccccccggcggtggctgaatattcaaccggattgcggatgggcgataccgccgagcagatggcgaaaagctgggggatctcccgcgagcaacaggatgccctggcgcatcgttcgcaccagctggcagcgaaagcctgggaagagggtaaactgtccgcagaggtgatgaccgcctatgctccccctttccgcgaaccgctcgagcaggacaacaatattcgtaaaaattcaacgctcgcagattatcagaagttacgcccggcctttgaccgcaaacatggcaccgtcaccgccgccaacagtacgccgctgacggacggcgcggcagcggtgatcctgatgaccgagtcgcgggctaaagagctggggctgaggccgctgggctatctgcgcagctacgcctttaccgccatcgacgtctggcaggatatgctgctggggcccgcgtggtccacgccgctggcgctggagcgcgctggcctgacgctggcggatctcacgcttatcgatatgcacgaagctttcgccgcgcagacgctggccaatctccagtgtctggcaagcgaccgctttgcccgcgaggtgctgggccgctcgcaggccaccggtgaggtagatgaaagcaagtttaacgtcctcggcggctctatcgcctacggtcaccccttcgccgccaccggcgcgcggatgatcacccagacgctgcatgagctgcggcgacggggcgggggatttggtttggtgacggcctgcgcggcaggtggtctgggtgcggcgatgatcgtggaggctgaataa

SEQ ID NO: 5433 - DNA, 1188 bp, Klebsiella pneumoniae
tcactgcacgtttcattaaatacctctgtaagtcgcactattttaagtttcgtgtcgcacaatagcgtacacttgtacgccgaacaagtccgatcagacattttgtgtataaatttgcgccctcaggcacacatcgttaagatcgtgctacgccttgtgattcgagtaacttacgtgaaacaaaacgccatacaacccgccaacctggaattcaacgctgagggtacacctgtttcccgagatttcgacgatgtttacttttccaatgacaacggtctggaagagactcgctacgtttttctcggcggaaatcgcctgccggagcgcttccccagccaccctcgcccgctgatgatcgtcgcggagagtggcttcggcaccgggctcaatttcctcaccctctggcaggcgtttgacgtttttgttcgtgataacccggacgttaccttgcaaaggttacatttcatcagttttgaaaaatatccgctgaaggctgaggatctccgcctggcgcaccagcgctggccagagctggctccgtgggcgcagcagctgcaggcgcaatggccgtcggccttcggcgggtgccatcgtctgctgctcgacggcgggcgggtgacgctcgatctgtggtttggcgatatcaatgagctgaccagggagctggatgattcgctgaaccagcaggtggacgcctggtttcttgacggctttgccccggcgaaaaatcccgacatgtggactcaggatctgttcagcgccatggcgcgcctggcgcggcccggcgggacgctggccacctttacctccgccggttttgttcgccgtggcctgcaggaggccggctttaccatgcgtaaaagcaaaggcttcggccgcaagcgggagatgctgaccggcgagatggcgcaaacgctgagctttcctgcgcgcgccccctggttcgctcgcagtagcagcgatgcccgcgaggcggccatcatcggcggcgggatcgccagcgccctgctctccctggcgctgctgcgccgcggctggcaggtgaccctttactgcgccgatgaggctccagcgcagggcgcctccggcaatcgccaggggcgcgctgtatccgctgttaagtcagcacgatccggcgctggcgcgcttttttccggccgcctttaccttcgcccgccgaatgtatga

SEQ ID NO: 5434 - DNA, 1845 bp, Klebsiella pneumoniae
caaggaaacgttgtgaacggtgaattgatttgggttttatccctcctggccatcgcggttgtgctgtttgctaccggcaaggtgcgcatggatgctatcgccctgatggtcattgtcgcctttgtcctcagcggaacgctgacgttaaatgaagctttttccggattcagcgatcctaacgtgatcctgattgccgccctgtttattatcggcgatggcctggtgcgcaccggagtcgccaccaaaatgggggcatggctggtgagcgtggcggggaacagcgaaaccaagatgctgatctacctgatgctcaccgtcgccggtctgggcgcgtttatgagctccaccggggtggtcgccattttcatcccggtggtacttagcgtctcggcgcggatgaatacctcgccatcgcggctgatgatgccgctgagcttcgccgggcttatcagcgggatgatgaccttggtggcgacgccgcccaacctggtggtcaacagtgaattgctgcgcgagggactgcacggcttcagctttttcagcgtcacgccgattggcctggtggtgctgatcctgggcatcgtctatatgctggcggtgcgctttatgctgaagacggataatggcgactccgcacgcgatgggcgaaagagaagcaccttccgcgatttgatccgcgaatatcacctcaccggccgcgctcgccggctggctatccgcccgggttcgccgatgatcggtcagcggctggatgatttaaaactgcgtgagcgctactgcgccaacgtgatcggcgttgaacgctggcggcggttccgccgggtaattgtcaacgtcaacggggtatcggaatttcgcgcccgcgacgtcctgctaatcgatatgtccgcctccgatgtcgatttacgccagttctgcggcgagcaaatgcttgagccgatggtattgcgcggcgagtattttgccgatcaggcgctggatgtggggatggcggaggtggcgctgatcccggattcagagatgattggcaaaacggtgcgtgagatagccttccgcacccggtttggtctcaatatcgtcggcatgaagcgcgatggcaaagcgatggatggttcggtggtcgacgagccgctgcagctcggcgatatcctgctggtggtcggcaactggcggcaaattgccttgctggcgaagcgcggccgggatttcgtggtgctcaatatgccggttgaggtcgatgacgcttcgccggcccacagccaggctccgcatgcgattttctgcctggtgctgatggtagccctgatgctcaccgatgaaattcccaacccgattgccgcgattatcgcctgtctgctgatgggcaaattccgctgcatcaatgccgaaagcgcctacaaggcgatccactggccgagcattattttgattgttgggatgatgccgtttgccctggcgctgcaaaaaaccggcggggtggatctggtggtgaagggactgatggatgtcgccggaggcgaggggccttatctgatgctcggctgcctgttcgtgatgtgcgcggcgattgggctgtttatctcaaacaccgccacggcggtgctgatggcgcctattgccttagcggcggcgaagtcaatgggcgtctcaccctatccttttgccatggtggtggcgatggcggcttcggcggcgtttatgaccccggtctcctcgccggttaacaccctggtgcttggcccgggcaagtactcatttagcgattttgtcaaaataggcgtgccctttaccatactggtgatggtggtctgcgtcctgctgatcccggtactgtttccgttttaa

SEQ ID NO: 5435 - DNA, 576 bp, Klebsiella pneumoniae
gattttgcagtggttgggaattcattaatgcaacagcaacaccattatcagcagctgatagaccttttcgacagctgctttgccgaagaatttaatacccgcctgattaaaggcgacgatgagccgatctaccttccggctgacgatgaaacgccctatcaccgtatcgtgtttgcgcacggattttttgccagcgccctgcacgagatctctcactggtgtgtcgccggcaaggcgcgtcgcgaacaagtagattttggctactggtactgcccggacggccgcgatgcgatgacccaaagccagtttgaggatgtcgaggtgaaaccgcaggcctttgagtggctgttctgcgtggcggcgggatttccgtttaacgtcagctgtgacaatctggaaggggacgttgagcccgatcgcatcgccttccagcgccgggtgcatgctcgggtgatgactttacttgaacaagggatccccgaacgtccggcgcgctttattcgcgcgttacaacactattatcaaacgccgccattgacggcgaaacactttccgtggccggaagacctgcactaa

SEQ ID NO: 5436 - DNA, 192 bp, Klebsiella pneumoniae
aacgataaagttaaggtgacatctgatatccggcgcgtcctttacaggctaccttgcatagattacaaactaaatgtgacctgtgtcgctaaacaaggggcgtctgcgcgttggacgttgttgttaagccgccatgaatttacagtgtgccaaaagatttattttgactttagcggagccgtaacggaatga

SEQ ID NO: 5437 - DNA, 393 bp, Klebsiella pneumoniae
ccgggaacggtaatactggaggtaggcttcagcgcgatgttggcaacgatctgctggccgctgctgatgccgccaagaatgccgccggcgtggttgctctggaacccggctttagtgatctcatcgcggttttcgctgccgcgcagcttcaccacctcgaagccgtcgccaatttccacccctttcacggcgttgatgctcatcagcgcgtgggcgatatcggcatccaggcggtcgaagaccggctcaccgaggcctggcggtacgccgtcagccaccaccgtcactttcgcgccaatggagtcgccctcttttttcaggccgcgcatcagttcatccagggcgtcgattttatccgggtccggacagaagaaggggttctgctcaacctga

SEQ ID NO: 5438 - DNA, 225 bp, Klebsiella pneumoniae
acgcccgcggtgaccatggtcgcggcgtggatcagcgcagagaccggcgtcggacccgccatcgcatcggcaagccacgtttgcagcggcagctgggcggatttaccgaccgcgccgccaagcagcatcagcgtcgcccactgcagcgtggtgctgccgttagcgaagtgctgcggcgccagctccaccatttcgcggaagttcagggtgcccagttcgttataa

SEQ ID NO: 5439 - DNA, 534 bp, Klebsiella pneumoniae
ctcaatgaggttatgggcatgagccagaaaacccgctttacccaatctgcccttgcagtggctgtcgcacttgtttccacccaggcctggtcagcaggcttccagctcaacgaattctctgcatcggggctgggtcgtgcctattccggtgaaggggcgatcgctgacgatgctggtaatgccagtcgtaacccggcattaattatgatgtttgaccgcccgaccatgtcggcgggcgccgtgtttgtcgacccgggcgttaatgtttcgggcacctctcccaccggcaagagcctgaaagcagacaatatcgccccgacggcgtgggtgcccaacttccactttgtcgcgccgattaacgaccaatttggttggggggcgtctatcacctctaactatggtctggcaacagagtataacgatgattatgcggccggcagcatgggcggtaaaaccgacctgaccaccgcgaacttcaacctgagcggggccctaccgcctcgacagcaactggagcttcggcttaggctttga

SEQ ID NO: 5440 - DNA, 1215 bp, Klebsiella pneumoniae
aaaggtacttccatgtcgagtaagttagtactggttctgaactgcggtagctcctctctgaaatttgctatccttgacgccgtgaacggcgacgaatatctgtccggtttagcggaatgcttccacctgccggaagcccgtatcaaatggaaaatggacggcagcaaacaagaagccgaattaggcgcgggcgccgcgcacagtgaagcgctgaactttatcgttaacactattctggcacaaaaaccagaactgtctgctcagctgaccgcaatcggccaccgtatcgtacacggcggtgaaaaatacaccagctccgtggtgatcgacgagtccgtaattcagggtattaaagacgccgcgtctttcgcaccgctgcacaacccggcacacctgatcggcatcgctgaagcgctgaaatccttcccgcacctgaaagacaaaaacgtggctgtattcgatacggcgttccatcagaccatgccggaagaatcctatctctacgccctgccgtacagcctgtacaaagagcacggcgttcgtcgttacggcgcgcacggcaccagccacttctacgtgactcaggaagccgctaagatcctcaacaagccggtggaagagctgaacatcatcacctgccacctcggcaacggtggttctgtttccgctatccgtaacggtaaatgcgttgacacctccatgggtctgaccccgctggaaggcctggtgatgggtacccgctccggtgacatcgatccggccatcatcttccatctgcacgacaccctgggcatgagcgttgacgcgatcaacaaaatgctgaccaaagagtccggcctgctgggtctgaccgaagtcaccagcgactgccgctacgtggaagacaactatcaggaaaaagccgacgctaaacgcgcgatggacgtttactgccaccgcctggcgaaatacatcggttcctacaccgcgctgatggacggccgtcttgacgccgttattttcaccggtggtatcggtgaaaacgccgcgatggtgcgtgagctgtcgctgggcaaactgggcgtactgggctttgaagttgaccatgagcgtaaccttgctgcccgcttcggcaagtctggcttcatcaacaaagaaggcacccgtcctgccgtggttatcccgaccaacgaagagctggtcatcgcgcaagacgccagccgtctgaccgcataa

SEQ ID NO: 5441 - DNA, 450 bp, Klebsiella pneumoniae
acttatcatccccttttgctgatggagctgcacatgaacccattcaaaggccggcattttcagcgtgacatcattctgtgggccgtacgctggtactgcaaatacggcatcagttaccgtgagctgcaggagatgctggctgaacgcggagtgaatgtcgatcactccacgatttaccgctgggttcagcgttatgcgcctgaaatggaaaaacggctgcgctggtactggcgtaacccttccgatctttgcccgtggcacatggatgaaacctacgtgaaggtcaatggccgctgggcgtatctgtaccgggccgtcgacagccggggccgcactgtcgatttttatctctcctcccgtcgtaacagcaaagctgcataccggtttctgggtaaaatcctcaacaacgtgaagaagtggcagatcccgcgattcatcaaccacggataa

SEQ ID NO: 5442 - DNA, 243 bp, Klebsiella pneumoniae
acttatcatccccttttgctgatggagctgcacatgaacccattcaaaggccggcattttcagcgtgacatcattctgtgggccgtacgctggtactgcaaatacggcatcagttaccgtgagctgcaggagatgctggctgaacgcggagtgaatgtcgatcactccacgatttaccgctgggttcagcgttatgcgcctgaaatggaaaaacggctgcgctggtactggcgtaacccttcc

SEQ ID NO: 5443 - DNA, 309 bp, Klebsiella pneumoniae
ggaagggttacgccagtaccagcgcagccgtttttccatttcaggcgcataacgctgaacccagcggtaaatcgtggagtgatcgacattcactccgcgttcagccagcatctcctgcagctcacggtaactgatgccgtatttgcagtaccagcgtacggcccacagaatgatgtcacgctgaaaatgccggcctttgaatgggttcatgtgcagctccatcagcaaaaggggatgataagtttatcaccaccgactatttgcaacagtgccgtccagcggatatcagcgctgaaagatgatggctga

SEQ ID NO: 5444 - DNA, 312 bp, Klebsiella pneumoniae
atgggttcatgtgcagctccatcagcaaaaggggatgataagtttatcaccaccgactatttgcaacagtgcctatatttctattattctggaaatatagataaaggaggtattatggatttaaacactgctgcaaacgcacttcgagaactgggccacccgacacgtctcagcatataccgggagctggtcagggcgggtcatgaaggcctgccggttggcgaactgcagaagcaccttgagattcctgcctccacgctcagccatcatctttcagcgctgatatccgctggacggcactgttgcaaatag

SEQ ID NO: 5445 - DNA, 540 bp, Klebsiella pneumoniae
gcagagcaagggcgcgaccataaggcgggcgctttatccgtggttgatgaatcgcgggatctgccacttcttcacgttgttgaggattttacccagaaaccggtatgcagctttgctgttacgacgggaggagagataaaaatcgacagtgcggccccggctgtcgacggcccggtacagatacgcccagcggccattgaccttcacgtaggtttcatccatgtgccacgggcaaagatcggaagggttacgccagtaccagcgcagccgtttttccatttcaggcgcataacgctgaacccagcggtaaatcgtggagtgatcgacattcactccgcgttcagccagcatctcctgcagctcacggtaactgatgccgtatttgcagtaccagcgtacggcccacagaatgatgtcacgctgaaaatgccggcctttgaatgggttcatgtgcagctccatcagcaaaaggggatgataagtttatcaccaccgactatttgcaacagtgcctatatttctattattctggaaatatag

SEQ ID NO: 5446 - DNA, 297 bp, Klebsiella pneumoniae; identical to SEQ ID NO: 2022

SEQ ID NO: 5447 - DNA, 192 bp, Klebsiella pneumoniae; identical to SEQ ID NO: 4151

SEQ ID NO: 5448 - DNA, 525 bp, Klebsiella pneumoniae; identical to SEQ ID NO: 2057

SEQ ID NO: 5449 - DNA, 234 bp, Klebsiella pneumoniae; identical to SEQ ID NO: 2064

SEQ ID NO: 5450 - DNA, 285 bp, Klebsiella pneumoniae; identical to SEQ ID NO: 2106

SEQ ID NO: 5451 - DNA, 184 bp, Klebsiella pneumoniae
tttgttggttcaatgtgccagggtattcatacaaaaactggaacaccagtctggcaaattggccgattgggtcagggatctactgtgtaggaaaagcaactttgtcgtcacttgtgctctggcaaacaagctggccagaatagcgtgggccctaacggcacgacagcaaacttatgtagcataa

SEQ ID NO: 5452 - DNA, 879 bp, Klebsiella pneumoniae
tgctggcgatcctcttcgccaacctcttcgcaccgctgttcgattatctggtggtgcaggccaatattaagcggaggaagtcgcgtggctgagaagaaaagtaacgatagcatcggcaaaacgctgctggtggtgctggtgctttgtctggtctgctccatcgtggtggcgggctcggccgtggggctgaaatcccgccagcaggcgcagcgggcgttggataagcagcgcaatatcctggcagtgtcagggctgatgcaccccggtatggatgcggatgcggtagcggacaccttcgcggcgcgcattaccccgcgactggtgaatctggccaccggcgaactgctggagaaagacccgggtaaatttaatcaggctcaggcgctgaaggatccgcagcagagtatggccctggatgccagtcaggatccggctggtataaagcgacgcagtaatctggcggaaatttacctggtgcgcgacgcgcagcagaagattgagcaggtggtgctgcccatttatggcaacggcctgtggtcgatgatgtatgcctttgtggcgctggacgtcgatggccgcacggtaaaaggcattacttactacgatcagggcgaaacgccggggctgggcggcgaggtggaaaaccccaactggcgccagcagtttgtcggcaagcaggtgctggatgacaacggcatgccggcgctgaaggtggtgaaaggcggcgcgcgcgcaggcgatctccacgcggttgacggtttatccggcgccacgctgacgtccaatggcgtacagcatagctttgatttctggatgggcgaactgggctttggtccgttcctgaaaaaggttcgtgagggagagctgaataatggctga

SEQ ID NO: 5453 - DNA, 543 bp, Klebsiella pneumoniae
aaaaccatgttcaagaaaaccacactggctttattaacagcctcactttttatttccaccagcgcgctagccatatctaataatactattacctttcgcggtgaagtttccgatgaaacctgttctgtggcgattaacggcaatcaggcaaaaccggtagttattctgccgacggtgagtgccaaggaattggcgaaaggcggtgatgtcgcaggtcaggtgacatttgatattggtctcaccggctgcacgggtaataccgatagagcgaccaaaatctctaccgtcttcgttggtaaccaggtgaccagcaacggtaatcttgggaatacgggagacgcgaccaacgttgaagtacaactccttgataccgcaaataaagttatcaatttgaccaacggcttcaaaggtgaaggcgatctacaactgaagcctggagagacggaagccagcgccacctacactgcgcagtattacgccacaggagcagcatcggctggtacggtcgaagccactctccagtacgccgtttcctacctgtaa

SEQ ID NO: 5454 - DNA, 807 bp, Klebsiella pneumoniae
aatagcgacccgggcagggtcgctgcccgggcgtatggctctcaaggagaaaacctcatgatcgatatccctcgcatttttaccatcagtgaaagcgagcaccgtatccataacccttttaccccggaaaagtacgccacgctgggacgggcgctgcgaatggcgccgggcaccaccattcttgacctcggcagcggctccggcgagatgctctgtagctgggcgcgcgatcatcagatagtcggcaccggcgtagacatgagcctgctgttcagtcagcaggcggccgcccgggcagaggagctcggggtaagcgaccgggtaacttttgtgcaccaggatgccagcggatatgtcgccagccagccgtgcgatgttgccgcctgcgtgggggccacgtggatcggcggcggggtggcaggcacaatcgagctgctgaagcagagccttaccccaggcggcatgttgcttatcggcgagccatggtggcgcaaacgtccggccacggcagaagaggcgattgcctgcggcgcgcagtcacccgatgacttcctgacgctaccggcgctggtcgcccactttggcgaactgggctatgacgtggtggagatggtgctggccgaccaggagggctgggatcgttatgaagcggcgaaatggctgacaatgcgccgctggctggaggccaatctgcacgatgacttcgcaccggaggttcgccagcagttgaccactgcgccgctacaccatgtcacctggacccgggaatatctcggctggggcgtgtttgtcctgatggcgcgttaa

SEQ ID NO: 5455 - DNA, 1575 bp, Klebsiella pneumoniae
gaggcgaaaccagtgaagctaaaactatcgtatataatttgtgcagtgctggtgccgctggtcatgatgcttacgttagcactgctggtcagtgtcctgcagtttaaacaggatgtcgccctgagtgcgaaaaccttattacgttttagtgaagatgtctcaactgcttcgtggcgggtcaccgggcaagccgtaaaattagcggacaggccctgcgctgaaattttgtcggagcttaaccgtacccgcgcctttactccttatattcgtgatattggtttgctggaaaagggcaatctgctctgttcctttgttagcagagagcaggcgcatccttttcctctgccaccaggtaaaacgctcccaacgccgctacctgccaggtgggttcgctcatttagctggatggccggtgggcctggcaggcccgcggtggtttacacacagcaagtcgcggcggataaagcggcgtttgttatcgtcgattctcggtatgtccaggagctgatggatgtactctcagaggagagagaggccgttttcagcctgagatttggcaaaggcgatgccattatcagtcaaccagcacagtatgatcgaatagtgatgacccagaattacgtcactgacgacggaaagatttctcttaccgtcgctgcgcctcttggcacattgacggcagtttggatgaaatctctgctcatttttatccctctctcgttttgcttctcatttttgaccctggttctttaccggcattggtcgaaaatgcggatgtccatggcgcgagaaattatccgcggtatgaaaaatgcgcagttcacggtgcattatcaaccagtatttaacgtcaaccgcggtaattgtggtggggtagaggcattaatgcgttggcctcttcccgatggtcgttttattacacccgacattttcatcaccgccgcagaaaacgaaggtatgatcgttccgctttcgcggcatctgtttaagctcatcgccgaggatgtcgaaaggtggcaggtcgccgaaggcttttatatcagtgttaatatttcgcctgaacacttggtgcatgagagctttattgaagacgttgagttgttacaggcaagattaggcaatctgcgtctgatgctggagctcaccgaacgcagcctcattgtacaaccagcacttgtgtcagataagctgatacggctacgcgagaaaggcatattgatagcgatagacgattttggtaccggctactgttcgctttcttacctccagcagctacccgttgattatctgaaaatcgatcgtacttttgtcgatacgattgataccagcggtagcgacgtgcccattctggataccattatcatgcttagccataaactcggtcttaatatcgttgcggaaggcgtgagttcagaacatcaattgagctatattctcgatcataacgtaggatttatacagggctatctttacgcaaagcctatgtgttcatctgattttacgcgctggcttgatacgtgtgccaatgagcaaaatgacaggattaaatgcaaaaaatgttcaataaatcagtaa

SEQ ID NO: 5456 - DNA, 870 bp, Klebsiella pneumoniae
gcggcgagaccgaactcggtatcgttggcctgggcaatgacgtcggcttcatctttaaagcggaacagcggggccagcgggccgaaggtctcctctttcgccactttggcgctgtcgggaacgttgaccaggatggtcggctggaagaagttgccacccagggcgtgcggtttgccgccggtgaccaccttcgcgcctttggcgatggcatcggcaatgtgttcttcaactttggccacggctttctcgtcgatcagcgggccggtggtgacgccgtcctgcaggccgtcgccaatgcgcagtttttccaccgcctgctgcagcttctcggcgaaacggtcatacaccccgtcctggacgtacaggcggttggcgcagacgcaggtctgtccggcgttgcggaacttcgacgccagcgccccctcgacggctttatcgaggtcggcatcgtcaaagacgataaacggcgcgttgccgcccagctccagggagacttttttgatgtctttcgcgcactgctccatcagctggcggccaatctcggtagagccggtaaaggagagcttgcgcaccagcgggttgctggtcagttcgccgccgaccgcgccggcggagccggtgaccacattgaacactccggcggggatcccggcgcgattcgccagttcggccagcgccagcgcggaaaacggcgtctggctggccggtttcaggaccatggtgcagccggcggccagcgccgggcccgctttgcgggtgatcatcgccgccgggaagttccacggcgtgatggcggcggtaacgccgatgggctgcttaatcaccagcaggcgcttgtcggcctggtggccgggaatggtgtcgccgtag

SEQ ID NO: 5457 - DNA, 525 bp, Klebsiella pneumoniae
tctcgcgcaaccattttccccctcgaacattatttaagccgtattacacaggctgggacacttcacatgagcgaaaaatacgtcgtcacctgggacatgttgcagattcacgcccgcaaactggccagccgtctgctgccggttgagcaatggaaaggcattattgccgttagccgcggcggactggtaccgggagccttgctggcgcgtgaactgggcattcgtcatgttgataccgtatgcatctccagctacgaccatgataaccagcgcgagctgaaagtgctgaaacgtgcggaaggcgatggcgaaggctttatcgtcatcgacgatctggtggataccggcggtaccgccgtggcgatccgcgaaatgtatcccaaagcgcactttgtcaccattttcgccaagccggcaggccgcccgctggtggacgattacgttgtggatattccgcaggatacctggattgaacagccgtgggatatgggcgtggtgtttgtaccgcctatcgcaggtcgttaa

SEQ ID NO: 5458 - DNA, 1449 bp, Klebsiella pneumoniae
cccgcgcaaaccggcgggcacgttggcgtacttcattttttcgcggatccccgccatcgccacgatcgccagcatccagccaatgccggagccgaagccgtagacgatggactccgggaagttgtaatcgcgctgcaccatgaacgacacgccgccgaaaatcgcacagttaaccgcaatcagcggcaggaagatgcccagcgcgttgtacagtgccggaaaatacttatcgaggatcatctcgaggatctgcaccagcgcggcgatcactccgataaaggtgatgaagttaagaaagctgagatccaccccctcaaccagcgcgccgtcgcgcagcaccaggttatagaccaggttattgattggcacggcaagccccagcactaccgtcaccgcgacgccgaggccgaaggcggtggagacctttttcgacaccgcaagaaaggtgcacatcccgaggaagaaggccagcgccatgttctcaacgaacaccgcgcggacaaacaggctgatgtaatgagccattaccgattactccttttcctgctgctcaggcttccagctacgcagggcccagatcagcaaaccgataatgaagaacgcgctcggcgccagcaggaacaggccgttcggctgataccagccgccgttctgcaccgtctccagcaccgtgataccgaacagcttgccgctaccgataagctcgcgcaggaagccgacgataatcaggatcgcgccatagccgagaccgttgccaataccatccataaagctcgccagcggcggcgacttcatggcgtaggcttcggcgcggcccatcacgatgcagttggtgatgataagcccgacgaataccgacagctgtttggaggtctcataggcgaaagcccgcagcagctgatccaccacgatcaccagcgaggcgatgatcgccatctgcacgatgatgcgcacgctattgggaatatggtggcggatcatcgagataaacatgctggagaacgccgtcaccagggtcaccgcaatggtcatcacgaaggcggtttccagtttggtggttaccgccagtgcggagcagacgcccagcacctgcagggcgatggggttattggcgatgagcggccccaccagcacgcgcttcacctctttcatatcgctctgttcagccattattcagctctccctcacgaacctttttcaggaacggaccaaagcccagttcgcccatccagaaatcaaagctatgctgtacgccattggacgtcagcgtggcgccggataaaccgtcaaccgcgtggagatcgcctgcgcgcgcgccgcctttcaccaccttcagcgccggcatgccgttgtcatccagcacctgcttgccgacaaactgctggcgccagttggggttttccacctcgccgcccagccccggcgtttcgccctgatcgtagtaagtaa

SEQ ID NO: 5459 - DNA, 819 bp, Klebsiella pneumoniae
atccagaaaactctgatttcgggtctctcttgccgtcctggcaatgtggctattttgttttatcaaggaacaagcagtatgcgcaaaatcgcattatttattgcgatgcttctgttgccgtgcgtgtcatttgccgggctgctcagcagcaacagcccgacgacgccggttagcaaagaatataagcagcaattaatgggttcaccggtttacattgagatctttaaagaagagcgcatgctcgacctttacgtcaaaatgggtgaaacctaccagctcctcgacagctaccggatctgcaactactccggtggcctcggtccgaaacagcgccagggcgatttcaagagtccggaagggttctataacgtcacccgcagccagctcaaacccgacagccgcttctataaagcgattaacatcggcttcccgaacgcctacgatcgcgcccatggttatgaagggaaatacctgatgatccacggcgactgcgtctcagtcggctgctacgccatgactgacagcggtatcgatgagatcttccagttcgtgaccggcgccttagtcttcggccagccaagcgtgcaggtgagtatctatccgttccgcatgaccaacgccaacatggaacgccacaaatactcctactacgcggatttctggaaacagctcaagccaggctatgactatttccagcagacccacaaaccgccggtcgtatcagtgaccgacggccgctatgtggtgagcaagccgctcagccacgaggttgtccagccgcagctggcctcaaactacacgctccccgagacaaaataa

SEQ ID NO: 5460 - DNA, 900 bp, Klebsiella pneumoniae
gggtttctcgcaatttgcattgaaagtgtatgggaaaatccctataacagaataaccagtcgtcgtcgggctggtttctgttatcgaggattaatgcccaaattgcgaaagaacacctacgccatgcgctatgtcgccggacaacctgcggagagaatattgcctccgggggcgtttgcgggcgtgagtccggtttatcccgccggtacgccattaagcagcgatgagaagatccgcgtgctggtatggaatatcttcaagcagcagcgcgcagagtggcagtcggtcctcaaaaatttcggcaaagatgcgcatttggtcctgttgcaggaggcgcaaactaccccagaactggtccggttcgcgacttcaaactatctggccgccgatcaggtgccggcgctggtattgccgcagcatccttccggcgtaatgacgctggcctccgcgcaccccatctattgctgtccgctgcgcgagcgcgagcctattttgcgattgccgaaatcggcgttagtgaccgtttatccgctgccggatgcgcggttgttgatggtagtcaatatccatgccgtcaactttagccttggcgtcgacgtctacagcaaacagctgctgccaattggcgatcagatcgcccatcacagcgggccggtgatcatggccggcgacttcaatgcctggagccggccgcggatgaatgcgctgtaccgctttgcgcgtgagatgtcgttacgcgaagttcgtttctcagacgatcagcgccgccgcgcgtttggtcgtcccctcgattttgtgttctaccgtgggttaagcgtgcacgatgcttccgtgctggtgacccgcgcctccgaccacaacccgctactattcgaattcagtcccggcaagcctgattaa

SEQ ID NO: 5461 - DNA, 399 bp, Klebsiella pneumoniae
  unsure (380): Identity of nucleotide at the above locations are unknown.
taccaatatttttgttcagtgtctgaatcaactgaatgtttcggagcccaaatgcatcactatcaaagaacggtactgaacagcattacgctgcttatcctggcgatatccttcgcgttactgattttacatgtacgtcaacaacgctaccctttatcagatttgaacgtttttttatgtactaccaggacggtaacctcagttcaaccgggtaattttcacgctgatggcaatatcgtccttgatttcaaaaataaacgcattacgcttcaatatgacatcatcaccgcacagcagataaaaaaagtgttgtatcgcgatgtatatataaaaaacctgaagatgccgggggccgaatttatacatttgatgttgattcngaaaaggtgtttctactga

SEQ ID NO: 5462 - DNA, 1464 bp, Klebsiella pneumoniae
agacaggaagcgtttatgcaactcaacgatatgacactgtttcgccagcaggcgatgatcgatggccagtggcgcgatgcgcccaacggcgacgtgattgcggtcaccaacccggccaacggcgagcagctcggcagcgtgccgaaaatgggcgccgatgaaacccgcgaagcgattgaagccgccaatcgcgccctacccgcctggcgcgccctgaccgccaaagagcgggcgaacattctgcgccgctggttcgatcttatgatggagaatcaggacgatctcgctcgcctgatgaccctcgagcagggaaaaccgttggcggaagccaaaggcgaaatcagctacgccgcctcctttattgagtggttcgccgaagaaggtaagcgcatctacggcgacaccattcccggccaccaggccgacaagcgcctgctggtgattaagcagcccatcggcgttaccgccgccatcacgccgtggaacttcccggcggcgatgatcacccgcaaagcgggcccggcgctggccgccggctgcaccatggtcctgaaaccggccagccagacgccgttttccgcgctggcgctggccgaactggcgaatcgcgccgggatccccgccggagtgttcaatgtggtcaccggctccgccggcgcggtcggcggcgaactgaccagcaacccgctggtgcgcaagctctcctttaccggctctaccgagattggccgccagctgatggagcagtgcgcgaaagacatcaaaaaagtctccctggagctgggcggcaacgcgccgtttatcgtctttgacgatgccgacctcgataaagccgtcgagggggcgctggcgtcgaagttccgcaacgccggacagacctgcgtctgcgccaaccgcctgtacgtccaggacggggtgtatgaccgtttcgccgagaagctgcagcaggcggtggaaaaactgcgcattggcgacggcctgcaggacggcgtcaccaccggcccgctgatcgacgagaaagccgtggccaaagttgaagaacacattgccgatgccatcgccaaaggcgcgaaggtggtcaccggcggcaaaccgcacgccctgggtggcaacttcttccagccgaccatcctggtcaacgttcccgacagcgccaaagtggcgaaagaggagaccttcggcccgctggccccgctgttccgctttaaagatgaagccgacgtcattgcccaggccaacgataccgagttcggtctcgccgcctatttctacgcccgcgatctgagccgcgtcttccgcgtcggcgaagcgctggagtacggcataatcggcatcaataccggcattatctccaccgaagtcgcgccgttcggcggcgttaaggcctccggcctcggccgcgaagggtcgaagtacggcatcgaagattacttagaaatcaaatatatgtgcattggcctttaa

SEQ ID NO: 5463 - DNA, 603 bp, Klebsiella pneumoniae
tcggtaatggctcattacatcagcctgtttgtccgcgcggtgttcgttgagaacatggcgctggccttcttcctcgggatgtgcacctttcttgcggtgtcgaaaaaggtctccaccgccttcggcctcggcgtcgcggtgacggtagtgctggggcttgccgtgccaatcaataacctggtctataacctggtgctgcgcgacggcgcgctggttgagggggtggatctcagctttcttaacttcatcacctttatcggagtgatcgccgcgctggtgcagatcctcgagatgatcctcgataagtattttccggcactgtacaacgcgctgggcatcttcctgccgctgattgcggttaactgtgcgattttcggcggcgtgtcgttcatggtgcagcgcgattacaacttcccggagtccatcgtctacggcttcggctccggcattggctggatgctggcgatcgtggcgatggcggggatccgcgaaaaaatgaagtacgccaacgtgcccgccggtttgcgcgggttagggatcacctttatcaccaccggactaatggcgctgggctttatgtccttctccggcgtgcagctataa

SEQ ID NO: 5464 - DNA, 735 bp, Klebsiella pneumoniae
cggaaggtggcaatgaagccggcaaggatacctcacacagtgacagcgcctgagcattggtccagtatgccgtggggcgaatactatcgcgaaacgctggagcagcagatgaaaccgtggctggctaaattatatggctttcatctgcttaagattggcaatctgagcgcggaaatcaataccgaagcttgcgccatctcgcaccaggtgaatgtctcgctggcgggaaatccaatgcaggtccgggctgacccgctgcatttaccctttgccgaaaagtccgttgacgcctgcctgctggcgcacaccctgccgtggtgtagcgatccgcatcgtctgctgcgggaagccgatcgtgtactgatcgatgatggctggatgatcctgaccgggtttaatccggtcagcctgatggggttgcgtaagctggtgccggtcctgcgcaaaggaacgccttataatagccgtatgtttacgctgatgcgccagctggactggctggcgctgctcaactttgaagtgctgcactatggacgttaccaggttttgccctggtcgcgccatggcggcaaattgttgagcacccatctgccggcgctgggctgtttgcaattgattgtcgcccgcaaacggaccattccgctgacgctcaatccgatgaaatccggcaaagcgaaaactcagctgcggccggcggtgggcgccacccggcagtggcgcaaagggcagaattaa

SEQ ID NO: 5465 - DNA, 729 bp, Klebsiella pneumoniae
cagaagaaggcgagcgctactttcgccggatgcaggtggtcttgcaggaaatggcggcggccagagaacgatctgctggagacgcgcacgacgccgcggggcctgctgcgggtagatgccgcgacgccggtgatgctgcattttctcatgccgctggtgaagccatttcgcgagcgctacccggaaatgacgctgtcgctcgtctcgtctgagacgtttatcaatctgattgaacggaaagtggatgtggccattcgggccgggaccttaacggattccagcctgcgcgcccgaccgctgtttaccagctatcgtaagatcgtcgcctcgcccgactatgtcgcgcgctacggtatgccgcagcatccatccgatctgaaacagcatcactgcctcggcttcaccgagccggtatcgctgaatacctggccggtctcctgttgcgatggccagctgttagagatcgaagcggcggtgtcatccaatagcggcgaaacgctcaagcagctgtgcctgaccggcaacggtattgcctgcctgtcggattacatggtggataaagagattgccagcggagagtttgtcgagctactggcggataagcgcttaccggtggaaatgcctttcagtgccgtctattacagcgaccgggcggtcagcactcgcatcagggcatttattgattttctgagcgaccacgtaaaacagctcccgaaggagctgtcgtaa

SEQ ID NO: 5466 - DNA, 645 bp, Klebsiella pneumoniae
tttcataattttctctcgatttttatggttatattgctgccgcaatcggtcttctacggtgattgcttgttgataagcattgagttatttaccagtaaggagctttacatgcagcgtattttttcaccatggattatggcggcattattattttcgcccgcattagcggtagcgatggaaaataataccctctcggttggctatgcccaaacgcaccttagtgcgttaaagaactctgccagtaaagatcttcgtggcctcgcactaaaatatcgttatgagttcaattctgactggggggtattaacctctcttaccgccactcgtcatgaagtacaaaattacaagtgggacgcggggaagttacataaagatggggataatactaccagctatagttcgttaatgattggaccgacctatcggtttaatgactatattagtttgtatggtaatgtcggcatggcagaaatgaagataaaaaaccgggataatcattcctcttcagaaaatgcttttgcctatggagcaggcgttatttttaatccattaacgaatctttcccttggcctctcatgggaaacggccaaattacttttcgttgatacaaatacatttggtgtgagcgtaggttatcgtttctaa

SEQ ID NO: 5467 - DNA, 630 bp, Klebsiella pneumoniae
agcgcacattatcttcttcggcatcaacagtgcggaagactaccgcacggcgatagaactgggcgccgacggggtgatggtggattctccggcgcaggcgaaaagctggcagtaagggagtcaacggccaaaaaggccgcgaaagcggcctcacattgctggcatgttgttgccgggtggcggctggcgccttacccggcctacaaaaccgaagcagcagccccggcaagcgcagcgcctccgggcacggagccgctttatgccgggtggcggctggcgccttacccggcctacaaaactgaagcagcagtcccggcaagcgcagcgccgccgggcacggagccgctttatgccgggtggcggctggcgccttacccggcctacaaaactgaagcagcaggtccggcatgcgcagcgccgccgggcattacaaaatacgccgctgctgacgctgcgcctcgcgggcgaggcgctttttacgcgcgtcgcacggttgcggacaatcgcagactttctccagccccagcgcggagatcccaccgcagctgccctggatgctcttgcgcttcaccaggtagcccagcgacatgccgaagatcaccagcgcaaaaatcacaaaggtcgcgataa

SEQ ID NO: 5468 - DNA, 462 bp, Klebsiella pneumoniae
atgcgcagttacaggcagtggttagttttcagtaaggctttgttagcgctattgttgctggcaggcatcactccggcgccgtttgctgcggttaacgttgatcgaacccggctcgtcttcgctgctaacgatgttgtccagtcgctgacgctcacaaacgatagcgtgacgccgatgctgttacaggtctggaccgatgccggagagacggcctcttcaccagacagtagccgcacgccgctggtggtcttgccccctgtctttaaaatgcagccggatgagttgagaacgcttcgtgtgatgctgagctcgcgccgtagtttgccaggggatcgggaaagcattttctggcttaatatttaccagatcccccccgagcagaatgcaacagacagcgtcactcgcaaattagtgttacccctgcgattacggttaaaggtatttattcgtccgcacggttaa

SEQ ID NO: 5469 - DNA, 936 bp, Klebsiella pneumoniae
aaaaatgaatattttttcattctcgcttcgataatatcgatacaaagaggaaatatggatctgcgacgcttcatcaccttcaaaactgttgtcgaagaaggttcctttctgcgcgcggcgcagaaactatgctgcactcagtccaccgtgacttttcatatccagcagctggagcaggagcttgccatcccgctgtttgagaaaatcggccggcggatgtgtctcaccgccgccggtaagaaggtcctgccgcatgtctacgacctgactaaagtgatggcctcgattcgtcaggcggcacgccaggacgatgagcccggcggcgaacttcgcgtcgccactggcgaaacgctgctggcgtataaaatgccgcgggtgctgcagcgttttaagcaacgcgctccgaaagtgcgcctgtcgctgcagtcgctcaactgctacagcatccgcgatgcgctgcttgccgacgaggtcgatttgggggtgttttaccgggtgggtaacgatgacgcgctcacgataatggagcttggccagcagtcgctggcgctggtcgcatcggtcgagcaggcgccggtagacttcatgcgcccgcggcagcatatcccgctgagctttatcatcaacgaaccccagtgcgtgttccggcagatttttgaaagcaccctgcgccagcgcgaaattactctggagaacaccattgagctgtggagtattgagagtatcaagcagtgcgtggcgggaaatctgggagtgagttttctgccacgctttgcggtggaggacgagctcaagcgcgggacgctggttgagctgccattcagcgagacgccgttgacgatccatgcgctctgcgcccaccatgccgggaaggctatcagtccggcgatgcgggtatttatgcagtgcatgcaggaggaacaagaggtgcgctga

SEQ ID NO: 5470 - DNA, 1380 bp, Klebsiella pneumoniae
aaacgtgatttatctcacgactacctgcgagaggaaatagtctcatgtgtcatcttcgccgaacgctgctgtttgcagctggcctgcttttcagcaccgcgccctggggctaactgcgttaaggtcacggataatagtttcctttctgaggctgcgattaaagcgggttataccgcgcgctactggcgcggcgcctatgatgacaatatcggtcatcttggtctgccgtcagtcattagcgttagcgccaataacaagttccagccttcaggtactgtgcttgccagcgcagtggctaatttccttaccgccggcgttcagacaccctactcggcaaaacaggtgctttaccgctgtgatttgaaggatgccgggcaactgtacgaattatattctaccaatgccgataacccttttgttggaggacgccgggcgaaagaagttgaaggggcctactatgacgcggaacgtaacgtcgcggtacggatgactaacctgagtactggcgaatactatagccgctactggaagcagcgccagcttactgcggatagttggtttcaggacgatcgcgcaatctatattcccgcaggcgcgtttagtaatgtcctgtatgagatgattaaaatcgccgcctcggatcaatatatttattcggacagaatcaacaaagacctctatacccagccgcgcggttatatcgcctttaaagggccgggcttaataacatccgctgttcagccaggtatggatcatgcttcaagctattatggttggcctgcttattggcccggtgcatggagtagctataatcaggttacctatattcgcggcgcagcttgcaccattgaagattatcctgcgacagtgctgctccccaccatatcagcagaagcgcttacttctggcgaaagcagcgaggcgcctttcagtataacgcttgagtgcgaagccggcgcgatgtcttcaactcaccccacaacccaggtagctaatgtcgccatgggctttttggtcaaccaacctgcggctgttgccgccgcgcgccgcctgggcctgacgaccaccggtggcggattaacctggttactggatacgcattatggcgaaaagggcgtggcttccggagtaggaatacggatttacgatgagcgcggtgcgccgcttaacctgttaccagacaaaacgagttcgggaacgggcaatgcccgtggctggtatgggtataaggagctcacggtacaaaccggcaaaaaagatcatggttcggtggaaatctggcacggtgattttacggcctcccttgaggcgcttggaggacaaacggtaacggtagggagcgtgaatgcgcagttacaggcagtggttagttttcagtaa

SEQ ID NO: 5471 - DNA, 207 bp, Klebsiella pneumoniae
caccttcatctgataaggatattgtgcagattaaaaactgtgaccggtattacgatttccctcggccttatccccattttgcgctatacgccacccgctctgttccgcaactttcaccaccaccttatccccccttccgcattgttaaataattgttgtcagatcacaaaatggaaacaaaaaggccatttcgtacgcattttataa

SEQ ID NO: 5472 - DNA, 510 bp, Klebsiella pneumoniae
  unsure (427): Identity of nucleotide at the above locations are unknown.
tttatgaatcttatcagtattcccgcgtttcaggacaactacatctgggttctcagtgagaataacggccgctgcatcatcgtagatccaggcgaagccgcgccggttctggcggccatcgaggaaaaccagtggcagcccgaggctattttattgacccatcatcatcaggatcacgtcggcggcgtaaaacaattacgtgaaaaattcccttctatagtggtttacgggccggcggaaacccaggataaaggcgtcactcaggtggtaggcgatggcgatcggctgtcaattctcgggcacgatttttccattttctctacgccaggtcacacattaggacatatctgttactacagcgaaacttatctgttctgtggcgatacgatgttttccggcggctgcggaaagctgttcgaaagtacancaaaacaaatgtatcaatcatttatgaaaattaatgcccttcctgaagaaacctcatatgttgcgcacatgaatatacgttag

SEQ ID NO: 5473 - DNA, 885 bp, Klebsiella pneumoniae
aagataaatcaggaagatgtaatcatgaagaaaatacttaccgcgctttgcctgctggccaccgccggcgcctgggccgctccacagctgatagcccaccgcggcggcaccggcgatgcgccggaaaataccctgccggccattaagctggcgctggagaataacgccgaagccatctgggtcacggtgcagttaagccgcgacggcgtaccggtgctctaccggtcaagcgatctttccgcattgaccaatagcgagggcaaagtttccagtttgaccgccggcgagctggcgaaagtcgacgccggctggaaatggggggatgacagccacccgtggcgcggtaagcaggccaccattccgaccttgcaaagcgttttacagcaatggccgcacacttttttctatatcgatatcaaatctccggatgccgatccgaccgtgatgggccagcgcctgcttgaagtgttaaaaaccaccgatagcctcgatcgcgtgcgggtctattccaccgaagaccgctatatcgccgccctgccgccagccatccctcgctttgtcactcgcagtgaaacccgcaccaggcttgccaatatttcgctcagccatcagtgccagccagcgagtcaacgcgatggtgagcagtggtatggactggagctgaagcgcaaagtcgaggtggtggagaaattcacccttggcgaagggatctccccggcgacgctcacctgggataaagaggcaatggattgcttccgctcgcaggataaagcgcacattatcttcttcggcatcaacagtgcggaagactaccgcacggcgatagaactgggcgccgacggggtgatggtggattctccggcgcaggcgaaaagctggcagtaa

SEQ ID NO: 5474 - DNA, 354 bp, Klebsiella pneumoniae; identical to SEQ ID NO: 1586

SEQ ID NO: 5475 - DNA, 2514 bp, Klebsiella pneumoniae
aaacgcatgcactacaaccaatacatcacaagtggtcagacctcctacaagctcagggagcatttctctatgatgattttgagtattgttgcaaccgtcgttttactcggcgcgctcttctatcaccgggtcagcctgctgctcagcagcgtgattttgctcgcctggaccgcggcgctcggcgcggccggagtgtggaatatctggctgctgctgccgctggcgatcatactgttgccgtttaactttgcgcctatgcgtaaatccatgatttccgcaccggcgtttcgcacattccgcaaggtgatgccgccgatgtcgcgcacggaaaaagaagccatcgacgccggcaccacctggtgggaaggcgatctgtttcgcggcaatcctgactggcaaaagttacataactatccgcagccgcggctgaccgccgaagagcaagctttcctcgacggcccagttgaagaagcctgccggatggctaacgacttcgccattacccacgaaatggccgatctgccgccggagctgtgggcctatctgaaagagcaccgcttcttcgcgatgatcattaagaaagagtatggcggacttgagttctccgcttacgctcaggcacgagtactgcagaaactctctggcgtctccggcatcctggcgatcaccgtcggcgtcccgaactcgctgggcccgggcgaactgctgcagcattacggtaccgaagaacagaagaatcattatctgccgcgtctggcacgcggcctggaaatcccttgcttcgctctcaccagcccggaagcgggctctgacgccggcgccatcccggataccggcgtggtgtgcatgggcgactggcagggtcaacaggtgctggggatgcgcctgacctggaacaaacgttatatcacgctggcgcctatcgccaccgtgctggggctggctttcaaactctctgacccggatcgtttgctgggcggagaagaagagctgggtatcacctgcgcgctgatccccacctccaccccgggcgtggaaatcggccgtcgccacttcccgctgaacgtgccgttccagaacggtccaacccgcggcaaagatatcttcgtgcctatcgattacatcatcggcggcccaagcatggccggtcagggctggcgcatgttggttgaatgtctatcggtcggccgcggtattactctgccgtccaacgccaccggtggtctgaaatccgttgccatggcgactggcgcttacgctcatattcgccgccagttcaaaatctccatcggcaaaatggaagggattgaagaggcgctggcgcgtatcgccggtaacgcctatgtgatggacgctgcggcgtcgctgatcacctacggcatcatgctcggcgagaaacctgcagtgctttccgctatcgtgaaatatcactgcacccaccgcggccagcgctccattatcgacgcgatggatattaccggcgggaaaggcattatgctgggcgaaggcaacttcctcgcccgggcctatcagggcgcgcctatcgccatcaccgtggaaggcgcaaacattctgacccgcagcatgatgatcttcggtcagggggcgattcgctgccatccgtacgtactggaggagatggccgccgcgcagaataatgacctgaacgcctatgacaagctgctgttcaaacacatcggccatgtcggcagtaataaagtgcggagtttctggctgggcctgaccggcgggcgcaccagcagcgcgccgacccgtgacgccacccgtcgctactatcagcaaatgaatcgtctgagcgccaacctggcactgctgtcagacgtctcaatggcggtgctcggcggcagcctcaagcgacgcgaacgtatctccgcccgtctgggggatgtgttaagccagctgtacctggcctcggcggtgctgaaacgctatgacgatgaaggacgcaatgaagccgatctgccgctggttcactggggggtacaggacgcgctgcaccaggccgagcaagccattgacgatctgttggacaatttcccgaaccgtctggtggcaggcgtaatgcgcctggtcatcttcccgaccggccgtcatcatcatgcgccgtcggataggctggaccaccaggtcgccaaaattctgcaggtgcccagcgccacgcgctcccgcatcggccgcggtcagtatctgacgccgagcgagcataacccggtaggcctgctggaagaggccctgctggaagtgatggcggccgatcctatccaccagcggatctgcaaagagttgggtaaaaatctgccgttcacccgtctggatgagctggcccacaacgcgctggccaaaggattaatcagtcaggatgaggccgccattcttacccgtgcagagcatagccgtctgcgcagcattaacgtcgacgactttgcgccagaggagctggcgacaaagccggtaaagctgccggaaaaagttcgtaaagttgaagctgcataa

SEQ ID NO: 5476 - DNA, 1227 bp, Klebsiella pneumoniae
cacgctgcgcagcgccgggccatattcatactttccagggcaaacataggtgcacagcgccagatcttcttcatccagctccagacagcccagcgcctgagcgctgtcggtgtctccggccagcagatcgcgcagcagtatggtcggcaggatatccagaggcatcacccgctcgtagttgccgatcggcaccatcgcccgctcgccgccgttggtatcggtggaaaaatgaaagcgcttgcgcttgaagaaatggcccagcgtggtgcgggtaatcgagaatttctctttgcccggcatcacccagccgaagagctctttttcccgcccttctttgaccacgctcacctgcagatggaagcgccccaggaaggcgtgagggccatgggcgcgggcgccgctaagcaccgagccggaaatgaccctgttttccccctcctgcaactcacctgccagcagatcctccaggctggcgccgagcgtcgttttgaccagccgcggagatgttacctgcgggccgccgagcgcaattatccgttcgcagtagagctccccgtcgaggaaaagcttaccaatggcgatcgcgtcctgataattgaggtgccagacctgcttattcaggctcaccggctccaagaagtgaatatgcgttcccggcagccccgccgggtgcggcccgctgaactgattgaaacagacctggccgagaggatgaccgcccagcttgccgccgctgggctggcagacgtgcactttcccgtcggtcaagcgcgtgagcacggtaagaccggcgtcgaaggcggcacgttcggccagaataatcggctgcggctccgccgccagcggattggtgtccatggcgttaacaaagatagcggcgggcgtgctccccgggagcggcgttttgctgaacggtcgggtacgcagcgccgtccattggcccgacgccagcagctgctgctgtacggtgtcgcgcggcagttcggccagcgcgtccgcggcgtaacgggtaaacgccaccgcgtcattgccctcgatatcaatcaccaccgactgcaacacgcgccgttcgccgcggtggatcgcgctgacgatcccgctcgccggggcggtaaagcagacgccagggatctttttatcttcgaacaggatctgaccttttttgacccgatcgccttctttaaccgccatcgcggggcgcatgccaacgtactcttcgccgagtag

SEQ ID NO: 5477 - DNA, 426 bp, Klebsiella pneumoniae
atgatggggcaactgtcgcaatcacaggatttaggggcggggctgaagtcgcgccacgtcacgatgttatctatcgccggggtgatcggcgcgagtttatttgtcggctccagcgtcgccattgccgaggcaggcccggcggtgctgctggcctatctgtttgccgggctgctggtggtgatgattatgcgtatgctggccgaaatggcggtcgccacgccggataccggctccttttccacctacgccgataaagccatcggccgctgggcggggtataccatcggctggctgtactggtggttctgggtcctggttattccgctggaagccaatatcgcggcgattattctgcattcgtgggtgccgggcgtcccggtgtggttgttctcccctggtcatcactctcgccctcaccggcagtaa

SEQ ID NO: 5478 - DNA, 456 bp, Klebsiella pneumoniae
tttattgctaaattctattggtttggtaaaacagttgcatcactaaaggagatcgcaatgacgttaccgagtggacacctgaaaagtaagttgatcaagaaattcacggcgctggggccttacattcgcgaagagcagtgccatgacaaccgtttctttttcgattgcctggcagtttgcgtcaatgttaagcccgcaccggagaagcgtgaattctggggctggtggatggaaatggaagcacaagagtcacgtttcacctatagctaccagtttggcctgttcaataaggaaggatcatggcaggcggtcgacattgacgacccggaagtgagcgacaggctggaaaaaacgctgcgcgagtttcacgagcgcgcagcagcgctgctgaccacctttaatctgaagctggaaccggccgacgatttcagcgagccggttcgcctgcgggcctga

SEQ ID NO: 5479 - DNA, 594 bp, Klebsiella pneumoniae
aggattatcctcatgtaccaggatcttattcgtaacgaactgaacgaagccgcggaaacgctggctaactttctgcaggacgaagccaatatccatgctatccagcgtgccgctgtcctgctggcggatagctttaaggcgggtgggaaagtgctgtcctgcggtaacggcggttcccattgcgatgcgatgcattttgcggaagagctgaccggacgttatcgcgaaaaccgcccgggttacccggccatcgcgatctccgacgtcagccacctctcctgcgtgagcaatgattttggctatgagtatgtgttctcccgctacgttgaatccgttggccgcgcaggcgatgtgctgctcggtatctccacgtctggcaactccggcaacgtgattaaggccattgaggccgcgcgggcgcaggggatgaaagtgatcaccctgaccggtaaagacggcggtaaaatggccggtagcgctgatgtggaaattcgcgtgccgcactttggctacgccgaccgcatccaggagatccatatcaaagtgatccacattctgattatgctgatcgaaaaagagatggcgaaaggctaa

SEQ ID NO: 5480 - DNA, 783 bp, Klebsiella pneumoniae
ggacaagacaacatgacaacacgctctcaccatgacaacgtcgaaaagcagttcggctcccaggccagcgcctatctgaccagcgccgtacacgcctctggtcgcgatctgcagcggctggcggaacggctggctgattttcctcaggcgaaagtgctggatatgggctgcggggcagggcacgccagttttaccgcggcgggacaggttgccgaggtgaccgcctatgatttatcgagccagatgctggaggtcgttgccgccgcggcaaaggagaaaggttttagcaatatcgtgacccagcaagggtacgccgaaacgctgccgttcgctgatgtcagctttgatgtggtgattagccgctactccgctcaccactggcatgacgttggccaggcgctgcgtgaggtgaaacgtgttctcaagccgggcggggtgattatcatgatggacgtgatgtcgccgggtcatccggtacgtgatgtctggctgcagacggtggaagccctgcgcgacacctcgcatgtgcgtaattattccagcggcgagtggttgacgctggcgactgaagcggggctggtggttaaccagttgttgaccgatcgcctgccgctggagttcagttcatgggtggcgcggatgcgtactcctgagccgctggtggaggcgattcgcttatatcagcagagcgcttcggcggaggtcaaagcgtacttcgagttacaggaggacggatcgtttaccagcgataccattctgttcgaagcgcataaagcggtttaa

SEQ ID NO: 5481 - DNA, 291 bp, Klebsiella pneumoniae
cctaaccccctcatgagaatggagttgaccattgtgcctggcctgaaaatttcgctgttgcaacaaccgctggtctggatggacggccttgccaacctgcgccattttgatcgccaactggaaggaatcaccgggcgccgatgtgattgttttaccagagatgtttaccaccggctttgccatggaagcggcaaaacagtctttacccgaggccgacgtggtggagtggatgcatgcccgggctgcgcaatcccaggcgctgattgccggcagcgctgcgctgcaaactga

SEQ ID NO: 5482 - DNA, 774 bp, Klebsiella pneumoniae
tggtttaacctgaacgacgcattcttaacagaaggtcttatgagtaagaaaaaatacctaattgataagaaagtcattcttgattgcgaaaagatgacgctgtcgtgcgatcgcgaaagcttgagaatttctgaatccgaatgcaatttgcttattgctttccatgaagggttatttaagaaggatgacttaattgcctgggtatggggacgaaaaggcgttgtggtttccagtgcgagctattataaattaatcaaccagttacgcggttcatttgaaaaggtcggccttcccccttcagcggtattaacgcgtcctaaggtcggcgtaacgctctcggtatccatcgaatcattgcctgatgcttcaacatccgcaatgcaaaatatcgccagctataccgttgcgccagttgcagacgcgtcgccagaaccaacgcaaatttctcagtttaccatcaggaaagaatggttttttttaatcggcgcaacgttattctttctggtaatgatttatatataccacaacagtaagccagattatttttctgaattgggaacctataacggatataccttttacggtgttacagaggataaccgtactcttgaggatgcggtgggggctttttccgagttgagcccgcaagtctataagcaaaatggcaattttatttattatattcgtgtccctaataccaatatttttgttcagtgtctgaatcaactgaatgtttcggagcccaaatgcatcactatcaaagaacggtactga

SEQ ID NO: 5483 - DNA, 1386 bp, Klebsiella pneumoniae
gcaactattgacacacacatgaaggcacgagcgatattactcgcctctgtcctgctggtggggtgccaggcgtctaagcacgatggcaccgtcgaacagcgagcacagagcctttctgcggctggtcaaggggaagcaggcaagttcacaagtcaagcgcgctggttagatgatggaaccttctacgcgcaagaccaggatctgtggacttccataggcgacgagctaaagatgggaataccggataatccccggattcgcgaacagaaacagaagtacttaagaaataagagctatctccacgatgtaactttacgggcagagccgtatatgtactggatagccgggcaggttaagaaacgtaacatgccaatggaactggtattactacccatagtggagagcgcttttgacccacacgcgacgtctggcgccaatgccgcaggcatttggcagatcattccgagcacagggcgcaattatggtttaaaacagacccgcagttacgatgcgcgtcgtgatgtcgtcgcgtctactaccgcggcgctggacatgatgcaacgtctgaacaaaatgttcgacggcgactggttgttaacggtcgcagcctataacagcggcgaaggccgggtcatgaaggcagtaaaagcgaaccgttcgcgtggcaaacccaccgatttctggtcgctgtctctgccgcatgaaacgaaaatctacgtcccgaaaatgctggcattgagcgacattctcaaaaacagcaaacgttacggcgtaaagctgcctacggctgatgaaagccgtgcgctggcgcgcgttcgcctcgacagtccggttgatatttctcagctcgcggacatggccggtatgccggtcagcaagctgaagacgttcaatgcgggcgtaaaagggtcaacgctgggcgcgagcgggccaaagtacgtcatggtgccgcagaagcacgccgcacagctgcgtgaatcgctggcctctggcgacattgccgccgtgcagccgacgcagctcgcggacaatacgccgctgaccagccgtagctataaggtgcgttccggcgacaccatttccgggattgcttcccgtcttggtgtgacgacccgcgatctgcagcagtggaataacctgcgcggctctggattaaaggttgggcagaatctggttattggcgcaggcagcagcgcccagcgtctggcgaacaacagcgatagcatcacctatcgcgttcgtaaaggcgattcgctgtcgagcatcgccaaacgtcacggcgttaatattcgcgacgtgatgcgctggaacagcgataccgacaacctgcgcccaggcgatcagctaacgttgtttgtgaaaaataacgatcgaccagagtcctga

SEQ ID NO: 5484 - DNA, 357 bp, Klebsiella pneumoniae
ctcgattctgaaacacaacccgcacgattcttccagacgaaatcaatgatatcctcttttttatatataccgcgatggaaggcaagaagtaggtttgtctccgactcagagattttaataatcttattaccattagccaatgtcattctggcactatcaaatatcacctttttagcgattaacaacaactcttcatccatggaaaatccgttcttcaatacacttactctgtcgcctgtcatattaacacagggtgaaatgatttcacccaccttaacattcgcaatcttttcacaaaacacagtcactaacatcaactctgctacccttattgcttactcttcaccaaatcaataa

SEQ ID NO: 5485 - DNA, 642 bp, Klebsiella pneumoniae
ataatggctgaacagagcgatatgaaagaggtgaagcgcgtgctggtggggccgctcatcgccaataaccccatcgccctgcaggtgctgggcgtctgctccgcactggcggtaaccaccaaactggaaaccgccttcgtgatgaccattgcggtgaccctggtgacggcgttctccagcatgtttatctcgatgatccgccaccatattcccaatagcgtgcgcatcatcgtgcagatggcgatcatcgcctcgctggtgatcgtggtggatcagctgctgcgggctttcgcctatgagacctccaaacagctgtcggtattcgtcgggcttatcatcaccaactgcatcgtgatgggccgcgccgaagcctacgccatgaagtcgccgccgctggcgagctttatggatggtattggcaacggtctcggctatggcgcgatcctgattatcgtcggcttcctgcgcgagcttatcggtagcggcaagctgttcggtatcacggtgctggagacggtgcagaacggcggctggtatcagccgaacggcctgttcctgctggcgccgagcgcgttcttcattatcggtttgctgatctgggccctgcgtagctggaagcctgagcagcaggaaaaggagtaa

SEQ ID NO: 5486 - DNA, 795 bp, Klebsiella pneumoniae
ccgtcggacctttttgatagcaatggagttgttgcgatgaaaaaggatgccccccgttcagggctacgctatctggtgctgctgatagccctgttctttcccgttaccggggcctgggccagcgttaccattgtaggcagtcggattatttatccatcgaccgtcgcctcagtcgatgtacagctaaaaaataacgatgactttccctatatcgtacaaacctggtttgacaatggcgatctgcatattgggccggagaacgcgagcggcattccttttatctctacgccgccagtatttcgaatccaaccgaaatcagggcagattgtccgcgttgtctatagccagcgtaaagcgctgccgcacgatcgtgaatcggttttctggttcaacgcgttgcaggtaccgccagccaatataggtggccgccagcaaaataaagtgctggtgatgcttaggacgcggatcaaactcttctatcggccggaaggcattggttcaccaggtaatctggcgaaaaaactgcacatcaccgtggtgcgtaatgcccgaaaaggcgccggtattgtcatcagcaatccgcaaccctggtatgcctccctcagtaatctgagcgtgaaagtaaatggtacttcacgcgagcttaatgtcgacatggtcccccctttttccagtcgcactttctggataccgggaaacgtcagcgccaattcacttaacggtaccgtcactgtgacggtggttaacgaccagggtgcaaggataagcgagcgttatcatgtcgctgaaggttaa

SEQ ID NO: 5487 - DNA, 1236 bp, Klebsiella pneumoniae
gtaatcttcgatgccgtacttcgacccttcgcggccgaggccggaggccttaacgccgccgaacggcgcgacttcggtggagataatgccggtattgatgccgattatgccgtactccagcgcttcgccgacgcggaagacgcggctcagatcgcgggcgtagaaataggcggcgagaccgaactcggtatcgttggcctgggcaatgacgtcggcttcatctttaaagcggaacagcggggccagcgggccgaaggtctcctctttcgccactttggcgctgtcgggaacgttgaccaggatggtcggctggaagaagttgccacccagggcgtgcggtttgccgccggtgaccaccttcgcgcctttggcgatggcatcggcaatgtgttcttcaactttggccacggctttctcgtcgatcagcgggccggtggtgacgccgtcctgcaggccgtcgccaatgcgcagtttttccaccgcctgctgcagcttctcggcgaaacggtcatacaccccgtcctggacgtacaggcggttggcgcagacgcaggtctgtccggcgttgcggaacttcgacgccagcgccccctcgacggctttatcgaggtcggcatcgtcaaagacgataaacggcgcgttgccgcccagctccagggagacttttttgatgtctttcgcgcactgctccatcagctggcggccaatctcggtagagccggtaaaggagagcttgcgcaccagcgggttgctggtcagttcgccgccgaccgcgccggcggagccggtgaccacattgaacactccggcggggatcccggcgcgattcgccagttcggccagcgccagcgcggaaaacggcgtctggctggccggtttcaggaccatggtgcagccggcggccagcgccgggcccgctttgcgggtgatcatcgccgccgggaagttccacggcgtgatggcggcggtaacgccgatgggctgcttaatcaccagcaggcgcttgtcggcctggtggccgggaatggtgtcgccgtagatgcgcttaccttcttcggcgaaccactcaataaaggaggcggcgtagctgatttcgcctttggcttccgccaacggttttccctgctcgagggtcatcaggcgagcgagatcgtcctgattctccatcataagatcgaaccagcggcgcagaatgttcgcccgctctttggcggtcagggcgcgccaggcgggtag

SEQ ID NO: 5488 - DNA, 771 bp, Klebsiella pneumoniae
tctatgtgcgaactgctcgggatgagcgccaatgtgccaaccgatatctgttttagctttaccgggctggtgcagcgcggcggcgggacggggccgcataaagacggctggggcatcaccttctatgaaggtaaaggctgtcgcacattcaaggatccccagccgagctttcagtcgccgatcgcgaaactggttcaggattaccccattaagtcctgttccgtcgtcgcccatattcgtcaggccaaccgcgggagggtggccctggagaacacccatcccttcacccgcgaactgtgggggcgcaactggacctatgcgcacaatgggcagctaaaaggctataagtcgctgaaaaccggtaattttcatccggtaggtgaaaccgacagtgaaaaggcgttttgctggctgctgcaccgtttaaccgagcgctatccgcgcacgccgggcaatatgctgggcgttttcaagtatatcgccaccctcgcgggtgaactacgtgagaaaggggtgttcaacatgctgctgtcggacgggcgctacgtaatggcgttctgctcgaccaatctgcactggataacccggcgagcgccgttcggcgtggcaaaactgctggaccaggatgtggagatcgactttcaacgcgagaccacacccaacgatgtggtcacggttatcgccacgcagccgctgacggccaatgaaacctggcataagatcatgccaggcgagtgggcgttattttgtctcggggagcgtgtagtttga

SEQ ID NO: 5489 - DNA, 378 bp, Klebsiella pneumoniae
tatttaccagatcccccccgagcagaatgcaacagacagcgtcactcgcaaattagtgttacccctgcgattacggttaaaggtatttattcgtccgcacggttaaaaggccccaccagcaacgatgagcggaaattacgcttcagtatcgcttcgcagggcatcacgataaccaatccgaccccgtggtatatgagcctggctgtcgcgccgataaagggaataagtatcggtaacatcatgctcgcgccctatgagcagcgcgatgtcgcgctttctaatatgccagcggtggggtcaacagtagactatgcggtgattaatgattcggggaactggcggacctataccgcaaccattatggataaagaaatttga

SEQ ID NO: 5490 - DNA, 618 bp, Klebsiella pneumoniae
tgtctgccagacaagaggagaaaacccgtgacacctaccctgataagcgcctttttaacttacactttgatcaccgccctgacacccgggcccaacaatatcctggcgctgagcagcgtcacctcccatggtctacgccgcagcctgcgggtgctggccgggatgagcgtcgggtttattatcactatgttgatttgcgcggctttaaccttttcgctggttgaactcgactcacgctttaccctggtattgggatggattggcgcggcgtacatcctgtggctggcctggcagattgccaaaagcaaaccggcgacagggacgccgagtgtagaaccggtaggcttttgggcgagtctggggctacagttcgtcaacgttaaaattattctgtatggcatcaccgcgctttctacctttgttctgcccgttactcgcgagcctgtttggcttatcagcgtgagtctgctgctggcggcgattggcgcgctgggaaatctgtgctgggcgctggcggggcatctgtttcaacgcctgtttttgctgtacgggcggcaactgaactggatgctggctgcgttattggtctactgtgctgtgcggatcgtggtggaataa

SEQ ID NO: 5491 - DNA, 1194 bp, Klebsiella pneumoniae
attatgccactggcgctatttgccttaaccatcggtgccttcgcaattggcaccactgaatttgtgattgtcggcctggtcccgaccattgctcagcaactctctatctccctgccttcggcgggactgctggtctctatctacgcgctgggcgtggcgatcggcgccccggtactgacggcgttgaccgggcgtatgccgcgtaaacagctgctgctggcgctgatggtgctgtttacggcgggtaacatactggcctggcaggcccctggctatgaaacgctgatcctggcgcgactgctgactggtctggcgcacggcgtgttcttttctatcggctcgacaatcgccaccagcctggtggcaaaagagaaagcagcctcggccatcgccattatgttcggtggcctgacggtcgcgctggtgaccggcgttccctttggcacctttattggccagcatttcggctggcgggaaaccttcctcgcggtatcgattctcggggtgattgcgctaatcagcagtctgattctggtgccgaataacattccgggccgcgccagcgccagcctgcgcgatcagctgaaagtattaacccatccgcgcctgctgatgatctacgccattaccgcgctgggctatggcggcgtgtttaccgcttttaccttccttgcgccgatgatgcaggagctggccggcttcagcccgtcagcggtgagctggctcctgctgggctatggtgtctcggtggctataggtaacgtgtggggcggcaaactggccgataagcatggcgccgtctccgcgctgaagtttatcttcgctgcgctggttgtgctgctgctggtcttccagctgaccgccagcgttcactatgccgcgctggcgacagtgctggtgatgggcgttttcgccttcggcaacgtgccgggtctgcaggtctatgtggtgcaaaaagcagagcagtataccccgggggctgtcgacatcgcttccggcctgaatattgccgcctttaacgtcggcatcgcgctggggtcgatcgtcggtggacagacggtcgagcggtacggtctggcgcagacgccgtggattggcgcgatgattgtgctggtcgctttgctgttggtggtcctgagcggacgtttagataaattgccacgccgttcggcagcgctttctcccgaaggctaa

SEQ ID NO: 5492 - DNA, 1506 bp, Klebsiella pneumoniae
ccctcgtcctgcaaccgctgtatgcaggagtctgtaaggagacttaccgtgtctgaactgtctcaactatccccgcagccgctttgggatatttttgccaagatttgctccatcccgcacccgtcctatcacgaagaacagctcgccgagcacattatgggttgggcaaaagaaaaaggcttacatgcggaacgcgaccaggttggcaacattctgattcgtaaaggcgcgactgccggtatggaaaaccgtaagccggtagcgctgcaggcgcacctcgatatggtgccgcagaaaaataacgacaccgtccacgacttcgttaaagatccgatccagccgtacattgacggcgaatgggtgaaagcgcgcggcaccacgctgggcgcggacaacggtatcggaatggcgtccgcactggcggtactggccgatgatagcgtcgctcacggcccgctggaagtgctgctgaccatgaccgaagaagccggtatggacggcgcgttcggtctgcaggccaactggctacaggccgatatcctgatcaacaccgactccgaagaagaaggcgaaatctatatgggttgcgccggcgggatcgatttcacctctaacctggagctgacccgcgaagcgattcccgccgggttccagagctttaaagtcaccttaaaagggctgaaaggcggccactccggcggtgatatccaccttggtctgggtaatgccaacaagctgctgtcgcgcttcctcgccggccacgccgatgagctggatctgcgtctggtcgatttcaacggcggcacgttgcgcaacgccatcccgcgtgaagcttacgctactgtcgccgtcgccgcggataaagccgatgcgctgaaagcgctggtgaatacttaccaggcgctgctgaaaaacgagctggaggccaaagagaagaacctggtggtgctcgtggaagcggtcgataacgacaaagcggcgctgactcaggcttcccgcgacaatttcatccgtctgctgaacgccacgccgaacggggttatccgcaactctgacgtggcgaaaggcgtagtggaaacttcgctgaacgtcggcgtcgtcaccatgaccgatgacaacgtacagatccactgcctgatccgctcgctgatcgacagcggcaaagactacgtggtcagcatgctggattctctgggtaagctggcgggggcgaaaaccgaagccaaaggcgcttaccctggctggcaaccggacgccaattcgccggtgatgcacctggtgcgcgagacttaccagcgtctgttcaacaagacgccgaacatccagatcattcacgccggtctggaatgcggtctgttcaaaaaaccgtatccggagatggacatggtctccatcgggccaaccattaccggtccgcactccccggatgagcaggttcatatcgagagcgtcggtcagtactggacgctgctgaccgagctgctgaaagccattccggctaaataa

SEQ ID NO: 5493 - DNA, 759 bp, Klebsiella pneumoniae
aaatttcgctgttgcaacaaccgctggtctggatggacggccttgccaacctgcgccattttgatcgccaactggaaggaatcaccgggcgccgatgtgattgttttaccagagatgtttaccaccggctttgccatggaagcggcaaaacagtctttacccgaggccgacgtggtggagtggatgcatgcccgggctgcgcaatcccaggcgctgattgccggcagcgctgcgctgcaaactgaacacggcgctgttaaccgcttcgtgctggtcgagcctgacggtacggtgcaccattatgataaacggcacctgttccgtatggccgatgaacatcatcactatgaggccggaaaccagcgcgtggtctttgaatggcgtggatggcggatcctgccgctggtctgttacgacctgcgctttccggtatggtcgcgtaatcagaacgactatgatttggcgctgtatgtcgccaagtggccggcgccgcgctcgctgcactggcagtcgctgctgatcgcccgcgcgattgaaaaccaggcctatgtcgccggctgtaaccgggttggcactgacggcaacggccatcattaccgcggcgatagtcggattatcaatccccagggggagattatcgccaccgccgatccgcatcaggccactcgtcttgatgccgagctgtcgctgagcacccttcaggaatatcgtgaaaaattccccgcctggcgcgatgccgatcctttcacgatcggctaa

SEQ ID NO: 5494 - DNA, 1221 bp, Klebsiella pneumoniae
ttatgcgtatgctggccgaaatggcggtcgccacgccggataccggctccttttccacctacgccgataaagccatcggccgctgggcggggtataccatcggctggctgtactggtggttctgggtcctggttattccgctggaagccaatatcgcggcgattattctgcattcgtgggtgccgggcgtcccggtgtggttgttctcccctggtcatcactctcgccctcaccggcagtaacctgctgagcgtcaagaactacggcgaattcgagttctggctggcgctgtgcaaagtgatcgctattctggcgtttatcgtactgggcgcggtcgccattaccggcttttatccctatgccgaagtgagcggcatttcgcggctgtgggatcacggcggctttatgcctaacggcttcggcgcggtgctgagcgcgatgctgatcaccatgttctcgtttatgggcgcggagatcgtcaccattgccgccgccgaatcggataccccggataaacatatcatgcgcgccaccaactcggtgatctggcgtatctctattttttatctgtgctcgatctttatcgtcgtcgccctcatcccatggaatatgccggggctgaagagcatcggctcctaccgctcggtgctcgagctgctgcatattccctatgccaagctgattatggacggcgtgatcctcctgtcggtcaccagctgtctgaactcggcgctgtataccgcctcgcggatgctctactccctgagccgtcgcggcgatgcgccggccattatgggccggaccaaccgcagcaaaacgccatacgtggcggtgctgctctccaccggcgcggcgtacctcaccgtagtggtgaactactatgcccccgccaaggtgtttaaatttctcatcgacagctctggcgccatcgccctgctggtctatctggtgatcgccgtttcacaactgcggatgcgcaaaatccttcaggcgcaaggcggcgagatccgtctcagaatgtggctctatccatacctgacctggctggtgatcgcctttatcaccttcgtgctggtggtgatgctgtttcgtccggcgcagcagctggaggtgatctctaccggcctgttagctctgggaattatttgtacggtaccgattatgtcacgctggaaaaagctggtattgtggcaaaaactgccgctgcaaaatacgcgttaa

SEQ ID NO: 5495 - DNA, 366 bp, Klebsiella pneumoniae
gcagcccatcggcgttaccgccgccatcacgccgtggaacttcccggcggcgatgatcacccgcaaagcgggcccggcgctggccgccggctgcaccatggtcctgaaaccggccagccagacgccgttttccgcgctggcgctggccgaactggcgaatcgcgccgggatccccgccggagtgttcaatgtggtcaccggctccgccggcgcggtcggcggcgaactgaccagcaacccgctggtgcgcaagctctcctttaccggctctaccgagattggccgccagctgatggagcagtgcgcgaaagacatcaaaaaagtctccctggagctgggcggcaacgcgccgtttatcgtctttga

SEQ ID NO: 5496 - DNA, 738 bp, Klebsiella pneumoniae
ccctgttcccggcgcccgccgggaagagtattcaggagtaagaacatgaccgccattcaccaggcgacggccattgacgggtaccgttggttaaaaaacgacatcatccgcggggtttaccaacccgatgagaagctgcggatgagcctgctgacgtcacgctatgccctgggggtcggtccgctgcgcgaggcgctttcgcaactggtggccgagcggctggtgacggtggtcaatcagaaaggctatcgggtggcgcccatgtcggaacaggagcttctcgatatcttcgacgcgcgcgccaacatggaggccatgctggtgcgtctcgccattgagcgcggcggcgacgagtgggaagccgagctgctggcccgcgcccatctgctcaacaagctggagtcgtgcgaagcgagtgagcacctactcgatgaatgggaccagcgccatcaggcgtttcacaccgccatcgtcgccggctgcggttcgcagtatctgctgcagatgcgcgaacggctgttcgatctggcggcgcgctaccgcttcatctggctgcgcaccaccgtgctgtcggtggagatgctggaagataagcatgtccagcatcagaccctggtggacgctattctggcgcgcgacgccgaacaggccagcgcgctgatgcgtgagcacttactgactccgatcccgattattcaacaggcgatggctggcaagctgtcgccgcaggcaggctga

SEQ ID NO: 5497 - DNA, 372 bp, Klebsiella pneumoniae
tttctgcgccgcgcgcagaaaggaaccttcttcgacaacagttttgaaggtgatgaagcgtcgcagatccatatttcctctttgtatcgatattatcgaagcgagaatgaaaaaatattcatttttttaaattatcagcttcgggtagtgtctgccagacaagaggagaaaacccgtgacacctaccctgataagcgcctttttaacttacactttgatcaccgccctgacacccgggcccaacaatatcctggcgctgagcagcgtcacctcccatggtctacgccgcagcctgcgggtgctggccgggatgagcgtcgggtttattatcactatgttgatttgcgcggctttaaccttttcgctggttga

SEQ ID NO: 5498 - DNA, 471 bp, Klebsiella pneumoniae
gtggcggaacggacgggactcgaacccgcgaccccctgcgtgacaggcaggtattctaaccgactgaactaccgctccaccgaatttcttcgctttattaccaccggttgtcaccccggcttactgcaatttgatgcctggcagttccctactctcacatggggagaccccacactaccatcggcgctacggcgtttcacttctgagttcggcatggggtcaggtgggaccaccgcgctagtgccgccaggcaaattctttgtgctcagtacgcaattctttatcgcatcagctgcgttgcctgcgctcgtaaagtcagtcacatacttcagtatgctccttcctttccgtcgcttgtcgccttgctgctgcgcaaattattgcgtactcaactctgaatctaagctgaaaattctctcaatccgccaaaacatcttcggcgttgtaaggttaagcctcacggttcattag

SEQ ID NO: 5499 - DNA, 1296 bp, Klebsiella pneumoniae
caggagcgacggatgaacagcaataaagcaatgatggcgcgtcgcagcgacgcggtcccgcgcggcgtcggccagatccaccctatcttcgccgaacgcgcggagaactgccgggtgtgggacgtggaaggccgggaatatctcgattttgccggcggtatcgcggtgctcaataccggccacctgcatccgcaggttgtctccgccgtcgaagaccagctgaaaaagctgtcgcatacctgcttccaggtgctggcctatgagccttatctggcgctgtgcgaaaagatgaatcaaaaggtgcccggtgatttcgccaagaaaaccctgctggtcaccaccgggtcggaagcggtggagaacgcggtgaagatcgcccgcgcggcaaccgggcgcagcggcgctatcgccttcaccggcgcctatcacggccgcacccattacaccctgtcgctgaccggcaaagtgaatccttactccgccggtatgggcttaatgccgggccatgtctatcgcgccctctacccgtgcgcgctgcacggcgtcagtgatgacgaggcgatcgccagcatccatcgcatcttcaaaaacgatgccgcgccggaagatatcgccgccatcattattgagccagtgcagggtgaaggcgggttctatgccgcctccccggcctttatgcagcgcctgcgcgccctgtgcgacgagcacggcattatgcttatcgccgatgaggtccagagcggcgcgggccgcaccggtaccctgttcgccatggagcagatgggcgtcgcggcggatatcaccaccttcgccaaatccatcgccggcggtttcccgctggcgggcgtcaccggccgcgcggaggtgatggacgccatcgcccccggcggactgggcggcacctacgccggcaaccccatcgcctgcgccgccgccctggcggtattacagattttcgagcaggagaatctgctggaaaaagccaaccagctcggcgacaccctgcgccagggcctgctggcgatcgctgaagatcatccggagatcggcgacgtgcgcggtctgggggcgatgatcgccattgagctgtttgaagagggcgaccgcagcaggccgaacgccaggctgacggcggatatcgtcgcccgcgcccgcgacaaaggcctgatcctgctctcctgcgggccgtactacaacgtgctgcgcatcctggtgccgctgaccatcgaagaggcgcagatcgagcaggggctcaagatcatcgccgactgctttagcgaggcgaaacaggcatag

SEQ ID NO: 5500 - DNA, 546 bp, Klebsiella pneumoniae
gcgccgcggcggacggggcgtgcgcctggttgggctccacgtgacgttgctcgatccgcagctggaaaggcagcttttattagggatttagccatgcatattcgtgcttaccgcgacagcgatttgccactgctctgccagatctttctgcgcgcggtgcgggaaaccgccagtcgggactataccccggggcagatcgcggcctgggcgcaggtggatgagacgcgctggcgacaaaagctggccgactcaatcggcctggtggccgtggtcaacagccagccggttggctttatcaccgccatcgggacgcatatcgatttgctgttcgtctcgccggatcgtgcccgccagggtatcggcggcgcgcttatcgaggcgctctgcgctcagtatccagcgcaaatcctgacggtggacgccagcattaccgcaaagccctgttttacggcccatggttttaaggtggtggctgagcagcaggtggcggcgcgcggggagtggtttattaattaccggatggaaaaacgcgtggcgctaaggtga

SEQ ID NO: 5501 - DNA, 879 bp, Klebsiella pneumoniae
tcgctctttttcccctccacaccatcagccataatttcatccgttaaccgaaatgaagaaataacgaggaaaatcatggcaatccctgcatttggtcttggcaccttccgtctgaaagatgatgttgttatcgcatccgtaaaaaccgcgctggagctgggctatcgtgctatcgacaccgcgcaaatctatgacaacgaagccgcggtgggtcaggctatcgccgaaagcggcgtgccgcgtaatgagctgttcatcactaccaaaatctggatcgagaacctgagcaaagacaaactcatcgccagcctgcaagaaagtctgcagaagctgcgcacggactatgttgacctgacgctcatccactggccatcaccgaacgatgcggttgccgttgaagagtttatggcagccctgatggaagcgaagaagctgggtctgacccgtcagattggtatctccaacttcactattccactgatggagcgcgcgattgccgccgttggcgctgaaaacattgcgaccaaccagattgaactctcgccgtatctgcaaaaccgtaaaatcgtcgactgggcacgtgagcacggcatccacatcacctcttacatgacgctggcttatggtaaggcgctgaaagatgaagtgattgcccgtatcgcggcgaaacataatgcgactccggcgcaggttatcctggcatgggcgatgggcgaggggtacgcggtgatcccgtcctcgacgaagcgtgataacctggctagcaacctgaaggcgctggatctgcagttggatgatgaagatcgacaggcgatcgctgcgctggattgcaacgatcggctggtgagcccggaaggtctggcgccgcagtgggattaa

SEQ ID NO: 5502 - DNA, 270 bp, Klebsiella pneumoniae
acaggtttcagtatgaatttatcccgtcaggaacaacggaccttacacgttctcgccaaaggtggccgtattgcgcacgtccgcgatacctccggccgcattaccgccgttgaatgctacacccgcgaagggctgttgctgagcgactgcacccttgcggtcttcaaaaagctcaaaaccaaaaagctgattaagtcggtgaacggccagccgtaccggatcaacacgaccggtttgaataacgttcgcgcgcaagcggacaaccgctga

SEQ ID NO: 5503 - DNA, 249 bp, Klebsiella pneumoniae
gtgccgcccagtccgccgggggcgatggcgtccatcacctccgcgcggccggtgacgcccgccagcgggaaaccgccggcgatggatttggcgaaggtggtgatatccgccgcgacgcccatctgctccatggcgaacagggtaccggtgcggcccgcgccgctctggacctcatcggcgataagcataatgccgtgctcgtcgcacagggcgcgcaggcgctgcataaaggccggggaggcggcatag

SEQ ID NO: 5504 - DNA, 306 bp, Klebsiella pneumoniae
tcgcgcaggctggcgctggcgcggcccggaatgttattcggcaccagaatcagactgctgattagcgcaatcaccccgagaatcgataccgcgaggaaggtttcccgccagccgaaatgctggccaataaaggtgccaaagggaacgccggtcaccagcgcgaccgtcaggccaccgaacataatggcgatggccgaggctgctttctcttttgccaccaggctggtggcgattgtcgagccgatagaaaagaacacgccgtgcgccagaccagtcagcagtcgcgccaggatcagcgtttcatag

SEQ ID NO: 5505 - DNA, 1236 bp, Klebsiella pneumoniae
gggcgaataagtatggaaattattcttggcgtcgtgatgttcacgctgattgtgctggtgctgtcggggcttatcctggcagcgcgctcaaagctggtgaacgcgggcgacgtggttattgagatcaataacgaagcggataaacagatccgcaccccggcgggtgacaaactgctgaacacgctgtccagcaacgggatcttcgtctcctccgcctgcggcggcggcggctcctgcggccaatgtcgggtaactgttaaagagggcggcggggatatcctgccgaccgagctttcgcatattaccaagcgggatgccaaagccggttgccgtctggcctgtcaggtggcggtgaagcagaacatgaagattgaactgccggaagagattttcggcgtcaaaaaatgggagtgtgaagttatctctaacgataacaaagccactttcattaaagagctcaagctgcggatcccggagggggaggtggtgccgtttcgcgccgggggctatattcagattgaatgcccgccgcataaagtggcctatgcagattttgatgttcccgatgaataccgttcagactgggataagttcaacctgtttcgctatgtctctgaggtgaaagagccgaccctgcgcgcctactcaatggctaactatccggaagagaagggcatcattatgctcaacgtgcgcatcgcgacgccgccgccgaaggtcccggatgcgccgccggggatcatgtcatcctatatctggtcgctgaagccgggggataaggtgacgatttccgggccgtttggcgagttctttgctaaagaaaccgacgccgagatggtgtttatcggcggcggcgccgggatggcgccgatgcgttcgcatattttcgaccagctcaagcgcctgcacagcacgcgcaaaatcagcttctggtacggcgcccgttcgctgcgcgaaatgttctacgatgaggagtttgaacagctggcgcgcgacaatccaaactttaccttccacgtcgcgctctccgatccgctgccggaagataactggaccgggcataccggctttatccataacgttctgtacgagaactatctacgcgatcacccggcgccggaagactgcgagttctacatgtgtgggccgccggtaatgaacgccgcggtaattaagatgctcaaagatctgggcgtcgaggacgagaatattctcctcgacgactttggaggctga

SEQ ID NO: 5506 - DNA, 279 bp, Klebsiella pneumoniae
gatgctcaaagatctgggcgtcgaggacgagaatattctcctcgacgactttggaggctgacgatgctgacggtatttatcgcgacctttgtgatttttgcgctggtgatcttcggcatgtcgctgggctacctggtgaagcgcaagagcatccagggcagctgcggtgggatctccgcgctggggctggagaaagtctgcgattgtccgcaaccgtgcgacgcgcgtaaaaagcgcctcgcccgcgaggcgcagcgtcagcagcggcgtattttgtaa

SEQ ID NO: 5507 - DNA, 1125 bp, Klebsiella pneumoniae
aataaaaaaagcataaaattcgcatctgattttgctatgctgtatgggtatacagtgttgagtctgacgatgcgtaaaattatccatgtcgatatggactgtttctttgcggcggtggagatgcgcgacaacccagcgttgcgcgatattcccctcgcgataggcggcagtcgggtacaacgtggcgtgattagtaccgcgaactatcctgcgcgtaagtttggcgtgcgcagcgccatgccgacggcgacggcgctcaagctgtgcccgcatctcacgctgcttcccggccgctttgatgcctacaaagaagcctcgaaccatatccgcgaaattttctcccgctatacctcgcgcattgagccgctgtcgctggatgaagcctatcttgacgtcagcgacagcgagcattgtcacgggtcagccaccctgatagcccaggagatccgccagaccatcgaacgggagctgcgcctcaccgcctcggcgggggtggcgccggtgaagtttctcgctaaaatcgcttcagatatgaataaacccaacggccagttcgttatcgccccccatcaggtggcagagtttgtgcgggcgctgccgctggcgaaaatacccggcgtcgggaaggtatcggcagcgaagctggaaaatatgggcctgcgaacctgtggcgatgtgcagaacagcgatctggccatgctgcttaagcgcttcggtaaattcgggcgtattctgtgggagcgcagccacgggattgatgagcgggaaattcataacgatcggcagcgtaaatcggtgggcgtggagcgcaccttagcggaagatatccatgaatggccggagtgcgaagcgattatcgaaaacctctatcccgagctggagaggcgactggcgaaggtcaaacctgacctgctgatcgcccgtcagggcattaaactgaaattcaatgatttccagctgaccacccaggagcacgtctggccgcggctgaacaaagaggatctgatcgccaccgcgcacaaagcctgggatgagcgccgcggcggacggggcgtgcgcctggttgggctccacgtgacgttgctcgatccgcagctggaaaggcagcttttattagggatttag

SEQ ID NO: 5508 - DNA, 1296 bp, Klebsiella pneumoniae
gggttttcaggcgaaggaattgagcggatgtatgatttcgtgattatcggcggcggcatcatcggcatgtcgaccgccatgcagttaattgagatttacccggacgcccgcattgcgctgctggaaaaagaggccggcccggcctgccatcagaccggccacaacagcggcgtgatccacgccggggtgtattacacgcccggcagcctcaaggcgcagttttgcctcgccggcaaccgcgccaccaaggccttttgcgagcagaacggcatccgctatgacgtctgcggcaaaatgctggtcgccacctcaccgctggagatggagcggatgcgcgccctgtgggatcgcaccgccgccaacggcctgcagcgcgagtggctaagcgccggggagctacgcgagcgcgaaccgaacattaccgggctcggcgggatctttgtcccttccagcggcatcgtcagctaccgcgaagtggcggcggcaatggcgaagaacttcgaagcgaaaggcggaacgatcgtctacaacgccgaagtcagcgccctgaaagaacatgccagcggcgtggtgatccgcacccgccagggcggagaatatgaggcctcgacgctgatcgcctgttcgggcttgatggccgatcggctggtaaaaatgctcggcgtcgaccccgggtttatcatttgtccgttccgcggcgagtatttccagctggcgccgcagcacaaccagatcgtcaaccatttgatctatccgatccccgatccggcgatgccgttcctcggcgtccacctgacccgcatgatcgacggcagcgtcaccgtcggccccaacgccgtactggctctgaagcgcgaaggctaccgcaagcgcgatatctcgctggccgataccctggagatcctcacctcgcccggcatccgccgggtactgcaaaacaacctgcgctccggactgggcgaaatgaagaattcgctgtgcagaagcggctatctgcggctggtgcaaaaatactgcccgagcctgacgctgagcgatttacgcccgtggccggccggcgtgcgggcgcaggccgtgtcgccgcagggcaagctgatcgacgattttctcttcgttaccaccgcgcgttcgatacatacctgcaatgcgccatcgccagcggccacctccgctatcccgatcggcgcgcatatcgtcagcaaggtgcagaccctgctggccagccagagcaatcccggacgcacgctgcgtgcggcacgtagcgtggagacactacacgccgcttttacccgttaa

SEQ ID NO: 5509 - DNA, 1383 bp, Klebsiella pneumoniae
cctgcgtcggggttgaagttacggatacctgctaacgatatgattaaaatcacgaaagggctggatttgcccatagctggcatgccattacagcagatttctcccgcgccagcggtgaagcgcgtcgcgctactcggcgaagagtacgttggcatgcgccccgcgatggcggttaaagaaggcgatcgggtcaaaaaaggtcagatcctgttcgaagataaaaagatccctggcgtctgctttaccgccccggcgagcgggatcgtcagcgcgatccaccgcggcgaacggcgcgtgttgcagtcggtggtgattgatatcgagggcaatgacgcggtggcgtttacccgttacgccgcggacgcgctggccgaactgccgcgcgacaccgtacagcagcagctgctggcgtcgggccaatggacggcgctgcgtacccgaccgttcagcaaaacgccgctcccggggagcacgcccgccgctatctttgttaacgccatggacaccaatccgctggcggcggagccgcagccgattattctggccgaacgtgccgccttcgacgccggtcttaccgtgctcacgcgcttgaccgacgggaaagtgcacgtctgccagcccagcggcggcaagctgggcggtcatcctctcggccaggtctgtttcaatcagttcagcgggccgcacccggcggggctgccgggaacgcatattcacttcttggagccggtgagcctgaataagcaggtctggcacctcaattatcaggacgcgatcgccattggtaagcttttcctcgacggggagctctactgcgaacggataattgcgctcggcggcccgcaggtaacatctccgcggctggtcaaaacgacgctcggcgccagcctggaggatctgctggcaggtgagttgcaggagggggaaaacagggtcatttccggctcggtgcttagcggcgcccgcgcccatggccctcacgccttcctggggcgcttccatctgcaggtgagcgtggtcaaagaagggcgggaaaaagagctcttcggctgggtgatgccgggcaaagagaaattctcgattacccgcaccacgctgggccatttcttcaagcgcaagcgctttcatttttccaccgataccaacggcggcgagcgggcgatggtgccgatcggcaactacgagcgggtgatgcctctggatatcctgccgaccatactgctgcgcgatctgctggccggagacaccgacagcgctcaggcgctgggctgtctggagctggatgaagaagatctggcgctgtgcacctatgtttgccctggaaagtatgaatatggcccggcgctgcgcagcgtgttaacccggattgagcaggaaggataa

SEQ ID NO: 5510 - DNA, 2568 bp, Klebsiella pneumoniae
gcgagcgttatcatgtcgctgaaggttaaattctcacgccaaaatatcttcgttatcttagccgtagcctgcgttggccaggctttcggtgaagaatattatttcgacccctctctattgcagggaacagcttacggacaaggtatggcgagcgttaacggacccgacacccccgccggagagtatctggttgacgttatcgtcaatggaacgctgataaaatccggcgtaaaaatccgctttagtccagtcaatggcggacagcgcaccgagccctgccttccgttatcgctgatgcaggccgctcaggttaaatcgctcccggacaacgcgctgcaaaatagctgccgtccgctaagggattgggtatcccgcggtgaatggcaatttgatagcgcgatgctacagctccggcttacgctgccgatgagcgagctgatgcacaggccgcgcggctatatcccgccttcgcagtgggacagcggcgcgctggcgctgtttttacgccataacaccaactggacccacacagacaacaccagccagcacttccgctaccactatttgtggagcggcatcaacgttggcagcaatattggcctgtggcagctccgccatcaggggaatctgcgctatgccgacagtaaccaaagcggtagcgcctggcattataatcgcgtgcgcacctgggtacagcggccactcaccgcaatcgacagcatcatggcatttggcgataactataccgactccagtttattcggcagcttgtcattcaatggtattaaactcgccacggatgagcgcatgtggccgcagggcaaacgcggctatgcgcctgaggtgcatggcgtggcgtcaagcagcgcgcgggtggtcatcaaacagctaggcaaagttatctatgaaacccatgttccacctggcccgttctatatagatgatctttacaacacccgctatcagggggatttgcaggttaaggtgattgaggctaacggaaaggtttctcgttttaccgttccctattccgccgttcccgactcagtgcgccctggtaactggcactacgcttttgctctaggcaaggtccgccaatattaccgcatcgacaaccgttttcttgaggggacgctgcagcacggggtgaataatcatctcacgcttaatcttggatcgcggttggcgcatgattatcaggcctggctggctggcggcgttctggcaacccgtctgggcgcgttcgggatgaatgccacctggtctggcgcacaagtggaacataacgatcggcagcagggctggcgcgcggagttcagctatagcaagaccttttccacaggcactaatctggtactggcggcttatcgctactcaaccggcggattccgcgatttagaagatgtgtttggcgtccggcaacaggagcacaacagcattgtttactactccgataccctacaccaacgccaacgtctttctgcaaccgtcagccagccgttaggtaggttggggacgctcaatcttagcgccagtaccgctgattattacaataaccggtcgcggatcacgcaactgcagctgggctatagcaaccagtggcgaaaagtgagttatggattcaaccttgccaggcagcgctccacctgggacgatggccgcttctaccacagcgttaacgaaccgcaggatctgaaccagcggcaaaaatataccgagacgacgctatcgttcactttatccattccctttaactggggcgacaatccgacctccgtggcaatgaattataaccagtcgcgcgcgaaccgatcctcaaccttgtcgatgaacggaacccgtggcgagcagaacgaactctcctggtcggtctacggcggctatgatcgctatcgcaatggggatgaagggacagcaacgacttttggcggcaacgtccagcaaaacacccgttttggggcgctgcgcgtgggctacgatcagggaaaagactatcgtcaggtggcgctaggctcctccggaagcgtggtgttgcattccggtggcgtgacgttcggcccctacgccagcgacacgtttgcattaattcacgccgatggcgcacagggcgccgtcgtacagaacggtcagggggcggtaatcgaccgttttgggtatgccattttgccctcgctatctccctatcgtcgcaacaacgtctcactcgatacccggcagatgcgcagcgatgctgagctgaccgggggaagtcaacaggtggttccctatgctggcgcgatcgcacgggtgaacttctcaacgattaccggcaaagcggtgctcatcgcggtgaaaatggcagatggcggcataccgccaatgggcgccgaggtcatgaacagcgaaggggccgtcattgggatggtcgggcaaggcgggcaggtgtatgcccggatcagcacaccctctggctcattactggtgcgttggggaaaaggagccaaccgacgttgccgtgtgccttaccagttcgatatgcattctcctgaaaacgtgatttatctcacgactacctgcgagaggaaatag

SEQ ID NO: 5511 - DNA, 411 bp, Klebsiella pneumoniae
aattttgctataggtgcaataatgagagccacatcagaggagatcgccatctttgtggcggtggtggaaagcgggagtttcagccgggcggccgagcagctcggacaggccaactccgccgtcagccgggcggtcaaaaagctggaatcaaagctaggcgtaagcctgctcaatcggaccacccgccagctcagcctgacagaagaaggcgagcgctactttcgccggatgcaggtggtcttgcaggaaatggcggcggccagagaacgatctgctggagacgcgcacgacgccgcggggcctgctgcgggtagatgccgcgacgccggtgatgctgcattttctcatgccgctggtgaagccatttcgcgagcgctacccggaaatgacgctgtcgctcgtctcgtctga

SEQ ID NO: 5512 - DNA, 741 bp, Klebsiella pneumoniae
atgaccgctatgagcactgcaattacgcgccagattgttctcgataccgaaaccaccggtatgaaccagatcggggcacactacgaaggacacaagatcattgagatcggcgccgtggaggtgatcaaccgccgcctgaccggtaacaattttcacgtctatctgaagcccgatcggctggtggatcctgaagcattcggcgtacacgggatcgccgatgagttcctgctggataaacctacctttgccgacgtggctgatgagtttatggattacatccgcggcgcggagctggtgatccataacgcctcgttcgatatcggctttatggattatgaattcagtaagctaaaccgcggcatcggaaaaaccgagaccttttgtaaaatcaccgacagtttggcgctggcgcggaaaatgtttccaggcaagcgcaacagcctcgatgcgctatgttcgcgttacgaaatagacaacagcaagcgtacgctgcacggggcgttgctcgatgcccagatccttgccgatgtctatttgatgatgaccggcggccagacttcgatggcgttctctatggaaggcgaaagccagcagcaggcgggagagttgggaattcagcgcgtcgtccgcgccggcagtcagttacgcgtggtttatgcctcagatgaagaactggcgaaccatgaatcccgcctcgacctggtacaaaagaaaggcggaagctgcctgtggcgtgcctga

SEQ ID NO: 5513 - DNA, 285 bp, Klebsiella pneumoniae
agaaacctcatatgttgcgcacatgaatatacgttagcgaatatgaagtttgcattgagtatcctgccagatgatagggacataaacgattactatcataaagttaatgagttacgtgcaaaaaaacaaaaaacactacccgtaactctgaaaaatgagcggcgtataaatttatttttacgcgtaaatgatattgatttaattgacaaaattaacaaagaaacaaatttgcaacactctgtggcgcgatttgcatggttaaggtcaaagaaagatgacttctga

SEQ ID NO: 5514 - DNA, 372 bp, Klebsiella pneumoniae
tgccgggccatgtctatcgcgccctctacccgtgcgcgctgcacggcgtcagtgatgacgaggcgatcgccagcatccatcgcatcttcaaaaacgatgccgcgccggaagatatcgccgccatcattattgagccagtgcagggtgaaggcgggttctatgccgcctccccggcctttatgcagcgcctgcgcgccctgtgcgacgagcacggcattatgcttatcgccgatgaggtccagagcggcgcgggccgcaccggtaccctgttcgccatggagcagatgggcgtcgcggcggatatcaccaccttcgccaaatccatcgccggcggtttcccgctggcgggcgtcaccggccgcgcggaggtga

SEQ ID NO: 5515 - DNA, 1041 bp, Klebsiella pneumoniae
atatttttaatttatggctacgaaatgaacatcaccctgaccttacagcgaggaacgatcctgatgaacgccctgaccgcagtaaaaccgacacccgcgccggtagcccagcaataccctggcttttctttcaccccttccgcccagtcgccgcgcctgctggagctcaccttttccgccgaaacgaccacgcagttcctgcagcaggtcgcgcagtggccggtgcaggcgctggagtacaaatctttcttacgcttccaggtcggcaagatcctcgacgatctgtgtggcaatcagctgcagccgttgctgatcaaaacattgctcgatcgcgcggaaggcgcgctgcttatcaacggcgaagggatcgatcacgtcagccaggccgaggagatggtcaagctggccaccgccgtcgcccacctgattggtcgttccaacttcgacgccatgagcggtcagtattacgcccgcttcgtggtgaaaaatgtcgataactcagacagctacctgcgccagccgcaccgggtgatggagctgcacaacgacggcacctacgtcgaagagcaaaccgactacgtattaatgatgaagatcgacgagcagaacatgcagggcggcaattccctgctgctgcatctcgacgactgggagcatctcgacgaatttttccgcgacccgctggctcgccgcccaatgcgttgggccgcgccgccgagcaaaaacgtcagcaaggatgttttccacccggtgttcgacgtcgattcgctgggccgcccggtaatgcgctatatcgaccagttcgtccagccgaaagattttgaagaaggcacctggctgagccgcctctccgacgcgctggagaccagcaaaaacatcctttccataccggtgccggtgggcaaatttctgctcattaacaacctgttctggctgcacggccgcgaccgctttacgccgcacccggacctgcgccgcgagctgatgcgccagcgcggctactttgcgtattccacgaatcattaccagactcatcaataa

SEQ ID NO: 5516 - DNA, 225 bp, Klebsiella pneumoniae
ttgccgttaatcgccacagaacaggtttcatcggaaacttcaccgcgaaaggtaatagtattattagatatggctagcgcgctggtggaaataaaaagtgaggctgttaataaagccagtgtggttttcttgaacatggttttttattcctttgttgctattcatttatatatgatgaggctcgctctgcagctagggcagataaagacaacgtcctttagttga

SEQ ID NO: 5517 - DNA, 1287 bp, Klebsiella pneumoniae
caggttacaatatccggagtggcactacgacggagactgcacatgtcacaggctaacctcagcgaaacgctgtttaaacctcgcttcaaacatcccgaaacttctacgctggtgcgtcggttttctgccggaaaacctcaggcgatgcagtcggcgctgagcggcaatcacgtcgatcactggtaccgtctgatcaaccgtttgatgtggatctggcgcggcgtaactccgcaggagatcctcgatgtgcaagcgcgcattgtgatgagcgaggccgaacgaaccgatcctgagctgttcgataccgtcatcggctatcgcggcggcaactggatcttcgagtgggcgaaagaagccatgcagtggcagcaaaaggccgggcaggaagccgatcctttgctgagcggccgccactggctgcatgcctcgaacctgtatagcattgccgcttatccgcatattaaaggcgatgagctggcggaacaggcgcaggctttagccaaccgggcgtatgaagaagccgcccagcggctgccgggctcgctgcgcgagctggagttcaccatccctggcggctcgccgataaccggctttttgcatatgccgaaaggcgaggggccgtttccgacggtgctgatgtgcggggggctggactcgctgcagaccgattattacaacctgtatgagaactacttctcaccgctcggcattgccatgctgaccattgatatgccctccatcggcttctcgtcaaaatggacgctaaatcaggacaccagcctgctgcatcagcacgcgctgcgccatctggaaaatgtgccgtggattgaccatacccgggtcgccgctttcggcttccgctttggcgccaatatcgcggtgcgtctgggctatctggagccgcagcggctgaaggctgtagcctgtctgggcccggtcgttcatggtctgctggtggatcccctgcatcaggggcgcgtgccggagatgtatcttgacgtgctggcttcgcggctgggcatgcatgacgcgtccgatgaagcgctacgcgtggagctcaaccgctattcgttaaaaacccagggactgctggggcgccgttgcccgacgccgatgctctccggcttctggaaggacgatccgttcagccccgaagaggagtcgcggttaatcacctcgtcatctgccgatggcaaactgctggagatcccgtttaacccggtgtatcgcaattttgatcacgcattgcgacagatcgcccgctggatcaatcatagatttggttaa

SEQ ID NO: 5518 - DNA, 183 bp, Klebsiella pneumoniae; identical to SEQ ID NO: 1431

SEQ ID NO: 5519 - DNA, 603 bp, Klebsiella pneumoniae
tgtgccccgatctggttcataccggtggtttcggtatcgagaacaatctggcgcgtaattgcagtgctcatagcggtcatttatgtcagacttatcgtttacaaatcgatttcaattacaggaagtctaccagagatgctcaaacaggtagaaattttcaccgacggctcttgcctgggtaatccaggacctggcggctacggcgccatcatgcgctaccgccagcacgaaaaaaccttcagcgctggctaccgtctgaccaccaataaccgcatggaactgatggcggcaattgttgccctggaagcgttaaaagagcattgcgaagtggtgctcagcactgacagccagtatgttcgtcaggggatcacccagtggatccacaactggaaaaagcgcggctggaaaacggcagagaaaaagccggtgaaaaatgtcgacctctggcagcggctggacgccgcgcttggccagcataaaattaaatgggaatgggtaaagggccatgccggccatcctgaaaatgaacgctgcgacgagctggcgcgcgcggcggcctcccaccccacactggacgatgtcggctacctgcctgagagttaa

SEQ ID NO: 5520 - DNA, 471 bp, Klebsiella pneumoniae; identical to SEQ ID NO: 1445

SEQ ID NO: 5521 - DNA, 1242 bp, Klebsiella pneumoniae
gagatgggcttaaagcacctgattgagaaacttgagccgcatttcacgcatggcggcaagctggaaaaatattacccgctgtatgaggcggcggcgaccatcttctacacgccgggccaggtaacccgcggcgcggcgcacgtgcgcgacgccatcgacctgaagcggatgatgatcctcgtgtggtttgccgtattcccggcgatgttctggggcatgtacaacgttgggctgcagaccattccggcgctgcacaagctatacggcgccgaacagctgcagcaggcgatcgccaacaactggcactacagcgtcgcccagtggttaggggtgagcttcagtgccgacgccggctggctgagcatgatgaccctgggcgcggtcttcttcctgccgatctatatcaccgtttttatcgtcggcggcttctgggaagtgctgttcgcgattgtgcgcaagcatgagattaacgaaggttttttcgttacctctattctcttcgcgctgattgtgccgcccacgctgccgctgtggcaggcggcgctggggatctccttcggcgtggtgatcgccaaagagattttcggcggcaccgggcgcaacttcctcaacccggcgctggcggggcgcgcgttcctgttcttcgcctatccggcgcagatttccggcgatctcgtatggaccgcggcggacggtttctccggcgccacgccgctctcccagtgggccagcggcggcggtgaagcgctggtgaacgtggcgactggcgtgccggtgagctggatggacgccttcctcggcaatattcccggctcaattggcgaagtgtcaacactgatgatcttcatcggcggggcgatcatcctctttggccgcgtcgcgtcctggcgcatcgtcgccggggtaatgatcggcatgatcgccaccgccaccctgtttaacgttattggctccgacaccaacccgatgttcgctatgccatggtactggcatctggtgctcggcggtttcgccttcgggatgatgtttatggcgacggacccggtatccgcctcgtttaccgataaagggaaatggagttacggcgtgctgatcggcgtgatgtgcgtgctgatccgcgtggtgaacccggcttatccggaagggatgatgctggcgatcctcttcgccaacctcttcgcaccgctgttcgattatctggtggtgcaggccaatattaagcggaggaagtcgcgtggctga

SEQ ID NO: 5522 - DNA, 474 bp, Klebsiella pneumoniae
ggcgagggagtggaaacgttagttattctggccgtagtcgtatgggtacttttcaaactggtacaaaaggttacgagcaaactctatcctccagactcggtgaaggtacaggagaagcccgacacaacgccagcgacggatgcctggggaaattaccctaaagctgaagggcatgtcgttttattcgagcagtaccggcgtgagcaggcgctgcggcagcaagctgctaaagaggctgatacgttttaccgctcaagggagtggcggcgtttacgttaccaggcgttccagcgctacggcaataaatgttgcgtatgcgggcgcggcgccagtgacgggatggtgatgcacgttgatcatattaaaccgcgttctctttacccgcatttagccctcgatattgccaatctgcaaatcatgtgcaacgagtgcaacgtcagtaagggcaacagagatgaggttgagtggcaataa

SEQ ID NO: 5523 - DNA, 882 bp, Klebsiella pneumoniae
gcaataagggtagcagagttgatgttagtgactgtgttttgtgaaaagattgcgaatgttaaggtgggtgaaatcatttcaccctgtgttaatatgacaggcgacagagtaagtgtattgaagaacggattttccatggatgaagagttgttgttaatcgctaaaaaggtgatatttgatagtgccagaatgacattggctaatggtaataagattattaaaatctctgagtcggagacaaacctacttcttgccttccatcgcggtatatataaaaaagaggatatcattgatttcgtctggaagaatcgtgcgggttgtgtttcagaatcgagttattacaagcttattaatcaaatgcggaataatttttcgctcgttggtttgaaagcggacgatattgttacccgtccacgaattggtgtttcgttgtcactgccattagaaccgttcaaaaaacaacgttcggaagcaggcgaacaggccagcgatacagcgcggggtaaagacagtcgacagactcatctcgcggagggtaaaaaatttaccgccaaaatacgtcttctggtgctgacaatgttgttgatgctgttaacggctatagcgatgctatttcaacatgcacctgtgcaaaataaacacaaaagcaccttcaggatgcttggtgataaggatggctatatcttcttcaaaatggcgagcgataaagtgacatttaaggaggtggtttcggcctataacaccctgacgctaccgctatgtcgccagaacggacattatctttattacctccgggagccgaacatgaatctttttttgcagtgcctgaatcctgttgaaacggcggtaccaaaatgcattaccatcaaagagcgttactaa

SEQ ID NO: 5524 - DNA, 213 bp, Klebsiella pneumoniae
gactcggtttccctgcggctcccctatccggttaaccttgctacagaatataagtcgctgacccattatacaaaaggtacgcagtcacacccgaaggtgctcccactgcttgtacgtacacggtttcaggttctttttcactcccctcgccggggttcttttcgcctttccctcacggtactggttcactatcggtcagtcaggagtatttag

SEQ ID NO: 5525 - DNA, 312 bp, Klebsiella pneumoniae
ccggcacgttcagggggagcacccgctccaccacctcacgggcgcgcgccagggagaggtcgatcggtttttcgcaatagaccgccttgcccgccctggcggcggcttccagcagttcggcatgcgacggggttgaactggcgatcagcaccgcgtcgatggcgtcgctatggatcgcctcgctcacggtcaccgcccgggcgccatagcgggcggccagcgcctgggcgcgctccggggcggcatcggccaccatcgtcagcgaacttccttcatgacgagcaagactggcggcatgaacctgaccgataa

SEQ ID NO: 5526 - DNA, 1158 bp, Klebsiella pneumoniae
cgcgccggttccgcaaaacggcctgaacaatctcgcgcgcctcgctgcaggcgcgcgttactgtcgcaaggatcctctatgattaaaaccttccgctttgctctgctggcctgcggtctggtcggcggcgccctgacggcgaccgccgcgccggcggtgccggtccgcgtcgccacggttgaactggctcctcatgctgaagaacgcgctatccccgggcgggtcgaggcgatccgcgccgtcgacattcgcgcgcgcaccgaaggggtgattgttcagcgccacttccaggacggccagtatgttaccgaaggcgacctgctgtttaccctcgacgacgcgcagccccgcgcggcgctggctctggcgcaggccgagctgaaaagcgccgaagcctcattacgtcagtcgcagcagttgcttactcgctacgagcggcttatcaacaaccactccatcagccgcaacgacgtcgatacggcccggatgcagcgcgacgtcgccgccgctgccgtgcagcaggccaaagcccgcgtcgaggcccagcggatagtgctcagctacactcagattgcggcgccggtgaccggtcgcgtgggccatagcgcctttcacgtcgggacgctggttaattcgtccagcggcgtgctggtggacattgtgcagttggatccggtgcgggtctcgttcgccctcgacgaagccgcgtttttcagtaaaaccggccagcatgccgacatccacgccctgaagcaggcgtggctggcgcagattgagattgatggtaaacggcgcgacggggtgttgacctctatcgataaccggatcgacgcccgcaccggcagcgtagcggtgcgggccgagttcgccaatccgcagcaccgtctgctgccgggcggcagcgtgacgatcctgttccgtccgcaggaactgccgtcgcgagtgatggtcccggccgccgccgtgcagcaggatccgcagggctttttcagctgggtgctgaagccggaccacaccgccgggcagcgtcgtctgaccctcgcggggcagcaggggcagcagtttgcggtcgagaaagggctgcaggcgggcgagcaggtgatcaccgacggcgcgcagcggttgcgcgaaggcgccgcggtacaggtgctgaactag

SEQ ID NO: 5527 - DNA, 1014 bp, Klebsiella pneumoniae
ctatcgatctcgacgtgctgccggcgcgagaaatgccggcggtgtcggccccggcggcgctgggcgtgccgctgggcacgctgctgcgcatcgttgagccgctgtgccgcagcggtaagctgcaggcggtggatctggtggagtttaacccgctgtttgacattgacggtcagggcgctcgcgcggcggcccgtgtggcatggcaaatcgcccattggtggcgctagcgatccgcgctattattttcgtttccccgctccgcttattacgcataaggaaagccaggccatgtttgcacaacaacctcgttccgcgcccgcgcctttctatgaaaaggtgaagcaggcgatcagcgaaaagatccacagcggcgtctggcgaccgcatgaccgtatcccgtcggaagctgagctggtggcccagttcggcttcagccggatgaccatcaatcgcgcgctgcgcgagctgacggacgaaggcctgctggtcaggttgcaaggggtgggaacctttgtcgccgagccgaaagggcagtcggcgctgttcgaggtgcgcagtattgccgcagaaattgtcgcccgtcaccatcagcaccgctgtgaggtactcctgctggaggagacccgggcggatcatattcaggcgacggcgctcagcgtcccggaaggcacccgcatctttcactcgctgatggtgcattacgaaaacgaggtgccggtgcaaatcgaagatcgctgcgtcaatgccgcagtggtcccggactatctgcatcaggactacaccgccaccacgccccatgattacctgtcgctgatcgcgccgttaaccgaaggtgaacatattgttgaagcggtgcaggccacggcggaagagtgcgcgctgctgcatattcacgcccacgatccgtgcctgctgatccgtcgccgcacctggtcgacaacccacatcgtctcccacgcgcgcctgctgttccccggtagccgatatcgtctgcaggggcgctttggctcctga

SEQ ID NO: 5528 - DNA, 396 bp, Klebsiella pneumoniae
ccttccgcctcgccgctgacgccaaggccgcgcagggtgcggaagccgctgacttccggcaatgggccgtcggcagctttatcaaggatcgctcgcgccagcggatggcttgagccctgctccagcgcggcggcaagacgcagcgcggtatgctcatcaacgccagcgaaagttttcaccgccaccacttgcggcttgccttcggtcagggtgccggttttatcgaacaccagggtgtcgagttcactggcgcgctgcagcgcatcggcatcgcggaccagcacgccatactccgccgcccggccaacgccggagataatcgacatcggcgtcgccaggcctaaggcgcacggacaggcgataatcagtaccgtggtggcaatgaccagggtatag

SEQ ID NO: 5529 - DNA, 321 bp, Klebsiella pneumoniae
cctgataactcccgcccttggtgggagttattattttgtcgtaacaccggagctgacatgaaaaccaaacttaacgaactgcttgaattccctacgccatttacttacaaagtaatggggcaggcgttgccggagctggttgatcaggtggtggaagtggtacagcgccatgcgcctggtgattactcgccgtcagtaaaaccgatcagcaaaggtaactaccactcggtctccatcaccatcaacgccacccacattgaacaagtggaaacgctgtacgaagagttaggcaatatcgatatcgttcggatggtgctgtaa

SEQ ID NO: 5530 - DNA, 858 bp, Klebsiella pneumoniae
ttatcatgctcttcgcccgcgaggggctgctggggaaaaaagagatttggcagatgggaagaaggaacagcagctatggcggaaaataacgttatcctgcaggtgcaggacgtcaccatgcagttcggcggcctgcgggccatcgacaacgtcagcttccatgttgacgaggcggagatctttggccttatcggccctaacggcgcgggcaaaacgaccctgtttaacgtcattaccgccaactataaacccaccagcggcagcgtcaccctggcgggcacgtcgctgaaggggctgaagcccaaccaggtggtgaacgccgggatcgcccgcaccttccagaatatccgcctgtttaactccatgacggtgctggagaacgtgatggtcggactcgaccgcgccagccgctattcgctgctggaggcggccctgcatattggtcgctactttccggccgagcgggcggcgaaagccaaagcgatggccatcctggaggatatcggcatcgcccacttcgcccatatgcaggccacaaacctaagctatggcaaccagcgcaaagtggagatcgcccgcgcgctggccaccgcgccgaagctgctcctgctcgatgagccggccgccgggatgaacccgaaggagaccgaggatctggcggagctgatcttccgcatgcgccatgactatcagctcagcgtcctgttaatcgagcacgatatgcccttcgtcaaccgcctgtgcgagcgggtgatggttctggagtacggtaagccgttgttcagcggcctgatggccgaggcgatccagcatccggacgtcatttccgcttatctgggagaagccaattatgcttaa

SEQ ID NO: 5531 - DNA, 1356 bp, Klebsiella pneumoniae
caacaccgctcccgtcagcggcagcaacacccacaggcgccagtccggcgcccagggaaaatcaaagactttcgtctgcagcatcgccagcgccacttccgcgcctatcgccgccaccaggccggaaaccagccccagcagggcaaactccgcccacagcgtagcgcgcagcagcgattttcctgcccccagcgtgcgccagaccaccagctcctgatggcgttgacgcataccgacctgcacctgcgccagcaacagcagcacgccgcaggccgtcaccaggcctaccatcacctccagcgcccggctgacctgggagagcacctggccgacctgacgcaggatggcgccgatatccagcagactgacggtgggaaactcgcggttcagctgggtcaacatcgcgggaccgttatcccagcggaagctggtgagccagctctgcggctgcccgtccagcgccccggaggggaaaataaagaagaagtttggccgcaagctctcccagtctactttgcgcgcgctgctgaccttcgcgctgaactcctgggtatcgccggtaaaggtcactgtatcgccgatctttatccccagccgctgcgccagcccctcctcaatcgatacctcgcccggcttcggcggccagctgccggccaccagcggattatgatccggacgctgttcgctccaggtgagattaagctcgcgattcagcgcttcgtctttgtttccgtccgtagactgaccgttgatctgcgtcagacgggcccggacgatcggatagaattccgccgcccgcgtctggtgttcggcgaggaaggtcttcaccggcactatctgctcaggggcgatattgatcagaaagtagttcgggctctgcgggggcaactgctgctgccagcggtcaagcagatcgccgcgcagcaccaacaggagcgccagcagcataaacgacagggaaaacgccgccagctggctgagggtcgaccacggctggcgcagcaggcggttcaccgccagacgcagcggcaaggctttgagcgtcaggcgtttgagcagccacagcaatccccagcccaccaggccgcacagcagcgccagcaccaccgccccggccagcaccgaccacagcagcgggctgccgcccagcagccaggccaacaggcccaccaccacgacgctaaccgccgggatccagattttcaacggccagacgttagccaccacatcctgacgcagcactcgcagcggcagggtcgccagcagcagtcgatagggtcgcaggcccaccagcagggaaatgacgcctgtcgccccgatagcccacagccacggccaaccgctggcagcgggtaa

SEQ ID NO: 5532 - DNA, 366 bp, Klebsiella pneumoniae
tctcggcgctcatctccagcgcgtcgcgggcgacgtccggcagatgatggccttcatcgaggaccagcagcaggtttttcggctccggcagcaccgcttcgctctccatcgccgccatcaccagcgcatggttggccaccaccacttccgcctcctgaatttcccgccgcgccacaaagaacgggcactcacgatagtagtggcagttgcggttcaggcagctggccttatcggtgctcagccggctccatagcccatcgtcgatggctttgtcggtatggtcgcgcaggccgtcccagcggtagctgtcgagatcctgcttcagggtcgcgcacagcttctgctccgcctgattattcggggtga

SEQ ID NO: 5533 - DNA, 1860 bp, Klebsiella pneumoniae
accactggctctgcgcctggttctgcaactggctatcgttgtggcgttggtggcttacgttctttatggatttgttgtggtgtggggtgtgtaatgaaattgccagtcagagagtttgatgctgttgtcatcggtgccggcggcgcaggtatgcgcgcggcgctgcaaatttcccagagcggacagacctgtgcactgctctccaaagtgttccctacccgttcccataccgtatccgcgcagggtggcatcaccgtcgcgctcggtaactcccatgaagataactgggaatggcatatgtacgacacggtaaaagggtcggactatatcggcgaccaggacgccatcgaatacatgtgtaagaccggcccggaagcgattcttgagctggagcacatgggactgccgttctctcgtcttgacgatggccgtatttatcagcgcccgtttggcggccagtcgaagaacttcggcggcgaacaggcggcgcgtaccgcggcggcggctgaccgtaccggtcacgccctgctgcacactctgtatcagcagaacctgaaaaaccacaccactatcttctccgaatggtacgccctcgatctggtgaaaaaccaggacggcgcggtagtcggttgtaccgccctgtgcatcgagaccggcgaagtggtctactttaaagcccgcgccaccgtgctggcgaccggcggcgcaggccgtatctatcagtccaccaccaacgcccacatcaatacgggtgacggcgtcgggatggccatccgcgccggcgtgccggtgcaggatatggaaatgtggcagttccacccgaccggtatcgccggggctggggttctggttaccgaaggttgccgcggcgaaggcggttacctgctgaacaaacacggcgaacgctttatggagcgttatgccccgaacgctaaagaccttgcgggccgtgacgtggtggcgcgttccatcatgatcgaaatccgcgaaggccgcggctgcgacggtccgtggggcccgcacgcgaaactgaaactggatcacctcggtaaagaggttctggaatctcgtctgccgggtatccttgaactttcccgtacctttgcccacgtcgatccggtgaaagagccgatcccggttatcccaacctgtcactacatgatgggcggtatcccgaccaaagtcaccggccaggcgttgaccgtgaatgagaagggcgaagacgtggtgatcccgggcctgttcgcggtaggcgaaatcgcctgcgtatcggtccacggcgccaaccgtctgggcggcaactcgctgctcgacctggtggtcttcggccgcgcggcgggcctgcatctgcaggaatccattgccgagcagggcacgctgcgcgacgctagcgaatccgatatcgaaggctcgctggatcgcctcaaccgctggaacaacacccgctctggtgaagatccggtggcgattcgtaaagcgctgcaggaatgtatgcagcataacttctcggtgttccgcgaaggcgatgcgatgcacaaaggtctggagcaactgaaagtgatccgcgagcgcctgaaaaacgcccgtctcgacgatacctccagcgagttcaacacccagcgcgttgagtgcctggagctggataacctgatggaaaccgcctacgcgaccgccgtatccgctaacttccgtaccgagagccgtggcgcccacagccgcttcgacttcccggatcgtgatgatgaaaactggctgtgccattccctgtacctgccagagtcggaatccatgacgcgtcgtagcgtcaatatggaaccgaaactgcgtccggcattcccgccgaagattcgtacttactaa

SEQ ID NO: 5534 - DNA, 936 bp, Klebsiella pneumoniae
acccggctatcaggtataagtaaggtgcgattgcttaactggagaaggcaggcggcgctgaacgccatgccgggcatcagacccggcgagatccataccccctggcatgagttctggcggcgctttcgtcgccagccggtggcgatgggcgctggtattttcgtgctgttgctgattgcggtagccatcgttgccccatggatagcgccgtacgatgcggaaaattatttcgactacgaccgtctgaacgagggaccttcgctggtgcactggtttggagtcgactccctgggacgggatattttcagccgggtgctggtcggggcgcagatctcgctggccgccggggtactggcggtgctgattggcgcggccatcggcacggtgcttgggctgctggctggctactatgagggctggtgggaccggctcattatgcgactttgcgacgtgttgttcgcctttccggggatcctgctggcgatcgcggtggtcgccgtcatgggcagcgggatggccaacgtgatcatcgccgtggcgatcttctcgatcccggcgtttgctcgtctggtgcgcggcaatacgctggttctgaagcagcagacctttattgaatcggcgcgcagcatcggcgccagcgacgccaccattctgttcaaccatattctgccggggacggtgtcatcgatcgtggtttatttcaccatgcgcattggggtatcgattatttcggcggccagtctgtcgtttctcggcctcggcgcgcagccgcccaccccggagtggggcgcgatgctcaacgaagcgcgggcggatatggtgatgtctccgcacgtggcgctctttccggcggtggcgattttcgtgaccgtactggcgtttaatctgctgggagatggcctgcgcgatgcgctggatccgaagttaaaggggtag

SEQ ID NO: 5535 - DNA, 531 bp, Klebsiella pneumoniae
gcatcaatatcaagaggatatgaaacgatgagtaccgcaaaactggttaaatcaaaagcgtctaatctggtctatacccgcaacgatgtcgctgacagcgaaaagaaagcgaccattgagctgttgaatcgccaggtgatccagttcattgacctgtcacttatcaccaagcaggcacactggaatatgcgcggtgcgaactttatcgccgtgcacgaaatgctggatggcttccgtaccgcgctgaccgaacatctggacaccatggccgagcgcgcggtgcagctgggcggcgtcgccctgggtaccactcaggtcattaacagcaaaaccccgctgcagagctacccgctggacatccatcacgttcaggatcacctgaaagccctggctgaccgctacgcggtagtggcgaacgatgtgcgtaaggcgatcgacgaagcaaaagacgaagacactgcagatatcttcaccgcggcttcccgcgatctggataaattcctgtggttcattgaagccaacatcgagtaa

SEQ ID NO: 5536 - DNA, 861 bp, Klebsiella pneumoniae
ttgttgatatcagcccctgaggcactgtttttagtattaccactcccggcagcggcggcattgtttcctttggccccaccgcctgttttaggcgcattcttaccagaactcagatcgccgagcaggttgtcaacgccgtccgcttctttcgcagccgccgctttcttcgccgccgcggcttttgctgctgccgccttggccgctttatcagctgcagccttctctgctgcagccgctttttcagcggctgcggctttctcggcggcggccttctcagcggccgctttttgcgcggcggctttctcagcggctttttcggcagccgctttttcagctgccgcctgcttagccgcttcctgctgggcttttttctccgcttcctgttgcgctttcttcgcagccgccgcttccgctttcttctgcgcctcggccgcagctttcgccgcttcagcttccgcctgtttcttcgcctcggcagcggctttcgctgcagcggcttcggcctgcttcttcgcgtcagcagccgccttggccgccgcctgttctgccgctttcgcctgggcatccgccttcgctttcgcctcggcggccgctttggcagcggcttcctgcgcttcttttgcctgtgcgtccgctttggcttttgccgccgcggcggccttggcagccgcttcttcagcctgcttctgctgctccttcgcttctttcgccgcttcctgcgcctgcagccgctcctgttcgagctgtttcagccgttcctgttccgccgcctgtttctcacgtaactcttccgcctgctgctgcgcctgtttttcacgctgttcagcggcgcgacgtgcgctggcctgctgctgttgctga

SEQ ID NO: 5537 - DNA, 570 bp, Klebsiella pneumoniae
cgacattcatccggagcagatcccagcatgagcgcattaactcttttttccgtgaccgatccgcaaacaccgctctggcacagcaccgacgccaaagcgattcaggatcaactgaacgccaaaggcgtccgcttcgagcgctggcaggccgaccgcgacctcggcgcaaatcccagcccggaaacggtcattgccgcctatcagcatgcgattgataaactggtcgccgaaaagggctaccagagctgggacgtcatcagcctgcgcgccgataacccgcaaaaagaggcgctgcgggaaaaattcctcaacgagcacacccatggcgaagacgaggtgcggttttttgtcgagggcgccggcctgttctgcctgcatattggcgacgaggtgttccaggtactgtgcgaaaagaacgatctgatttcggttcccgcccacaccccgcactggtttgatatgggttcagaaccgaacttcaccgccattcgcatttttgataacccggaaggctggatcgcccagtttaccggtgacgatatcgccagcgcctacccgcggctggcgtaa

SEQ ID NO: 5538 - DNA, 819 bp, Klebsiella pneumoniae
ccgataccatcgccgatatggcgcaggacaccagcatccacgatttcatcaagcaaaacgcgcgttaatgctatcgcgaacccggcctccgccgggttcgtgctttatgctatgtccagtcattacttacgcatttttcagcagccgaaatcagccattttgctgctccttggcttcgcctccggtctgccgctggccctcacctccggtaccctgcaggcctggatgacggtggaaaatatcgatctgaaaacgatcggttttttctcgctcgtcggccaggcctatgtctttaaattcctctggtccccgctgatggaccgctacacgccgccgtttcttgggcgtcgtcgcggttggctgttgaccacccaggtattactcctgctggcgatcgcgacgatgggctttcttgagccggtcacccaattacgctggatggcggcgcttgcggtggtgaatcgccttctgctcggcgtcgcaggatattgtgttcgacgcctggaaaaacgacgtgttgcaagcagaagagcgtggcgcccggcgccgcgatcagcgtgctgggctatcgcctggggatgctggtctccggtggaactggccctgtggcttgccgaccgctatctcggctggcaggggatgtactggctgatgggcggcgctgctggtaccctgcattatcgccacgctgctggcgcccgaaccgagcgacgttatcccggtccccagatcgctcgagcaggcggtagccgaaccgctgcgcgattttttcggccgcaacaacgcctggctgattctgctgctcatcgtcctttataa

SEQ ID NO: 5539 - DNA, 630 bp, Klebsiella pneumoniae
actgctcaatctggtcgttggctaagcgcgggaggaagcgtgcgatatctggtaacaatgttgttatctctggcggtgctcgtcaccgccggctgtggctggcatttgcgtagcaccaccaaggtgcccgccaccatgaaaaccatgattttccagtcgagcgatccgaacggcccgttaagccgcgcggtacgtaatcagctgcgtcttaacggcgtggaactgatcgacgccagcacgctgcgtaaagatgtcccttctctgcgcctcgatggctcgtcgattcagaaagataccgcatcggtgttccaggatggtcgtacggcggagtatcagatggtcatgaccgttcatgccagcgtcctgatcccgggtcacgatatctatccgattaccaccaaggtctatcggtcgttctttgataacccgcaggcggcattagcgaaagacgccgagcaggatatgattatccaggaaatgtacgacaaagcggcggaacagctgattcgtaagctgccaagcgttcaggtagcggatgttgaagcaacccagcaggaagagaaaccggccgccagcagcgcggcgccggcttcctcgggtaaccgcgtctccaccacgctgggtcaatga

SEQ ID NO: 5540 - DNA, 798 bp, Klebsiella pneumoniae
gttcgacaatcgttttgccctttcctgctgattttacaaggaatacttatgttaaagcgtctgctgttactcagccttttgccgttatgcagccatgcggaggaactccccgctccggtaaaagcgattgaaaaacagggcattaccattataaaaccctttgaggcgccggggggaatgaaaggctggctgggcaaataccaggacatgggggtcgccatctacctaacgccggatggtaaacacgcgatctccggctatatgtatgatgagaacggcagcaacctcagcgagcagctgtttcagaaagaactctataccccggcgggacaagagatgtggaagaagatggccagcgcccactggctgcaggatggtcgcaaggacgcccctatcgtgctgtatgtctttgccgatcccttctgtccctactgcaagcagttctggcagcaatcccgcccctgggtagaggccggtaaagtgcagatccgcactctgctggtgggggtgattaagccggagagcccggccaccgccgcggcgattctcgccagcagcgatccggcgaaaacctggcatgattacgagcaatcgaatgggaaaatggctctgacgatcccgaaagcaattccgccgaagaaaatgaaaatgctcaacgtcaaccagcagctgatggacgatctgggagccaacgtgacgccggcgatttattatatgaataaagataatatgctgcagcaggtggtcggcctaccggataaagagaaactgcatattatgatgggtgaaaaagagtaa

SEQ ID NO: 5541 - DNA, 678 bp, Klebsiella pneumoniae
aaaattgaatcgacttttgaggggattttcgtaatgcgtattattctgcttggcgctccgggcgcgggtaaaggaactcaggctcagttcatcatggagaaatacggtattccgcaaatctccaccggcgatatgctgcgcgcggcggtaaaatccggctctgagctcggtaagcaagcgaaagacattatggacgcaggcaagctggtgaccgatgagctggtcatcgcgctggtgaaagagcgtatcgcccacgaagattgccgtaacggcttcctgctggacggcttcccgcggaccattccgcaggctgacgccatgaaagaggcgggcattaccgttgattacgtgctggaattcgacgtgccggacgaactgatcgtcgaccgcatcgttggccgtcgcgtccacgcggcatccggtcgcgtataccacatcaaattcaatccgccgaaggtggaaggcaaagacgacgtgaccggcgaagagctgaccacccgtaaagacgatcaggaagagaccgtgcgtaagcgtctggtagaataccatcagatgacagcgccgctgatcggctactacaccaaagaagcgcaggcgggcaacaccaaatacgccaaagtcgacggcaccaaagcggtagctgacgtgcgcgccgaactggaaaaaatcctcggctga

SEQ ID NO: 5542 - DNA, 261 bp, Klebsiella pneumoniae
aggcttcgatctaagcactcctgctggggaagcatgcttaccatcatggcagcattggcaaaaatggaactgtctgtattagatgagcgtaggaaggcaggaattaaacgcgctaaatctcaagggatccattgcggtaggcttgccaaggcgtctactgaagacatactgttactgattgcacaagataagagccgtagagagattgaaaaggaacttgggattagcaaagcaacatacttccgtctcaaaaaattttag

SEQ ID NO: 5543 - DNA, 1020 bp, Klebsiella pneumoniae
cctgcaggatccacctctatcgcaggaagtgcagggtttatgtctattcagaaaattgctcgtctggccggcgtctcggtggccacggtgtcgcgggtgctgaacaacagcgatacggtaaaagccaaaaaccgtgagcgcgtgctgcaggcgatcaaagagagcaactatcagccgaacctgctggcgcgtcagctgcgaaccgcccgcagcaatatgatcctggtgatggtctccaatatcgctaaccccttttgcgccgaggtggtgaaggggatagaagaagaggcggagaagaatggctaccgcattctgctgtgtaactccgggtcggatctggcccgctcgacctcgggcctgcagctgctctccggcaaaatggtcgacggcattattaccatgaacgcgctctccagcctgccggaactgaccaccatgattggcgacgcgccctgggtgcagtgcgcggagtatgccgacaccggcagcatctcctgcgtcgggattaacgacgttgaggcggctcagggggcggtatcccggttggccgatagcggccgccgccgcatcgcgctcattaatcacgacctcagctatcgctatgcccgtctgcgcgagcgcggctataaaagcgtgctgcacgtgcacggtctggcgtatcagcaggtgacctacgcgcaggatcttagcgcggcggccggtaaacgggcgatggagcaactgctgtcgcaagacgagaagcccgatgcggtgtttgccgtttcggactccctcgccgccggggcgctgcgggctatcgcccaggccggactgcgggtgccggaagatatcgcggtgatcggcttcgatggcaccgagctggcggaagtggtctccccgcagctgaccaccgtcgaacagccctcccgggcgatcggccgtacggcggtgtctctactgatgaaacgcatcgacgatcccgacgctgccgtcgaacgggtgatgatggactggcgcgtgatagaccgcgccagcgtctga

SEQ ID NO: 5544 - DNA, 1269 bp, Klebsiella pneumoniae
tcgattacttttctgagggcgagcaacatggtcacaacaacagaaggtcgggaaagtgtccgcgtgagccaccgttttctggtgccgcggctgtcgttaatgatgtttatgcagttttttatctggggcagctggtcggtgaccctggggctggtgatgacccgctatgagatgtcattgctgatcggcgatgcgttctccgccgggccgatcgcctccatcttgtctccctttgtgctggggatgctggtggatcgctttttcgcctcgcagaaggtgatggcggtgatgcacctggccggggcggcgatcctgtggtttgtcccgcaggcgctggtggcgcagaacggcgccctgctgattggcctgctgttcggctatacgctgtgctatatgccgaccctggcgctgaccaacaatatcgccttccacagcctggccaatgtcgataaaaccttcccggtggtccgcgtgttcggcaccatcggctggattatcgccgggatctgcatcggggtgaccggtatctctgataccaccggcatcttcacgctagcggcgctctgttcggtcgcgctggcgctctacagcctgacgctgccgcacaccccggcgccggccaaaggcatgccggttcagtttcgcgacctgctgtgcgcggacgccttcgcgctgctgaaaacccgccatttcctgattttctccctctgcgccaccttaatttccgtgccgttaggcacctattacgcctataccgcgtcgtatctggcggatgccggcgtcaaagatgtcagcaccgcgatgtccttcggtcagatgtcagagatcgtctttatgctggtgatcccgttgctgttccgtcgcctcggggtgaaatacatgctgctcatcggcatggcggcgtggttcgtccgctacgcctttttcgctctcggagtcagcgaggaggggcgcttcctgctctatctgggcattttgctgcacggcgtgtgctatgactttttctttgtcgttggctttatctacaccgaccgcgtggcgggcgagaaggtaaaaggccaggcgcagagcatgattgtgatgttcacctacgggatcggcatgctgctgggctcgcagatctccggcgcgctgtataaccatctggtggccggccagagcgtgcctcaggcctgggtgaccttctggtggatcccggcggtggccgccgcggttatcgcgctgattttccttttctctttccagtacaacgagaaagagccgcactaa

SEQ ID NO: 5545 - DNA, 405 bp, Klebsiella pneumoniae
cgttcaccgtcgaacaggccgcctgacccaggccggctgtacagctcctggcttagcgcttatgctgacgttttgccggtaacaggacagaaaatggctccgcacgacacatttccccaacgcgtctggcacatcgtggcgtcgataccggaagggtatgtcacgacctacggcgaggtcgcccggctggcaggttcaccgcgcgcggcgcgccaggtgggcggcgtattgaagcgcctgccggaagggtccaccctgccatggcatcgggtggtcaatcgccatggcgatatctccctcaccggccccgatctacagcggcagcgtcaggcgctgctggccgagggtgtgcaggtctccggcagcggccatatcgatctccagcattatcgctgggtttattga

SEQ ID NO: 5546 - DNA, 600 bp, Klebsiella pneumoniae
aaaacggcgtcgctatcggcgcacacccgagcttcccggaccgggaaaatttcggtcgaaccgcgatgcagttaccgccagagacggtctacgcccaggtgctgtaccaaattggcgcgctggcggcaatcgtacacgcccaggggggcgagctgcggcacgtcaaaccgcatggcatgttgtacaaccaggcggcgaaagagccggcctttggccgacgctatcgcccgtgcggtgcgcgatgccgacgccgacctggtgctggttgggctggcgggcagcgagcttatccgcgccggacagcattatcagttgacgacgcgccaggaagtcttcgccgatcgcggctatcaggccgacggcagcctggtgccgcgcagccaaccgggcgcgctgattgagagcgaagagcaggcgctggcgcaaacgctggaaatggtgcagcacaatcgggtgcgcagcctgagcggcgaatgggcgcatgttaaggcggaaacggtctgcctgcatggcgatggcgctcacgcgctcgatttcgcccgacgcttgcgcgccgcgtttgccgggcggaatatcgacgtcagcgcggacctcgagtaa

SEQ ID NO: 5547 - DNA, 702 bp, Klebsiella pneumoniae
agccaggcgtctggcgcgctaggaacgggagacattatgaatcagtggggcgttatctggtcggttcgcgatagctttattgccggggtattcgcgaccctcgaactgtttattaccgccgccctggcggcgctgattatcggtattgcgctgtgttattttagcgaatatcaaaagaaagtgattaaccggattattattggtttcgtcagcctgatgcgcgcgatcccttttttgatcctcgcttatcttctgtattacggactgccgcagctcggtattagcatggagccgtggaccgccggtttactggccctgattatttatcatggcgcctatttctttgaaatattgcgcagccagcggcgggtattttccggcggatatattgaagcggcgattgctcagggcttttctcgctatgccatttttcggcggattattttacccaatatcgtctcttccgccttaccgctgatcggcaatcagctgattatttgcctgaaggacaccgctttcctgagcattattaccgttcaggagatcaccgccgccgccaacagcgtccaggcgacctattttattccgtttaacgcctttatcgtcgctattgggctttactgggcgatcagcattctgctggagctgctgattaagcgcctgaccgcctggggagccaaaagaggaatgagccatgcctga

SEQ ID NO: 5548 - DNA, 648 bp, Klebsiella pneumoniae
tggctaaagtctatctcgtcgcttttcgcatcgtcggacatcacggggaaaatagcgcgagcgttgcgtaatcagctaagcttccgggataacaagttgagttatgccgcgttgcaggtattatgcaacgcaaaagaaacggaaggagaggaaaagatgccatctttcgatattgtctctgaagttgatcttcaggaagcccgtaacgcggtggacaacgcgagccgcgaagtcgagtcgcgttttgattttcgtggcgttgaagccacttttgaattaaacgacgccaacaagaccattaaagtgctgagcgagtctgacttccaggtgaaccagctgctggatatcctgcgcgccaagctgctcaagcgcggcattgaaggcacctccctcgacgtaccggaagatatcgtgcacagcggtaaaacctggtttgttgaagcgaagctgaagcagggcattgaaagcgcggtgcagaagaagatcgttaaactgatcaaagacagcaagctgaaagtgcaggcccagattcagggcgaagagatccgcgtgaccggtaagtcccgcgacgatctgcagtcggtgatggcgctggtgcgcggtggcgatctgggacagccgttccagttcaaaaacttccgcgactaa

SEQ ID NO: 5549 - DNA, 1749 bp, Klebsiella pneumoniae
acaggagagtcagtcgtgaacaaaaaagccatggccgcggcggtcagcatgatcctcgccggtggcgcgcacgccgcgcagcaggagcgtccaaacgtcatcgtgattatcgccgatgatatgggctactcggacatcagcccctttggcggcgagatccccacccccaacctgcaggcgatggccgagcagggaatgcgcatgagccagtattacacctcgccgatgtcggccccggcgcgctcaatgctgctcaccggcaacagtaaccagcaggctgggatgggcggcatgtggtggtacgacagcaccattggcaaggagggctacgagctgcggctgaccgaccgcgtcaccaccatggccgagcgctttaaagacgcggggtataacaccctgatggccggtaaatggcacctcggttttgttcccggcgccacgccgaaagatcgcggctttaatcacgccttcgcctttatgggcggcggcaccagccactttaacgacgcgataccgctggggaccgttgaagccttccacacctactacacccgcgacggcgagcgcgtctccctaccggatgatttttactccagcgaagcctacgcccgccagatgaacagctggattaaagcgacgccgaaggaacagccggtcttcgcctggctggccttcaccgcccctcatgatcccctgcaggcgccggacgagtggattaagcgcttcaaaggccagtatgagcagggttacgccgaggtctatcgccagcgcatcgcccgcctgaaagcgctgggaattatccatgacgataccccgctgccgcatctggagctggataaagagtgggaggagctaacgccagagcagcagaaatatacggcgaaagtgatgcaggtgtatgcggcaatgatcgccaatatggacgcgcaaatcggcaccctgatggagacgctgaaacaaaccgggcgcgataaaaataccctgctggtctttttaaccgataacggcgccaacccggcgcagggtttctactacgaatctaccccggaattctggaagcagttcgataacagctatgacaacgtcggccgcaaaggatcatttgtctcctacggcccgcactgggccaacgtcagcaacgccccctacgccaattatcacaaaaccaccagcgcccagggcggcatcaataccgactttatgatctccggtcccgggatcacccgccacggtaaaatcgacgcctcgacgatggcggtgtatgacgtggcgccgacgctatatgaattcgccggcatcgatccgaacaagtcgctggcgaaaaagccggtgttgccgatgatcggcgtcagctttaagcgctatctcaccggcgaagtacaggagccgccgcgcggcaactacggggttgaactgcatcatcaggcggcctgggtcgatggcgaatggaagctgcgacggctggtgccgcgcggcctcaccgccggcgacgcgccgtggcagctgtttaatctgcacaacgacccgctggagacgcatgatgtcgcggccgaacatcccgatcgggtcaaagccatgagcgaggcctacgaggcatttgctaagcgcaccatggtcacccgggcacagggcaagatgatcgactacgtcggcatcgacagcaaaaccgggcactatctggcagtcgaccccgccaccatgaagccggtgcctgcgccgcaggcgatccctgtgagcgagatccattaa

SEQ ID NO: 5550 - DNA, 1926 bp, Klebsiella pneumoniae
agcagatggtcaccgtctccggccgtattcgtgcagaagacggcacgctgctggcgaatgcgcggattaacaaccatatcggccgtacccgcaccgatgaaaacggcgagtttgtcatggacgtggataagaaataccccactatcgatttcagctacggcggcaataaaacctgcgaagtggcgctggagctcagccaggcgcgcggcgccgtctgggtcggggatgtggtctgcagcggcctctcgtcgtgggcggcggtgcagcagtcaggagaagagaataaaagttaatgcactgatggcgctggcgatcctcgcgctgctctggccggcggctgcgctcagggcggcggtgaccaagaccacctggtcggatgcgccggcgcgcgagtttgtgtttgtggaaaacaactccgacgacaactttttcgtcactcccggcggggcgctggatccgcgcatgaccggcgccaaccgctggaccggcttaaaatacaccggctccgggaccatctatcagcagagtctcggctatatcgataacggctacaacaccgggcttaatgccaactggaagtttgatatgtggctggaaaactcgccggtttcgcaccccttatccggcctgcgctgcatcaactggtacgccgggtgcgatatggccaccagcctgatcctgccgcagaccactgacgccagcgggttctatggcgcgacggtgaccagcggcggcgcgaagtggatgcacggtatgatgtcggacgcgttttatcagtatctgcaacagatgccggtcggcggcagcttcacgatgaccatcaatgcctgccagacctcggtgaactacgacgccagcagcggcgcgcgctgtaaggatcaggcctccggcaactggtatgtgcgcaacgtcacccacaccaaagccgcgaacctgcggttgataaacacccactcgctggcggaggtgtttatcaacagcgatggcgtgccaacccttggggaagggaacgccgactgccggacacagaccattggcagccgttcaggattaagctgtaagatggtaaattataccttgcagaccaatgggttaagcaatacgtcgatccatattttcccggcgatcgccaactcgtcgctggcctcggccgtcggggcgtatgatatgcagttcagcctcaacggcagctcatggaagccggtgagcaataccgcctattactacaccttcaatgagatgaagagctcagatgcgatctatgtgttcttctccagtaacttctttaagcagatggtgaatctcgggatcagcgatatcaataccaaggatctgttcaactttcgcttccagaacaccacctcgccggagtcaggctggtatgagttttccacctccaatacgctgattatcaagccccgtgatttcagcatcagcattatctctgacgaatatacctcggcgccgtcgcgggaggggtatgtcggcagtggtgaaccggcgctcgatttcggctacatcgtcaccaccagcggtaaaacggccgccgacgaagtgctgatcaaagtgaccggaccggcgcaggtgattggtgggcgctcctactgtctcttcagctccgatgacggtacggcgaaagtgccgttcccggcgacgctctcttttatcacccgcagcggcgcgacgcagacctacgacgccgggtgcgatgacagctggcgggatatgaccgatgcgctgtggctgaccacgccgtggaccgatatctccggcgaagtggggcagatggataagaccacggtgaaattttcgattccgatggataacgccatttcgctgcggacggtagacgataacggctggtttggcgaagtcagcgcttcaggagagattcatgtccaggcgacgtggcgcaacattaactaa

SEQ ID NO: 5551 - DNA, 1524 bp, Klebsiella pneumoniae
ccagccactttattcgtcagcatttaccgaacccataaccgaggaggcgttatgtcccgaatggcagaacagcagctttatattaatggtggttatacatcggccaccagcggtcgcaccttcgagaccatcaaccctgccactggcgaggtgctggcgaccgttcaggctgccggacgcgaggatgtcgaccgcgccgtcgagagcgcgcagcgtgggcaaaaaatctgggcggcaatgaccgccatggaacgctcgcgcatcctgcgtcgcgccgtcgaccttctgcgccagcgcaacgatgagctggcgcggctggagacgctggataccgggaaacccctcagcgaaaccgccgccgtcgatatcgtcaccggcaccgacgtgctggagtattacgctggcttgatcccggcgctggaaggcagccagatcccgctgcgcgacagttccttcgtctacacccgtcgcgaaccgctgggggtggtagccgggatcggcgcgtggaactacccgatccagatcgccctgtggaaatcggcgccagcgctggccgctggcaatgcgatgattttcaaaccgagcgaagtcaccccgctgaccgccctcaagctggcggaaatttacagcgaagcgggcctgccggacggggtgtttaacgtcctgccagggatcggcgcggaaaccggccagtatctgaccgagcatccggacatcgccaaaatctccttcaccggcggcgtcgccagcggcaaaaaagtgatggccaactcggccgcttcatcactgaaagaggtcaccatggagctgggcggcaaatcgccgctgattatcgccgatgatgccgacctcgacctcgccgccgatattgccatgatggccaacttctacagctccggtcaggtctgcaccaacggcacccgggtgtttgtcccggcgaaacagaaggcggaattcgagcacaagatcctcgagcgggtggcccgcatccgcgccggcgatctgtttgccgacgacaccaacttcggcccgctggtcagcttcccccatcgcgacaacgttctgcgctatatcgagagcggcaaacgcgaaggcgcgcgcctgctgtgcggcggcgaggcgctgaaaggcgacggtttcgataacggcgcgtgggtcgccccgacggtgtttaccgattgcagcgacgagatgaccatcgtgcgcgaagagatcttcggcccggtgatgtcgatcctcagctatgccgacgaagcggaggtcattcgccgcgccaacgccaccgaatacggcctcgccgccggcgtggtgacgcccaacctcaaccgcgctcaccgaattatccaccagctggaagccggcatctgctggatcaacagctggggggaatccccggcggaaatgccggttggcggctacaaacactccggcattggccgcgagaacggcgtcatgacgctgcagagttacacccaggtgaagtccatccaggttgagatgggtaaattccagtccatattttaa

SEQ ID NO: 5552 - DNA, 1212 bp, Klebsiella pneumoniae
atcttttttccccaaaccggggccgttttttatttctgcctttatctggtcgctgctggccgtgatcttttggcaggcgggcggcggcgactggctgctgcgggtcaccggggcatcgcaaaatgtggcgatcagcgcggcgcgcttctggtcgctcaactatctggtgttctacgcttactatctgttttgcgtcggcgtgttcgcgctgttctggtttgtctactgcccgcaccgctggcagtactggtcgattctcggcacctcgctcatcatcttcgtcacctggtttctggtagaagtcggggtggcgtcaacgcctggtatgcgccgttctacgacctgatccagagcgcgctggccaccccgcataaggtcagcatcaaccagttttatcaggaaatcggcgtctttctcggcatcgcgatcatcgcggtgattattggcgtgatgaacaacttcttcgtcagccactacgtcttccgctggcgcacggcgatgaacgagcactatatggcccactggcagcatctgcgccatatcgaaggcgccgcgcagcgtgtgcaggaagataccatgcgttttgcttccaccctcgaagatatgggcgtgagctttatcaacgcggtgatgaccctgatcgccttcctgccggtgctggtgacgctctccgaacatgttcccgacctgcctatcgtcggccatctgccgtatggcctggtgattgccgctatcgtctggtcgctgatggggaccggcctgctggcggtggtggggattaagctgccgggcctggagtttaaaaaccagcgcgtggaagcggcctatcgtaaagagctggtttacggcgaggacgatgaaactcgcgccacgccaccgacggtgcgcgagctattccgcgcggtgcgtcgcaactatttccgtctctatttccactatatgtatttcaatatcgcccgcatcctctatctgcaggtggataacgttttcggccttttcctgctgtttccgtcgatcgttgccggtacgattaccctcgggctgatgacgcaaattaccaacgtcttcggccaggtgcgcggctcgttccagtacctgatcagctcgtggacaacgctggtggaactgatgtccatctacaaacgtctgcgcagttttgaacgcgagctggacggcaaaccgctgcaggaagcgatcccgacattacgttaa

SEQ ID NO: 5553 - DNA, 1176 bp, Klebsiella pneumoniae
tttcaccttccagcgtttcagagccagcccatgagttatcaggtcttagcccgtaaatggcgcccacaaacctttgctgacgtcgtcggccaggaacatgtgctgaccgcactggcgaacggcttgtcgttagggcgcattcatcacgcttatcttttttccggtacccgcggggtcgggaagacctccatcgcccgtctgctggcgaaagggttaaactgtgaaaccggcatcaccgccaccccctgcggcgtgtgcgataactgccgggaaattgaacaggggcgctttgtcgatctgattgagattgacgccgcctcgcgaaccaaagtcgaagatacccgcgatctgctggacaacgtccagtacgcgccggcccgcggccgctttaaggtctatctcatcgacgaagtccatatgctgtcgcgtcacagcttcaacgcgttgttaaaaacgctggaggagccgccggcgcacgtcaaattcctgctggcgacgacggatccgcagaagctgccggtaacgatcttatcccgctgcctgcagttccacctgaaggcgctggacgttgaacagatccgccatcagctggagcatattcttggcgaagagcagattgcctttgagccccgcgcgctgcagctgttgtcgcgggcggccgatggcagcctgcgcgatgccttaagcctgaccgatcaggcgattgccagtggggaagggcagctgacggccgcatcggtgagcaccatgctcggcacccttgatgacgatcaggcgctgtcgctgattgaagcgctggttgctgccgacggcgagcgggtcatggcgggcgtcaatgacgccgccgcacgcggcgtcgagtgggaggcgctgctggtcgagatgcagagcctgctgcaccgcatcgccatggttcagctgtcgccttcggcgctgggcgccgacatggccgcggtcgaagtgcggatgcgcgaactggcgcgaaccgtaccgcccggcgacgttcagctctactaccaaacgctgctgattggccgcaaagagctgccttacgccccggaccggcggatgggcgtcgaaatgacgctgctgcgtgccctggcgtctcatccgcgtaagccgctgccggagccggaggtgaagctggcaacaggcagcgggccccgggcaggttaa

SEQ ID NO: 5554 - DNA, 1074 bp, Klebsiella pneumoniae
aatcaacttccgctcgtcgaccattctcgggctggtgggcgcaggcggcatcggccaggagctgatgaccaacatcaagctcgaccgctacgatcaggtgagcatcaccctgctgctgatcattctggtagtgtcggcgctggacatgctgtccggtcgtctgcgcctgtgggtactggaggggaaaaaatgagcgtctggcacatgcaaccggatatcgccgccagccggcggcaacataagcagctctatcaggtccaggggcgctacctgcgctacgtcgggctggtggcgctggcctgcctgctctattacgtctggttttttctgcagttcggcgtcagcggcgagcagctgaccaccggcctgcagcagattggccgctacctggcgcggatgttcgtctggcacgacttctggaactggccgttcggctattactttacgcaaatcggcgtcaccctggccatcgtcttcgccgggacgctgaccgccacggtgctggcgctgctgctctccttcttcgccgcccgcaacatcatgcgcggcgtggtgctggggaccctcgccctgctgatgcgccgcctgtttgatgtgctgcgcgggatcgacatggctatctgggggctgattttcgtgcgtgcggtcggcctcgggccgctggcaggggtgctggcgatcatcatgcaggacaccggcctgctgggacggctgtacgcggaaggacacgaagccgtggaccgatctcccgggcgcgggctgaccgccgtgggcgcgaacggcctgcaaaagcatcgctttggcatttttacccagtcgttcccgaccttcctcgcgctgagcctgtatcagattgaatccaacacccgctccgcggcggtgctgggcttcgtcggcgccggcggtatcgggcttatctatgccgagaatatgcgtctgtggaactgggatgtggtgatgtttatcaccctgctgctggtggcggtggtgatgatcatggacaccctttccgcctggctgcgccgtcgttatatcggcggcgccgcggtgccgctgtatcagggcggacgctag

SEQ ID NO: 5555 - DNA, 1404 bp, Klebsiella pneumoniae
ggcctttctccatccgatcgcttatcgaccccagggccagcacgcaggccacggcgaggcttaacgccagccagacgatcagcagcgacggcgagcgccattcgcgccagaaccagcgggcgatcatgcttcctcccgcagctggccatccgccaggcgcagacggcgatcgcagcgcgccgccagcagcggatcgtgagtgacgaggatcagggtggtgccgtgttcgcgattaagcgagaacagcagatcggcaattttgtccccggtctggcgatcgaggttgccggtgggctcatcggcgaacagaatggccgggcgcccgttaaaggcccgggccagcgccaccctctgctgttcgccgccggagagctgcgccggcaggtggtgcaggcgtttgccaagtcccagctgctcaagcagcgcgcgggcatcgccccggctctggctatcgctggcgccgcgcaacagcgccggcagctcgacgttctccagggcgttgagcgtcgggatcagcataaacgactgaaaaacaaaaccaacgtgctgcgcccgcagcgccgcccgcgcctcttcatccatccggtgcagcggtttgcccagcatcgatacttccccgctgctgccatcgtcgaggccggcgaggatcgccagcagggtcgatttaccggaacccgactcgccgatcagggcgatggtctgccgcggtttgacaaccagctcaactccggtaaggatggagagctgatgctccccctgaccgacggacttcttaagatgatgaacttcaagtatgttttccgctggcatgtgcctttcctgttgttgttcctgtttacctgccgcgcgatggcggcggacacgctgctgatcctcggcgacagcctgagcgctggctatcggatggcggccaacgccgcctggcctgcgctgctcaatgagcagtggcaggcgaaaacgccggtggtgaacgccagcatcagcggcgatacctcgcagcaggggttggctcgcctgccagcgctgcttaagcagcaccagccgcgctgggtgctggttgagctcggcggcaatgacggactgcgcggttttccgccgcagcagaccgagcaaacgctgcgcaccattattaaagatatcaaagcggccaacgccgagccgctgctgatgcaaattcacctgccggcgaactatggccgccgctataatgaagccttcggcgcgatttacccggccctggccaaagagttcgctattcctctcctgcccttttttatggaggaggtctatctcaagccgcaatggatgcaggacgacggcattcatccaaatcgcgacgcgcagccgtttatcgccgactggatggcgaagcggctggctcccttagttaatcatgactcctga

SEQ ID NO: 5556 - DNA, 378 bp, Klebsiella pneumoniae
caggagtatccgatgaatatgaaaaaactgacgacccttttgctcaccgccaccttaggtcttgccagcggcgcggccctggcggcagacaccggcgcccagtccaataatggccaggccaactcttccgcggatgccggtcaggtggcgccggatgcccgtgagaacgtggcgccgaacaacgtggacaatagtcagatcaactctggttctgggggcaccacgggctcgacgatgacccaggataatatgtcgagcgatgaggtacataaaaactcgatgtgtaaagacggccgctgtccggacaccggtaaaaaactggacaacggcggcaatacgacccaagacaacagcaaaaccgacggcaccacccagtaa

SEQ ID NO: 5557 - DNA, 1407 bp, Klebsiella pneumoniae
aacctgctgttttatactaacttgaacgaaacgggaagacgtggacggaaaaacttaccgtctttacgcaacgcgcagccctgccggatggtctttagtcacaaaaaaataacatttccctgcgctattgttgactttaccggcgttatgaaaataaatgtctatacaacccatgacaagttaagcgctatgactgaagccacttccgaactcgttatctggcgaaacgggcgtctcgccactctgaaccccgatcacgctcaaccttacggcctgctggagcgccatgcgctgctggtgcgcgacggccgcatcgcggcgattgtcgccgaagatgacgtccccagcgggcgcagtatcgatcttgaaggccggttggtaacgccgggattaatcgactgccacacccatctcgtcttcggcggcagccgggcccaggagtgggagcagcggctgaacggcgtgtcgtatcaaaccatcagcgccagcggcggcggtattaactccaccgtgcgcgccacgcgcgacagcagcgaagctgaactactggcgctggcccagccgcgtctggaacgcctgctgcgtgaaggggtgaccaccctggagatcaaatccggctacggcctcgacctgccaaacgaacgcaaaatgctgcgggtcgcccgacaactggccgatcataatggcgtggaactgtcggcgacgctgctctccgcccacgccacgccgccggaatatcaaggcgatgctaacggctatattacgctggtctgcgagaccattttgccgacgctgtggcaggagggactgtttgaaagcgttgacgtcttctgcgaaaacgtcggcttcagcccgcagcaaactgagcgcgtctttcaggcggcgcaggcgctgggcattccggtaaaaggccacgttgagcagctctcgtcgctgggcggcgcgcagctggtgagccgttatcatgggctttccgccgaccatatcgagtatctgacggaagagggcgtggcggcgatgcgcgaaagcggcaccgtggcagccctgctccccggcgcgttctacttccttaatgaaacccgtaaaccgccggtcgagctgctgcgcaagtaccaggtgccgatggcggtggcgaccgatttcaaccccggcaccagccccttcgccagcctgcatctggcgatgaacatggcctgcgtcaagtttggcctgacgccggaggaggcgtgggccggcgtgacgcgccatgccgcgcgggcgctggggcgccaggccagccacggccagctggcgccgggctttgtcgctaacttcgccatctgggatgctgagcatcccgtcgagatggtgtatgagccggggtgcagtccgctctggcatcgcgttgttcaaggagaattgcaatga

SEQ ID NO: 5558 - DNA, 1695 bp, Klebsiella pneumoniae
tcatcgctgttgctgcagacgaccggactgatcattgagcgcgcgttggcgtttgagaaagtccagatccatttccagaatcggctcacccgccttcacgtccgtgccctcttcaaccagacgtttgaagcccttgccttccagcgccacggtgtcgatacccatgtgaacgacgatttccgcaccgttgttggtttcgaggcagaacgcgtggttagtgttgaaaattttcaccacggtaccggcggccggggccaccacgatgttgctggtcggtttcaccgcgatcccgtcgccgacggctttgctggcgaaggcttcgtccggcacctgctcaagggccaccacgtcaccggtaatcggcgaaaccagcgactcaacggtcttcgcgttcgctaccgcctgcggtttagccgcgggcgctgcggtggcgacgttgccagccggtgcggctgccgctgccgctaccgggccgcgggtaaccacttttttcatctcatcgccgatagactctgctttcgcaccgacgataacctgaatggtttgcttattcagtttcaccaccccggacgcgccgagacgtttacaggcggcgtcgttcaccttcgccgaatcgcccacggtcagacgcagacgggtgatacaggcgtcaatggctttcaggttgtccgttccgcccaccgcggcgatatagctggtcgccagctgggtcagcccctcttcagtgttgctgttggcttcttccgttaccacgtcagcggctttgtcttcacgacccggcgttttcaggttgaacatgcggatcaccgcgctgaacagcaggaagtagacgaagaagaacaccacgcccatcaccagcagcatccagacgtttttgctggcggccggcaggctgtacatcagcacgtagtcaattgcacctgcggagaaggagaagcccgcatggatcccgagcgccgttgcgatgaacaggctgataccggtcagcaccgcatgcaggaggtacagcagcggagccaggaacatgaacaggaattccagcggctcggttaccccggtcaggaacgcggtgatggccacggacagcagcataccgcctaccatcggacgacgcgctttcggcgccgccagatacatcgccagcgccgcacccggcagaccaaacatcatgattgggaagaagccggacatgaacatccccgcggtgccgtcgccggcgtagaagcggttgatgtcgccgtggaacacagcgccagcggcgttagtgaactcaccaatctggaaccaggcgatggtgttcagcacctgatgcagaccggttgggatcagcagacggttgatgaaaccaaagataccggaacccagcgcgcctgcggagacgatccattcgccgccagagtggatagcgtgctgcaccggcggccagacgtagccgaagatcgccgcgaggatcagacagaagaagccggtggcgatcggcacgaagcgtttgccgccgaagaagctcaggaagtccggcagcttgatgccggcccagcggttgtataccgcccctgccaccagaccggtaatgataccggccagcacgcccatattgatttccgggttgatggtgaccatcgctttggtcatcacgaaataccctaccgcaccggccagcgccgcagaaccggcgttatccttggaccagcttga

SEQ ID NO: 5559 - DNA, 390 bp, Klebsiella pneumoniae
atctggctgttttatttatttaaccttgcactctggagttattttatgaccctggactatgtggcgctggccattctgatcgccgtggccttaatacttttttatggcgtgattgttattcacgatattccttatgaaatcgccaaagagcggcgtcatcctcatcaggatgcgattcattatgccggttgggtcagcttatttaccctccacgcgctgtggcccttgttatggatctgggcgacgctgtggcgcgaagaccgcggatgggggatgcgccacattgccgacgatcagcaggcgctgcatcagcgtctggaaacggtggtccagcagctggaacaggtccagcgcgaggtggacgttctgaaagcgaaggaggcaaaataa

SEQ ID NO: 5560 - DNA, 699 bp, Klebsiella pneumoniae
ggtattatgttggacattctgccatccggctgcaagacccagaagttttctgagttttaccgccatcctggtttgacgctatccgcggttgggatttgtacttataatcccaacgatttgtattcagaaaagatatcgcactggattaagatgaaaacaattgaagttgatgatgaactctatcgctatattgccagccacactctgcatatcggcgagagcgcatccgacattttacggcgtatgctaaaattttccgccgtttcccaaccggctacaccggtcagcaaagccgcgccgacgctggcgccagcgcctgtcgctgaggtgaaacccgctaacccggtgaaagataaagtccgcgccatgcgcgagatgctgttatctgatgaatacgccgagcagaagcgcgcggtgaaccgttttatgctggtgttgacgaccctctactccctggacagtaaagcatttgccgaggccaccgagtctctgcacggccgcacgcgcgtttacttcgcggaagatgcgcgtacgctgctgaaaagcggtaatcagaccaaaccgaaacaggttcctggtacaccgtggtgggtgatcaccaataccaataccggccgtaaatgcagcatgattgagcacatcatgcagtcgatgcagttccctgcggagctgattgaaaaggtttgcggcacgatctag

SEQ ID NO: 5561 - DNA, 417 bp, Klebsiella pneumoniae
cattatttcccctccactgcggcaacaacctgctgtgctgcgtccgtcagacttttcgctgcaataatattcaggccgctgtcagccagttttttcgcgcccagttcggcgttgttaccttccagacgaaccacaaccggaacgttaacccctacttccgctaccgcgccgatgatgccgtcagcgatcaggtcgcaacgcacgatgccgccgaagatattaaccagcaccgctttaacgttgtcgtcagagaggatgattttgaacgcttcggtcacgcgctctttggtcgcgccgccgcctacgtcgaggaagttagccggttcgccgccgtgcagcttaacgatgtccatggtacccatcgccaggcctgcgccgttaaccatgcagccgatgttgccgtccagcgcgacgtag

SEQ ID NO: 5562 - DNA, 900 bp, Klebsiella pneumoniae
atggatttcccgcaacaattgcaggcctgtgtggaacaggcaaacgaagcgctgcgccgtttcatcgccccgcagccctttcagaacactccgctggtggaagcgatgcattatggcgcattgttaggcggtaaacgcctgcgtcccttccttgtctacgccaccggcgagatgttcggcgtgtgccgtaccacgctggatgctcctgccgcggcggtcgaatgcattcatgcctactccctgatgcatgatgatttgccggcgatggatgatgacgatctgcgccgcggcctgccgacctgccatattaaatttggcgaagccaacgcaattcttgcgggagatgccctgcaaacgctggcgttctctatactgagtgatgcgccgatggtcgacgttcctgaccgggaccggctggcgatggtttccgaactggcgcaggccagcggcgtggcgggcatgtgcggcggccaggcgctggatctgcaggccgagggacagcaggttgatttacaggcgctggagcgtatccatcgccataaaacgggcgccctgatccgcgccgccgtccggatgggagccctgagcgccggcgaacgcggccgcgctgccctgcccgcgctggatcgctatgcggaaaatatcggtcttgccttccaggtccaggatgacattctcgacgtggtaggggatactgcgacccttggcaaacgtcagggtgccgaccagcaattgggtaaaagcacctatcccgccctcctgggtcttgagcaagcccggaagaaagcgcacgacctgatcgctgatgcccgccggtcgttagatgagctggccgcacaatctctggatacttcggcactggaagcgctcgcgaattacattattcagcgcgataaataa

SEQ ID NO: 5563 - DNA, 489 bp, Klebsiella pneumoniae; identical to SEQ ID NO: 3262

SEQ ID NO: 5564 - DNA, 318 bp, Klebsiella pneumoniae
acgagatacccggaatggcgcgctttttcgccagaatccgcgccagttcgtcccagacggcggccaccgtcgagcaggaatattgcggatacagcggcagcaccacgatgtgctccaccccctgcgccagtaagtcatccaccgcgctggccagcgacggtgaaccatagctcatgcccagcgccaccggggtatccggcagcctggcagccagcgcctgctgctggcgacgactatacaccatcagcggcgatccctcttccatccacacggactgatagagcttcgccacgcgcggggagcgaatcggcagtatga

SEQ ID NO: 5565 - DNA, 1221 bp, Klebsiella pneumoniae
aacgcgcaccctcccttcggcgatgtacaccttgattcaaaccccgggcggggagggggcggcggcccgcctctgcctcatcgccatcggtctggcgctggtttcgctgctgatttcggaatggctggcccgcgtgagccgccagcgcatgggaggataatgatgctggagctggactttacccagaccctcggtagccactgcctgcagatccgtgaaactctgcccgccagcgggatcaccgccgtctttggcgtctccggcgcgggcaaaacctcgttgattaacgccatcagcggcctgacccgaccccaggcggggcggatcgtgctcaatggccgggtgctgaacgacaccgcgcagcgtatctgcctggcgccggagaagcgccgtatcggctatgtctttcaggatgcgcgcctgtttccccattataaagtgcgcggcaatctgcagtatgggatggcgaaatccatggtcagccagttcgataagctggtggatctcctggggattgcacccttgctggatcgtctgccgggccggttatccggcggcgaaaagcagcgagtggctatcggccgcgccctgctgaccgcgccggagctgctgctgctggatgagccgctggcctcgctggacattccgcgcaaacgcgagctattgccctacctgcagcggctggcgcaggagattcatattccgatgctttacgtcagccactcgctggatgagatccagcatctggccgatcgtgtgctggtgctggaggccggtaaggtgaaagctttcggtccgctggaggaggtctggagcagcagcgtgatgcacccctggctgccggcggagcagcagagtactatccttagcgccaccgtcgccgcgcagcacccgcagtatgcgatgacggccctggcgctgggggaccagttgctgtgggtcaaccggctcgaacgtcccgcaggcgacaccgcacggatccgcattcaggcgtcggacgtttcgctgacactggcccagccgtccgggaccagcatccgcaatatcttgcgcgccgaggtggctcagtgtctggaggtcaacggacagattgaagtgcagctcagagtgagtggccgtctgctatgggccaggattagcccatgggcgcgggacgacctggcgatagcgccaggtcagcaggtgtttgcccagatcaaaagcgtgtcgatcgccgcctga

SEQ ID NO: 5566 - DNA, 483 bp, Klebsiella pneumoniae
gaccttaacccttgcccctttcggcgagggttttcttttacggacaggttcctggataacatggagtatgcaatgaccagacccgcaatcatcattaatgaactggatgccgaacgtatcgacaggctgctggagcagccggctttcgccaactcaccggttgccgatgccctgaatgaggaactcgaccgcgcgcaaatgctggccccggaagcgatgccgcatgatgtcgtcaccatgaatagcagggtaaaattccgcgatttaaccagcggcgaagagcgcgtgcggacgctggtgtttccgtcacaggtgaccgacagcgccagccagctctccgtcctcgcgccggtgggcgccgcgctgctgggcctgaaagtcggcagcaccattcactgggagctgccgggcggcgcatcgacgcacctggaagtgctggagctattgtaccagccggaagccgctggcgaattccaccgctaa

SEQ ID NO: 5567 - DNA, 606 bp, Klebsiella pneumoniae
aaagcagacccatttcctgcatcagggcaacaccggtattacgcagaacctgtcctatattggcggttaatcgttttcgaaaggagcattcagatgagccaggctagcgctgagtttatcccgacccgtattgctattcttaccgtttccagccgtcgcggcgaagaggacgacacttccggtcactggctgcgcgaggcggcgcaggaggcggggcaccaagtcgtcgagaaggcgatcgtcaaagagaatcgctacgccatccgcgctcaggtatcggcgtggatagccagcgataacgtgcaggtggtgctgatcaccggcggcaccggttttaccgacggcgatcaggcgccggaagcgctgctgccgctgtttgatcgtgaggtcgaaggctttggcgaagtgttccgcatgctgtccttcgaagagatcggcacctcgacgttgcagtcccgggccgtggccggcgtcgccaatcgcacgctgattttcgccatgccgggctcaaccaaagcctgccgcacggcgtgggacaacatcatcgccccgcagcttgatgcccgcactcgtccctgtaacttcattccacacctgaagaaataa

SEQ ID NO: 5568 - DNA, 834 bp, Klebsiella pneumoniae
gtttttcgcccatccgcagcatgcccgcgcacggcgttttctgcagaaggtgctggatccgctgcaccaggagagcctcgagtgacgccgatgcttgactggcacggcgtcctgagcgggcagccgttgcaatggattatctctggttttctcaccaccgtctgggtcagcgtcgccgggatcctgctcgccaccctgctggcggtcctgctgctggccctgcgcctcggcggcggacgcgcggggcgcggactggtggccgcgtgggtctcgttgtttcgcaacactccgctgctggtccaactgctgttctggtactttgccgcctggaacctgctgccgctggcggtgaaggaggtggtgaacgacgaacacgcctggtccattctgccgggcaacgtctggtggctgacgccggagttcctctgctcaatgtgggggctgggggtctttacctccgcctttctggtggaagagatcgcctccggactgcgcgccgtcagccacgggcagcgggaagccgcgctgtcgcagggctttacgccgtggcaggagctgcgctttatcctcctgccgcaggggctggccaacgcctggcagccgattgtcggccagtatcttaacctgatgaaactctcatcgctggcgagcggcatcggctttgcggaactgacctatcaggtgcggcagattgagagctataacgcgcacgccctggaggcgtttgccgtcggcaccgcgctgtacctggcgctgggggtggcgatgggcgtggcgttcacgcgtctcggcccgggaagaaaactgcaacggagcgcccgacatgaacgctaa

SEQ ID NO: 5569 - DNA, 3186 bp, Klebsiella pneumoniae
gctgttcgcccatacggtgcatacgctcaccgcggaggacgaaaacgcatgaaaatcctcagtctgcgtctgaaaaacctcaactccctgaaaggggaatggaagatagactttaccgccgagccgttcgccagcaatggcctgttcgccattaccggcgccaccggggccgggaaaaccacgctgctcgatgccatttgcctggcgctctatcatgagacgccgcgcctgaataaagtctcccagtcgcaaaacgacctgatgacccgcgataccgccgagtgtctggcggaagtcgagtttgaagtaaaaggcatcgcctaccgcgctttctggagccagaaccgggcccgtaaccagccggatggcaatctgcaggcgccccgcgtcgagctggcgcgctgcgctgacggcaaaatcctcgccgataaagtctcggacaagctggagcaaaccgcgacgcttaccggcctcgactatggccgcttcacccgctcgatgctgctttcccaggggcaatttgccgccttcctgaacgcgaagccgagcgatcgcgcggagctgctggaggagctgaccggcacggaaatctacggccagatttcagccatggtctacgaacagcacaaagccgctcgccatgcgctggagaagttcgaagcccaggcggcgggcatcgtcctgttgacggaggcccagcagcaggcgctgcaggaaagtttgcaggtacttactgacgaagaaaaagccctgctggcccagcagcagagccagcagcaccagctccagtggctgacccgccgcgacgagctggcgcagcagcagcagcaggccgccacccggcagcagcaggcccgccaggcgctggcggacgccgccccggcgctggcgaagcttgagctggcccagcccgccgcccaactgcgtcccctgtgggagcgccagcaggagcagacggcaggcctggcgcaaacccggcagcggatcagtgaagtaaatgctcgcttacttgccagcacggcgctgcgcgcgcgcatccgccagggcgccttgcgcgctcagcagcagcgtcaggctgaactggccgatctggcgcagtggctggccgcccatgagcgtttccgcttatggggtcaggagatcgccggctggcgagcgcaattctcgcaactgacgcgggataaacaacagctaacggctcagagcacccgcctggccgcgctacgccagaagctggccacgctgccagccagccctctcaccctgagcgcggatgacgttgccgcagcgatagaacagcaaacccaatcgcggccgctgcgccagcgcctgatctccctgcatgagcagcatcagctgctgcgcaagcgtctgcgccagaacgccgacagcgtccagcaggcgcaggcggagcaggtaaaacttaacgctaccctgacgctgcgccgggaacaatataaagacaaaaaccagcactatctcgacctgaaggcgctctgccagcgggaagaaacgattaaagacctggaaagctaccgcgaccggctcgaggcgggtaagccctgtccgctgtgcggcgcctgtgaacacccggcgattgaacaatacgcctcgttgacgctcacggataatcagcgccgccgcgatgcgctggaaaaggaggtcgccgtgctgaaagaagaaggcctgctgatcctcgggcaggtcaaggccctgacgcaacagcttcagcgtgacaccgaagcggccgggcggctcgcagaggaagagcaagcgcttactaaagcgtggcaggagacctgcgcctctctgcacatcgcgcgggatattgcgcaagagataaacgactggatgcaggaacaggagcgctacgagcagcagctctatcagctcagccagcgcctgatgttgcagagtcagcttaacgatcagcaggcgctggagcgccaggccgagcagcagctggcggccacgcgccagggactggagagcgccctgcaggccctggccctgagcctgccggcagaagggacagaagccgcctggctgcacgctcgcgaaagcgaatttgcccagtggcaggcgcaacagacccaacatgatgccattcagcagcaaatcgctgctctgcggccactgctggagacgctgccgaccagcgacgagacagaggttgaagctgagtcggccatcccggacaactggcgcgaaatccacgaggaatgcctgtcgctgcacagccagcttgtcgcccagcagcagcaggaaacccaggaaaaggcgcgtctggaccagtcgcaggcgcaattcacctccgccctggccgccagccgctttagcgatcgggaggcgttcctcgccgcgctgctggatgacgagaccgcccagcggctgacgcagttaaaacagacgctggagcagcagcttcagcaggcggctgcgctctgcgagcaggcgacccggcaacatgaggcgcacctggcgctgcgtccgcaaggggtggacgctgacgtccccaccctgcaaacccagctgcacgccctggcccagcggctgcgggataacactacccgccagggtgagatccgccagcagctcaggcaggacgcagagagccgtcaacagcagcaggcgctggggcagcagattgcagaggcggcgcagctggcggacgactggggctatctcaattcgctgatcggctccagcaccggcgaccggttccgcaaattcgcccaggggctgacgctggataatctggtctggctggcaaaccagcagctcaaccgcctgcatggccgctatctgctacagcgcaaggccagcgaggcgctggagctggaggttgtcgatacctggcaggccgacgccgtgcgcgacacccgcaccctctccggcggcgaaagtttcctcgtcagcctggcgctggccctggcgctgtcagacctggtgagccataagacgcggattgactccctgtttcttgatgaaggcttcggcaccctcgacagcgaaacgctggacacggcgctggacgccctggatgcccttaacgctagcggtaagattatcggggtgatcagccacgtggaggcgatgaaagaccgcattccggtgcagatcaaagtgaagaagattaacggcctgggctatagccggctggacaaagcgtttgccgtggagtga

SEQ ID NO: 5570 - DNA, 363 bp, Klebsiella pneumoniae
cgcctgcgcccagttgcgggtgcggagcacatgcccggtggggtgttcataaagcatcgcgtcgtccacatatgccaggccgtggatctgctgtttggcgagcatggcagtgaggcttaccgcttgctctaccggcataggatcggcggccaaaaccttttttgcgtgataatcatacaaataggtgccattacaacaaattgcaggtgtatcgagagccagtgcctgataaaaaggatggatagcgacgtgatgacgtccggtgacgacgatgacctgatagcctgcctctctggcgcgggccagcgcctccagcgaagcgggcagaatggtttttttgctggtaagcagggtgccgtctaa

SEQ ID NO: 5571 - DNA, 2412 bp, Klebsiella pneumoniae
cttaccagccctatttttattagcgcaatttgcacagaatcactatttcgcggtcacaacctgcatgccgaacggttcgttctgcagcgcaagtgtcagaacttcctcgattcgtttcaccggatggatatccaaatcggcgataacgttatccggaatttcttcaaggtcgcgtttgttctcatcaggaatcagaacagtcttaatgccgccgcgatgcgccgccagcagtttttccttcagaccgccgatcggcagcacctgaccacgcagagtgatttcaccggtcatcgccacatcagcgcgtaccgggttgccggtcaggcaggagaccagcgccgtgcacatggcaatacccgcgctcggaccatccttaggcgtcgccccttccggcacgtgcacgtgaatgtcacgcttctcgtagaagtcggcgttaatgcccagcttgtcagcccgcgaacgtaccaccgtcagcgcagcctgaatcgactcctgcatcacctcgcccagcgagccggtgtaggtcagcttgcctttgcccggcacgcaggcggtttcgatggtcagcagatcgccgcccacttccgtccacgccagaccggtcacctgaccgacgcggttctcactatcggcgcggccatagtcgaagcgctgtacgccgagataatcatgcagattctcaccgttaatttcgatgtgtttcagcgatttatccagcagcagttgcttaacggccttgcggcacagcttggagatttcacgctccaggctacgtacccccgcttcccgcgtgtagtaacgaataatgccgataatggcgctatcgtcgacggtcaactcgcctttcttcagcgcgttacgttcgatctgtttcggcagcagatgacgtttggcgatgttcagtttttcatcttcggtatagccggagagacgaatcacttccatacggtccagcagcggcgccggaatgttcatggagttggaagtcgccacgaacatcacgtcgctgagatcgtaatccacttccagatagtggtcgttaaaggccacgttctgttccggatccagcacctcaagcaacgcggaagccgggtcgccgcgcatgtcggaagacattttgtcgatctcgtccaacaggaacagcgggtttttgacccccactttcgccattttctggatcagtttgcccggcatcgagccaatgtaggtccgacgatgaccgcggatttccgcttcatcgcgcacgccgccaagcgccatacgaacgtatttccgtccggtcgctttggcgatggattgacccagcgaggttttacctacccccggcggtcccaccagacaaaggattggccccttgattttgttcacccggctctgcaccgcgagatattcaaggatgcgatccttcacgcgctccaggccatagtgatcggtatcgaggatctcctgggcctgacgcaggtcttttttgaccttactgcgcgcattccacggcacctgcaccatccagtcgatgtagccacgcacgacggtcgcttccgcagacatcggcgacatcatcttcagcttctgcagttccgcttcggttttttctttcgcctctttcggcattttcgccgcgtcgatcttacgcttcagcgcttcgttttcgtccggggcgtcgtccatctcgccgagttctttctgaatcgctttcatttgctcgttcagatagtactcgcgctgagatttctccatctgctttttgacgcggttgcgaatgcgcttctcaacctgcagcagatcgatttccgattccatcatcgccatcagatattccagacgttcgttaacgtcggacatctcaagcacagactgcttgtcagccagcttcagcggcatgtgcgccgcgatggtatccgccaggcgcgccggatcgtcgatgctgttcagcgacgtcagcacttccggtgggatcttcttgttcagcttgatatagccttcaaactggctgatagcggtgcgaaccagcacttcctgctcgcgttcgtcaatcgccggcgagtcgagatactccgctttcgccgagaaatgctcgccattatcagacagcgcagaaatgcgagcacgctgcagcccttcgaccagcaccttcacggtgccgtccggcagcttcagcatctgcaaaatagacgccacggttccaacggtgaaaagatcgtttacacccggctcatccgtcgacgcttctttctgcgcaaccagcatgatttttttatcatggtccatggccgcttcgaggcaacggatagatttttcccgccctacgaacaggggtatgaccatgtgcggataaaccaccacatcgcgcaatggcaatacggggatttcaatgcgttcagaacgctcaggattcatagagctctctcttag

SEQ ID NO: 5572 - DNA, 186 bp, Klebsiella pneumoniae
caggagagcccgatgtcgctggaaaatgcatccgatgaggtcaaactggccgtcgatttaatcatgttgctggaatcgcatcagatcccggcgcaaaccgtgctgagcgcgctggaaattgtccggcgggattatgcaaacaagttaaaaaacgcggaaagcgggtcgcaaaacccagagaagtag

SEQ ID NO: 5573 - DNA, 948 bp, Klebsiella pneumoniae
ctcaggagccccaacatgtcgcagactaatccgtttaccgccctgcttgccgcccagcctttcgtgctgctggacggcgccatggccaccgagctggaggcccgcggctgcgatctggccgacagcctgtggtcggcgaaagtgctgctggagaacccgcagctgatccgcgatgtgcatctcgactactttcgcgccggggcgcaggtggcgatcaccgccagctatcaggccactccggcgggctttgccgcgcgcgggctggatgaggcgcagtcccgggcgctaatcggcaaaagcgtcgagctggcgcgcaaagcgcgcgaggcgtacctcgccgagaacccgcaggccggtacgctgctggtggccggttcggtggggccgtatggcgcgtttctcgccgacggctcggagtatcgcggcgattatcagcgcagcgcggcagagttccaggccttccaccgcccgcgcgtcgaagcgctgctggatgccggcgccgacctgctggcctgtgaaaccctgccgtcattcgctgagatccaggccctggcggccctgctgcaggagtatccccgcgcccgcgcctggtactccttcacgctgcgcgacgccgaacatctcagcgacggtacgccgctgcgcgaggtgatggccgccctggcggataacccgcaggtggtggcggtggggatcaactgtatcgccctggaaaatacgcccgcggcgctggcgcatttgcacagcctgacggccctgccgctggtggtctatcctaactccggcgaacattatgatgcggtgagcaagacctggcaccatcatggcgaagcctgcgccagcctggcggattatctgccgcagtggctggcggccggggcgaagctgatcggcggctgctgccgcaccacgccgaaggacatcgccgcgcttaacgcgaagcgctaa

SEQ ID NO: 5574 - DNA, 1203 bp, Klebsiella pneumoniae
ggtgatggccctggccgaccgcatcctggtgatggccgatggccgcattaccgccgatttaccgcgccatgcggtgacccgcgaacagttaatcgcggcttcaacacctcaagattaatcaggctggaatccatcatgaaccagaaatatatgatttatatgtacctgctgaaggcccgcacctttatcgccctcctgctggtgatcgcgttcttcagcgtgatggtacccaacttcctgaccgcctctaacctgctgatcatgacccagcacgtggcgatcaccggcctgctggccatcggcatgacgctggtcattctcaccggcggcattgatttgtccgtcggcgcggtggcggggatctgcggcatggtggcgggcgcgctgctgaccaacggcctgccgctgtggaacggcgatatcctcttctttaacgtcccggaggtgatcctctgcgtggcgatcttcggcgtgctggtcggtctggtcaacggcgcggtgatcacccgcttcggcgtggcgccgtttatctgcaccttaggcatgatgtacgtcgcccgcggctccgcgctgctgtttaacgacgggagcacctacccgaatctcaacggcatggaagcgctgggcaacaccggtttcgccaccctcggatccggcaccctgctcggcgtctatctgccgatctggctgatgatcggcttcctcgtgctgggctactggctgaccactaaaacgccgcttggccgctacatctacgccatcggcggcaatgagtctgccgcccgcctcgccggcgtgccgatcgtgaaagcgaaaatattcgtctatgccttctccggcctgtgcgcggcgtttgtcggcctgatcgtcgcatcacagctgcaaaccgcgcacccgatgaccggcaacatgtttgagatggacgccatcggcgccaccgtgctcggcggtaccgcgctggccggcggccgcggccgggtgaccgggtcaattatcggcgccttcgtcatcgtcttccttgccgacggcatggtgatgatgggcgtcagcgacttctggcagatggtgattaaaggcgtggtgattgtcaccgctgtggtcgtcgaccagttccagcagaagctgcagagcaaggtcatcctgatgcgccgccacgaggaaaaactggccgccatcccccccaacggcgccacctccagctaa

SEQ ID NO: 5575 - DNA, 255 bp, Klebsiella pneumoniae
ttaattttaccggcgctgcttgccggcctgacaaaggggagagaaatgatggcgttgtacaaagcttatcctgctcatattattttgctgcgtcgtgctttcgccgtcgtggctggcgtcgcggcgctgccggtgatgctgttctggaaagatcgcgcccgctactacagctggctgcaccgggtgtggtcgaaaaccagcgagcagccggtgtggatggcgcaggcggagaaagccgctcacgatttctattaa

SEQ ID NO: 5576 - DNA, 774 bp, Klebsiella pneumoniae
caatggctacccttttttttccaggagtcatgtatgtcaatagactggaactgggggatattcctgcaacaggcccccttcggcaacactacctacctgggctggctgtggagcggttttcaaatcaccgtcgccctctccatctcggcctggatcatcgcttttctcgtcggctcactgttcggcattttacgcacggtacccaatcgcttcctctcgggcattggcacctgctatgtcgaactgtttcgcaacgtgccgctgatcgtgcagttctttacctggtacctggtggtgccggagttcctgccggaaaatatcggcatgtggtttaaatcggagctggacccaaacattcaattctttgtctcctccatgctgtgcctggggctgtttaccgccgctcgcgtctgcgagcaggtacgcgccgccatccagtcgctgccgcgcgggcagaagaacgccggcctggcgatgggcctgaccctgccgcaaacctaccgctacgtgctgctgccgaacgcctaccgcgttatcgtgccgccgatgacctcggagatgatgaacctggtgaaaaactcggccatcgcctccaccatcggtctggccgatatggccgcgcaggcgggcaaactgctggactactccgctcatgcctgggagtcttttaccgccatcaccctggcctatgttttcatcaacgcggtgattatgctgattatgtatgtggtcgagcgtaaggttcgcctgcctggcaatatgggaggcaaataa

SEQ ID NO: 5577 - DNA, 906 bp, Klebsiella pneumoniae
cgcttgatacctatgtttgacgttctggagcatgctatgcacgttcgctattctctgctcgcctcgcaggcgacaacggccctttttgtgctgctgtggggcagcgcggccatcttcacccgctggggactggataacgcctcgccgatggcgctgctggtctttcgttttctggttgccctggtcgcgctggcgccgctggctatcgtccgtcggcgctggctgcccgcgccgggcacccgcctgcaaacagcggccaccggtctgatgctgattggcggctattcggtctgttacttcgaggcgatggccaacggcgtgacgccgggacttatcgccaccatcatggggatccagcccatccttacgctttgcgtggtggagcgccgcctgcaggggcggcggctgtcaggactgctgcttgccctggcggggctggtgctattggtgtggcgcagcctggcggcctcaccgatggcgacggtggggatcctgtttgcgctggcggcgctgctgctgatgacctttggcgcgctgtggcaaaagcgcagccgtcaggcgccggcggatgtcctgccgctgcagtatgccgttagtctggggctgtgcctgctgattgccccggtcagcggcttccggtttaccgttaacgccgggttgattattccggtgctgtttctcggactgctgatttcggtggtcgcccagctactgctgtaccgtctgctgagcgcgggaaatatcgtcaatgtcaccagcctcttttatctggtgccagcgatcacggcgctgctggattatctgctgctgggcaaccggctgccggcggcggcgatgatcggtatgatggcgatcgtcggcgggatcgtgctggtgttccgcaccgcgaaggtccgcgccggctga

SEQ ID NO: 5578 - DNA, 471 bp, Klebsiella pneumoniae
gcgccgatacccaggcgctttatcccgaagagaatttgcgccagccgctgcgcgtcgtcatcgacagccagaaccgcgtcacgcctgagcatcgtattgtgcagcatgcgggggaaacgctgtttgcccgcctgcgcgccgatgaacggcagtggccggaaagcgcccgcacgctgctggttccggagcataacggcccatctcgatctggtgctgctgatgatgctgcttggcaaacagcagatcaacagcgtctgggttgaggcaggggctacgcttgccggggcgctgctgcaggcgggtctggtcgacgagcttatcgtctatattgcgcctaaactgttaggcaatgcggcgcgtggattatgcgcgctgccggggcttgaagagctgagccaggccccccattttaaattcaatgagatacgtcaggttggcccggatgtctgcctgcatttaactactgcgtga

SEQ ID NO: 5579 - DNA, 1941 bp, Klebsiella pneumoniae
aggcatgtaccgcgcctggtgctatgccggcgatacgccgaccattggcatttatcgcgaatagaacaagggagagggcgagtgtcgcaaactcacgaaaccgatacctgcgaagtgctggtggtgcgcaacctgaacgtggcgttccgccagcaggatgcgccggaggtgcaggccgtgcgtcagctttccttcagcctgcgccgcggcgagacgctggcgatagtgggtgagtccggttcgggaaaatcggtgaccgcgctggcgctgatgcgtctgctagacgcggccagcagcgaggtgaacagcgaggggctgtggttgcggcggcgtaaccggcaggtgatcgcgctcaatgagcaaacggacgctgagatgcgccgggtgcgcggcgcggatctggccatgatttttcaggagccgatgacctcgctgaatccggtttttaccatcggcgagcagattgccgaatccctgcgcctgcaccaggggctggggcgcgaagaggcgctgcgcgcggcgaaaaagatgctcgatcaggtgcgtattccccaggcggaagagatgctctcgcgctatccgcaccagctctccggcggcatgcgccagagggtgatgatcgccatggcgctctcctgtcggccggcggtgttgatagccgatgagccaaccacggcgctggatgtcaccatccaggcgcaaattctgcaactcattgctgtcctgcaaaaggagatggcgatgggggtgatctttatcacccacgatatgggcgtcgtggccgatatcgccgatcgggtgctggtgatgtatcgcggtgaggcggtagagaccggcagcgttgaggagatctttcgttcgccgcagcacccgtatacgcagtcgctgctggcggcggtcccgcggctgggggagatgcgtggccaggatctgccgcgccgttttccgctgccgggccagccgctggcggagagcgaaacgcccgatacggtagtcgccggcgagccgatcctgcaggtgcgtgacctggtggcccgttttcccgtgcgcggcgggctgctcaatcgcgtgacgcgcgaagtgcatgcggtggagaaggtcagttttgatctctggccgggagagaccctgtcgctggtgggcgagtccggctgcggcaagtcgaccaccggccgggcgctgctgaggctggtagagacccagggaggcaccattaccttcgacggtcagcggatcgataccctcgccggcggcaagctgcaggctctgcggcgcaatattcagtttatttttcaggatccttacgcctcgcttgatccgcgtcagacggtcggcgattcgattatggagccgctgcgggtgcatggcctgctgcgtggggaagcagcgcgtgagcgggtcgcctggctgctgaagcgcgtggggttgcagccggagcatgcctggcgctatccccatgccttttccggcggccagcggcagcggatctgcattgcccgcgcgctggcgctgaatccgaaggtggtgatagccgacgagtcggtgtcggccctggatgtctccattcgggcgcagattatcaatctgatgctcgacctgcagcgcgagatgggcatcgcgtttctgtttatttcccatgatatggcggtggtggagcgcatcagccaccgcgtggcggtgatgtatcgcggtcgcattgtcgaaataggcccgcgccgcgcggtgtttgaaaacccgcagcacccctatacccgtaagctcatggccgccgtaccggtggccgacccgggccaccgtcatccgcagcgggtcctgctgtctgatgacgtcccgggcaatatttataagcggggcgaggagatcgccagcgtgccgttgcagcaggtcgggccgggccacttcgtcgcccgcgaatccgccgatgtgctgggcagaacataa

SEQ ID NO: 5580 - DNA, 1722 bp, Klebsiella pneumoniae
tgcgccccaccgctttttcacctctgcagtaaggagtccaacatgagcgggcctgtgaaggtggatgtgctggtggtcggctccggcgccgcggggctctctgccgcggtgactgcggcgatgcacggcgccagcgtcatggtggcggagaaagcgtcagtgctcggcggaaccagcgcctggtccggcggctggctgtggatcccccgcaacccgctggcgcgggcggagggcatcgacgaagcagccgacgcgccgctgacctatctgcagcatgagatggggggcgaagccgccgatattcgtctgcaaaccttcctgcgttacgggccggagatggtggaatttttccatcagcggacggcggtgcagtttctctcgggcagcgccatgccggactttcacccgtcgccgggtgcggcgaacggtgggcggtcggtcaccgcgcaaccctacgatggccgcctgctcggcgactggctccatcgcctgcgtccgccgctggaaaccattagtctgggcgggatgggcatcgccggcggcgcggatatggcgcattttttcaatgccacccgctcgccgcgctccgcgctgtatgctgcccgccgcctgctgcgccacggctggcagcggctacgcgccggacgggggcagcatctggtcaatggcaatgcgctggtcgcccgtctgctgcgatccgccctcgacgccggcgtgcgttttcagctcaatgccccggtggtccggctgctgcagggtccgccgggcgtgtccggcgcggtgctgcgcagcgacggcggggagattcacgtcgaagctggcgccgtggtgctggcctgcggcggttttccccacgatcgccagcggctggcgcaggtggtgccccacgcggcggagggttacggccatttctccgccgcaccgccggacaatcagggcgaggggatcaggcttggcgaatccgtcggcggccagttcgacacttccctgcgccacccgctggcctgggcgccggtgtcccgcgtcactctggccagcggccagcagctaatgtttcctcatctggtggagcgcgccaaacccggggtgatcgccgtcctgcccaacggcaaacgttttgttaacgaggccgactcttaccatgactttatcgccgccctgctggcggccacacccgcgggcgacacgccgcaggcctggctgctggccgatcgtcgtacgctgcgtcgctacggcctgggccacgccagaccgttcccgttcacccccaccgcctggctgcgtaccggctatctgcagcgaggaaacaccctggcggagctggcgaagcagtgcgctatcgacgccaatgcgctggcggaaaccgttgaacgctttaaccacttcgccagcgctggcaaagacgtcgattttcaccgcggagcatcagcctataaccgcgcccagggtgaccatcaggtgacgctcggaccgctgcgcgaagggccgttctacgcggtgcgcattctgcccggctcgctgggcaccttcagcggattgcaaaccgacgaacacgcccgggtgctggatgaacagcagcagccgataccgggcctgtacgccatcggcaacgacatgtcgagcgtgatgcgcggctattaccccagcggagggatcaccctcgggcccgccatgaccttcggctatctggtgggtaaaggcctgacaaaaaaacaaatataa

SEQ ID NO: 5581 - DNA, 420 bp, Klebsiella pneumoniae
  unsure (234): Identity of nucleotide at the above locations are unknown.
acgacgccaccgggttatcgcgtgattaacaccgggctgatcccgattactgagaagttttctatcaaccacgttctgacctggggctcggcggatgacattaccgactataccgacaaaacgcggatgctgtcgctggtcgcccgcgggcagtaccagttcaccgactacgtgcgcctgattggcgaagtcggcggtttctatcagaaagacagctacaacaatggcaccagntacaaacaggccggtgagaaatacaccattgcgttgggcctggcggacgggccagactttatgtcacgtccggaattacgcatttttgcttcatatttgaatgattccgaagatggtaaaccgtttgaagaccagacggcgaataatacctggaatttcggcgtgcaggttgaggcctggtggtaa

SEQ ID NO: 5582 - DNA, 270 bp, Klebsiella pneumoniae
tcgtggccaccgatcgcggtattttctataaaatgcagcaggcggtgccggagaaaacgctgctggaagcgccccaccgccggcgaaagggcgacctgccgcagctgcgcgcattgtccgtggatggcgatgaatggcctgaaagccattgccgagggtctcgagcagggcggcgctgaacatgaaatccatgtcgacgaagcgctgcgaaccggcgcattaattccccttaaccggatgctggattttgcggctacactacggggataa

SEQ ID NO: 5583 - DNA, 417 bp, Klebsiella pneumoniae
tgcatcaaaccgccggtttctggaaaggccggagttaaccaggagaacgctatgcacgcttttaaacttaaacacccggtacctgatctgcagccgatcggcagcgtcagcctgctcggcgcgacgccgaccgccggcgacccgcaggtagcgggcgcgatgatctacggcgagccgcaggacgcctttacctgcggactgttttcgtccactgaggggagctttaccatgacctatccgtttaccgagcacgccaccgtgctggagggcgaagtggagctgaccgtcgccggcggcgagccgcagcgctttgcgccgggcgacagctggtttgttaaacagggcaccgaagtggagtggaaaattctgacgccgcgctttgtgaagcactacctggcgaacgtcgagacccgctaa

SEQ ID NO: 5584 - DNA, 2652 bp, Klebsiella pneumoniae
ataaccaaacccgctccggcgggttttttatgcccggagtatgcgatggcagaaaaagcaggtgaaatttattatgacattgaggctaacgtatccggcctgatccaggcgcagcagcaggttaataagcgtcttgaccaaatggacgccaagtttgagcaatcgtcacgatctgccgggcggtttgaaggtgctttaaataaagttggcgttgccattgcagcagctttcaccattgatgcagcgaagaagcttatcgccatcggcgacgagatggttacgctacaggcgaggatagccagactaagccccagcattgacgtggccaaagaaacacttgcctccctgtctgcaatcgcagctcaaacaggtaatagcctgtcagaaactgagaggttatgggaatcactgacgacagcgttaaaggagactggcgccactaactcgcagattcttgggttaacatcgacactgcaaaaaattggcacgatcggtgggtcctctactgaggaaatggcaaacgcattgcggcagttcggccagtctatttctggcggtatcgtccgtgctgaagagttcaactctattcttgagcagatgcctgaacttgcgcgccagattgcagcggggttggggatatcaatcggcgatcttcgcaagagaatgctggaaggaaaactgacggctcaggatgccctgaacgccattcaacgtcagtcgcagtcggtcaatgaagagttcgataaaatgccggtcagcattgatcgcgcaaagaacagcctcgatgtggccttcaaaaatgctattaacgacctgaaccaggcaataggcctgaccacgacccttgcaggattaatgcagagcgtcgcggataacctcaattactacaacaacaatgtcggcgattcttcaagaatgccgaagctgatcaaactccagcaggatctgaacaatgagctgaaagacggccagagatggtatgaaactgactcagtttttcagtccagaagggcgcaggcagcagtgcagctgaagcagatcgagggggaaatagcccacattcgagcaaaggctcagaaggacgccggaagcaaccagtttaatgcgccgccgaccaaaggtgatgacgccgcaaccaagaagctggttcaaaactctgagcgccgtcttgcattggccaaacttgagggtgaggcgcgagccaggcttcaggcccaatatgatgcagctgatgctggggtgaccgatccgaagcgaatcaaagcgctgcaggacgaatacgccgaaacctaccgggttacggaggccaggaaggaaagcgacaaagccgggaagcagtctgcttccaccgctgagtctatagctcaaaaactcgaaaaccttcgccagcagtctgagcttgcagcggactcaactcaggaattgagccgtgagcaggcgatattgcgtgcgcagcagtctctcggtaaatcggctactcaggctcaaatccaggaagcaggcaaatacgcagcagccgcatgggatgcagccgcagcggcgaagggggtaacagaggcgcttaatgccattcctgaacaggctgagaataaatcctacgctgaatccatgcagaacctgaaagcggcgctgaacgccgggaagattgatctgcaggagtacaacgcagccactgagcagatggagcagcagcatcaggccaaccttgccaaaatacgctcgcagcaggtggttaatcccacccagcaggcacttgccgaagttgacccggtgcagcaactcgctaaccagcacgcgcaggagctggcgctgattcagcagtttgagcagcaaggggttctcgctcatgagaatgcattggcgctgaaaaatgccgctgaccggcagtatgagcagcagcggatcgcagctcaatgggaaatcctcagccagcagagcctcggttataacatgctgacgagtgcggtggatgcctttagcgggaatgcctccaatgcaatcaccggcctgctaaccggcacaatgtcagcgcaggaggcgatgcggtcgctcggcaacaccatcctgaacagcgtgatcaacagcattgtccaggtgggcgtagaagcgctgaaaaactacatcctcggtcagacgctcggcgctgcatcggtggcgacatcagtcgggctggcggcaactaccgcatcggcctgggctccggcggccgcgatggcatcgctcgcctcgttcggtgctaacgctggcccggctgcagctggtatcagttcgacagtagggcttgccagcgggcttgcgcttgccggcgctcgctacaacggcggcccggtatcagctggcggcctgtatcaggtcggcgagaaaggtaagccagagatttaccaggccagcaccggcaagcagtacatgatccctggcgataacgggaaggtcatcagcaataaggatatgcagtcaggaggagggatcagcgtgcaggtgaacgtcatcaaccagtctaccggcgccaccgttcagagtgccaacggctacatgcaggacggtagtgcggtggtggacttgctgatcaccgacatggaaagaggcggcccggtatcctctcagatgcagcagacatttggactaagccgcaaagcgcaaggtgcttactaa

SEQ ID NO: 5585 - DNA, 1941 bp, Klebsiella pneumoniae
atccagaaaccgaataccttcatcggtcctgtatcatggtgcccgtgttcatgcgcgtgggcagtatgcgcaagagtatcagttcccatttttcagccctgctttgttaatctcatcgaaatgctgtttttccagtttttcgacttctgcaaccggtacgtagtaatccacgtcctcgtcaaagctcttaataatccaggtcgctacgatgccgatgaagctggcgatcgccatccaccagatatgccagatcatggcgaaaccaaataccgtagcgaaggcggcaatcacgatgccggcgccgctgtttttcggcatatgaatttcttcatagtgagcaggttgtttgtacgcttcacctttctctttcatttcccagaaggcatcacgttcgtgaacctgaggaacgatagcgaagttgtagaacggcggtggagaagaggttgcccactccagcgtacggccaccccacgggtcaccggtcaggtcacggttctgatcgcggtcgcgaatagacacgtagaactgaatcagctggcacagaataccgcaggcgatcagcgctgcaccgcaagctgcaataaccagcatcgggtggaactgcggatcgatctgctggctcagacgacgggtcatacccatgaagcccagcacgtacagcggcataaacgccacgaagaagccgatgatccagaaccagaaagcgcgtttgccccaggtttcgttcagggtgaagccaaaggctttcggccaccagtaggtcagacctgcgaagcaaccgaacactacgccgccgatgataacgttatggaagtgcgcaatcaggaacaggctgttgtgcagaacgaagtccgcgcccggtaccgccagcagcacgccggtcatcccacctacggagaaggtcacgataaagccgatagtccacatcatcgccgagttgaagacgatgcgaccctgatacatggtgaacagccagttgaagatcttaaccccggtcgggatcgcgataatcatggtagtaataccgaagaaggcgtttacgttcgcgccagcacccatggtgaagaagtggtgcagccaaacgatgaacgacagaacggtaatacagacggttgcccataccagagaggtgtaaccgaacagacgcttacgcgagaaggtcgcggcgatttcggagaagaccccgaacaccggcagaaccaggatgtacacttccgggtgaccccaggcccaaatcaggttgatgtacatcatcatgttgccacccatatcgttggtaaagaaatgggtgcccaggtaacgatccagggtcagcagcgcgatggtgacggtcagaattgggaaagaggcgataatcaggatgttagcgcacagagatgcccaggagaatactggcatcttgaacatggtcatgcccggggcgcgcatcttgataatggtcacgaagaagttaataccggtcagggtagtaccgataccggagagctgcagcgcccaaatccagtaatcaacccctacgccaggactgtactcaattcccgacagcggcggataggccagccaaccggtctgcgcgaactcaccaacgcccagagacaggttaaccagaatcacgcccacaacggtgaaccagaagctcaggttgttgaggaacgggaaggctacgtcgcgcgcgccgagctgaagcggaaccaccaggttcatcagaccgataacaaacggcatcgccacgaagaagatcatgataacgccgtgggcggtaaagatctgatcgtagtgatgaggcggcaggaagccggcttccccggccgaagccagcacctgctggctacgcatcatgatggcgtcagcaaagccacgcagcagcatgacgattgccacgataacgtacatgataccgagacgtttgtggtcgacagaagtcagccactcgttccatag

SEQ ID NO: 5586 - DNA, 1071 bp, Klebsiella pneumoniae
cggcctgaacctgatggggctcaattatctggtgaacgacgcgctggtcggcgtgattctggtggtggccctcgccctatccttctggcaggcgcgcctgcgccaaacgcatcgctaaacgggagaacgatggcaacctttgacgccgtatttgtcggcctgactattctggatatcgccgggcgcccggtggtggcgatcccgccgcgcggcggcgtcgcctttattgagcaaattcgtctcaaccccgccggcaccgccgccggggctaatatcaacgccgcgaagctcgggatccgcaccgcagcggtggcctgcctgggcgaagatgaaaaggccgactttatcctcgccagctatgcccggctgggcatcgactgctcgcttatccagcgcaccgcgctgaaggagacctcggcgacgatcctgccgattcgccccaacggcgaacgtccggccctgcactgccggggcgcgtctgacgccctgtttgtcagtgaagcggaatttgacgccgtccttgactgtcgtttcctgcatcacggcgggaccgggctgctggcggcaatggaccagggacagagcgcgcggctgttgcaggcggccaaagcgcgcggagtcaccaccagctttgaccttatcgccccgaatgaagagaccctcgaactactgcggcccctgttgccgtcggtggattatttcatgccttcgctggaggaagccgcctttctctccggagagacgcagccggaggccatcggccgcttcttcctggcgctcggcgtgggcacctgcattctgaaagacggcgagaacggctcctggcttatcggccgcgatggcgggccgcagcatattgcgccgtggccggtcgaggcggtggataccaccggctgcggcgacagctactgcggcgggtttattgccgcactggcgcgcggactcagcgtgaaagcagcgtgtgacgtcgcctcggcggtggccgcgctggtggcgaccgggatgggatcggatgccggggtagtggactgggaacagacccaggcttttatggcggcccatcgcccctga

SEQ ID NO: 5587 - DNA, 1008 bp, Klebsiella pneumoniae
aggttggaacctgaccgcatttatcttcaccgtaatcatcattgcgatcgtggttgtcggctccatctggattatgtggaacctgaactacaacatgatgatgcactaagagcggcgagtatgtttaagcaatacctgcaagtaacgaaaccaggcattatttttggcaacctgatctccgtgatcggcggtttcctgctggcctccaaaggccacatcgactatccgctgttcgtctggacgctccttggagtatccctggtggtcgcctcgggttgtgtattcaacaactacatcgaccgggacatcgatcgtaagatggaacggacgaaaaaccgggtgctggtcaaagggctgatctcgccagaagcttcgctggtgtacgccaccttgctgggtattgctggcttcatgctgctgtggttcggcgctaacccgctggcctgctggctgggggtgatggggttcgtggtttatgtcggcgtctacagcctgtacatgaaacgccactccgtctacggcacgctgattggctcactctccggcgctgcgccgccggtgattggctactgcgcggtcaccggtgatttcgacagcggtgcggcgatcctactggctatctttagcctgtggcagatgcctcactcctacgccatcgcgattttccgctttaaggattatcaggcggcgaatattccggtgctgccggtggtgaaaggcatttcggtcgccaaaaaccatattacgctgtacatcgtcgcctttgccgtggcaaccctgatgctctcgctgggcggctacgccgggtataaatacctggtcgtggcggcagcggtcagcgtctggtggctgggcatggcgctgcgtggctataaagtggccgatgataaagtctgggcgcgtaagctgttcgtcttttctatcgtcgccatcaccgcgctgtccgtgatgatgtccgttgactttatggtgccggattcacatagtctgctggcttacgtgagataa

SEQ ID NO: 5588 - DNA, 801 bp, Klebsiella pneumoniae
tcaccccgaccgtctatacctaatgatgatgctcaccactctcgcaacgaggtcatcatgcagatcgatttaacaggtaagaaggcgctggttaccggcgccagccgtgggttgggtcgcgccatcgcgctgtcgctggcgcgcgccggcgccgatgtggttattacgtatgaaaaatcggtcgataaagcccaggcggtcgccgatgaaataaaggcgctgggtcggtacggcgaagcggtacaggccgacagcgccagcgcgcaggcgattcaggaggcggtaacccatgcggcccggtccctcggcgggctggacattctggtcaacaacgccggaatagcccgcggcggtccactggaatccatgacgctggcggacattgacgcgcttatcaacgtcaatatccgtggggtggtcatcgccacccaggaagcgctggtgcatatggccgatggcggacgaatcatcaacatcggcagctgtctggctaaccgcgtggccatgccgggcatcgcggtgtacgccatgaccaagtccgccctcaacgccctgacccgtggcctggcgcgtgatttaggccctcgcgggatcaccgttaaccttgtccatccagggccgaccaacagcgatatgaacccggaagacggagaacaggcggaagcccagcgccagatgattgcggtcggccactacggccagccggaagacatcgccgcggcggtcaccttcctcgccagcccggccgccgggcagatctccggtacggggctggacgtggatggcggattgaacgcctga

SEQ ID NO: 5589 - DNA, 879 bp, Klebsiella pneumoniae
cctgaccgacctgctggtacggttaaccgacccgagggtgcgctgatgccgacttatctgtttttacgccgcctgcgccgctcacccgccgccttcagcggcctgaccctggtgatcctgctggtgctgaccgcgctgttcgccccgtggctggcgccgcacgatcccaactggcaggatgccgccgctcgtctgcaggggcccggggcgggacactggctcggcaccgacagctacggccgcgacctgctgtcgcgcttgctctacggcgcccgcccggcgctgggtctggtggcgctggtgaccgccattaccctgcccgtcggtctgctggtgggtatcctctccggctactatggcgggtggctggagcggatactgatgcgctttaccgacgtggtgatgtcgatgccgcgcctgatcctcgccttcgcgttcgtggcgatgctcggcccggggctggtcaacggcgcgctggcgttagccctgaccacctggccggcctacgcccgtcaggcgcgcagcgaaattcagcgcctgcgccatagcgactacctcgccgcggcggagatgctgggcatccgcggcgggcggctgctggtcggccatattctgccgctgtgtctgccgtcggcgattgtccggctggcgctcgatctggcgggcattatccttgccgccgccgggctcggctttctcggtctgggcgcccgcccgccgatggcggagtggggagcgatgattgccgacgggatgcaggtgattttcgaccaatggtggatcgccgccatccccggcgcggcgatcctgctcgccagcctggcgtttaacctgctgggcgatggcctgcgcgatattctggagccgcaacatgactga

SEQ ID NO: 5590 - DNA, 270 bp, Klebsiella pneumoniae
ccggctttgccgatccgctgtcagcggcgaataaggcgctggactgggtcgacctggtgctgtgcaccgccggcccggcgggcctgtatatggcgggcttcaccgaagaagaggcgaagcggaaaacccagcatccgctgctgccgggggcgatcccggagtttaaccagtttgaattcagccgcgcgatgcgtcaccaggattgcgttaatccgctgcgcatatattcccatatcgctccctatatgggcggccccgagaagatcatga

SEQ ID NO: 5591 - DNA, 1374 bp, Klebsiella pneumoniae
atgctgacgtttattgagatcctgatagggatcgtggtcattgtgggcgtagcccgctatatcattaaaggctactcggccaccggggtcctgttcgtcggaggcttaatcttactgatcgtcagcgccctgctgggacataaagtgttaccgggtaataccgcgagcaccggctattccgctaccgatattattgaatacattaagattctactcatgagccgcggcggcgatttgggtatgatgatcatgatgctgtgcggcttcgccacctatatgacccatattggcgctaatgatatggtggtcaaattagcgtcgaagccgttgcgctatattaattcgccctatctgctgatgattgccgcctattttgtcgcctgcctgatgtcgctggccgtctcctccgcgaccggccttggcgtactgctgatggcgacgctgttcccggtaatggtgaatgtcggtatcagccgcggggccgccgccgccatctgcgcctcaccggcggcgattatcctctcgccaacctcgggtgacgtcgtcctggcggccaaagccgctgaaatgccgctgatcgactttgcttttaaaaccacgctgccgatctccatcgcggctattatctgcatggcgatcgcccactttttctggcagcgctatctggataaaaaagagcacatttctcacgagatgctcgatgtcaacgacatcaccaccaccgccccggcgctgtatgccattctgccgtttaccccgatcatcggcgtgctgatctttgacggtaaatgggggccggagctgcacattatcaccatcctcgttggctgcatgctgctggcggcgatcctcgagttcctgcgcggtttcaacaccaaaaacgtctttagcgggctggaagtcgcctaccgtggaatggccgacgccttcgccggcgtagtgatgctgttggttgccgccggcgtctttgcccaggggttaagcactatcggctttatcaacggtctgatctcaatcgccacctccttcggctcggccagcattattctgatgctggtgctggtgatcctgaccatgctggcggcgatgaccaccggttccggtaatgccccgttctacgccttcgttgagatgatccccaagctggcgcactcctccggcatcaatccggcctacctgtcgattccgatgctgcaggcttctaacctcggccgcacgatatcgcccgtctccggggtggtggtcgccgttgccgggatggcgaagatttccccattcgaagtggtcaagcgcacctcagtgccggtgctcgttggcctgctggtggtgatcgttgctactgaaatcctggtgcccggcagcgcgctccactaa

SEQ ID NO: 5592 - DNA, 732 bp, Klebsiella pneumoniae
aaaggactgcccatgttattacgttgcctgctccctctggcgctgctgcccctggccgccgtcgccagcgccgcctgtaccctcaccgacccgacgctgaccctgcagagctatcgggtggatgcgcagaaagagcgcattgcgatgtactggcaggatcggcacggcaaagcctggggttccctgcgttcgctgctggcgggtatcgatggcgacggccgggtgcagatggcgatgaacggcggcatttacgataaggcctacgcgccgctggggctgtatatcgaagacggcaaacggctgacgccggtaaaccgctccgccggcggcgggaacttctttatccgccccggcggcgtattcctggtggaaaacggccgggcgaaaatcgtgccgctgccggcgtacaaaccctctcccgccatccgctatgcggtgcagtccggcccgatgctgattgagaatggcgccatcaactggcggctgaagccctccgccagttcgcgcaagctgcgcaacggggttggtatcgataagcagggccgggtggtgtttatgctcagcgatcgcgagaccaacttttacgattttgcctgctatgcgcagtcaaagcttggcgtgcggcagatgctttatctcgacggcaccctgtcgaagatgtaccgcaaaggcggcagcgtgccgtggcagtatcatccgttcgtgaccatgataacggtggagagaaaatag

SEQ ID NO: 5593 - DNA, 867 bp, Klebsiella pneumoniae
cgagaaatgcccatgtccgaacagaatattgtcaacattagcgaagcgaacctgcagcagacgctacagcagtccatgaacgttccggtgctgttttatttctggtctgcccgcagtcagcactgcgaacagctgaccccggtgctcgagcgcctggcagcccaatacaacggccagttcacgctggcgaaggtcgattgcgacgccgagcagatgctcgcctcacagtttggtctgcgcgccatccctacggtttatctgttccagaacggccagccggtggatggttttgaaggcccgcagccggaagaagcgatccgcgccctgctcgataaagtcctgccccgtgaagaggagctgaaagctcagcaggcgctggccctgatgcaggaagaaaaatacgccgatgccctgccgctgctaaaggaagcctggcagctgtcgaatcaggaaagccagattggcctgctgctggcggaaacgctgattgctctgcaccgttccgatgaagcggaaagcgtgctgaaaaccattcctctgcaggatcaggatacccactatcagggtctggtggcgcagattgagttgctcaaacaggccgccgacaccccggaaatccagcagctgcagcagcaggtggaacagaatccggaggatgcgcagttggcctcccagctggcgctgcagctgcatcaggtcgggcgtaatgaagaagcgctggccctgctgttcagccatctgcagaaagatttaggcgccggcgatggccaggcgcgcaagatgctgcaggagatcctcgccgccctcggtaccggcgatgcgctggccgccaaatatcgtcgtcagctctattcactgctgtactaa

SEQ ID NO: 5594 - DNA, 444 bp, Klebsiella pneumoniae
cgagcatcgccgcctgattggctaaaatatgcccgaccgcgccgcagaatgcccgcggtcgttggcgcagccgttcgcctgatgtatgatggcgcgctatctgcgccggctagagcccggcagcttgtttccccgaagtcactcagaatcatggcaaaagaacaaacggaccgtacgacattagatttgttcgcaaacgagcgtcgcccgggaagaccgaaaaccaatccgctgtcgcgcgatgaacaactgcgcatcaacaaacgtaaccagctgaaacgcgataaggttcgcgggctgaagcgcgtggagttaaaactcaacgccgatgcggtcgatgcgctcaacgagctggcggaagcgcgtaatatgagccgcagcgatctcattgaagagatgctgatgacccagttaaccgccctgcgcagccagggaaaagtctaa

SEQ ID NO: 5595 - DNA, 216 bp, Klebsiella pneumoniae
tcgataccgccaacaatattatgggcggcaacctcagcgcgctggctaatggctaacaacccagcggccgtaccaccgcgcaagaagggtttcactttctccatcatcagcggccccaccaacggcaccaccgccgtgaccgattacagcactctgccggaagggatctggagcggcgacgtcagcgtacagttcgacgccacctggaccagctga

SEQ ID NO: 5596 - DNA, 2307 bp, Klebsiella pneumoniae
cgagcaccgccagagataacaacattgttaccagatatcgcacgcttcctcccgcgcttagccaacgaccagattgagcagtttacccggaacgtaaatcactttacgcacggttttaccgtcgagatatttcgccaccagatgttcctggccggcgcgctcgcgaacctgctcttcagttgcatctaccgcaacggtaattttaccacgaactttgccattgacctggacgacgacgagggtgctgtcttccaccatcgcgctctcatccgctaccggccacggcgcgttgtcgatatcgccttcgccgttcagctcacgccacagggtgaagctggcgtgcggagtgaacgggttgagcatacgcaccaccgccagcagagcttcctgcatcagcgcacgatcctgctcatcttcctgcggcgctttcgccagcttgttcatcagctccatgattgccgcgatggcggtgttgaaggtctgacgacggccgatgtcatcggtcactttggcgatggttttgtggatatcgcgacgcagcgctttctgatcttcgctcagagccgccacgttcagtgccgcaacctctcctttagtggtgtgctcgtagaccagtttccagacgcgtttcaggaagcggttcgccccttcaacgccagattcctgccactcgagggtcatatccgccggggacgcaaacatcatgaacagacgcacggtatccgcgccgtagcgctcaaccatcacctgcgggtcgatgccgttgtttttcgacttggacatcttgctcatgccggtgtacaccagctcgtggcccgccgcgtctttggccttcacgatgcggcctttttcgtcgcgctcaacgatggcgtcaaccggggaaacccagttacgttcgccgttttcgcccacatagtagaacgcgtcagccagcaccatgccctggcacagcagctgtttcgccggctcatcggagttcaccatgcccgcgtcgcgcatcagcttatggaagaagcggaagtagagcaggtgcatgatggcgtgttcgataccgccgatgtagatatctaccggcagccagtagttggccgctttcgaatccagcattccttcctgatactgcgggcaggtgtagcgcgcatagtaccaggaggattccataaaggtgtcaaaggtgtcggtttcgcgcagcgccggctggccgttgacggtggtcttggcccattcaggatcggctttgatcgggctggtgatgccgtccatgaccacgtcttccggcaggatcaccggcagctgatcttccggggtcggcagcacggtgccatcttccagggtcaccatcgggatcggcgcgccccagtagcgctgacgggatacgccccagtcgcgcagacggtagttaactttacgctcgcccacgcccatggcagccagtttgtcggcaatggcgttgaagcccgcttcataatcaagaccgctgaactcgccggagttaaacaggacgcctttctcggtcagcgcctgctcggagagatccggctcggagccgtcggcagcgaggataaccggcttaatgttcagaccgtacttgctggcgaactcgtagtcgcgctggtcgtgacccggaacggccattaccgcgccggtgccgtattccatcagcacaaagtttgccgcccagaccggaatttcttcaccggtcagcggatgaatggctttaaagccggtatcgacgccttttttctccatcgtcgccatgtcggcttcggccactttggtattgcggcactcgtcgataaaggtggccagcgccggattgttcgccgcagcctgctgcgccagcgggtgacccgccgcgacggccaggtaggtacaacccataaaggtgtccggacgggtggtgtagacagtcagtttgtcagcgtagtcgttgacgtcaaaggagatttctaccccttccgaacggccgatccagttgcgctgcatggtcttcacggtgtccggccagtggtccagcttatccagatcgttcagcagttcatcggcgtaggcggtgattttaataaaccactgcgggatctctttacgctcgaccttggtatcgcagcgccagcagcagccgtcgataacctgttcgttggcaagcacggtctggtcattcgggcaccagttcactgcggaggtttttttgtacaccaggccttttttgtacagctcggtgaagaacttctgctcccagcggtagtattccggggtgcaggtcgccagctcgcggctccagtcatagccgaagcccagcatttttag

SEQ ID NO: 5597 - DNA, 1800 bp, Klebsiella pneumoniae
acccgaccgccaccaccacatctttggcggcaaaggcgggagcgctcgccagggccgccgcgatactcagcgccagccaccatttgcgtgaaacaggttgtgtcatcgtgttctcctgaaaagatgcgttatgtgttgttatgttctgcccagcacatcggcggattcgcgggcgacgaagtggcccggcccgacctgctgcaacggcacgctggcgatctcctcgccccgcttataaatattgcccgggacgtcatcagacagcaggacccgctgcggatgacggtggcccgggtcggccaccggtacggcggccatgagcttacgggtataggggtgctgcgggttttcaaacaccgcgcggcgcgggcctatttcgacaatgcgaccgcgatacatcaccgccacgcggtggctgatgcgctccaccaccgccatatcatgggaaataaacagaaacgcgatgcccatctcgcgctgcaggtcgagcatcagattgataatctgcgcccgaatggagacatccagggccgacaccgactcgtcggctatcaccaccttcggattcagcgccagcgcgcgggcaatgcagatccgctgccgctggccgccggaaaaggcatggggatagcgccaggcatgctccggctgcaaccccacgcgcttcagcagccaggcgacccgctcacgcgctgcttccccacgcagcaggccatgcacccgcagcggctccataatcgaatcgccgaccgtctgacgcggatcaagcgaggcgtaaggatcctgaaaaataaactgaatattgcgccgcagagcctgcagcttgccgccggcgagggtatcgatccgctgaccgtcgaaggtaatggtgcctccctgggtctctaccagcctcagcagcgcccggccggtggtcgacttgccgcagccggactcgcccaccagcgacagggtctctcccggccagagatcaaaactgaccttctccaccgcatgcacttcgcgcgtcacgcgattgagcagcccgccgcgcacgggaaaacgggccaccaggtcacgcacctgcaggatcggctcgccggcgactaccgtatcgggcgtttcgctctccgccagcggctggcccggcagcggaaaacggcgcggcagatcctggccacgcatctcccccagccgcgggaccgccgccagcagcgactgcgtatacgggtgctgcggcgaacgaaagatctcctcaacgctgccggtctctaccgcctcaccgcgatacatcaccagcacccgatcggcgatatcggccacgacgcccatatcgtgggtgataaagatcacccccatcgccatctccttttgcaggacagcaatgagttgcagaatttgcgcctggatggtgacatccagcgccgtggttggctcatcggctatcaacaccgccggccgacaggagagcgccatggcgatcatcaccctctggcgcatgccgccggagagctggtgcggatagcgcgagagcatctcttccgcctggggaatacgcacctgatcgagcatctttttcgccgcgcgcagcgcctcttcgcgccccagcccctggtgcaggcgcagggattcggcaatctgctcgccgatggtaaaaaccggattcagcgaggtcatcggctcctgaaaaatcatggccagatccgcgccgcgcacccggcgcatctcagcgtccgtttgctcattgagcgcgatcacctgccggttacgccgccgcaaccacagcccctcgctgttcacctcgctgctggccgcgtctag

SEQ ID NO: 5598 - DNA, 351 bp, Klebsiella pneumoniae
cgcgctgcgccgctgccgggaggctggcgtcccggcgatcaccctggcgacggacctgcccggcgccgaccgactctgccacgtggggatcaatcagctgcaggctggccgcacggcggggttaatgctggggagaatgacgccgcggcccggcgaggtgctgatggtcagcggccggcaagattacagcgcgcatcgcctgcgcattcaggggttccgcgaggtgctgagccagcgctttccccacctgcagctcagcgacgtgctggcgggcgaggagcggcgggagcagatcacccgcctggtggagcaagccctgtgccgcagccgaaatattgttgggatctataa

SEQ ID NO: 5599 - DNA, 1521 bp, Klebsiella pneumoniae
acaagcgcgccagacaaaacagttaaaggtacgatcatggtatctcgtagaagtgttctgaagatgacaataccagctgccgcagccatcccggtagcagtaatggctgcgtcagataagcctggaaatgatagggtttttgcgagcatttcagcgttgtcgtcgttttcaggcaatgacggcgatatagggtttttgttgtcctgccatgaaggaaaaatgtcaggtggtggtgttcttgtccatactatatcggatgccaagcctgatatgattctttcgttcccatctaaaaatggtgtctggaaaaggattctcgagaatagtggatatgttgattgttcccactcagggatgcttgcagaaaaaggatttgacaattcaccttatcataacaggttaataaaggttgctgatgatgcaggtctgaccattaaatatggatcaggttcttatgaacacaacaccaatgtattgaaagagcaatcattttcctgcccatcatttgtaggttgtggtgggagaaggggtgacaaaggcactattttaaaattccttaatggttcaactttcaaaataaagggtggctctggttatgtatgtaattccaaaatcgaagggattacatttgcaggggatggggaaactgatggagtccttacaatagctgatcagtgtggcatttctgttgatcgttgttattttgataaatgcaaaactggcgtgttaatgcttaatgagagtaagggtggttttactgagtttaatgtattaactgcttgttatttcacatcctcttgtgtaactggttttgcatacagaagattgaatgggaacgagtcattccatggcacaggaatgaaagagtgtgcatttcaacagcaaaaaaaagataatgatgcccctcacatacacattggtgagaagtgcatggtatataatgcgccaatgactattcatgtgtttagagattatactacatctccaattatcagacacgacgggttcccaagatcaaatgtgtatggtgtaataaccgttgagaaaaagcctaaaaatatagtaagccttgtagatggtaatccgttatacattttaggcagcatatcatgtttgagcgaaaatctgtcaacaactaattcaattctttgcagcagatttcaagctaattctgatggctccgtgaattttatacgaaacccagcgtcattatctggcgggttcgatagcgaaaaagaggccgtgattcatcttaatgcgggtgaaagtgccttcatggatgttactgttatttctaatggagttgtcagtaggggtctgatttttatagctgtagatacaaatggtaatggcaaaataactgacacaggcatgtctccaagtgagagtaaattaaagcacgataattattttgtttttgacaggtcaacgctgtacgttaataacaatggcgatccatcggctaagtggattgctgatatttcatttgtggctagcagatatcaatttacattaaagtga

SEQ ID NO: 5600 - DNA, 186 bp, Klebsiella pneumoniae
cggagagcgcctgcccggcagtcagtacggagtaagcatgtcaggacgccaatagcaaaaaagcccaccgaagtgagcttttttgcattgaaatggctggggtacgaggattcgaacctcggaatgccggaatcagaatccggtgccttaccgcttggcgataccccaattgtctgttgcgcttga

SEQ ID NO: 5601 - DNA, 906 bp, Klebsiella pneumoniae
cgatttcagccgaaaaaacacgtcccatttgtgcggtgggtaatgaccaaccgcgcagagaggttttgcaagtgggcgactatcggtcacaatacccttttttgtcaggaaacgattatgcaggccgaaattcttctcacccttaagctacagcagcgcctgtttgccgatccgcggcggatcgccctgctcaaacagattgaccagaccggttcgataagccagggggcgaagcatgcgggtatcagctataagagcgcttgggatgccatcaatgagatgaaccagctcagcgaacaaccgctggtggatcgcgccaccggcggaaagggcggcggcggcgcggtgctgacccgctacgggcagcgtctgatccagctgtacgatctgctggcgcagatccagcagaaagcgtttgatgtactcagcgatgacgatgccctgccgctggatagcctgctggcggccatctcgcgcttttccctgcagaccagcgcccgcaaccagtggttcggcaccattaccggccgcgatcgccagcaggtgcagcagcacgtggaagtactgttggctgacggaaaaacccgcctgaacgtcgccatcaccgcgcaaagcgctgagaagctgggactcgatgagggccaggaggtgctggtcctgctcaaagcgccatgggtcggcatcaccctcgatcccgcagcagcccgccaggccgataaccagctgtcgggacgtatcagtcatatcgaatgcgggtccggacagtgcgaagtactgatgaccctggcggacggtcaaaccctgtgcgccaccctgccacaggcgcaggccgctggcctggcggaaggaacggaggcgatcgcttacttcaatgccgatcgcatcattctcgcgacgttatgctga

SEQ ID NO: 5602 - DNA, 660 bp, Klebsiella pneumoniae
attctggcgttttcgagcgcgggcaagcctggtcaaaggttaaacaaatgtttctttggccccttttgcacgcccgtgggtaataccgtttcaatcaggcatacacttatgaccgcaactgcacagcagcttgaatatctgaagaacagcatccagagtatcgaggattatccaaaacctggcattcttttccgcgatgtcaccagcttactggaagacccgaaggcctacgcgcttagcattgaactgctgaccgagcgctacaaagacgcgggtattaccaaagtggtagggactgaggcgcgtggcttcctgttcggcgccccggtcgcgctggcgctgggcgtgggctttgttccggtacgcaagccgcgtaagttgccgcgtgaaaccatcgccgagacctatgagctggagtatggcaccgatcagctggagatccacgttgacgccattaaaccgggcgataaagtgctggtggttgacgatctgctggcgaccggcggcactatcgacgccacggtcaaactgatccgccgcctcggcggcgaagtgcacgatgccgctttcattatcaatctcttcgatctgggcggcgaacagcgcctggagaagctggggatccactgctacagtctggtgctgttcccgggccactaa

SEQ ID NO: 5603 - DNA, 1260 bp, Klebsiella pneumoniae
gggagccagccgcttcgccatccagtcggcgataaacggctgcgcgtcgcgatttggatgaatgccgtcgtcctgcatccattgcggcttgagatagacctcctccataaaaaagggcaggagaggaatagcgaactctttggccagggccgggtaaatcgcgccgaaggcttcattatagcggcggccatagttcgccggcaggtgaatttgcatcagcagcggctcggcgttggccgctttgatatctttaataatggtgcgcagcgtttgctcggtctgctgcggcggaaaaccgcgcagtccgtcattgccgccgagctcaaccagcacccagcgcggctggtgctgcttaagcagcgctggcaggcgagccaacccctgctgcgaggtatcgccgctgatgctggcgttcaccaccggcgttttcgcctgccactgctcattgagcagcgcaggccaggcggcgttggccgccatccgatagccagcgctcaggctgtcgccgaggatcagcagcgtgtccgccgccatcgcgcggcaggtaaacaggaacaacaacaggaaaggcacatgccagcggaaaacatacttgaagttcatcatcttaagaagtccgtcggtcagggggagcatcagctctccatccttaccggagttgagctggttgtcaaaccgcggcagaccatcgccctgatcggcgagtcgggttccggtaaatcgaccctgctggcgatcctcgccggcctcgacgatggcagcagcggggaagtatcgatgctgggcaaaccgctgcaccggatggatgaagaggcgcgggcggcgctgcgggcgcagcacgttggttttgtttttcagtcgtttatgctgatcccgacgctcaacgccctggagaacgtcgagctgccggcgctgttgcgcggcgccagcgatagccagagccggggcgatgcccgcgcgctgcttgagcagctgggacttggcaaacgcctgcaccacctgccggcgcagctctccggcggcgaacagcagagggtggcgctggcccgggcctttaacgggcgcccggccattctgttcgccgatgagcccaccggcaacctcgatcgccagaccggggacaaaattgccgatctgctgttctcgcttaatcgcgaacacggcaccaccctgatcctcgtcactcacgatccgctgctggcggcgcgctgcgatcgccgtctgcgcctggcggatggccagctgcgggaggaagcatga

SEQ ID NO: 5604 - DNA, 1671 bp, Klebsiella pneumoniae
ttcagacagccaacgtcaaaaccggcgacagcgtggaggtgtacggcgtcttctcggcctgggatattccacaaactctcccggaaattaccccggcgaaaatcattcatgcagggggacaataatatggcgccgcacgatctcgtcgctccccagcccgttgagtccgaagtgattatcgaaacccgcggcctgtcgcgcgtctatcccggcgtaaccgccctggataatgtcaattaccgggtctatcgaaataaggtcaacgtgctgatcggagaaaatggtgcgggtaaatccaccatgatgaaaatgcttgccggcgttgaaacgccctcctccgggcaaattatcctcgatggtgaagcagtttcattacagtcgacgcatcaggcagaaaaactgggcatcagtattatttttcaggaactgaatttatttcccaatatgaatgtgatggacaacatcttcatggcgaatgaattctttcagaaaggacgcattaacgaaaaataccagtacgcgctggccaaatcgctgctggaacggctggagctggatgtcgatccttacgctccgctgggtgaactcggtatcggccaccagcagttagtcgagattgcccgcgccctgtcgaaagacacccgcgtgctgatcatggacgagcccacctcggcgctgagccagtctgaggtcaaagtgctgttcaaggtgatcgcgcagcttaagcggcgcggcgtgaccatcatctatatctcgcatcgcctcgaagagctgatggagattggcgataacatcaccattttccgcgacggtcgctttatcagcgagcgtcacgtcagcgacgccagcgtaccgtggatcatcgagcagatggtcggtgataagaaaaaacactttgattatcaaccggcgccaaaaggcgacgcagtgcttgacgtcaaagggctgaccgcgctgcatcccagcggcggttacaagctcaatgacgtcaccttcaccctcagcaaaggcgaagtgatcggtatttacggcctgctgggcgccgggcgcaccgagctgtttaaaggcctggtcggcttgatgccctgccagcgcggcgaggtgcatcttaacggcgaaagcatcggcaaatctcgctttcaacagcgcctgaaaaaggggctggcgctggtgccggaggaccgtcagggcgaaggcgtggtgcagatgatgtcgattcaggccaacatgacgctctctgatttcagcctgcaggggttccgccgcgcctggcgctggttgaacccgcaaaaagaagagacctgcgtgaaagagatgatccagcagctggcgatcaaggtcagcgacgccacattgcccatcacctcgctgagcggcggcaatcaacaaaaagtggtgctgggtaaagcgctgatgacccagccgcaggtggtgttcctcgacgaaccgacgcgcggcatcgacgtcggcgcgaaaaccgacgtctatcacctgatcggcaaaatggctcagcaggggctggcggtgatgttctcatcttcggaactggatgaggtgatggccctggccgaccgcatcctggtgatggccgatggccgcattaccgccgatttaccgcgccatgcggtgacccgcgaacagttaatcgcggcttcaacacctcaagattaa

SEQ ID NO: 5605 - DNA, 363 bp, Klebsiella pneumoniae
tggccccggcctgcatcaggttttcccgccccaccagcgccggggtcgccgccagcagcgcggtcacccccagcgaggcgaagaacccatcccagatccccagcaggtagatcgccgccagcgacggctccggcagcagggcgttcagacacaggccgacaaagcctacgccgcaggtgccgcgcgccagcaggatcaggcgtttacgttcatagcggtcagccagcacgccccccaccatcagaccaacaaacatcgacgccccggtcagcgtcaccgacaacccgacctgccaggtcgaatgggtcatcatctggatctgcaccgggatggccacgcccagcaggccaagcgacagaatag

SEQ ID NO: 5606 - DNA, 585 bp, Klebsiella pneumoniae
atcagccggccaaacggacggatccagactccctgctcgacgaaaaagcgctgcagggcggccatgttgaccgggcgacgggtttcaaccacgccaatagcgcccagcacgcggacgtccgcgaccagcgcagatccccgcgccggggccagctcggcctgcagctgggcttcaatcgccgctacctgcagctgccattcgccgctctccagcaggcgcaggctttcgccggccaccgcgcaggccagcggattgcccataaaggtggggccgtgcataaagcaaccggcttcgccattgctaatggtttcagcaaccgttcgggtagtgatggcggcggaaagggtcatggtgccgccggtcagcgctttgcccagacacagaatgtcggcggtaatcccggcgtgttcacaagcgaacagcttgccggtgcggccaaagccggtggcaatctcatcggcgatcagcagtatcccttcccggtcgcacattttacgcacccgcttcagccactccggatggtacatccgcatgccgcctaccccctggacgataggttcgaggatcaccgcggcgatttcgtga

SEQ ID NO: 5607 - DNA, 1245 bp, Klebsiella pneumoniae
aaccgagctttttgccttcctgcagcgccccggcgacaaactgggtggtgttatcgtcagacccgaggttgcggatcacggcaatgcggatcgggccgttgtgttcggcaatcgccgccggcaccggcgtcggggcggtggccagcgccgccgtcgactgcaacagacccagcgtcatcagagagagtgcgatctttttcatgcggtttaccctgtaaaatgttaagtacggcgctgaaaataggtcagtgccagcgcgccagccagcaccaaccctttaataatgtccatcgcgtaatacggcaccgagagcatcaccagcccgttggagagcacgccgaggatcaccgcccccaccagcgtccccagggcgttcggtttaccggagcccgccagcgaaaagccgatccaggccgccgccaccgcgtccatcagatagccgccgccggcgttgacctgcgaagagccgatgcgcgaggccagcagaatgccgcccagcccggccagcagcgaggcaatcacgtatgctgcgactttgtaacgcgtgatccgcaggccggagagccgcgccgcctccgggttgccgccgatggcgtacatccgccgtccgtgggtagtgaacgacagcgccagctgggcgatcagcgtcaccaccagcatgataatgacgatggtcggcacctgccccagcgcgccaaaggccgccgggatagtaccctccgccatctcgccgctcggcagaaccatgttttcggtaatcgacccaccgtagctgtaggtcattgccacgccctgaatcacaaacaggctggccagggtggcgagcatgtcaggaatgcgcagcaccacgatcagaaaggcgttaaacagccccaccagggtgcagagcgcgagggttatcagaatcgcttcggtggtccccaggccatgccagacaaacagggaaatcaccagcgcgttagccagcgatgccgtcgatccgacggacagatcgaagccgccgatggtgagggaaatcgacaccccaatggcaatcaccgtcacgatggcaatcgagcgcagaatgttgatgatgttgaacgggtcaaggaagttgtccgaggcgaggccaaagaccgccaccagcagcaccacggtcagcaacatgccccacttatagagaaaatcaaaaaatcgctgacggcccgataccgtcgcgtttactgccagggccttgctcacgctgccgctcctccggttgaataa

SEQ ID NO: 5608 - DNA, 429 bp, Klebsiella pneumoniae
ttacagcagttggcggtagataaactcggcgatgctggtggactcattgtcgccgatgaccatgttggcgcgggctttcacctcgtccaccgcgttgcccatcgccaccccggtgcccgccgcttccagcatgctaagatcgttgtagttatcgccgaaggccaccacatcctgcatcgacagcccctggtcggccacccattgcgccaggcgtttgcctttgctgttgccggcgcgcgcgatatccacctgatcgtgccacgaccattcgcactcgaggcccagcgtctcgccaacctgctgcgcaaaccgctgcaggcggggaatgtcgtcatcggtgagagcgaatttccataccgcgttaacttcgcgaaccgcctgcgccagcgaatcgacctgagcgaaaaccggacgctgatcttccggtaa

SEQ ID NO: 5609 - DNA, 471 bp, Klebsiella pneumoniae
tgcgtgaagttgcagctggtggccgttggcaccaaaatgccggactgggtacagaccggctttagcgagtatctgcgccgttttcccaaagatatgccgttcgagctggtggagatccctgccggtaagcgcggtaagaacgctgatatcaaacgcatcctcgaaaaagagggcgagatgatgttagccgctgccggtaagaaccgcatcgtgaccctggatattccgggtaaaccatgggatacaccgcagctggcgcgcgaactggaacgctggaaacaggacgggcgcgacgtcagtttactggtaggcggtccggaaggtctctctcccgcctgtaaagcagcggcggaacagagttggtcgctctccaccctcaccttacctcacccgctggtgcgcgtactggtggccgagagtctgtaccgggcgtggagcatcaccaccaaccacccgtaccaccgtgagtaa

SEQ ID NO: 5610 - DNA, 1401 bp, Klebsiella pneumoniae
aatggcattacccctctgggatccttcaataactgtgcatgttgcacaccgcgcgctattccccgtgcccggtttttcctggcacatctcttgctacttccggctatcaccgcccatctaccagccagaggttccaggatgtcaaacagcaatgattttcccctcgtcgaagcgcccgccgccggacgcaaaggcgtattttccatcgccatggtgttgttcagctttacctttttcaccggcacgatgttcgccggcggtaaactcggcgtctccttttccatcgtcaatctgctgtggatagccgtcatcggcaacgccttgctggccctctatgccgcgtcgctgggctggatcgccgcgcgcagcggcctgaatacggtgctgatgggccgcttctgcttcggggagattggcagcaagctggccgattttattcttggctttgccgagctgggctggtacgcctggggcaccgccacggtcgctatctcgctggtgaagatcctcgctctgcccgaggcgctgacccagccgttgatggtgctgtttggtattctgttctgcgtcaccgcgctggtgggctacaaggggctggacgcgctgtcgcgcctgtcggtgccattgatgtttgtgctgctgatggtctccatgtatctggcgctgcaccacgccggcggctggcaggcgatgacccgtattgcgccgagcgacaccatgacctggtcggcggccatcaccatggtcttcggcactttcgccagcggcgccacccaggcgacaaactggacccggctggccaactccagccggaccgccattctcgccagcatgggcagcttcctcatcggcaacgggctgatgatcgtcgccggcgcctggtgcgctatcgtctatcaacaggccgatatcgttgaagtgctgatcctgcaggggctatcggtggccgcggtgatcatgctctgtctcaacctgctgaccatccagggccccaccatctataacgtctccgccgcagcctgccatctgctgcgcagcgaacgtcgccggacgctgaccctcgccgccgccggggtgggcattgtgctggccattggcgggatgtacgaaatgctgatccccttcctcgtgctgctgggcagtattattccgcccatcggcggggtgatcctcgccgactactggttcgcccgcggcgggcgctatcccctgctgcagaacgcccgcctgccgcgttttaactggctgggactcggcgcctacgccgccggcgcggtggtggcctatctttcgccgtggatcgcgccgctggtggggatctccgtttccgcgctggtctatatcgccctggctctgctaagcaaacgccagcctgccgccgtcgcggagcaggagccatga

SEQ ID NO: 5611 - DNA, 1884 bp, Klebsiella pneumoniae
gctgcctctaccgcaggcgctgctggatacgctcgacagcaccactcatgtggccgacgttgtcaccgccccggtgatgacgccgttgctcactttcgccgccgcacgtggttgcaaagtacagaccgggccggaaatggcgctggcgcagatgaggctgatgggccagtttatcggcgccatcccgcaggcgcagggagcggcggcatgaagagctgggatgtgatcgtcatcggcagcggcgcggccggttttgccgccgcggtcaccgcctgctgtaaagggctgtcggtgctgatgctggagaaagccggccagttcggcggcacctcggccatctccggcggcgccgtgtggctgcacgataccgaccaggcgcgcgccgagggcaaaagcggtagcgccgaggcgatgaaaacctacctgcgaaccattatcggcgagggccagtaccgagaagatcttgccgaagcgtttgtcagcgccgggcgggaggcgctggcctttctcgagcgtgagggggcagtaaagtacagcctgcgtccgctctcgcccgattactatccggatgaatccggcgcagtcgacgtcggtcgtgcgctggaggtggtggagtatgacggccgtgaactgggggacgcgtttcgcgacctgcgttcgccgccgccggggatgctgctgtttggcgggatgatggtcaaccgcgtcgatattcaacattttctcgacatgcgccgctcgctgcgctccctggcccattgcacccggctgctgctgcgctatgcccgcgaccgggtgaagtaccctcgcggtacccgcctggcgatgggcaatgcgctgattgcccgcatggcgactacggcgctgcgtaaaggcatgaacctgcggctgaatgtcaatgttctgacgctgtgcgaagcgcaaggcgcggtccgcggggtggagattgagtatcaggggcaaagagagacgctgcacgcccgacgcggggtggtgctggccgcaggcggcttcgccgcgggcgcgctggcggcgcgctatcggccacatacccgcgaacacttcaccatgtcgccgccggccaacgatggcgccgcgctgcgtctcgcggcggcgcttaacgctcgcgagggagccgatcgggcctccaactttttctgggcgccggtatcggtgctgacccgggccgacggcagcgaggagcgcttcccccatctggtaaccgatcgcgcaaaaccgggcgtgattgccgtcaatcagcgggcggtacgcttcgtcaacgagtccagctcctatcaccatttcgccagcgcaatgcaggatgcagcggaaaatgccccctgttttttactctgcgacgcccaggcgatgaagcgttatggcctcggactggcgcgcccggcgccggtcaataatgacgccctggtcgccgctggctatctgcacaaagccgataccctggccgcgctggcgcaacagcttggtctggatgcccaaaccctgagcgagacggtagcccgctacaaccgcgacgccgcgcagggcgtggatcgggaatttgctaaaggcggcaacagctataaccgggcgatgggcgatccgggccatcagcctgacgcctgtaatgcccccctgctcagcgcgccgttctatgccatcaaactttataccggcgatctggggacctcacggggcctggtcaccaccgccgatgcccaggtcgtcaatacccaaggaaaccccatcccggggctgtacgcggtgggaaacgacatggattcgctgatggccggcacctatccgggccccggcatcaccctcggcccggggctgacgtttggctatctcgccgcctgccatctggcacaacactccacccactaa

SEQ ID NO: 5612 - DNA, 261 bp, Klebsiella pneumoniae
caagagtctacattcactatgccaaagaaaaatgaggccccggccagctttgaaactgctctgggcgaactggagcagatcgttaaccgtctggaaagcggcgatttgccgttagaggaagcgctaagcgaatttgagcgcggcgtacagctggcgcgccaggggcaaagtcagctgcagaaggccgaacagcgcgtgcagatcctgctggcggatagtgaagattccccgaccacgccttttacgccggacgctgaataa

SEQ ID NO: 5613 - DNA, 354 bp, Klebsiella pneumoniae
atttcacctacagcggccaggtgcaacaggaggctgactatgagtgctaagacgatgaaaggaaaacaggcaattctgcgttatctcgaaacgcacaggacctttaccgcgaaggatgtggccacagagtgcggcatgaccatcaactgcatcacgaagaatgcgctcgatctggagcgggcccgcaagattgtccgggtgagcaaggtctggcgaacggtgacttatcgcctggcgacaccggaagagcaggatggtaccgcgcgcagctgcactaacggaatatttcaggagtgccgtaacagtgcggcgatgaagcgggtactggctgtttacgggagggcgcaggcatga

SEQ ID NO: 5614 - DNA, 1827 bp, Klebsiella pneumoniae
aaactcgagtttcattttcctgtctccgcattagtaagtacgaatcttcggcgggaatgccggacgcagtttcggttccatattgacgctacgacgcgtcatggattccgactctggcaggtacagggaatggcacagccagttttcatcatcacgatccgggaagtcgaagcggctgtgggcgccacggctctcggtacggaagttagcggatacggcggtcgcgtaggcggtttccatcaggttatccagctccaggcactcaacgcgctgggtgttgaactcgctggaggtatcgtcgagacgggcgtttttcaggcgctcgcggatcactttcagttgctccagacctttgtgcatcgcatcgccttcgcggaacaccgagaagttatgctgcatacattcctgcagcgctttacgaatcgccaccggatcttcaccagagcgggtgttgttccagcggttgaggcgatccagcgagccttcgatatcggattcgctagcgtcgcgcagcgtgccctgctcggcaatggattcctgcagatgcaggcccgccgcgcggccgaagaccaccaggtcgagcagcgagttgccgcccagacggttggcgccgtggaccgatacgcaggcgatttcgcctaccgcgaacaggcccgggatcaccacgtcttcgcccttctcattcacggtcaacgcctggccggtgactttggtcgggataccgcccatcatgtagtgacaggttgggataaccgggatcggctctttcaccggatcgacgtgggcaaaggtacgggaaagttcaaggatacccggcagacgagattccagaacctctttaccgaggtgatccagtttcagtttcgcgtgcgggccccacggaccgtcgcagccgcggccttcgcggatttcgatcatgatggaacgcgccaccacgtcacggcccgcaaggtctttagcgttcggggcataacgctccataaagcgttcgccgtgtttgttcagcaggtaaccgccttcgccgcggcaaccttcggtaaccagaaccccagccccggcgataccggtcgggtggaactgccacatttccatatcctgcaccggcacgccggcgcggatggccatcccgacgccgtcacccgtattgatgtgggcgttggtggtggactgatagatacggcctgcgccgccggtcgccagcacggtggcgcgggctttaaagtagaccacttcgccggtctcgatgcacagggcggtacaaccgactaccgcgccgtcctggtttttcaccagatcgagggcgtaccattcggagaagatagtggtgtggtttttcaggttctgctgatacagagtgtgcagcagggcgtgaccggtacggtcagccgccgccgcggtacgcgccgcctgttcgccgccgaagttcttcgactggccgccaaacgggcgctgataaatacggccatcgtcaagacgagagaacggcagtcccatgtgctccagctcaagaatcgcttccgggccggtcttacacatgtattcgatggcgtcctggtcgccgatatagtccgacccttttaccgtgtcgtacatatgccattcccagttatcttcatgggagttaccgagcgcgacggtgatgccaccctgcgcggatacggtatgggaacgggtagggaacactttggagagcagtgcacaggtctgtccgctctgggaaatttgcagcgccgcgcgcatacctgcgccgccggcaccgatgacaacagcatcaaactctctgactggcaatttcattacacaccccacaccacaacaaatccataa

SEQ ID NO: 5615 - DNA, 1347 bp, Klebsiella pneumoniae
aggacttataccctggcgtctcagccggggtatttcactacgcttaattttgcccggagcaacatgaacacatattccgtttcccgtctggcgctggcgctggccttcggcgtgacgctgtccgcctgtagctcgacgcctgccgatcaacagccctcaacgcagactgcaccgggcactaccgcgcgtcccatactcaacgccgaagaagcgaaaaacttcacgccggcggcctatttccagtcgctggctcccaacgccgccgcctggacgccgtctgctatcagcctgccggcgcagcctgactttatcgtcggccctgcgggaacccagggcgtaacccataccaccattcaggcggcggtggatgccgcaattgcccgtcactctaaccgtcgtctgtatatcgcgattatgccgggcgagtacccgggaaccgtctacgttccggcggcgccgggcgccctgaccctgtatggtactggcgataagccaatcgacgtgaaaatcagcgaagccattgattccgagatggatcgcaacacctggcgtcgtctggtcaatccaggcggtaaatatatgccgggtaaaccggcgtggtatatgttcgacagttgccaaagcaaatccgcggcgaccgtcggcgtaatgtgttccgcagtcttctggtcacagaataatggtctgcagctgcagaacctgaccatcgccaacaacctcggcgacagcgttgacgccggtacccaccaggcggtggcattgcgcagcgatggcgaccaggtgcagatcaataaggtcaatattcttggccgtcaaaacaccttcttcgtgaccaacagcggcgtgcaaaaccgtctgcaggacaaccgtcagacccgcaccctggtgaccaacagctacattgaaggcgatgtggatatcgtttccggccgcggcgcggtggtgtttgataacaccgatttccgcgtggtgaattcccgtacccagaaagaggcctacgtcttcgcgccggctactctgaagagcgtgacctacggcttcctggcgaccaacagccgcttcaccgcctccggggataacgtcgcgcagctcggccgcgcgctggacgtcgatggcaacagcaacggccaggtggtgatccgcgacagcgctatcaatgaaggctttaatattgcccagccgtgggcggcggcggtaggctccggccgcccgttcagcggcaacaccggcagcgccgatgacaaaggcaatctgcagcgcaacctcaacgacaacggcttcaaccgcatgtgggagtacaataaccgcggcgtgggaagcaccgtggtcgccgagccgaaacagtaa

SEQ ID NO: 5616 - DNA, 1017 bp, Klebsiella pneumoniae
caaacacatacaaatgcggcacgtggacgcgtgcccccaataacaacacacacaatcacaatgggtatcaatagcgtcgctgacgctgcggataaggagttggatatgcaattacgtaaactggccacggcaatgctggtaatgggaatgaccgctggtctggcgcaggcggaagatgctgccccggcggctggccagaacaccctggataagatcgccaaaaacggggttatcgttgtcggccatcgtgaatcttcggtcccgttctcttactacgataaccagcagaaggttgtgggctactctcaggattattccaacgccatcgtcgatgccatcaagaaaaaactgaacaaacccgatctgcaggtcaaactgatcccggtcacctcgcagaaccgtatcccgttgctgcagaatggcacctttgatttcgagtgcggctcaaccaccaacaaccttgagcgccagaaacaggcggccttctccgataccatcttcgtggtcggtacccgtctgctggtgaagaaaggcggtccgatcaaagatttcccggacctgaaggataaagcggtcgtcgtcacctcaggaaccacctcggagatcctgctgcataagctgaacgatgagaaaaaaatgaatatgcgcattatcagcgccaaagatcatggcgactctttccgcaccctggagagcggacgcgccgtggcctttatgatggatgatgccctgctggctggcgaacgcgccaaggcgaagaaaccggataattgggaaatcgtcggcaccccgcagtcgaaggaagcctatggctgcatgctgcggaaggacgatccgacgttcaaggcgctggttgatgaaaccgtcgcccaggctcagacctctggcgaagcggagaagtggtttgacaaatggttcaaaaacccgattccgccaaaaaatcttaacctcaacttcgagctgtcggacgacatgaaagcgctgttcaaatcacctaacgacaaagcactgaactaa

SEQ ID NO: 5617 - DNA, 1209 bp, Klebsiella pneumoniae
ttcagcgatacgcagacccatctccgcttcggtgcgcacgattttaccgcgcagcgagttggtatatacatcgacgatttcgacatcgacaaacttaccgacgaggtccggggtaccttcgaagttgaccacccggttattctccgtacgtccggagagctccatgatgttcttacgcgaggtgccttccaccaggatgcgctgtaccgtgccgagcatgcgacggctccaggccatcgcctgctggttaatgcgttcctgcaggatatacagacgctgttttttgtccgcctccggcacgtcgtcgaccatatcggccgccggggtgcccgggcgagcggagaagataaagctgtagctcatatcgaaattgacgtcggcgatgagcttcatggtcttttcgaaatcttccgtggtttcgccggggaagccgacgataaagtcggagcttatctgaatatccgggcgcgcttcacgcagcttgcgaatagtcgctttatactccagcgcggtatgggtgcgtcccatcaggttcagcacacggtcggagccactctgcaccggcaggtgcaggaagctcaccagctccggcgtatcgcgataaacgtcgatgatatcgtcggtaaattcgatcgggtggctggtggtgaagcgaatgcggtcgatgccgtcgatggcggcgaccaggcgcagcaggtcggcaaagctgccggtggtgccgtcgtaattctcaccgcgccaggcgttaacgttctgccccagcagattgacctcacgcacgccctgcgccgccagctgggcgatttcaaacaggatatcgtcgcacggacggctaacttcttctccgcgggtatacggcaccacgcagtaggtgcagtatttattgcaaccttccataatcgagacaaaggcggtcggcccttcggcgcgcggctctggcaggcgatcgaatttttcaatttccgggaagctgatatcaactaccggactgcggttgccgcgcacggagttaatcatctccggcaggcggtgcagggtttgcggcccgaaaataatatcgacatagtgcgcgcgctggcgaatatggtcgccttcctgggaagccacgcagccgccgacgccaataatcaggtccgggttcttctctttcagcagcttccagcggccaagctgatggaaaactttttcctgggccttctcacgaattga

SEQ ID NO: 5618 - DNA, 1260 bp, Klebsiella pneumoniae
cgtggagatacatttgtgaaatgtcgttggcaggaaggcaaccgcattacgctactggagaatggcgaccagtactatccggcgctgtttgcggccatcggtcgcgccagccggcgggtgatcctcgaatcctttatctggtttgaagatgaggtaggccggcggctgcacgcggtcctgctcgaggctgcccgccgtggcatccaggtggaggtgctccttgacggctatggttccccggatctcagcgatgaatttgtcggcgagctcaccgccgctggggtgattttccgctactacgatccgcgtcctaagctgatggggatgcgcaccaatctgttccgtcgcatgcaccgtaaaatcgtggtaatcgacgacaccaccgcctttgtcggcggtattaactactccgccgaacatatgagcgactacggtccggaggcgaagcaggattatgcggtgaaggtcgaagggccggtggtgctcgacatcctgcagttcgagctggaaaacctgcccaacagcgaaaccgcccgccgctggtggcgacgtcgtcgccaccagccggagattaaccagacccccggcgaggcgcaggcgctgttcgtctggcgcgacaaccaggatcaccgcgacgatattgaacgccactacctgaagatgctgaccagcgcccgccgggaagtgattatcgctaacgcctattttttccccggctaccgcctgctgcatgcgatgcgcaatgccgcgcggcgcggagtacgggttaagctgatcgtgcagggcgaaccggatattcccattgtgaagtttggcgcccacctgctctatcactatctcgttaagggcggggtgcagatttacgaatatcgccgtcgcccgctgcatggcaaggtcgctctggcagacgaccactgggccaccgttgggtcaagcaacctggatccgctcagcctgtcgctgaatctggaagccaatctgatcatccacgatcgggtgtttaaccagacgctgcgcgataatctcaacgggcttatcgcccgggattgccagcggatcgataaaacgatgctgccgaaacgcaactggtggcggctgggcgtcagcgtgatggctttccactttctacgccacttcccggcatgggtcggctggttaccggctcataccccgcggctggccagagtcagccctccggtccagccggaaattgaaactcaggaccgcgtcgagtctccagccagggataatccactatga

SEQ ID NO: 5619 - DNA, 1026 bp, Klebsiella pneumoniae
acctgctgtacggcggcaagcgcgttaaaaagctgtctatctgaggagtgcgttgtggcacaggaatatactgttgaacaattgaaccacggccgtaaagtctgggactttatgcgctgggactactgggccttcggcatttcaggttttctgctgattgtgtcgatcgccatcatcggcgttcgcgggtttaactgggggctcgatttcaccggcggtacggtgattgaaattacccttgagaaaccggtcgatctggaccagatgcgcgattccctgcagaaagcgggctttgaagagccgcaggtgcagaactttggcagcagccgcgacattatggtacgtatgccgccggtgcatgacgccaacggcagccaggagctgggcagcaaggtcgtgacggtgattaacgaatcgaccagccagaatgcggcagtgaagcgtattgagtttgtcggcccgagcgtcggcgcggacctcgcgcaaaccggcgccctggcgctgattgcggcgctggtctgtatcctgatctacgtcggcttccgcttcgaatggcgtctggccgccggggtggttatcgccctggcgcacgacgtggtgatcaccatgggcgtgctgtcgctgttccatatcgagatcgacctgaccatcgtggcttcgttgatgtcggttatcggctactcgctgaacgacagtatcgtggtatcggaccgtatccgtgaaaacttccgtaagatccgccgcggtacgccgtatgagatctttaacgtgtcgttgacccagacgctgcaccgtaccttgatcacctctggtaccactttgatggtgatcctgatgctgttcctgttcggcggcccgattctggaaggcttctcgctgaccatgctgatcggtgtttccatcggtacggcttcctctatctacgtcgcctccgcgctggcgttgaagctgggcatgaagcgcgagcatctgatccagcagaaggttgagaaagaaggggcggatcagccgtctattctgccgtaa

SEQ ID NO: 5620 - DNA, 1347 bp, Klebsiella pneumoniae
atacatttcacgatgaaagcccgatataaagccgttgtcgaccgatatgcgcaggcgatccgcagcgggcagctgcccgccggcagccgactgccgacgcaccgtacccttgccgccggggagcgcatctcgctggccaccgccacgcgcgtctatcgtgaactggaagagatggggctggttagcggcgaaaccggccgcggcaccttcgtgcgcgacctctcgctgccgccggggcatggggtcgatcagcaggtggtcgccgccgatgtcgtggatctcaatttcaactacccttcgctgccggatcagggcgatgcgctgcgcgaggcgctcaggcagctggcgatggcgggcgatattgactcgcatctgcgctatcagcctcacgccgggcggctcgccgagcgggacattatcgcccgccatttgacctgccagcactttgcgccggacgcggaaaatgtcctgatcgtcaacggcgcacagcacgggctggcggtgaccgtcatggggctgttacgtccgggggatgtggtggcggtggatgcgctgacctattcgggcttcaaggttctggcggcgctgtatcatctggagctggcggcgatcccctgtcgaccggagggaccggacctgcaggcgcttcagacgctgtgccagcagcggcgggtgcgggcggtgtataccatgccgacgctgcacaatccgctgggctgggtgctcaacaccgggcagcgacaggcgctggccgatctcgcgcgccagcacgatctgctgattattgaagatgccgcctatgcccggctggtgagccatccgccgccgccggtggtcagctatgcgccggaaagaacggtgtatgtcaccggattttcaaaaaatatcgccaccggactgcgcgtgggggtggtgatttctccgccgcgctatcggccggagattgagcgcgccatccgggccacgacgtggaatacgccgacgctgataagttcgctgatctgcgcctggattgaagatggcacggtggcgcgctttgaaacgcagaaacgccaggatgcgcgacagcgacagcaggtggcccgcgaggtgctttgcgggcttcccgtcgtcagtcatcccgattcgtacttcgtctggctgccgctgggtgaagagagccgggccgatcggctggcgaatgcgctgatggaacgccgtatttcggtgtcgaccgccgagccgttctgcgtctccaccacgatcccgcaggcgctgcgcattgcgctcggatcggtgcctttcgacagcctgcgcccggcgctgctcagcgtgcgcgacgccgttgagtatgaacaataccgctaa

SEQ ID NO: 5621 - DNA, 1347 bp, Klebsiella pneumoniae
aaaggtatcacagaaaggcgtcgtcgcgcagcgccttgcgccctatgccgggtagcggatgtgctccacctcacgctgcaaaatcaccctgccgtggcgaatggaggtcagcacccgtgcctgacgacggacggcctcgtagtcgttttccgcatcgaggatcagcaggttcgccgggcggccttcggcgaggccgtagttatcgcccagacagagcgcccgggcgctgttgtcggtgacaaagtcgagacagcgctgcagatcgtcatagccgagcatatggcagatgtgcagtccggcatccagaatgcgcaggatattgccgtttcccaacggataccacggatcctgaatcgagtcctgagcaaagcagacattgatgccggcgcgatccagctccgccacccgggtgacgccgcgccgtttcggccagctgtcaaaccggccctgcagatgaatgctttcggtcgggcaggagatgaagttgatccccgaggctttcagcaggcgaaacagcttcgagcagtaggcgttatcgtaagagcccatcgcgcaggtgtggctggcggtgacctgcgcccccatgccgcgcacccgcgcctcttccgccagcacttcgaggaaacgcgactgcggatcgtcgatttcatcgcagtggacatccaccaggcggccgtagcgctgggcgaggtccatcaaaaacatcaccgagctgacccctttgtcgcgggtgttctcatagtgcggaatgccgcccaccacgtcggcgcccatctcgatggcgcgcgtcatcagctcccggccgttgggatacgattctattccctcctgcggaaaggcgacaatctgcagatcgatgagatcggcggcctcttgtttcaccgccagcagcgcctgcagggccgccagcgacgggtcggtgacatccacatgggtgcggacgtgctggacgccgaaatcgcgcagcatgccgatggttttcagcgctcgctgacgggtgtcctccggggtaatactcgctttgcgctggctccagcgggtgatgccttcaaacagggtgccgctgcggttccactccggctcgcccgcggtgagggtggcgtcaagatggatatgcggctcgacgaagggcgggatcgccagccggccctgggcgtcgatatcccctgcgtcggcagtctgcatcgcggcctgggcggtgatgcggtgaatcatcccgtcatgcaggtcaagggtaaacagcgcctcctggcggcgcaggcgagcgttaataattttcatggtgggtcctgtaaatggttttgcgataaacgccagatcaccagcgcgaccgaggcgttgagatga

SEQ ID NO: 5622 - DNA, 1500 bp, Klebsiella pneumoniae
cgggtcatcaccagccccagggtcaccgaccagctgccccagataaaaaactgcataaacatcattaacgacagccgcggcaccagaaaacggtggctcacgcggacactttcccgaccttctgttgttgtgaccatgttgctcgccctcagaaaagtaatcgattacaaaacagctcaaaacaaaagtaatcgattacaaaaagaagatcgccaggcaaatgcgccgcctgcgaagaggatcacaataaaaaggcaggcagccccgccggacggcggggcatctcgcttacgccgggcggcgcagcagtttgaaggcgataaacaggaacaggatccacaccggcagcaggatcgccgacagacgcatgccgtcgatagtgcacatcagcgccaggatcagcccaaggaaagcaatgcagaagtagttgctggcgggcgccagcagcgctttgaacttcgattcgcgccctttgcggcgctgggcggcgcggaacttcaggtgcgccatacagatcatgatccagttcagcagcaacgtcgccaccaccagggccatcagcagccccagcgcttcatgcggcagcaggtagttcagcaccaccaccagcgaagtgataatcccggagagcagcagggagttcaccggcacgccgcgcttgctgacgcgggcgagaaatttcggcgcattaccctgcaccgacaggccgaacagcatccggctgttggagtacacgccgctgttatacaccgacagcgaggccaccagaatgacgaagttcagcgcggaggccaccaggttgctgtccagattatggaaaatcatcacaaacgggctgctgtcggatttgatctccacccacgggtagagcgccagcagcaccaccagcgaaccgatatagaacagcaggatacgatagaccacctgattgaccgctttgggaatgctcttttccgggttttgcgcttcggcggcggtgatgccgataagctccagcccgccgaaggagaacatgatcaccgccagcgacagaataagtccgtgccagccggtggcgaggaagccgccgtgtttccacagattgtcgaacccggctttgctgccgccgtggccgccgaacagcatccacaggccgaaggcaatcatgccgataatcgccagcaccttgatcagcgcgaaccagaactccgcttcgccatacaagcgtacgttgaccaggttgacggcgttaataatgatgaagaaagccgccgcccaaacccaggtgggcacgtcgggaagccagtactgcatatagatcccggcggcggtcagctccgccatccctaccagcacgaacatcacccagtagttccagccggagagaaagccggcgaacggcccccagtacttataggcaaagtgggcaaaggaaccggatactggctcttccaccaccatttcgcccagctggcgcatgatcagaaaagcgacaatcccggccacggcgtagcccagtaa

SEQ ID NO: 5623 - DNA, 684 bp, Klebsiella pneumoniae
agaggctggttgatgaaaatcttagtcattgaagacgatgcgctgctgttgcaggggttaattctggcgatgcaaagtgaaggatacgtgtgcgatggcgtctccaccgcgcacgaagccgcgctatcgctggccagcaatcattacagcctgatcgtgctggatctcggcctgccggatgaagacgggctgcattttctctcccgcatgcggcgggagaaaatgacccagccggtgctgatcctcaccgcccgcgatacgcttgaggatcgcattagcggtctcgataccggggcggatgactacctggtaaaaccctttgccctggaggaactcaatgcgcgcattcgcgccctgctccgccggcataacaaccagggcgataatgaaatcagcgtcggcaatctgcgccttaacgtcactcgccgcctggtgtggctgggtgaaacggcgctggatcttacgccgaaagagtatgccctgctgtcgcggctgatgatgaaagccggtagcccggtgcatcgcgagatcctctacaacgacatttacagctgggacaacgagccggcgaccaataccctggaagtgcatattcacaacctacgcgaaaagattggcaaatcgcggatccgcaccgtccggggctttggctatatgctggctaacaacatcgacacggaatag

SEQ ID NO: 5624 - DNA, 537 bp, Klebsiella pneumoniae
aacacacccacaggagttttaagacgcatgtcttcccgcaataattcggcgcgtatcgccatcgtgatggggtccaaaagcgactgggctaccatgcaatttaccgcagaaatccttgatgccctgaacgttccgtaccatgtcgaagtggtctccgcccaccgcacgcccgataagctgttcagctttgctgaaagcgccgaaagccacggttatcaggtgattattgcaggagcaggcggcgcggcgcatctgccgggcatgattgcggcgaaaaccctggtgccggtgctcggcgtaccggttcagagcgcagccttaagcggtgtcgacagcctctactccattgtgcagatgccgcgcggcattccggtcggtaccctggccatcggcaaagctggcgctgcgaacgccggcttgctcgccgcgcagatccttgcccagcatgatgcagaactgcaccagcgcctgagcgcctggcgtcaggcgcaaaccgatgaagtgctggataatccggatccgcggggtgcggcatga

SEQ ID NO: 5625 - DNA, 468 bp, Klebsiella pneumoniae
tgggcgtggtttccccggcagcgtagcgttgccggggagaggcggttaaagcagaccgatgggccagtgatgaccaatgacgtacagcacgccagcggagatcacgccggcgacgatgtcgtcgaccataatccccattccgccgtggatattgcgatcaaaccagcgaattggccacggcttccacatatcgaagatacggaaaatcacgaagccggcggccacccactgccagtccatggtcggcagcgccatcagggtgatccacatcccgacgaactcgtcccagacgatgctgccgtggtcatgggtgcccatatctttggccgtgcgatggcacagatagacgccgatacagatgctcatcatcaccaccagcgagtaaagctgccaggggagaaaggtcatcagataccagaacgggatcgccgccagcgagcccatcgtccccggcaccaccgggcttaa

SEQ ID NO: 5626 - DNA, 336 bp, Klebsiella pneumoniae
acgcccgccacaccgccgccggccgggcgggacgcgggcgcagcagcagcgcgcagagggccggagtcagggttaacgccaccaggctcgacagggccaccgcggtggaaagcgtcacggcaaactgccggtacagctcgccgacgatccccgggagcagcgccaccggcacaaacaccgccagcagcaccagggtcgtggcgatcaccggcccggcgatctgccgcagcgcctgggcggtggcctgcaggcgatccagcccttccgccattttggtttccacattctccaccaccacaatggcgtcatccaccaccatcgtcagggcgagaatga

SEQ ID NO: 5627 - DNA, 1491 bp, Klebsiella pneumoniae
cactatcggttcccaaaaactgttcgcctgtatccgcgatgcgcaccgacggcgagcgatacccgccaccggacgccgcgcggacgcacctacctgaagcgattaaataggtttggtcatcaagccgaccgatttaacccctgcactatgcaacaggttcagcgctttaataatttcatcgtaagggacgtctttcgcaccgccgatcaggaataccgttttttcattggcttcaagacgacgcttcgcttcggcaattacctgctccggcggcagctgggacagcgtctcctgccccaccttcacgctgtactgccctaccccggagacttccacaatcaccggcggatcgtcattgcttttcaccgcttgcgattccgtggcgtccggcagatcgacttccacgctctgcgtaatgattggcgccgttgccataaagatcagcagcagcaccagcaggacatccagcagcggaacgatgttgatctcggacttcagttcgcgacgtccgcgtccacgtgctctggccatggcttaccccttattgctttcgctggtggtaaaggcctgacggtgcataatatcggtgaactcttccataaagttgtcgtaattcagttcaagcttgttcacgcgctggttcaggcggttatacgccatgaccgccgggatcgcggggaacagaccaatcgcggtggcgatcagcgcttcggcgatacctggcgccaccatctgcagggtggcctgcttcaccgcgccaagggcgataaaggcgtgcataatcccccagacggtaccgaacagaccgatatacgggctgatcgagcctacggtgccgaggaacggaatatgggtctccagcgtttccagttcgcggttcatcgaaatacgcatcgcacgcgatgccccttcgacaatcgcttccggcgcatggctgttagcccgatgcaggcgtgcaaactctttgaaaccgctgtagaagatttgttccgaaccggtcaggttatcgcgacgcccctggctctcctggtacagacgagagagctcgatcccggaccagaatttgtcctcgaacgcttcagcttcacgcgcggccgagttaaggatacgcgttctctgaataatgatagcccaggaagcgatagaaaaaccaatcaaaatcaacatgataagttttaccagaaggctcgccttcaggaacaaatcaaggatattcatgtcagtcactgcttaaactccgcgacaatagacttgggaagcgcacgtggcttcattaagagtggatcaacgcacacaatgagaacctcagcttcgtttaacactgtattctcggcgttgacgattcgctgcgtgaaaaccaaagaggtgccgcgcatcgaggtaatttccgtctggacttcgagcatgtcgtcgagtctggcgggggcaaaatactccagcgtcattttacgaaccacgaaggcaacgcgttcagccaacagcacctgttga

SEQ ID NO: 5628 - DNA, 1053 bp, Klebsiella pneumoniae
acgagtaacacgttatttttgcaatcaattgtcacgcacggcaacgcggtgggccgctatacttggcctatcattcccaaccggactcatcgcgtgccagagaatacgcctccgtcagaatctcctgacagacaggatgaacgttacgatcgtcaaatgtttcgcatcctgcgtaatattgacctcaatctgttgacgatctttgaagcggtatacgtgcataaaggtatcgtcaacgccgcgaagatactcaatatcacaccgtcggcgattagccagtcaattaacaaactgcgggcgctgttccccgatccgctatttatccgcaaaggacagggcgttacccccaccgcctatgccacccatcttcatcaatacatcagccgcggcatggaagctttcctcagcgcgctggatatcaccggtagcccgcaccagcagcgggtgatcactatcgccactacgccagcgatgggagcgctgctgatgcctggcctggccagcgcgctgaagccgacctttccgcagatcttgttgcacaatatcgccatcgtcgacgccgcgcggcagcttgaccagcgccaggtggatctgctcattgatacccacctgcacagcggccaggcgataagccatcatgtgctgtatcaggatcgggtacagatgtactgccgcgcagggcatcccgcgctggacggtccgcaggatgaaacgaccctcgcggagtacgaatttgcgctgctgctgccggaaggccagcgctaccccaccctccatcgccgactacaggaagagatgggcgagcgccgctgcggctttagcacctttaacctgatgacccaggcggcgatgatcgccgggagcgatatgctgggtctgaccaccgaacgcctgttcgccatggtgtcccgtctctggccgctgcagaccctggatttcccttccctgggtggagagcagattgacgttgcgctgcactttaataagctgagcgggaaagagccattgctgaaagagatcatcgagacggtgatccgctcgtttaaggcgtag

SEQ ID NO: 5629 - DNA, 282 bp, Klebsiella pneumoniae
ttttattgcacgggaagcgtagctatgaccacagtggttttgaatgtaaaaattgacgcagagctaaaagaaaagttgcgtcattatgcggaagttaataacgagaacctgggaacggcaacggaaaagctgctgcagctggcttttcagctggaggagtcagcaggtgaggcgggggtgacggaagaggacattgacagccagcataccgaagaggaagcaacgccacttacccctaaagaaatcaaagcattaagaaaacttctgaagaagaaaaaatga

SEQ ID NO: 5630 - DNA, 360 bp, Klebsiella pneumoniae
gcctgccgcacctctgggagaacgacaatgaaaaaaatgctgcttattgccatgatggcagcgggcctggtggcctgcaccacgtcgccggcgccgaaagaagacaccaaactgaaagatgcctatagcgcctgtattaatacggcggaagggaatccggacaagattgaagcctgccagagcgtactgaatgtgctgaaaaaggataaacagcaccagcagttcgccaaccaggagagcgttcgcgtcctggattaccaacagtgtattcaggccacccgcaccggcaacgatcaggcggtgaaagcgcgctgcgatcagatctggaaggagatccgcagcaataatacgacccattaa

SEQ ID NO: 5631 - DNA, 894 bp, Klebsiella pneumoniae
gataaacgcacttttggcaaggatcccgatatgaacgatttcacttcccttctgcagcagggcaatgcctggctgtttatacccagcgcaatactgctcggcgcgctgcacggcctcgaacccgggcactcaaaaacaatgatggccgcctttatcgtggcggtgcgaggaaccttaaaacaggcggtactgctggggctggcggccacggtttcgcatacggcggtggtctggctgatcgccatggccggcctgtggtttggccgcggctggaacgcccaaacctctgaaccctggtttcagctggtctcggggatagcgattgtgctgattgcctgctggatgctctggcgcacctggcgcgaaacgcagccccacacgcaccatgatcaccatcacgaacatgatcaccaccacgaacatgatcactaccacgaacatgatcaccaccacgaacatgatcaccaccatgaccatcaccatgcgtcctcatccgccgcgccgctggtggcggaggagtggcaggacgcgcatcagcgggctcatgctcaggagatcaaccggcgctttgatggccgccaggtgacgaccgggcagatcgtgctgtttggcctgaccggggggctgatcccctgcccggcgtccattaccgtgctgcttatctgtttacagctgaagaaattctcgctgggcgccacgctggtgctgggctttagcgttggtctggcgctgacgctggtggcttccggggccatcgccgccctgagccttaaacatgccacccgccgctggccgtggcttaacgacctctcgcgcaaggcgccctggttctcaggcttactgattattgtggtggggatctacatgatgcttcatggcctgagcggcctgtaa

SEQ ID NO: 5632 - DNA, 987 bp, Klebsiella pneumoniae
caggagcgcactatgcactatatccccctcggtgatactgccttacgtgtttcccgactctgcctcggctgcatgaccttcggcgagccggaccgcggcagacacgcctggacgcttccggaagagagcagccgcccgcttatccagcacgccattgaaggcggcatcaacttcttcgataccgcaaatagctactccgacggcagcagcgaagagatcgttggccgcgccctgcgcgactttgcccgccgcgacgaggtggttgtcgccaccaaggtgtatcaccaggtcggcgatctggcggaaggactttcccgggcgcagatcctgcgctccatcgacgacagcctgcgccgtctcgggatggactatgtcgacctgctgcagatccatcgctgggactataccaccccgattgaagagacgctcgaagcgctggacgaggtggtgaaagccggcaaagcgcgctatatcggcgcctcgtccatgcatgcccgacagtttgcccaggcgctggcgctccagcagcagaacggctgggcgcgcttcgtcaccatgcaggatcactacaacctgatttaccgggaagaagagaatgagatgctgcccctgtgccaacgtaacggcgtagcggtgatcccatggagtccgctggcgcgcggcaggctaacccgcccctggggtgagaccaccgcccggctggtctcagatgagttcggcaaatcgctgtacagcaccagtgaagaaaacgatgcgcagatcgccgggaagctcgcggacgtggcggaagaactcgacgccagccgcgcccaggtcgccctcgcctggctgttaagcaaacccggcgtcgccgcgccgattatcggcccgtcgcgtcaggaacagctcgatgatctgctgcaggcggtggatttgacgctctccccggaacagatcgacaagctggaggcgccgtatcagccgcatccggtggtgggatttaagtga

SEQ ID NO: 5633 - DNA, 189 bp, Klebsiella pneumoniae
gtttctggcacacgcattcgccatcgtcgtatgcgtactgatagcaagcgcgttctgcctgatgcctggtggttcagcatgagcagaaatggcattcgttcactgatttactgcctgctgatctgcggcgttatctggacagcgttgattatcaaaattctgcacgttacgggggtgttcaatggctaa

SEQ ID NO: 5634 - DNA, 216 bp, Klebsiella pneumoniae
agacggggcacgttttcgaggttatggttgaagacatccggcggggtcaccgtcagaatatcaagtgcgcgatccatgcggccgcggaaatccggaaccagcgtttcgatcttaatcgacgggtttttctcgcgaatggcgctgatgcagtcggcaaaatgctgtgcgccgccatcacgcaggtcgtcacggtctaccgaggtgactacgacatag

SEQ ID NO: 5635 - DNA, 192 bp, Klebsiella pneumoniae
tcgctcaggttgacgaatatctggacgacacttttacgttgttcagtaactacggcattaactctacggatttgcaaaagtggaaaaaatccggtaaccgactatttcgttgctttgtcaacgccagccgggaaaacccggccagtctatcgtgttagaattattacaatcaaaaggtggaattatgtctga

SEQ ID NO: 5636 - DNA, 237 bp, Klebsiella pneumoniae
tacacaaggttatccacaggaatagtggataactgtccgcagcccaagaccaccgccgcccggcgcctgccgccttttgcggtcaaccgcgtggcgaaaaatttttatcgaactatttttgataactatccgcttaaagccgctcgatttttgctgctttttgcaccaccctttagcgtcgggcaccggaaaagtgcagccccggcgctgacgaggcccgatgttatcggcgtttag

SEQ ID NO: 5637 - DNA, 219 bp, Klebsiella pneumoniae
agaagaaggttagctatgggtgagattagtattaccaaactgctggtagtcgcagcactgattatcttagtgtttggtaccaagaaattacgtacgctgggcggcgacctggggtcggctatcaagggctttaaaaaagccatgaacgaagatgacgatagcgcgaagaaaaccaccgcagaagaagcgccggcgcagaagctctctcataaagagtaa

SEQ ID NO: 5638 - DNA, 474 bp, Klebsiella pneumoniae
gctgagttaacagcgggctggtttgcatcagaacggcatcttgaagcctggcggcagttgcataccggcagaaacggaagccatcttctctttctggggctcttcgatacggcgcgcggcgtcgttgaacgcggcagccaccagatcttcgagcatctctttgtcgtcttccagcaggcttgggtcgatctccacacggcggcagttgtgcgcgccgttaatggtcactttcaccagacccgcgccggattcgccggttacttccagctgagcgatctcttcctgcatcttctgcattttttcttgcatctgctgggcctgcttcatcaggttacccaggccgccttttccaccaaacataggcttctctctcagtcatcgttaaaggtactgaatgccagtcagactggcattcaaatggggcgaatactctcttcatccagatcggcgtcgaagaaacgacgcagggtctga

SEQ ID NO: 5639 - DNA, 837 bp, Klebsiella pneumoniae
caaatgaggtttgaaatggtcagtggaactacccaggttgtcgccgtgattggtcatccgatcgcccaggtgaaatcaccggataacttcaaccgctactttgccgaacagcacatggacagcgtcatgatcccggtggatatcgtcccggacgcggtggccgcctacctcaacgccctgcgcggctggcagaacatgaccggcgtgctggtgacggtaccgcataaacaacgcgccgccgcgctggtcgacgacctcacgccgcgcgcccgccgactcaacgccgtcaatgtgatccgcaagctggcggatggccgcctgcagggcgatatgctggacggcgtcggctttcagctcgccgccgaggcgcagggttttcagccggcaggtaagcaggcgctgctctccggttgcggcggcgtcggcagcgccatcgcctggggactgtgcgaggcggggatccgtcggctggccctgcacgatcaaaccccggccacccggcagcgcctgcatgaccttctggctgaggcctttccggcggtgcaactgagcgcgctgccagacaccctttacggcctcgatctactggttaatggctcaccggccggcatggccggatttgatgagctgcctctaccgcaggcgctgctggatacgctcgacagcaccactcatgtggccgacgttgtcaccgccccggtgatgacgccgttgctcactttcgccgccgcacgtggttgcaaagtacagaccgggccggaaatggcgctggcgcagatgaggctgatgggccagtttatcggcgccatcccgcaggcgcagggagcggcggcatga

SEQ ID NO: 5640 - DNA, 516 bp, Klebsiella pneumoniae
atactactaacaaattaccacaaacccgtgtgcagcaaggcctccagcccacttcacggttttgtaaaacgagaatatgctatgaatcttaaaccacgcaactttgatgaagtcattgaaaatgtattagttgaaaaaggtgtttgcacctctgatacactgaataaatattcaaaaaaagagaaattttattactttaatcagtttctgatcggagccaccaataggagaaagcatcccaaagatgagcacgctttctcactttattcctatgagagacgaaaacatataccgagagcttcaagatttgatgacatgataaaagatattcctttaatcaaaaaaagctgtaattaccgggcagataattggcctaatggctatagagttactagtgctggatatgacattttttcggcatgttgcagagcagttcctagccgatgcggtctctataacgaaggaaaaccatacaacccacctcggaatggcatccgctcccaattaaaaaaatag

SEQ ID NO: 5641 - DNA, 204 bp, Klebsiella pneumoniae
ccggcgataaccgactcatcaatgaccactttttcgacatcttccatcgaaggcaggtcatacatggtatccagcagcgccgcttccacaattgagcgcaggccacgggcgccggttttacgcgccatcgctttcttggcgatagcgtccagcgcttcgtcgcggaattcgagctctgcgccttcaaggctaaacagcgcctga

SEQ ID NO: 5642 - DNA, 357 bp, Klebsiella pneumoniae
ccatcttcaactccatctcagaggctaaccagcatgcaaaagagcagatcgcactggacgcatcgggagcctcggctgatatccgggttgctgttgcgaatgatgattgcgctaatcgccctgtgcctgctggcgcagttaagcggctgcagcaatatgcgaacggtttacgtcaaggtgccggtagtggcgttaccggtcagcctgacagctgacaccccgcaaccggaaatccctgacaatctgacgtggggtcaaagtctggatttgaacgtcagcctgctttcggcactgggccagtgcaaccgggataaggctgatatcaggcagtccgagaaacaacgagcctcgctatag

SEQ ID NO: 5643 - DNA, 228 bp, Klebsiella pneumoniae
cgatgttcaacagcagtaaaatcatgccctgactataacttccgcggattttgcgccatacagggacgtttcatttctgcaaggatgatcacacaactggcagcttatggtagttttatcaacgatcaaagcgtagcgtataacaaaagcgcatcagaacatgttttccacgtaatacggcggtttgaaaagatttatttttctaactggcatacggaattcaaataa

SEQ ID NO: 5644 - DNA, 822 bp, Klebsiella pneumoniae
cacatgacaacacgcgtgattgccctggatttagacggcaccctgcttaccagcaaaaaaaccattctgcccgcttcgctggaggcgctggcccgcgccagagaggcaggctatcaggtcatcgtcgtcaccggacgtcatcacgtcgctatccatcctttttatcaggcactggctctcgatacacctgcaatttgttgtaatggcacctatttgtatgattatcacgcaaaaaaggttttggccgccgatcctatgccggtagagcaagcggtaagcctcactgccatgctcgccaaacagcagatccacggcctggcatatgtggacgacgcgatgctttatgaacaccccaccgggcatgtgctccgcacccgcaactgggcgcaggcgttaccggaagatcagcgtccggttttcgctcaggtcgattcgctggcgcaggcggttcgcgaagttaacgcggtatggaaattcgctctcaccgatgacgacattccccgcctgcagcggtttgcgcagcaggttggcgagacgctgggcctcgagtgcgaatggtcgtggcacgatcaggtggatatcgcgcgcgccggcaacagcaaaggcaaacgcctggcgcaatgggtggccgaccaggggctgtcgatgcaggatgtggtggccttcggcgataactacaacgatcttagcatgctggaagcggcgggcaccggggtggcgatgggcaacgcggtggacgaggtgaaagcccgcgccaacatggtcatcggcgacaatgagtccaccagcatcgccgagtttatctaccgccaactgctgtaa

SEQ ID NO: 5645 - DNA, 648 bp, Klebsiella pneumoniae
tccattgcaacggctgcccgctcaggacgccgtgccagtcaagcatcggcgtcactcgaggctctcctggtgcagcggatccagcaccttctgcagaaaacgccgtgcgcgggcatgctgcggatgggcgaaaaactcagccggcggggcgacttcgaggatgtcgccgccgtcgataaacaccacccggtcggcaatttcgcgggcaaactgcatctcgtgggtcaccaccagcatggtgatcccgctgtgggcgagggttttcatcacctgcagcacttcgccgatcatctccgggtcgagcgccgaggtgggctcatcgaacaggataatctgcggcgaggaggccagggcgcgggcgatggccacccgctgctgctggccgccggagagttgcgccggcatctgctgcgctttttcttccagtccgacctgacgcagcagcgccagcgcccgcgcctgagccgcgcttttcccccagccatgaacgcgctccagcgccagagtgatgttctcctgcgccgtcaggtgggcataaaggttgaactgctggaagacaaagccgacgcggctgcgcagctggcgcaaggcgctgccgctcagccggctggtgggtttgccgtcgatcaggatctcgccgccgcttaa

SEQ ID NO: 5646 - DNA, 366 bp, Klebsiella pneumoniae
ggccaagggttactgaggctgctggcgcatggaagcgcctttaaaataattcttgacggattgcatgagtggcttagtattaccaataaggtaaaacaggaggcgactatgagaactgatgatgtgttgaaattctcgagccttttcaaagtaaacgtgtgtcacgatacagaagagaatgtatgggtggcatactgtgaagatcttgggctctccactgaagctgactcttacgaagatctgaccgaaagagtgtgggagatagctcctgagttatatgaaatgaacggatacaaaggcaacctcaaacggctgcatttatccttcgttcaggaacagaacttcactgacagaatggcactgtag

SEQ ID NO: 5647 - DNA, 519 bp, Klebsiella pneumoniae
aaaatgggaactgatactcttgcgcatactgcccacgcgcatgaacacgggcaccatgatacaggaccgatgaaggtattcggtttctggatctacctgatgagcgactgcattatcttcgctacgctgtttgctacctatgccgttctggtgaacggcacggccggcggaccgacgggcaaagatatttttgaactgccgttcgttctggttgaaaccgcactgctgctgttcagctccatcacctacggcatggcggctatcgccatgtacaaaaacaacaaaagccaggtggtttcctggctggcgttgacctggttgtttggcgccggatttatcgggatggaaatctatgaattccatcacctgatcatggaaggctttggtccggatcgtagtggcttcctgtccgcgttcttcgcgctggtcggcacccacggtctgcacgtgacctccggtcttatctggatgggcggtgctgatgttccaggtttcacgtcgtggcctgaccagcactaa

SEQ ID NO: 5648 - DNA, 504 bp, Klebsiella pneumoniae
ctttcgttgacaatttccgggcgctggaaacggcgcagctcgcgtagcagcccaaccagcagcacaccgacaagcgccagcgcccagccgctggcgctggcggatgccgccggcgtcatcactgcccctaagccgccgagcagcgccgcgccgatggcgtcgccggtgacgttttgcgcggtccacagaccgttaatccgcccgagcatatgttccggcgtctgggtctggatcagggtgtactgcagcagcgagctaatagcgctcagccagccaaacagcgccaggcacagcgcgcccaacgcccagtgcggcatcaggctgaacagcgcaatggcgacaaacgatcccaccgtcgtcgccagcatcagcgcgcccggccgcaccgtctgggccagctggccgctggtcaacgcccccagcgccgcaccgagcggaatagcggcgtacagcaggccaatctgtccggccgacatctgccagctaccggccagcgccggatag

SEQ ID NO: 5649 - DNA, 909 bp, Klebsiella pneumoniae
caaaacctgacaggagaaaggatgcccggtccatccagaaaagcggcggcatggttgccgatactggtgattttagtcgccatgacctcgattcaaagcggcgcatcgcttgctaaatcgctgttcccggtggtcggcgccccgggcgtcaccgccctgcgtctggcgctgggaacgcttattctggtggtggtgttcaagccatggcggctacgtttctcccctgcgcagcgcgtgccgctgctactgtacggcctggcgctcggggcgatgaactatctcttttatttatccctgcagcgcattccgctcggcgtggcggtggccctggagtttaccggcccgctggcggtggcgctgtttggttcgcgccgcccgctggattttgtctgggtggcgctggcgatcctcggactatggtatcttctgccgctggggcagaacgtggcgcaggtcgatttaaccggcgcgctgttcgccctcggcgccggggcgtgctgggcggtctatattctgaccggacagcgtgccggtgaagagcatggtccagccacggtagcgatggggtcgctcatcgcctcgctggtgtttgtgccgttaggcatggcgcaggccaccgatacgctgtggcagtggtcgctgctgccgctgggtttggggatcgcgattctctctaccgcgctgccctactccctcgagatgatggccctgacgcgcttgccgacgcgcaccttcggcacgctgatgagccttgagccagcgttagctgccctctccggtatgatcttcctcggtgaaacgctgaagctctcccagaccctggcgctcggcgcgatcattatcgcctcgatgggcgccacgttgacgatgcaacggcagagtaaagtcgagcaggtcgatatcaattaa

SEQ ID NO: 5650 - DNA, 681 bp, Klebsiella pneumoniae
ccctgcctgacgggagagaagaaagtgcagcgagcgcgttgttatctgttaggtgaaacggcggtggtcctggagcttgagcctccggtgaccctggagagccaaaaacgtatctggggcctgacgcagcggttgaccgatcgcgaagaggtggttgaagtgatcccggggatgaacaacatcaccgttgtgctgcgtcgtccgcaggagatggcgtgggaggcgattgacaagctgcagcgctggtgggaagagagcgatgcgctggagccgcaatcccgtgagataagtatcccggttatctacggcggcgaggcgggaccagatcttggcgacgtcgcgcgccatagcggtttgagcgaaaagcaggtggtcgaactgcactcttcggtggagtatatggtgtggtttctgggtttccagccggggtttccgtattttggcggcctgccggagcatctggctatgccgcgtcgcgccgagccgcgcgtactggtaccggcgggatccgtctgtatcggcggatcgcaaaccggtatttatccactggcgaccccgggcggctggcagctgctggggcgcacgccgctggcattattcgatccaaaacgtgaagagccggtgctgctgcgttccggcgatcgcgtgcgctttgtgccgcagaaggagggggtatgttga

SEQ ID NO: 5651 - DNA, 816 bp, Klebsiella pneumoniae
ttaatcatgactcctgaacgccaggggtcgctgacaggtaaagttatgcaaaaaacggttttagtgacaggctgttccagcggaattggtctggaaagcgcgctggatttaacccgccagggctttcgcgtgctggcggcctgccgcaaagcagaggatgtcgcgcggatgcaggagctggggctaaccggtattttgctcgatctggatgacccgcagagcgtggagcgcgcggcagcggaggtgattgcgctgaccgataatcgtctctacggcctgttcaataacgccgggtatggcgtctatggcccgctgaacaccatcagccgccagcagatggaacagcaattttccgctaactttttcggcgcgcatcagctcaccatgctgctgctgccggcgatgacgccgcacggcgaagggcgcatcgtgatgacctcctcggtgatggggcttatcgccagtcccggccgcggagcctatgccgccagtaaatatgccctcgaggcatggtccgacgcgctgcgcatggagctgcgccacagcggtattcaggtcagcctgattgaaccgggcccgatccgcacccgctttaccgataacgtcaaccagacgcaaagcgataagcccgtagaaaatccgggcatcgccgcccgctttaccctcgggccggaggcggtggtggaaaaagtgcgccatgcttttaccagcgataaaccaaagctgcgctatccggtcaccctggtcacccacgcggtggcgctgcttaagcgcctgctgcctgcccgcgcgatggacaaaattatccacggctga

SEQ ID NO: 5652 - DNA, 1368 bp, Klebsiella pneumoniae
atctacgtgaccactcagggagtgagaccgtcactttccccctacaaacgtcttgtggagtgtgctatgagtcaaggcctcaacaatgatatcgccgtcagcaaaacgcgccgggtagtgaaaaacctgcgctggtgggtgctggtcctgtttttacttggcgttaccgtcaactacatcacacgcaactcgctgggaattatcgcgccggaactgaaagcgaccctcggcattactaccgaacaatactcgtggatcgtcggcgcgtttcagctggcttacacgattttccagccgctgtgcggctggcttatcgacgtcattggcctgaagcttggctttatgatctgcgccaccctgtgggcgctggcctgtatcgcccacgccggggccggtagctggctgcacctggctatgttgcgcttctttatgggtggggccgaggcggccgctactccggccaacgccaaaaccatcggcgaatggtttccgaaatctgaacgcccgattgccgccggctgggctggcgttgggttctccatcggcgcgatgctggccccgccgatcatctacttcgcccacgcctccttcggctggcaaggggcgtttatgtttaccggcgcgctggcgctactgtgggtagtactatggtgggccttctatcagaccccggaaaagcaccccaatctcagcaaaagcgagctggagtacatcaaacaggataacgaagccccgccggtaaaacagcccttctttaccgcgctcaaaaccgtctcgaaaaataaacgtttctacgggatcgccattcccgcctttatggccgagcccgcctgggcggtgctgagtttctgggtgccgctgtacctggcgaaagagcacggcatggatttgaagcagatcgccatgttcgcctggctgccgtttctcgccgccgatctcggcagcgtggtcagcggctacctcacccgcctgtatgttcgctggttcggctgtacgcgagtgaactcggtgatcgccagctcagtaaccggcgcgttcctgatgctctccctggccctcgtcgccatcacccgcgatccctatatcaccatcatcctgatctccattggcggcttcggccatcagatcatctcctgcatgctcagcgcgctggtggtggagtctttcgacaagggacaaatggcgacggtcaacggtatgcgcggctccgcagcgtggatcgccagcttcttgttctcgttattaatcggggtgaccgccgacaaaatcggcttcaacccgctattcatcgccatgggtttctttgacctgattggcgccgttttcctggtggcatttattgctgaacgtcgcgccaagcgcgcctga

SEQ ID NO: 5653 - DNA, 354 bp, Klebsiella pneumoniae
tttcacgtgacaggggcaaggagcgccccctatattgagcctttaaccgacgatcagaagggcttgtttatgcttcaaagcaatgaatactttgacggaaaagtgaaatccattggcttcaccagcagcagtaccggtcgcgccagcgttggcgtgatggcggaaggggaatacacctttggtacggcgcagccggaagagatgacggtagtcagcggggcgctgaatgtcctgctgccgggtgagactgagtggaaagtttacgctgccggcgaagttttcaatgtgccaggcaacagtgaatttcatctacaggtggctgagccaacctcttatctgtgccgctatctgtaa

SEQ ID NO: 5654 - DNA, 288 bp, Klebsiella pneumoniae
tcgtgcgtgacatacaccatagtggtcttcagctcctggtgcagacgggcaatatgcaggcgcatatcgacgcgcagctccgcatcaaggttagagagcggctcatcgaacataaacacccggggattacgcacgatagcccggccaatggccacgcgctgccgctggccgccagagagctgcttcggtttacgatccagcaggtgcgagagctgcagcgttttagccaccatttccacctggcgacggatctccgttttcggcactttattcaccttcagcccgtag

SEQ ID NO: 5655 - DNA, 243 bp, Klebsiella pneumoniae
cgctccacgaccgttacagacggtctgaaaggtattacttttgcgaggctactcacggccttcctccttccgtttcagctcttccaggatggcgcgcattttcatgccaaccaccgggttaaccgagcgaatgaagcgatcgcgggtaacatttttgtgtgtttgtgcctggtaaaatctgttgctcttaggcataattactcctgtgaatttgttcagttaattcgcgtagaaagccgttag

SEQ ID NO: 5656 - DNA, 396 bp, Klebsiella pneumoniae
caggaaacgaccgtgtttcaacttctttgcgccgtttttattggcggcggcaccggcagcgtattgcgctggtggctcggcatgaagctcaatcctgtgcaccatgctatcccgattgggactctaacggccaacctgttaggcgcctttgtgattggcgccgggctggcgtggtttaatcgtctgaccggtattgacccgatgtggaaactgctgattaccaccggtttctgcggcggcctgaccacgttctccaccttttctgcagaagtggtgtttctcctgcagcagggccgggtaagctgggcgctgctcaacgtcgcggtgaatttgctgggttcgtttgcgatgacggcggtcgccttctggcttttctcgcaggcgcccagccgctaa

SEQ ID NO: 5657 - DNA, 330 bp, Klebsiella pneumoniae
ttgatggcgacctggcggcgaataacggcggctggcagtgggcggcttcaacgggcaccgacgccgcgccctatttccgcatatttaaccccacccacccagggcgaaaagtttgataaacagggggtgtttatacgtctctggctgccggagctggcaaaggtgccggagaaggccctgcatcagccgtgggcgtgggcggataaacaagggatcacgctggactattcgcgcccgatagttgatcacaagcaggcgcggcaggagacgctggcggcatgggaggccgccagaaaaggaattactccaccgccagacggcgggtcttga

SEQ ID NO: 5658 - DNA, 726 bp, Klebsiella pneumoniae
ttcgtggcgacactttttattgcagatttgcacctgcaaacagaagaaccggcgatcaccgccggttttctgcgttttttacagggagaagcccgccaggcggacgctctgtatatccttggcgatctgtttgaggcatggatcggcgatgacgatcctaacccgctgcaccaacaaattgcctcggcaatcaaagccgtcgtcgacgctggcgtgccgtgctacttcatccatggcaaccgcgattttctcgtcggccagcgctttgcccgccagagcgggatgatcctgctcgccgaagaagagcgactggacctctatggccgtgaagtcttgatcatgcatggcgacacgctgtgcaccgatgaccaaggctatctggcgtttcgcgccaaagtccacaccccgtggatccagcgtctgttcctggccctgccgctgtttatccgccgtcgcatcgccgcccgcatgcgcgccgacagcaaagccgccaacagcagtaaatcaatggaaattatggatgtgaatccacaggcggtagttgacgcaatggagcggcatcacgtgcagtggctgatccacggccatacccatcgcccggcggtccatgaactgcaggccaacggccaacccgcatggcgtgtggtacttggcgcctggcacatcgaaggttcgatggtcaaggtgacgccggacgacgtcgaactaatccactttccgttctaa

SEQ ID NO: 5659 - DNA, 1104 bp, Klebsiella pneumoniae
gccgttcagacgtctatacttctggattccatcctgacacaatgtgatacaacaacgcaacagggatttaacgacatgcagacattacagaccaccagcctgcgggtgagtgaaaatcagctttttattctcgaccagcaggccttgccgcaggaaaaacgctggctggcggcggataacgttgcgctgctggtggaccatattcataccctgcgggtgcgcggcgcgccgctgattggcctgtccgccagcctgctgctggccctgctggcccagcgcggcctgaaccgggatgcactccagcaggcgctggagacgctgcgcgcggcgcggccgacggcggtcaacctgatgaataatctggatcgcatgaagcaggcgctggcccgggaggattacccgcaggcgctggaagcggaagccttgcgtctggtcgaagaagataaacagctgtgcgaccgcatcgctgaggcgggcagtgcgctggtgaagcccggcagtcgactgctgacccactgcaacaccggtggcctggcgaccgccggggtagggaccgccctcggcgttatcgcgctggcgcaccggcagggaaaagtgaccaacgtatgggttgatgaaacccggccgctgctgcagggcggtcgtttaaccgcctgggagctgggcgagctgggcgtgccctatcagctgatcgccgattcaatggccgccagcctgatggcgcaggggcaggtggatgcggtgtgggtcggcgccgaccgtatcgccgccaacggcgacgtggcgaataaaatcggcacctattctctggcggttttggcccattatcaccagatcccgttttacgtcgctgccccgcagaccaccctcgaccgccattgcccgaacggggcggcgatccccattgagcagcgcgcggcggcggaagtgaccggagtggcgggcagcttcggcgcggtacagtgggcgccgacgggggccaccgtttacaatccggcgttcgacgtcacgcctgctgggctgataagcggctgggtgctggacagcggggtggtcaccccggcgcaggtcgccgccggggcgtttgcgccggacaacggataa

SEQ ID NO: 5660 - DNA, 2367 bp, Klebsiella pneumoniae
gatatgaagacgctgaaacactggagtttgcatcaacagctgaagcatcacgttgaactgacggtcgatggccagcacaccctgtgcctgtacgtactggaagagaatttgttccgcgtcctgctaaaacgccagggccagctggcgctggatcgcacctggagcatcgctccacagcaggatgtgccgtgggaaggccgcgcccgggatgacctcagcggttttagtctcccggcctggcagctggcccaggagggcgatacgctgactatcgccacccgccagctgcgcgtcaccgttaaccagccgctgtggctggagtggagctatcgcgacgaggccggcgaatggcagccgcttgccaatgaccgtccgaccagcgcctacctggcgaatgcccacggcgacggcgtcgcccattatctgagccgccgcaaagatgagcgtttctacggcctgggcgaaaaggccggcgacctgcagcgcaccggtaaacgctatgagatgcgtaacctcgatgccatgggctacaacgccgtcagcactgacccgctgtataaacatattccgttcaccatcacccagcgcagcgatatcagctacggcctgttctatgacaacctgagcagctgctggctggatctggggaacgagatcgacaactaccacaccgcctatcgccgctggcaggcggaagccggcgacatcgattattacctgtttaccggtaagcaggtgctggatgtgaccaaagccttcgttcgcctgaccggtaaaacgctgtttggacccaaatggagcctcggctacagcggctccaccatgcactataccgacgcgccggatgcgcaaaatcagctgatgaactttatccgcctgtgcgagcagcacgcgatcccctgcgattcgttccagctctcttccggctatacctcaatcaacggcaagcgctacgtctttaactggaactacgacaaggtgccgcagcccaaagtgatgagccagtcgtttcacgatgccgggctgaagctggccgccaatatcaaaccgtgcctgctgcaggatcacccgcgttacggcgaggtggcggagcgcggtctcttcattcgcgattcgcaaactgacgctccggagcgttccagcttctgggatgatgaagggtcgcatctcgatttcaccaatccgcaaaccgtggcctggtggcaggaaggcgtgaccacccagctactggagatgggcatcgattcgacctggaacgataataacgaatacgaagtatgggacggcgaagcccgctgctacggctttggccgcgaaatcgccatcaaacatattcgcccggtgatgccgctgttgatgatgcgcgcctcgctggaagcccagcagcgctttgcgccgcaaaagcgcccatatctgatctcccgctccggctgcgccgggatgcagcgctacgtccagacctggagcggcgacaaccgcaccaactgggatacgctgcgctataacatccgcatgggcctggggatgagcctttccgggctgtttaatgtcggccacgacgtcggcggtttctccggcgataaacccgagccggaactgtttgtgcgctgggtacaaaatggcgtcatgcatccgcgctttactattcactcgtggaatgacgaccagacggtaaacgaagcatggatgtatccggccatcactccggcgatccgctcagccattgagctgcgctaccgcctgctgccctatctgtacactctgctatggcaggcgcatgctgatgatgagccgatgctccgcccgaccttcctcgatcaccagcacgatgcgcagaccttcgccgaatgcgatgacttcctgctgggccgcgacctgctggtggccagcgtggtcgagccgggcgcccgccagcgtgaagtatggctgccggataatcaggccggttggtacgatttctacagccatcagtggttcgccggcggccagtgggtgacgctggacgcgccgctggaaaaactaccgctgttggtccgcgccggcgctggtctgccgcttagtgaacgtatcagccatgtcgatgcgcaaaaagacgatcgtcgcgaactgcagctgttcccgctgaaaggtaccggctcaacccgcggtctgctgtttgaagacgacggcgaaagctggggctataaacagggggatgcgctatggctggagtgggaaatgacctgcagcgccagcagcataaacctggatatcaacgcccgcggcaactatcgcccggcgtggaaagcgctgaagctgtcattaccggtaggagaaaagcgtaagctgctggtgaatggcgttgaagggaccgagtggagactctga

SEQ ID NO: 5661 - DNA, 270 bp, Klebsiella pneumoniae
gactggaagaccatcgccacgccgcggcgggcgggcacgacatcattcatcacctcatcgccgatcagtacttctccttcgctgacctcttccagcccggcaatcatgcgcagtagcgtcgattttccacaaccggaagggccgacgaagacggcaaactcgccatcttcaatatcgagattgacctggtgcagcgtcaccgtgctgccgaaccttttggtgacattcctcagtcgtatattggacatccacattccccggagtgagtag

SEQ ID NO: 5662 - DNA, 576 bp, Klebsiella pneumoniae
ctcagcgagacggtgtcccgggaaactattaataatcagggcttctctcccgccccgttaacgcgcatccttttgccgtttcatattctcattagcgcaggaggcgcaacagaccgcctgcgccccattttttcttttatgattaaggatgatatccccatgaggctctccaccgcggttctcgccctcagctgtgccctggcaacgatcaccggctgcacctcgtcaaaatcgtcaccggaacgccatgcctacgccttcgtcgcccaccgctccgattttgtcggcggcaacttcaccgtcaaccgccaggaaaattaccgtttaaacctgccgacctttacggcgatgtatgcccgcggacagcaggataaagccgctggcatgagcgaaagtgatgcccgccgcaccgcggaagccatcaaacagcaggcggcgcagggcacccgcaccgagcacgccttcaccggcaatgccagcgacaaatgggataatgcgatggaaaataaagatgccgtcctgttcggcaacgagctctccggtgcctatctcgacggctatcttggggtgaaataa

SEQ ID NO: 5663 - DNA, 1392 bp, Klebsiella pneumoniae
ctggctgggactcggcgcctacgccgccggcgcggtggtggcctatctttcgccgtggatcgcgccgctggtggggatctccgtttccgcgctggtctatatcgccctggctctgctaagcaaacgccagcctgccgccgtcgcggagcaggagccatgagcctgacggtcagcgaactgctggcccttgagggactctccgccctgcgtctgcgggcgggaaagcaagggctgcagcgggccgtacgctggtactatgtggcggaaaatgaacatatcgccgagtggatcatgggcggcgagctggtgtttatcaccggcatcaaccatccccgggatgaagccaacctgatccagttgctgatggagggcaaacagcgcggcatcgccgggatggtgatcctcaccggcgaggcctatatccacgccattcccgccacgctgatcgcccttgccgacgagctgggcatgccgctgatcgagcagccctacctgctgaagatggtgattgtcaccgagcgcatcggcaccgcgctggtccgcagcgaaaacgtcctgcagtcgcagcgcgacattctgatgcagctggtcaccggcgactatccggacctgcagatgctccatcagcgcgccctccaccagcagctcgattttacccgtccgctgcggctggcggcgctgcgtctggaggggctgtcccgcctgtttcgccagttcccgcccgagcaggccgaagcctggctgctgcaggcccaccgcagcgtacgtcagcagctgcagcagcagctcaaccagcagggcaatcccttcccgctgctggagcgcagcaatatgtttcttttcctgctgccggatgaggagggggaaggctttcagcagaaaaaatggctacagcagtggctgcaaaccctggcggacggagaggagggtttgtcgctgctctgcggcctctccgcgccggtcaggcagctgcagggttacccgcgggcgctgtcgcaggcgcgccaggcgctggatctgtgcgataccctgcggccaacccagcgcatcagcgactatcagcagctggggtttatcaaactgctgtccgcggtcagcgacccggcgctgctcaacgattttatgcacgacaccctcggctgcctgatcgagccgggccgtaaagcgccgtggctgctgctggagaccctcgagacgctgctgcaggagaacggcaatgtggtgcgggccgccgaccggctgggtctccatcgcaacacgttgcatcagcgcatccagcgcattgaaaaactgaccggctacccggtcagccaccctcagtttcatctcaacgcctcggtcgcgctggtgatctggcgtttatcgcaaaaccatttacaggacccaccatga

SEQ ID NO: 5664 - DNA, 432 bp, Klebsiella pneumoniae
cctttttttgcattaccgggatgtaaagtgaatacaacgctgtttcgatggccggttcgggtctactacgaagataccgatgccggtggtgtggtttaccacgccagttacgtcgctttttatgaaagagcacgcacagagatgctgcgccaccatcactttagtcaacaggtgctgttggctgaacgcgttgccttcgtggttcgtaaaatgacgctggagtattttgcccccgccagactcgacgacatgctcgaagtccagacggaaattacctcgatgcgcggcacctctttggttttcacgcagcgaatcgtcaacgccgagaatacagtgttaaacgaagctgaggttctcattgtgtgcgttgatccactcttaatgaagccacgtgcgcttcccaagtctattgtcgcggagtttaagcagtga

SEQ ID NO: 5665 - DNA, 1539 bp, Klebsiella pneumoniae
atggtatttgcctctcttcttgaacgccagcgcgtacgtctgttgctggcgctgttgtttggagccagcggaacgctggctttttcaccttatgacttctggccagcggctatcgtttcgctgatcggtctgcaggcgttaaccctcaaccgacgcccgctgcaaagcgccgggatcggctatttctggggactcgggctgttcggcacgggtatcaactgggtctatgtcagcatcgctcagtttggcggaatgcccggcccggttaacgtcttcctcgtcgttctgctggcggcctatctctcgctctacaccggcctgtttgccggcctgctcgcccgtctgtggcctaaaactaactggatacggatggctatcgctgcccctgtcgtctggcaaatcaccgagttcctgcgcggctgggtgctgaccggctttccgtggctacagttcggctacagccagattgacggcccgctgaaaggcctcgcgccggtgatgggcgtcgaggcgattaacttcctgctgatggtagtcagcggcctgctggccctggccctcgtccagcgcaactggaagccgctggcgattgccgcgctgctgttcgccctgccgttcccgctgcgctatatccagtggtatcagctgctgccggcgcgcgcgacccaggtctcgctggtgcaaggcgatatcccacaggccatgaaatgggacgaaaagcagctggtcaataccctgaaaacctacctggcgctgacccagccgcatatcggccactcgcagctgattatctggcctgaatcggcgatcccggatctggagatcaaccagcagcagttcctcagcatgatggacgatctgctgcgcgcaaaagacagctcgctgatcaccggcattgtcgatgcgcgtctcaacaagcagaaccgttacgatacctacaacaccatcattactctcggcaaagataacccgtaccgctacgactcgaccaaccgctacaacaagaaccatctggtgccgttcggcgagtttgtaccgctggagtcgattctgcgtccgctggcgccgttctttgacctgccgatgtcctccttcagccgcggcccctacgtgcagccgcagctgatggcgcataacctgaagctgaccgcggccatctgctacgagataatcctcggggaacaggtgcgggataacttccggccggacaccgacttcctgctgaccatctccaacgacgcctggttcggcaagtccatcggcccgtggcaacacttccagatggcgcgaatgcgcgccctggagctggcccgcccgctgctgcgcagcaccaacaacggcattactgcggtgatcggcccgcgcggcgagatccagaagatgatcccgcagtttacccgcgaggtgttgaccaccaccgtgacccccgccagcggcttaaccccttacgcccgcaccggcaactggccgctatgggcgctgacggcgctgtttggtttcgccgcgctgctgatgagcctgcgccagcgtcgccgataa

SEQ ID NO: 5666 - DNA, 1776 bp, Klebsiella pneumoniae
catctgtttgccgatatggaccacctcaatcagcttggtggggttggaatccaggtcgaccatgttgcccgcttccttcgccgcctgggtaccggagttcatggctaccgccacgtcggcctgagccagcgcgggcgcgtcgttggtgccgtcgccggtcatcgccaccagccgaccttccgattgatactggcggatcagcgccagcttggcttccggcgtcgcttcggcgaggaaatcatcgacgccggcctcggcggcgatcgccgcggcggtcaggcggttatcgccggtgatcatcaccgttttaatgcccattttgcgcagctgggcgaaacgttctttgatgccgcctttgacgatatctttgagcgcaataatccccagcaccttttcgccttcggcgaccaccagcggcgtggccccctggcgagcgacctcttccacctgtttatcgacatcggcagggaagaggccgccgttggcctccacgtggcggcgaatggcgtccaccgaccctttgcggatcatgcgctgatcgatattgatgccgctcatcctcgtttgcgcggtaaaggggacaaaggtggcgtgcagcgactgcagatcgcgttcgcgcaggttaaagcgctgtttcgccagcaccacgatgctgcgcccctcaggggtttcatccgccagcgaggagagctgggcggcgtcggcgagggttcgctcttccacgccgcgagccggcaggaaggcggaggcctggcggttgccgagggtaatggtcccggttttatccagcagcaggacatcgacgtcgccagcggcttccaccgcgcggccgctggtggcgatcacgttggcgccgagcatacggctcatcccggcgacgccgatggccgacagcagcccgccgatggtggtcgggatcaggcacaccagcagggcgaccagtacggtaacgctgaccgcattgccgctccacgccgagaagggccagatgtggcggtggccagcaggaacactagcgtcagggcgatcagcaggatcgtcagggcgatctcgttcggcgttttacggcgctgggcgccttccaccatggcgatcatccggtcgaggaaggtttctcccgggttcacgctgcagcggatcaccagccagtcggagagaatgcgtgtcccgccggtcaccgaggcaaaatcgccaccggattcacggatcaccggggcagactcgccggtaatggcgctttcgtccaccgaggcgccgccttcgatgacttcgccatcgcaggggataatatccccggcttccaccagcaccacgtcgcctttgcgcagatcttccgccggcacgtggtcgaccggcgcgtcatgctgcggggcgcgcagtttgcgggcgaaggccgtttttttcacccctttcaggctgttggcctgggctttgctgcggccttccgccatcgcttcggcaaagttggcgaacagcacggtaaaccacagccagatactgacggcggcggtaaaggtggcgctaccggtcagggcgccgccagccatggcgatcgccagcagggtggttaacagactgcccacccagacgataaacatcaccggattgcgccattgcaccatcgggctgagttttttcacggcatccagcagcgcctggcgcaccagcgtcggctccagcagggctaattgtttgcgactcataacagggtgctccgcatcgctcaaagtaaggaaaagtgttcagccagcgggccaagcgccagcgcaggaataa

SEQ ID NO: 5667 - DNA, 246 bp, Klebsiella pneumoniae
gcccgaattgcccgccatgctggcaatatcgggcgtatctcacattttttatttatcagtcgtactaatgaatatctaacacacggatttttcaggcacggcgccgccgcccggcaatctttacattcaaccgcggcgtggagctgctacgcttctcgacggttgatttttactcaccaggggggcggatgctgtgtgtggaaagcctgtgttgaagcagtggttgtgaaaaggtacatgatatga

SEQ ID NO: 5668 - DNA, 714 bp, Klebsiella pneumoniae
tcaggaattgccatgaaacgcgccgtagttgtcttcagcggaggacaagattcaaccacctgtctggtgcaggctctgcaacagtatgatgaagtgcattgcgtcacttttgattatggccaacgccaccgcgcggaaatcgacgttgcgcgcgaactcgccctgaaactgggcgccgtcgcgcataaagtgctggacgtcactctgctcaacgaactggcagtcagcagcctgacccgcgataacattccggtaccggactatcagcctgatgccgagggcattcccaacacctttgtccccgggcgtaatattctgtttttaaccctgacggcaatctacgcctatcaggtaaaagccgaagccatcatcaccggcgtgtgcgagaccgacttctccggctacccggactgccgcgatgagtttgtcaaagcgctgcaccacgccgtcagcctggggatggcgaaagacattcgctttgagacgccgctgatgtggctgaataaagccgagacctgggcgctcgccgactactggggtcagctggatctggtgcgccgggaaaccctcacctgctacaacggcattaagggcgatggctgcggccagtgcgccgcctgtaacctgcgcgcaaacggactcaaccagtatctggcagacaaggtcggggtaatggcggtgatgcagcaaaaaaccggactggcgcaggcataa

SEQ ID NO: 5669 - DNA, 1689 bp, Klebsiella pneumoniae
atccctgttgcgccagccctaacgccagggcgccgccgaccatgccgccgcccacgatggcgacatctgttacgtgaattgtcatggctattatccttaaagcagaatccgttaagtttaccggatttttcgccctcttgcggcgataacgctcgcactggtcagggggcgaccaaagcattacaatacgcgccctggaatgcgaaattcaccctgtatatatccccgcgttttggatatctattactgagcatgagcaagtcaatgacaaaaaaactccatattaaaacctggggctgtcagatgaacgagtatgattcatcaaagatggccgatctgctggatgcgacacatgggtatcaactgaccgaggtggcggaagaagcagatgtgctgttgctcaatacctgctcaattcgtgagaaggcccaggaaaaagttttccatcagcttggccgctggaagctgctgaaagagaagaacccggacctgattattggcgtcggcggctgcgtggcttcccaggaaggcgaccatattcgccagcgcgcgcactatgtcgatattattttcgggccgcaaaccctgcaccgcctgccggagatgattaactccgtgcgcggcaaccgcagtccggtagttgatatcagcttcccggaaattgaaaaattcgatcgcctgccagagccgcgcgccgaagggccgaccgcctttgtctcgattatggaaggttgcaataaatactgcacctactgcgtggtgccgtatacccgcggagaagaagttagccgtccgtgcgacgatatcctgtttgaaatcgcccagctggcggcgcagggcgtgcgtgaggtcaatctgctggggcagaacgttaacgcctggcgcggtgagaattacgacggcaccaccggcagctttgccgacctgctgcgcctggtcgccgccatcgacggcatcgaccgcattcgcttcaccaccagccacccgatcgaatttaccgacgatatcatcgacgtttatcgcgatacgccggagctggtgagcttcctgcacctgccggtgcagagtggctccgaccgtgtgctgaacctgatgggacgcacccataccgcgctggagtataaagcgactattcgcaagctgcgtgaagcgcgcccggatattcagataagctccgactttatcgtcggcttccccggcgaaaccacggaagatttcgaaaagaccatgaagctcatcgccgacgtcaatttcgatatgagctacagctttatcttctccgctcgcccgggcaccccggcggccgatatggtcgacgacgtgccggaggcggacaaaaaacagcgtctgtatatcctgcaggaacgcattaaccagcaggcgatggcctggagccgtcgcatgctcggcacggtacagcgcatcctggtggaaggcacctcgcgtaagaacatcatggagctctccggacgtacggagaataaccgggtggtcaacttcgaaggtaccccggacctcgtcggtaagtttgtcgatgtcgaaatcgtcgatgtatataccaactcgctgcgcggtaaaatcgtgcgcaccgaagcggagatgggtctgcgtatcgctgaatcacccgaatcagtgattgcccgcacccgtaaagagaacgatcttggcgtgggaatttaccagccatga

SEQ ID NO: 5670 - DNA, 423 bp, Klebsiella pneumoniae
ctcgcatctgcgctatcagcctcacgccgggcggctcgccgagcgggacattatcgcccgccatttgacctgccagcactttgcgccggacgcggaaaatgtcctgatcgtcaacggcgcacagcacgggctggcggtgaccgtcatggggctgttacgtccgggggatgtggtggcggtggatgcgctgacctattcgggcttcaaggttctggcggcgctgtatcatctggagctggcggcgatcccctgtcgaccggagggaccggacctgcaggcgcttcagacgctgtgccagcagcggcgggtgcgggcggtgtataccatgccgacgctgcacaatccgctgggctgggtgctcaacaccgggcagcgacaggcgctggccgatctcgcgcgccagcacgatctgctgattattga

SEQ ID NO: 5671 - DNA, 552 bp, Klebsiella pneumoniae
ccgcttcctgctgggcttttttctccgcttcctgttgcgctttcttcgcagccgccgcttccgctttcttctgcgcctcggccgcagctttcgccgcttcagcttccgcctgtttcttcgcctcggcagcggctttcgctgcagcggcttcggcctgcttcttcgcgtcagcagccgccttggccgccgcctgttctgccgctttcgcctgggcatccgccttcgctttcgcctcggcggccgctttggcagcggcttcctgcgcttcttttgcctgtgcgtccgctttggcttttgccgccgcggcggccttggcagccgcttcttcagcctgcttctgctgctccttcgcttctttcgccgcttcctgcgcctgcagccgctcctgttcgagctgtttcagccgttcctgttccgccgcctgtttctcacgtaactcttccgcctgctgctgcgcctgtttttcacgctgttcagcggcgcgacgtgcgctggcctgctgctgttgctgacggttatagttatttaccaccgcccccggatcgaccatga

SEQ ID NO: 5672 - DNA, 1233 bp, Klebsiella pneumoniae
aataatcctgcgccccgcctgcgctcagcgttcgacgctgacccagcgctgctgctgatggcttttgacgatcgcctcgatgatgtacatcacatcggcgccgtcgtcgaaagcggcgaagcgccgggccccggccgccggcatcttcccggcgcgcaccgcctgataaaaatgccccatcatattcttaaaagcgtccggccagccctcaatatggccgccggggtaatgggcgctgtcagcgatttccggccgcagcaggctcgggtcatcgctgagcaggcgatccggctgctcgcggtggccgatccacagccgctggggcacttcctgatcccaggccagagaacagaggctgccgttaatctccaccgccagacggtttttccgcccggcgctcacctgagagaccataaagctgcccttgctgccatcgtcaaaacgcaacagcaccgagccaaagtcctcggtatcgacaggccgcgtttcatatgcctgcgcctcgtgaacggcgctgaaggtcgctttgccattgaccggcgctttacgcgttggccagacgatagacagatccgccatcacctcgacaatccgccgaccggtcataaactgcacggtatcgcaccagtgggagccgatgtcggccaccgtccgcgacgcgccgccctgcgccgaatcgacccgccagttgtagtcggtctccagcagcatccagtcctgcagatagctgccgtgggccgcgaagattctgccgacctcgccatggcggatcatcgccgccgcctgctggaccatagcgaactggcgatagacgaagctgacgccatgcaccacgccggcccgggcggcaagcgccaccagctcccgcgcctcctccgccgtcatacacagcggcttttccgagaagacgtgcagcccggcggcgaggatctgccggttaatctgggcatgcaaatggttcggcgtacagttatgcaccacctgcagccccggatgggccagcagcgcctccacgctgtcgtaggcatgggcaatgttcaacgcctgcgccttgcgctgcgccgcctcaaggcggctgtcgcacagcgccaccacctcgacatctcccagccgccgcagcgcctccagatgcgccgggccaataaaccctgccccgataatcgcgacctgaatcatgttattccctcccgccggcggcaaagtcatcgaaggcccgtcctgcaacgggaatga

SEQ ID NO: 5673 - DNA, 708 bp, Klebsiella pneumoniae
ggttcgcctgcctggcaatatgggaggcaaataatgtacgattttgactggagttcgatcgttccctccatgccctatctgctggcagggctggtgatcaccctgaagattacggtgatcgccatcgtggtcggcatcgtctggggcaccctgctggcggttatgcgcctgtccagctttctgccgctggcctggtttgctaaatcctacgtcaacgtatttcgctcaatcccactggtgatggtcctgctgtggttctacctgattgtcccgggcttcctgcagaacgtgctgggactgtcgccgaaaacggatattcgcctgatctcggcgatggtggcgttttcgatgttcgaagccgcctactattcagagattatccgcgccggcattcagagcatctcccgcggccagtccagcgccgcgctggcgttggggatgacccactggcagtcaatgcggctggtgatcctgccgcaggccttccgcgccatggtgccgctgctgctaacccaggggatcgtcctgttccaggatacctcgctggtgtatgtattgagtctcgccgacttcttccgtaccgcctccaccattggcgagcgtgacggaacccaggtcgaaatgatcctgttcgcgggcggcgtctattttgtgattagcctcagcgcctcgctgttggtcagctggttgaagaaaaggactgtgtaa

SEQ ID NO: 5674 - DNA, 228 bp, Klebsiella pneumoniae
cggcatactgcagcggcaggacatccgccggcgcctgacggctgcgcttttgccacagcgcgccaaaggtcatcagcagcagcgccgccagcgcaaacaggatccccaccgtcgccatcggtgaggccgccaggctgcgccacaccaatagcaccagccccgccagggcaagcagcagtcctgacagccgccgcccctgcaggcggcgctccaccacgcaaagcgtaa

SEQ ID NO: 5675 - DNA, 897 bp, Klebsiella pneumoniae
agaataactgcatttaataaatatcaagaggtgaatatgttagtgtcgatgaaggacatgcttcagcatgccctgcgggacggctacgccgtcggtcagttcaacattaataatctggaatgggtcggcgccgtattaagcaccgcccagcagtgccgctcaccggttattttgggggtgtccggcggcacggttaagcatatgctcgggttaaaatgtattcatgacatcgtggttaacgccatggagtatttgcatattgatgttccggtggcgctgcatctggatcacggcactacccaggaggcctgcgaagcggcgatcgccgccggcttcagttccattatgtttgatggctcgcatctgccgttcagggaaaacctggccattactcgccacctggtaacgctggcccacagcaaaggtatctctgtggaggccgaactggggaccatcgccggcagtgaagacggcattgtcaattccgaagtcatctacgccgatccgcaggagtgctacaccctggtgacagaaacccaggtggattgcctcgccgccgcgctgggctccacccatggtctgtataaaggtaaagcccggctgggatttaccgagatgaaagccattgccgagcaggtgaaggttccgctggtgctgcatggcggcaccggaattgccgatgaggatatgcgccgggcgattgcctgcggcaccgccaagattaacgttaataccgaaaatatgtacgcctggtgccaacaggtgaaagcaattttcgccgccgacaccgggcacgatgtgaacgatccgcggaaagtcatcgcccagggactgcagccggtacgcgagatgattgcccgccgcatggcgctctttggctcagagcagcgctattga

SEQ ID NO: 5676 - DNA, 483 bp, Klebsiella pneumoniae
tttatggctgcactaaaaccagaggtgaaagccgccatcgttcaaatgcttgcgtgctatgacaccctgtcgattgtggtcgaagtcatccaaaaagattacgggataaaagtcaccccgcagcaagtcgagtcgcacgatccgacgaaggtcagcggcaaaggactggcgaaaaaatgggtggacatgttcaacgctacccgtgaccgcttcctcaacgaaatctccgacatcccaatcgccaataaggcctaccgtttgcgcgtcctgcagcgaatgtcgacgactgccgagaacatgaagaacatcggcatgaccgcgcagctgctggagcaggcggcgaaagaggtcggcgaagcatataccaacaggcagaaagtggagcacaccggcgctaatggtggcccgatcgaatcgaccaccctgacgaaggatgaatacaagaaagctcgacaggagatgctggaggatgacgactgttga

SEQ ID NO: 5677 - DNA, 648 bp, Klebsiella pneumoniae
ttggcggctgcaccggcaacggtaaaactcagctggtctgctcgcgcccggacggtatcgacctggaagggcttgctcatcaccgcggttcttcattcggtcgaaccctgcaggatcagcatccgcaggccacctttgaaaaccacctggcggtcagcctgcttaaaaaagccgaacagcagacccgctgggtgctggaagcatgaaggccatatgatcggcgccaatcatctaccggagagcctgcgcctccgcatggcgcagtcgccgctggcggtggtggaagatccgtttgacgttcgcctcgaacggctgcgcgaagagtatttcgatcgcatgtatcgcgactttatcgccgcgtatggcgaagagaaaggctggcaggcatacggcgagtatctgcatcacggcctgtttgccatccgccgtcgcctggggctgcagcgttttgctcagctcactgaacggctcgatgaggcgctggtgcagcagcagcgcaccgccagcaccgaggcgcactttgcctggctggtaccgctgctggaagaatactacgacccgatgtatcgctatcagttggggaaaaaagccgggaaaattctctttcgcggcagctggcaggaggtcgccgcctggctggcgaagtaa

SEQ ID NO: 5678 - DNA, 747 bp, Klebsiella pneumoniae
tgtgaggctgctatggcgttttacagtatcggtgaagtcgccgaacgttgcggaatcaatccggtcacactgcgcgcctggcagcgtcgttacggtctactgaaaccgcagcgtagcgaaggcgggcatcgacaatttgatgaagaagatatcctgcgtatcgaagagatcaagcgctggatagagcgcggtgtatcagtagggaaagtcaaagcgctgctggaggataacctgccggcggcgcgcgacgaatccgcgcatcttcaggaagagatgatgtccattctgcgttatatgcagcccgccagaatccgcgccaaattaatggcgctcagtcatcaacaccccgtcgacaccctcatcgatagcctgttagtgccggtacgacagcgtctcaagctggatcagaatacctcgctggtgattagcagcatgctggacggcctgttaattgactgcgtagcgttgtttctcgccgaagcgcgtaaaaaaaatggcaaagagacgctgctggtgggctggagcaatgaggacaggacgcgtctgtggctggaggcatggcgtctttcccaacgcggctggcatgtcaacgttctcgccgaaccgctggagtcgccgcggcctgagctatttcccgggcagcatattttcgtctggaccggacgtgccgccacgcctctgcaggaggaactgctcagccactggcaggagcagggcttcagcatccattttcacggccaaaattaa

SEQ ID NO: 5679 - DNA, 243 bp, Klebsiella pneumoniae
agtcctcatgcaactggattgggacgtggtgatcgaatgtctggcggagcatggctacgtcattactcaccgggagaaagcagcatgagcgcggcggaaaaatggaatgacgacgaattcattcagctgatgagcgatgcgatcggcgaacgtgatgccgacgatgacgaacctgtaaccctttctgcggaacggcagaacccggtgatcagctgggatgaattcgcgggagattttcaatga

SEQ ID NO: 5680 - DNA, 1167 bp, Klebsiella pneumoniae
caaactcatgcgcaatgtcggatgctggcccgcagagcatttgctatagtaaggcacttttttaactccatcacggatgccgttgttctgaccatgaagacctctttcaccgctcgtttactcattacggcgctctccgttgcagcgctctcctccgctgcccgcgccgatgacctgaatatcaaaacgatgatcccaggcgccccgcagattgacgccgaatcctggatccttatcgattacaactctggcaaggtactggctgaaaacaatgccgactcccgccgcgacccggccagtctgaccaaaatgatgaccagctatgttatcggtcaggcgatgaaagcgggcaaattcaaagagtccgatctggtcaccgtcggcaacgatgcctgggccaccggcaacccggttttcaaaggctcttctctgatgttcctcaagccgggcatgcaagtgccggtttctcagctgatccgtggtattaacctgcagtccggtaacgatgcctgcgtggcgatggccgactacgtcgccggcagccaggacgccttcgtcagcctgatgaacaactacgtcaatgctctgggcctgaaaaacacccatttccagaccgttcacggtcttgatgctgacggacagtacagctccgcgcgcgacatggcgctgattggccaggcgctgatccgcgacgtaccgaacgagtactccatctatcgtgagaaagagttcaccttcaacggcatccgccagctgaaccgtaacggcctgctgtgggataacagcctgaacgtcgacggcatcaaaaccggccataccgacaaagcgggttacaacctcgtcgcctccgccaccgaaggccagatgcgcctgatctccgcggtaatgggcggccggacgttcaaaggccgtgagtcggaaagcaaaaaactgcttacctggggcttccgcttcttcgaaaccgtcaacccgattaaagctggcaaagagtttgcctccgaaccggcctggttcggcgacagcgatcgcgcttcgctgggggtggataaagacgtctacctgaccattccgcgcggccgaatgaaagatctgaaagccagctacgtgctgaataacactgagctgcacgccccgctgcagaaaaaaccaggttgtcggcaccattaa

SEQ ID NO: 5681 - DNA, 1284 bp, Klebsiella pneumoniae
atgtctgatgctaaagcaaaaatcaccctgggtggtgacactgctattgaactggatgtgctaaaaggcacgctcggtcaggatgttattgatattcgtagtcttggttcaaaaggcgtatttacctttgacccaggtttcacatcaacggcttcttgtgaatctaaaattacgtttatcgatggtgacgaggggatcctgctgcaccgcggcttcccgatcgaccagttagcgaccgaatctaattatcttgaagtctgttatatcctgctgtacggcgaaaagccgacccaggccgaatatgacgaattcaaaactaccgtcacccgccacaccatgattcatgagcagatcacccgtctgttccacgcgttccgtcgcgattcccacccgatggcggtgatgtgcgggatcaccggcgcgctggcggcgttctatcatgattccctcgacgtgaataacccgcgtcaccgcgagattgccgcctaccgtctgctgtccaaaatgccaaccatggcagccatgtgttacaaatattctatcggccagccgtttgtttatccgcgcaacgacctctcctacgccggcaacttcctgcgcatgatgtttgcgacaccgtgcgaagagtatgaagtcaatccggtgctggagcgcgcgatggatcgtattctgatcctgcacgccgatcacgagcagaacgcgtcaacctccacggtacgtaccgcgggctcctccggcgctaacccgttcgcctgtatcgctgcgggcatcgcctccctgtggggaccggcacacggtggcgccaacgaagcggcgctgaaaatgctggaagagatcagctccgttgagcacattccggaatttgttcgtcgtgcgaaagacaagaatgactctttccgcctgatgggcttcggccatcgtgtttacaaaaactacgatccgcgcgccaccgtgatgcgtgaaacctgccatgaagtgctgaaagagctgggcaccaaagacgacctgctgcaggtggccatggagctggagcatatcgcgctgaacgacccgtacttcatcgagaagaaactgtatccgaatgtcgacttctactccggtattatcctgaaagcgatgggtattccgtcctccatgtttaccgttatcttcgccatggcgcgtaccgtgggctggattgcgcactggaacgaaatgcacagcgatggtatgaagatcgcccgtccgcgtcagctgtataccggctacgccaaacgcgatttccagtccgacattaagcgttaa

SEQ ID NO: 5682 - DNA, 1218 bp, Klebsiella pneumoniae
acgcctgatgcaagcccaggacgccagccgtccgcaagtcgacatcagcctcgccgtgggtaccctctttggtctgatccctttcctgatcggctgcacgttcatcggggtactggcgcttatcgtgcgctggcgtcagcgccgttaacgccgcgccatacagtttgcccgccgctcatcaacccgtttcgcaaaccacgccgtcgtcagatttcgggtgatttttggactctccagctggatccctggcaacatctcccgcggcagggttttgcccgcctttttctcggcgagacggaaaacctgctgatagagatcggtcttctcaaacgccaggctgtcgccctttttcaactgacgatggatctcgctgtcgctcatccccagctggctcgccaggcgacgcaccgccagctcggtgctgcccggctcctcgctgtcgtagcggataaggtcgccgtcgagcgccagttttaccccgctggctttcaccaccgcgttctggaaggcggcgttacggctggcgtaccagccggcgttgaagtcggcaaagcggtacaatggcgcactataactggccggatagttcagcagatgataggtgccaaaccacaggccaccgcgcagactgaagacctcctggcgcaccgtgccgttcattttccacgggtagccggaggtgtgctgctcggcaaaagcaatgctgacctgcatcggccccccggtgtgcaccgggttaagggaaccgaacagcttctgccccatcggcaccatcccgataaagtcatcaaaaatggcgctcaactgcttttccgtcttcacattgtccagacggtcgctatagcttttaccgtttggcgaggtgatcttcagcgcggtatggaccagaaacggcggaatgtgcattttttccgcccggcggtcaatttcctgccaggcgattttattcagccccggcaccaccggatcggactgatagttagactcttgctgcgcgaccgccagcaccgagcagacgttttcttccgtcggcgccagcttctggctgtcaaacgcggtggcgatggcttgcgcccaggcctcccgatccttgacgctggccggcattttctgccgcaccaccgacgccacgtcaacaggcttctcgccctctttcagcgccggagcctgctggctggtacaggcgctcagcgccatggccgccagcagcgtcaatga

SEQ ID NO: 5683 - DNA, 198 bp, Klebsiella pneumoniae
cgtgatgatgctgtcggcattagaagctgcaggccccatcagcgacgttaccggacctgcccccatccggttaacttcaccaaacatgaaatcaccaaagataccgagtccaccaccctgcgccgccgccgcaaggaatgttttagcatctgcaggtcgcggggtttgccccttcaacatcaacttggcctgcagtga

SEQ ID NO: 5684 - DNA, 747 bp, Klebsiella pneumoniae
gcccttcgtgccggggatttgatctatccccttccccggcacaccttgaggcgcgtacaatcccccccttgctgtaaagctcatttctgttttgacttcagaggataccccatgaccaatgggacggattatcgcgccattctcgccagcgatacgccactgattgacgtacgcgccccggtggagtttagccaaagcgcgatgccggcggcgatcaacctgccgctgatgaatgatgaagaacgcgccgcggtcggcacctgctacaagcgtcaggggccggaagcggcgctggcgctcggccataaactggtccagggtgacctgcgcgccagccgtactcaggcgtggctggaagcgtgcgcccgttacccacacggttacctgtgctgcgcccgcggcggccagcgctcgcatatcgtccagcagtggctgaaagaagctggcgtggattaccccctgatcgtcggcggctataaagcgctacgccaggcggcgatccaggccaccgacgaactggtgcagcggccgatcgtgctgattggcggctgcaccggcaacggtaaaactcagctggtctgctcgcgcccggacggtatcgacctggaagggcttgctcatcaccgcggttcttcattcggtcgaaccctgcaggatcagcatccgcaggccacctttgaaaaccacctggcggtcagcctgcttaaaaaagccgaacagcagacccgctgggtgctggaagcatga

SEQ ID NO: 5685 - DNA, 2244 bp, Klebsiella pneumoniae
gggggtagtgcgccttttacagggcgacaagacatggcagaagttccactcccaacgccgacgcaggttccggtaccgagtaccgatattcgtaatgcggtatttgcaggcgcgaagcttgacgaagaagttactggcctcggtgatttctatactgaccgtcttggtgcaaagcatctgacaaacaccgggagaaataaccagtttcaggatgcgcagaatcaaagggattctgatttcgttgcgtcacaagcggataaagaagcgcgttttcagcaattcctcttaaactctggctatcagtttttaggggattatgaaaacggaccgtatacaattaccgccagaaaccagattattcgttatcagaatgaattctggcgtttaaatgctgcaactaatccaccatatacaaccacaggtattaacagtacatcatgggctactgatattacgcatctggtaagtgttggtgatgctaatttaaggcaggaattatctttctcttatggactgaaattaattggacaatgcgaaagcatagccgcgttgcgcgctattacacttgaatatgtcggacagcaagtgtttgttaaagagcatacctctggaatggggcaaggcgggggtatattttattgtcattctttgacaaacccaggctcacttgttgatgataacggtttccaaatagttacggcatctgggcaagtcttacgtagaaaagaccgcaacataatgtctgccgagatgtttggtgctatcggcggacaggatataactcccgtattgaataatatgttgctggcgtctaaaacgttcaacatacaagaggcctatatcccgcaccctcttaataaaacagattatactgccacaggtggtagcgttgccgatgtcaccgatgggataggtttcaatttaataggcatcaaaacggtaaataaagggccagcgataaaccatatctctaataatatatttttcagattcaggaagaatgggccagcatcgtctagtttttatgagcaatgtagcatcacaggacttctcatccgtggtcgtaattctacaaacacagcagcaggtaacgacggttatgctatagaggcctcagatataattggtttttattgcgacgtattctgtactgggtatacaaacacctttgccgcagcagtatcattgtataatgatactagttttacagagcaatcacgtattaagttgcacatccgaaattgctgcaatggcgttcatttccaccggaacgcatcacctggcgcgacaagcacaaattctttcatgggaactgacgttgacttggctttccaggccgccgtttctggtaaaacgaataacggtattgttgtaggtaatttagatggtacttcaacatcaaatacatttgatgttaacctgtatgcttctaaaattaaaatgaaatattgggctgaaggaggctcggccacacgggctattttagttaccgctaaaggtatagtgccggaatcaacaacatttgatctgatttcagacggttatggatctggcacgtcagacacggatacaattacagatccgtctacacaactaatacgtgttgagaatggtgggatattccgagataaatgcactgatcagtcaatgcagacaggcctgagtcaccgacttaaccagctacagcgtctcaggaacactattttttcattccaggacgatacgtataaagtcccatataatgacgcacgtccttacatcaaccctgtggggatgtcttgtatttgctctggcactattgatgtggctactcagcaagccggtgcgtcatggcagatatctggcctgcctatgggcatgcggatcaaggttacgataaatcaatacctggagggagaatcagctactagcgttcaagaggtgtgggaagtgttggtgcgcggggacgcgcagtcagtaatttgcaccccgttggttacaaatgacgtattaactacgaccactggcctagcggtggttaactcatcattcgcaaccgcaacattccttaaatcagtggcagcagtctttggcaagttttggcagggagactcaaccagaacgcgcctgactgttagaaataacaatgatgataactcattaacaacagggtcatcagacggccgcaagtttaggatattccttccagtaaatgcctccgcgactagtgttctacattattcagttaaattggaggtggtataa

SEQ ID NO: 5686 - DNA, 1140 bp, Klebsiella pneumoniae
agggttggtgctggctggcgcgctggcactgacctattttcagcgccgtacttaacattttacagggtaaaccgcatgaaaaagatcgcactctctctgatgacgctgggtctgttgcagtcgacggcggcgctggccaccgccccgacgccggtgccggcggcgattgccgaacacaacggcccgatccgcattgccgtgatccgcaacctcgggtctgacgataacaccacccagtttgtcgccggggcgctgcaggaaggcaaaaagctcggtttcaaaatcagcaccttcctgagcaacggcgatgacgccaaattccaggacttcgtcaaccaggccatcagccagaaatacgatggcattattctctctcaggggcgtgacccgtattccaccgccctggtgaagaaggcggtggacgccgggatcaaagtggcggtgttcgataccgcggtaagcggtgagatccccggggtgacggtcagccagcaggatgacgcctcactgaccgagctctcctttggccagctggtgaaagacttcaacggtaaggccaacatcgtcaagctgtgggtggcgggcttcccgccaatggagcgccgtcaggcggcttaccagacgctgctgaagcaaaacccggggattaaagagctggagtcgatcggcgccgtgtcatccgatgtgcagggcgacactgccaacaaggtgggggcgatcctcgccaagtatccgaaagggaaaattgacgcgatctggggcacctgggatgcctttagccagggggcttataaggcgctgaaagagaacggccgcaccgagatcaaactctacagcattgatatttccaaccaggatctgcagctgatgcgcgaggccggcagcccgtggaaggtgagcgtggcggtggatccgaagcttatcggcgcgaccaacgtgcggctgatcgccaataagatcgccggcgagccgacgccagccacctacgacttcaaggcggcagcgattccccaggcgctgctggcggcccagccgggagcggtaaacgtggcgtcgctggggaaaattatccctggctggggccagaccgaagactttatcgcgccgtggttcgcgacgctggaagcgaaaaacaaataa

SEQ ID NO: 5687 - DNA, 273 bp, Klebsiella pneumoniae
ggaactggtgctatgaagaatctcattgctgagttactggttaaactggcgcaaaaggaagaagaagcaaaggaactgacggtgcaggttgaagcgctggagatcgtggtcaccgcattattgcgccatatggagcatgatgcccagcaggcattgattcaggatattgaacaggcgattgaccaggtgaccccctgtccgccggtcaacgaccatgatgcgatgctgctgcagcaatatctaaagaagctgttgcggcatcctcgtagctag

SEQ ID NO: 5688 - DNA, 993 bp, Klebsiella pneumoniae
agagccggtgctgctgcgttccggcgatcgcgtgcgctttgtgccgcagaaggagggggtatgttgaaatttatccgcgccggcatgtatacctcggtacaggatggcggccgggaaggccagcgccagtgggggattagccgctgcggcgcgctggataaaccggcgatgaccattgccaatctgctggtgggcaatgcgccggaggcggcggcgctggaaattacgctgggtcagatcgatgtgcagtttacccgccactgctggttcgcgttgaccggcgccgcctgtgaagcgacgctcgacggcgcgccggtctggttgggctggcgaatggaggcgaaggccgggcagcggctggtgctgaaaaatcctcagcatgggatccgcagctatctggcggtcgcgggcggtattgatgtccctgaagttttaggttcccgctctaccgatctgaaagtcggtatcggcggaatcgaagggcgccggttgcaggatggcgatcaagtgaagattgggaaatcgtcccgccgctttagcgcctcgcgcggcgttaaacagctgccgataggcaatattattcgcgcgctgccggggccggagtatcacgaattcgacagcgtgtcgcaggagtctttctggcgctcgccgtggaagctgagtccgcaaagcaaccgtatgggctaccgcctgcaggggcagccgctcaagcgcacaaccgaccgggaaatgctctctcatggcctgctgcccggcgtggtacaggtaccgcataacggccagccgattgtgttgatgaacgatgcgcaaaccaccggcggctatccgcgtatagcctgcattattgaagccgatatgtaccaactggcgcaaattccgctaggtcagccgatccatttcaccccctgttcgctggaggaagcgctaaaagcgcgcgccgaccagcagcgctaccttgaacaactggcctggagattaagcgatgaaaattga

SEQ ID NO: 5689 - DNA, 1392 bp, Klebsiella pneumoniae
cgaggcggtgcgcgccgggctgtttaccatcccaggcgacggctgcatcgactatgcgccgatcctcgactttgtccgggacagcgactaccgcggctggctgattatcgaagccgagcaggacccggcgatggcgccgccgctggccaccgccagccgcgcctatgcctggctggcgcaccatttatcttccccttcatcgtcagaggagtacgcatcatgagcgcgcggttaaatattggccttatcggctcaggttttatggggcaggcacacgctgacgcttaccgtcgcgcggcgatgttctatcccgatctgcccaagcgcccgcatctctacgcgctggcggatcaggatcaggcgatggccgaacgccatgcggcgaaactgggggcggaaaaggcctacggcgactggcgcgagctggtaaacgatccgcaggttgatgtggtggatatcacctcgccgaaccatctgcactacacaatggcgatggcggcgatcgcggcgggtaaacatgtctattgcgagaagccgctggcggtcaatgagcagcaggcgcaggagatggcgcaggcggcacggcgcgcgggggtgaagaccatggtggcctttaacaacatcaaaacgccggcggcgctgctggcaaagcagattatcgcccggggcgatattggcgaaccggtgcgctttcgcggcacctttgatcaggggttttataacgacccgaacctgccctggtcctggcgctgctcgaaaactctcggcggcagcggggcgcttggcgacctcggcgcccataccctgtcggtcgcccagtttttgcttggcgggatccgcgaagtgaccgccagcgcgcaaacctgcctgcgccagcgtccggtgccgcaaaccgatgccgggtatgccagccgggtcgcggccgatgccgagtggcgggaagtggaaaatgacgatcaggttcagtgcctggtcaatttcgacagcggcgcggcgggagtgattgaggcctcgcgcatcgccgccgggcggatcttcggcgtgttctgggaggtttccggcaccgaaggcacgctgtatatggacggggagcgctttaacgaactgcaggtatatcgcttcaacgatgataaacacgaccgcggctttaagacgctgtatgccgggagccagatcccggcctatgccggcttcttcggcttcgattttggcggcggtgggctgggctattttgacgtcaaggtgatcgaagtgcatgacctggtgcaggggatttgcggggacgacgactgctatcccaactttgaatttggtttgcagaatcagcgcgtgctgtcggcgattgaagcctcgatggtcagccgtcgctgggtgaacgtggttaaagactaa

SEQ ID NO: 5690 - DNA, 921 bp, Klebsiella pneumoniae
gttctcttcgctgtagttcagctggctgcgatagtggccggacatcaggaagtagcgaatcgtctccgcatcgtaatacttcagcacgtcgcggacggtaaagaaattacccagcgatttcgacatcttctcgcggtcaaccatcaccatgccggagtgcatccagtagttgacgtattcgccgtcgtgggcgcaggtggactgggcgatttcgttttcatggtgagggaacatcagatccgaaccgccgccgtgaatatcgaagtggttgccaagctgcttgcagttcatcgccgagcactcgatatgccagcccggacggcccgcgccccacggcgacggccagctcggctcgccctctttcgacattttccacaggacgaagtccatcgggttacgcttgacgtcaaccacgtcgacgcgcgcccccgcctgcagttgatcgagatcctgacgcgacagcaaaccgtagttcgggtccgtcggcacgtcgaacatcacgtcaccgttatctgccacgtaagcatggcctttggcgatcagctgctcggtgatctcaatgatctccgcaatatggtgcgttgcgcgcggctcgctgtcgggacgcagaatattcagcgcgtcaaaatctttgtgcatttcggcaatcatgcgatcgaccagcgcgacaaagctttcgccgttttcattagcgcgcttaatgattttgtcgtcgatatcggtgatattgcgcacgtacttcagcttatagccaagaaaacgcagatagcgcgccacgacgtcaaaggagacgaaggtacgtccatgaccgatatgacagagatcgtaaacggtaataccacacacgtacatgccgacttccccggcatggataggtttaaattcctctttctggcgcgtcagtgtattaaaaatttttaa

SEQ ID NO: 5691 - DNA, 1359 bp, Klebsiella pneumoniae
ccggcaatcgcgatgcgcgggatctcttttttcagcaggcgctcgatatcgcgcagcagcttatgctcatccacgcacaccagcgataaggcttcgccggtggccgccgcgcgaccggtatcggccgatgcggtggacgtaatcttccggtacgttcggcagctcgtagttcaccacgtgcggcagctcttcgatatccagaccgcgggcggcgatatcggtcgccaccagcacgcgaatgccgccggatttaaagtcggccagcgcgcgggtacgcgctccctggctcttgttgccatggatcgccgcgctgcggatgccgtctttgttgagctgttccgcgaggtggttggcgccatgcttggtacgggtaaacaccagcacctgctgccagttgccttcgccgataagctgcgacagcagttcacgcttgcggttcttgtcaacaaaatggacgtgctgggtgatctgctcggacgcggtgttacgacgcgccacttccacttccagcgggttgtgcagcagtttctcggccaggcccttgatctcgtcggagaaggtcgccgagaacagcagattctgtcgacgcgccggcagtttagccagtacgcgacggatgtcatggataaagcccatatccagcatacggtccgcttcgtccagcacgaggatttcaactttatcaagactgacggcgttctgatgttcaagatccagcagacggcccggggtggcgacgaggatgtcgacgccgccgcgcagcttcatcatctgcgggttgatactcacgccgccgaagaccaccagcgagcgaatattcaggtatttactgtaatcgcggacgttctcgcccacctgcgccgccagctcacgggtcggggtcaggatcagcgcgcgcaccggacgacggccctttgcgtgcggctcattctggatcaggcgctgcagcagcggcagggtaaagcccgccgttttaccggtgccggtctgggcgctggccatcaggtcacggccctgcagtaccgccgggatcgcctgctgctggataggggtcggctcaacgtagccctgctcagcgacagcgcgcaggatatcgggattcaggccaagggaatcaaaagacataacaactccgaaccgccccggcccggtaaagggcgtagttttcagggagattattgcgataagagatggcaaaaaccacaatgccatgaaggggcgcagtctagcagattttgtgacaggccgcataaaatctgcaaaagaatgccgcgcctggctggcgggcatgagaaggccgctgagcgcgctcagcggccagtgggtcatagcagcgcggttaacgcagacgatacttaa

SEQ ID NO: 5692 - DNA, 294 bp, Klebsiella pneumoniae
gggtgcgtcgcgctcggcagcgcccgcgccggcatctcgtcgacctgtctcccctggtacatcaccagcacgcgatcgcaatgcgcggctaccagcggtagatcgtggctgatcagtaacatggccatctgccgctgcgcgctctgctccaccagcagctcgaggatctggttgcgcaggcgggcgtcgagggccgaggtcggctcgtcggctatcagcaccttcgggttattgagcagcgcgagggcgatcatcacccgctgtcccatcccgccggagagttcgccgggatag

SEQ ID NO: 5693 - DNA, 459 bp, Klebsiella pneumoniae
tccggatccgcggggtgcggcatgaaacaggtatgcgtgctcggtaacggccagttaggccgtatgctgcgccaggccggcgagccgctgggcatcgccgtctggccggtggggctggaagccgacccggaagcggtgccgttccagcagagcgtcatcacggcagaaattgaacgctggccggaaaccgccctcacccgcgagctggcccgccacccggcgttcgtcaaccgcgatgtcttcccgattatcgccgaccgcctgacgcaaaagcagctgtttgacaagcttggcctcgccaccgccccgtggcagctgctggcggataaaagcgagtggccggcggtgtttgcccgccttggcgaactggcgatcgttaagcgtcgcgttggcggttacgacggccgcggccagtggcgtctgccgggaaaacgagatcgatcagctaccggccgataa

SEQ ID NO: 5694 - DNA, 303 bp, Klebsiella pneumoniae
cgccatcccgccgatgagaaaatttttatatttaataaaaacaggggcatgttgaaacgggatgcatttgatggtgccgataataggagtcgaacctacgaccttcgcattacgaatgcgctgctctaccaactgagctatatcggccctgcaagaggtgttcacgagcgtgaatcacgaggcaaaaggttagaacttagcgggcgatgcgtcaatagccagtggaatcaactgcctatttttgcatcgcccgttctcatttacgcacgaatggtatcgtcgccgaaaccaatccacttatag

SEQ ID NO: 5695 - DNA, 519 bp, Klebsiella pneumoniae
accaaacccgctccggcgggtttttcaatgcccggaggaaacgtggcaacagttcaataccctccgttcctgccactgccccagcgtgccgatcagaacatgacgcaggatacagcctggcagacgacgcagacggcagtcggcccattgataatcacgccgatcaccacagaccttaaggcgacatggacgctgcagtggatattcacgcttgcccaggccgagcggtttaagtcatggctgcgatcgccgacatattgcgaccgcgggcgcaactggttccagatgccgatcgaccttggtgatacgcagggcgtgcagcagcagacgctgcatttcgtcgacatgccggtgcagaccagcaaaaacggcaacattgtcacctggagcgcaacggtcatcagcaacggtatcgaggacattaccgaggactatgacgactggatcgtagaggcccagcctggctatggatactggctggattacctgatcaccgaagtgatgccgagggccgactga

SEQ ID NO: 5696 - DNA, 201 bp, Klebsiella pneumoniae
ttttcgcccgctgtccatcagaacggcttaactatccatctggtgattatatccaggcgtgacgggggacgtgtagttcttatcgctttattgatttgcatcagcgagttttgtccgttttttcggcacattcgcacattaaaatttggtgtggtgctttttagctacatattctttgggtttaggggtaataaatgctga

SEQ ID NO: 5697 - DNA, 585 bp, Klebsiella pneumoniae
cttgtcgccgctgagtctcaacttaacaaggaagacctgatgcccttacccgaacgttttaagccagccaagataaatcgccagaaacttaaagaactaacggacgcagccgaagaaatgctgtcgcaaattgatagtggtgctgacgaagatgatgaagagctaaaagcgatgattgatgactggaacaggcaggtagttaatccgtatgaattctctgatttccgtgacttttcctcatggaccgacgcaaagaactttacccggatggcatttaatcaggagaaatacgttgcggatttaacctgggatgaactcgttcagataattagtttcgtgtgcaatgctgaaggcaaggaatcggaacaaagctacgcgctgggattgctggagataaactttgatgccaatccgtccgatctcatctactggcctaatgaatggttccagaatgaagacatgctccatgtagatttgacgcctgaagaaatagccggatacctgatggcaagatctggccggcttctaagcgatgcgccacaaatcgacctgagatacccgctacctcccagcgcagcaagttaa

SEQ ID NO: 5698 - DNA, 2595 bp, Klebsiella pneumoniae
ttgcccgccgcatggcgctctttggctcagagcagcgctattgacgccgggcctgcggctgaaaccaccgccccgacgctgccggggcggtggtttctggtatcaaaaagcaaagcaggaacagcccagcacgccccagaaggcctgctcgtcagagaccggaatcgacgacttacgcgcaatatcatgctgatggccgtggacgccacagctaccgcagcactggtgcatctgcaccatggcgccgattttagccgtcgccggcggagcggaacggtaatggcccgggaccttcaccaccggcgaccactccggcagcaccgggatcggcggcggcgccagcggcgagaagtgaccggcggcgtacaccactttgccgtcaaccaccgtcagcaccgactcaatgcctttgatctcctcttccgcgacgctgaagtagtctttcgacagcaccaccagatcggcaagctgaccggcggccagacggcctttcttgccctgctcgctggagaaccaggcgctgcccgccgtccacagctccagcgcgacatcgcgcggcaggcggttggcgtcgtcatacatcgccatcccgccaacggtgcgcccggagaccagccagtacagcgcggtccacgggttatagctggcgacgcgggtcgcatcggtgcccagccccaccggcacgtccagcgccagcatctttgctaccggcggggtatgtttcaccgcctctttgccgtagcgatcgacaaaatattcgccctggaaggccatccgatgctgcaccgcaataccgccccccagcgccttcacccgctcaatgttacgctcggtaatggtctcggcatgatcgaagaaccagtgcaggccattaaacgggatatcgcggttcaccttctcaaacacgtccagcatccggctgatggactcatcgtaggtggcatgcaggcggaacggccagcgatgctccaccagatggcgtaccacccgctccagctcatcctccatgccttgcggcagatccggccgcggctgcaggaaatcttcaaaatccgccgccgaaaataccagcatctcgccggcgccgttggcgcgatagaagtcagtcccctgccccggcttcagcatgtcggtccagcgttcaaaatcctccagctcctgcttcggccgctgagtaaacaggttgtaggcgatgcgcacggtcatctgatctttcgcgtgcagctgttcgataatttcgtaatcttccggatagttctggaagccgccgccggcgtcgatggcgctggtcagccccagtcggttcagctcgcgcataaattgacgggtggagttcacctgcagatccagcggcagcttcggccccttggccagcgtagcgtaaaggatcatggcgttcggtttggcgatcagcatcccggtcgggttgccgtggctatcgcggacgatctcgccgcccgccggatccggcgtctctttgctatatcccacggctttcagcgccgcacggttcaacagcgcgcgatcgtagagatggagcacaaacaccggcgtatcaggcgccgcctcgttcagctcttccagggtcggcatccgccgctcggcgaactgaaattcgctccagccgccgaccacccgcacccactgcggggacggcgtgcgatccgcctgatccttcagcattcgcagggcatccgccagcgaggggacgccctcccagcggagctcaaggttgtagttcaacccaccgcggatcaggtgcagatgagaatcgttgaggcccgggatcaccgtatgccctttgagatcgacgatttgcgtcccctcggcggcaaagctcatgatccgatcgtgacttccggtggcaacaatttttccgtcggcgatggctacagcttccgccaggggattcgcacgatcgagggtatgaatctgaccgtgggtcagaatcagtgtggcagtttgcgacataacgcactccttgaggaggctgactcagtttttcttcaaccagccagcaaacaggcgggtcacgatgggcatccagaaccagaccaccagcgcaaccacgcaggcatcattgatgaggtgcagcagcaggctccccttaagcgacggcagcagcatgccggtcaccgcaggcaccaggttggtgctggggaaaatcaccagcagggtgatcagaaactgtttccagcgccgcggctggcgtacgttcaccgtcggcggggtaaaccagaaggccggttcagtccgcacctcagtccgatcgccttccgtcagcagtggggcaatctcagccaccagttgccgacgggtttccgactgcgtccaggcgtagaggtgctccagggtatcgaagcggattatgacgctccacagattctgccctgcggcgggccggatcacattcgccccaagatggccgggaaattctgccgcaatgggcataattttaccgagccactcttcgtagcgctggctgtgttgcggatcgagcagatggctgataaccagggtcaccgatttttgctgcgccatgatgagttccttgcttcagggaaatggccggttttctcctgccactctccataa

SEQ ID NO: 5699 - DNA, 243 bp, Klebsiella pneumoniae
gcccgcgccgcgcggtgtttgaaaacccgcagcacccctatacccgtaagctcatggccgccgtaccggtggccgacccgggccaccgtcatccgcagcgggtcctgctgtctgatgacgtcccgggcaatatttataagcggggcgaggagatcgccagcgtgccgttgcagcaggtcgggccgggccacttcgtcgcccgcgaatccgccgatgtgctgggcagaacataacaacacataa

SEQ ID NO: 5700 - DNA, 402 bp, Klebsiella pneumoniae
ccgtcagccgcgccatggcgggcattgagcgccagcagcataaagccgccgcccatcagcagcaggccgaaagaaaatttcagccagacgcgcagcacagaacgcacgctgccttccgggcgcatcagccacgccagcaccacgccggccgccatcaccgctatcgcgttaactgactggaacagcgcggtcggcacgtcccagttcagcagacgacgattgacgaagtggtcgataaacaggctaatcgagctcccgccctgctgcgccagcacccagaacagcgttccggcgagcatcagcaggacgatctgccacagcgcgcgtcgatgctccggggctttgatcatgatccgcgccaccatctgggcggcgaacaggcagacgatcgccagcagatag

SEQ ID NO: 5701 - DNA, 432 bp, Klebsiella pneumoniae
  unsure (409): Identity of nucleotide at the above locations are unknown.
cgtacagccgccgggcaagcgccacgccgaatatctggcgacgctgaaaaaccgactggccgcgccgttcctcggcgaaataccgtggcttgccgacatcgcgcagcgcgacgatctcggccagtatctggacctcagggcgctggatccggcgttatccactgcgccagcagcggctcatccagcgccataatatcgccttcggcgacgttacggccccggtgcaagacacagaagcgatccgccacccggcggataaagggcaggtgctgctcggcgagcagcaccgtcaggccgatatcgcgatttaaccgcaacagcagatccgccagcttttgcaggcagcgcggccctctgccgcgcgagggttcatcaaggatcagcagccgcggctggacgatcagcgccntggccagcgccagctggtactga

SEQ ID NO: 5702 - DNA, 645 bp, Klebsiella pneumoniae
ggtaaagccgcaacctctttatcgcaggcaggagtgacgatgaaactcattggtatgatggattcaccttatgtaagacgcgtggcggtttctctggcgctctatggcgtggaattcgagagcctgccgctatcggtctttagcggctttgacgaattttcccgcattaatccggtggtcaaggcgccgacggtggtgctcgataacgggacgcagctgatggactccacgctgatcctccactatttcgaaacgaccaatccggccgggcgccggctgcttcccgcgcatcccgaggcgctggcccgcgatctgcacctgctgggggtgatcctcgccgcctgtgaaaaagcggtccagcatgtttatgagcaccgtctgcggccggaagagaagcagcatcagccgtgggtagcccgggtgaccggccagctgctggccgcctgtcgggagtgggacgcccggctggcagaccgcgccgccgccgcgcagccggatcaggtgctggtcaccagcacggtggtctggtcctttatccagttgatgatcccggcggtggtgtcgacagctgagtttccacatattcgcgcgctggcggagaagggggaggcgctgccggcgtttcaacagtatccgctgggttaa

SEQ ID NO: 5703 - DNA, 1167 bp, Klebsiella pneumoniae
caacactacgctgccaagcgaaaacccggcggtaaccgcaggggaggatcaataatgacggataatccgaacaaaaaatcgctatgggataaaatccatcttgaccccaccatgctgcttatcctgctggcgctgctgacctacagcgcgctggttatctggagcgccagcggtcaggacgtcggcatgatggagcgtaaaatcggccagatcgccatgggcgtggtgatcatgatcgtcatggcgcagatcccgccgcgggtctatgaaggctgggcgccctacctctatattttctgtatcatcctgctggtagccgttgacgccttcggcgccatctccaaaggggcgcagcgctggctggatcttggtattgtgcgctttcagccgtcggagatcgccaaaatagccgtgccgctgatggtggcgcggtttattaaccgcgatgtctgtccaccgtcgctgaagaacaccggcattgccctggtgctaatcttcctgccgacgctgctggtggcggcgcagcctgacctcgggacctcgatcctgatcgccctatccgggctgtttgtgctgttcctctccggcctcagctggcgcctgattggtatcgccgtggtgctggtcgccgcctttattccgatcctgtggttcttcctgatgcacgactatcagcgtcagcgcgtgatgatgctgcttgatccggaaaccgacccgctgggcgccggctatcacattattcagtctaaaattgccattggctccggcggtcttcgcggcaaaggctggctgcacggcacccagtcgcagctggagtttctgccggaacgccacaccgactttatcttcgccgtcctcgccgaagagctgggcctgattggcgtactgatcctgctagcgctttatattctgctgattatgcgcggactgtggatcgccgcccaggcgcaaaccacctttggccgggtcatggccggtggtttaatgttgattttattcgtttatgtcttcgtaaatattggtatggtgagtggtattttaccggtggtgggcgtaccgttgccgctggtgagctacgggggctccgccctgatcgtactgatggccgggtttggtatcgtaatgtcgatccatacccacagaaaaatgttgtcgaaaagcgtttaa

SEQ ID NO: 5704 - DNA, 1242 bp, Klebsiella pneumoniae
aaaagtcacgctatacatagggttaatgacagaatgttaaggacaggaagcgaggagtggtggcaaaccctgcgggggccgcagtgccgcgcagtggatgacgccatcgaggtaacgttctggtggcgggacccggcgggggatgagacctgctctccccatcgtcgggtatggctctatatcaccggcgtgaccgaccaccatcagaatgcgcgaccgcaatcgctgcaacgtctccccgggaccgacgcctggttctggcgcactacgctgtcgccgacctggcgcggcagctactgttttattccctccgaccgtgacgatgatttttcccctgaggtgttcagcgctgatgcgcccgaccgcgcgctgctacgcgaaggctggcgcaaactgctgccgcgggcgatagccgatccgctgaacccgcacagctggcggggcggacgcggccatggcgtgtccgccctggagatgccgcaggcccccgcgcagcccggctgggaccggcttaatgaggcgcatcctcccgcccgttgtcttgagtggcgcagcgcgcgtctgggcaaccatcgccgggtctggatctacacccctggcgaggccgtcgacccgcaaacgcggccgctggcgatcctgctggacggccagttctgggccgagagcatgccggtgtggtcgccgctggccgccctgacccgcgaggggagactgccgccggcggtctacctgctgatcgacgcgatcgacaaccagcgccgcggggttgagctgccctgtcaccgcgatttctggctggcggtgcaggaggagctcctgccgctggtccacggctatgccccgttcagcgaccgcccggatcggacggtggtggccgggcaaagcttcggcggtctggcggcgatgttcgccgctctcaactggccgcagcgctttggctgcgtgctcagccagtcaggctcctactggtggccgcaccgtgatggccgcgggacgggctttatcggcgaacagcttcgccagggtgaggtgtccgcggccgggctgcgcgtctggctggaagcgggccaacgcgaaccgatcatttttcgcgcgaaccaggcactactggcgcaactcaccacaacacagcagacgattttctggcgtcaggttgacggcgggcatgatgcgctttgctggcgcggcgggctgacggcagggcttatccagctctggcagcctctgctgtcgcacccttag

SEQ ID NO: 5705 - DNA, 984 bp, Klebsiella pneumoniae
ggatatgacgcctcaacgatgaacagtaccggtctgagcattatcaagacattaggctgtatgacagcggtgacctttttcaccatctataacacctgggatcgctttgattatgactatcactggatcctcgggctgctgacatttatctcgaccatcgcgacgccgctgttttttgtcgtggccggctatcttgatgcgcagacgcgccacgatgccaactggcaaattggtaaaattaaaagcgtggtcatcgtctttctgttttgggtgacggtctattatgtctgggagccttaccagcgcggctacctgatccagccctggtttattttcgccctgattgtcatctatacctttcatcctttgatcgcctggctcagccagcggcgcgggctctttttcgccgtgctcctgacgctgctgtgctgctcctacggttacgacctgctctcggtgatctacccggacagacatcttttcagtttgccgccgcagtatcgcctgtggacatggctactgttttatttaaccgggcagttgtttaacgatccaaaggtcgctgagtggatacgcaacccacaggtgattaaagggtcgattatcgccctgccctttgtctatttgtttacctggttttatgaacgccatttcttcttcgccctgtttaaagcagatcgtaatgcgttcattctcacgggatcgcaaatttatatcctgatcgtcctgctggtgatcgccgctaacgccgtgcagtttaaaaagaaccgcgagtggaaagaggccgtgctggcgacggtcagtaaagcgatgaccggggtttatatcctccactattccgtgtttcacctgctggtgatgctcatccctgtgcactcgctagccaccaagttgggggtaatagcgctgacctttgtcctgtcggtgctcatttcccttgccgcgctctccagtacgctgctcaggaaggtgattaccttgtaa

SEQ ID NO: 5706 - DNA, 1542 bp, Klebsiella pneumoniae
cgccattgcgcttctggcggcccgtcacctgacgcgtctgctgcctgccgtactgcattaatcaccgttgttctctgtacccgcgtcgggggaagtcattcccccgaccgccctacaccgcatatttgtcgtcatataaaaaaatcaggacacctgtatatgcaacaacaacacaagccacatctgctgcgcgggctcaatgcccgacacattcggtttattgcgctcggctccgctatcggcaccgggctgttctatggctcggcctcagccatcaaagcggcgggcccggcggtgctgctggcctatctgattggcggcgcggcggtgtttatcgtcatgcgcgcgctgggcgagatggcggtgcgcaacccggtttccggctccttcggcagctatgcccgtcagtatctcgggccgctggccgggtttattaccggctggacctacacctttgaaatggtgatcgtcgccctggccgacgtcaccgccttcggcatctatatgggattgtggtaccccgatgtgccgcgctggatctggatcctcagcatcatcttctttatcggcgcgatgaacctgtgcaacgtgcgggtatttggcgagatggagttctggctgtctctggtgaaggtggtggcgattatcgccatgatgctggcgggagcggggatcatcttctttggctttggccacagcttcccggccaccgggctggaaaacctctggagccacggcggctttgcccctaacggctggcagggcgttatcgcctcgcttggcatcgtgatgttcgccttcggcggggtggagattatcggcgtcaccgccgcggaagcgaaggatcctaagaaggtgatcccgcaggccatcaataccattccgctgcgcattattctgttctacgtctgcaccctggcggtactgatggcgatcttcccgtggaacagctttggcgaacaggggagtccgtttgtgcttattttcgacggtctggggatcccggcggcggcgaccatccttaacatcatcgtgatcagcgccagcatctcggcgattaacagcgatatttttggcgccggacgcatgatgtacggcatgtcgaaagaggggctggcgccgaaaagcttccagcgcatcgccagcaacggtgtgccctggatgacggtggtggtcatgggcggcgcgctgctggcggcggtggtattgaactatctgatccccgagcaggtatttgtgctaattgcttcgctggcggcattcgccacggtatgggtgtggctgatgattctgctatcccattttgccatgcgccgcggtttgtctgccgaagagcgcagccagatcgcctttcccattccgttctggccggttgcgccgctgttgacgctgctgtttatggggctggtcatcgccgtactagggatgtttgccgaaacgcggatggcgctgatcgccggcctggtctggctcgggctgctgacggtggtgtggtatgcgcgggtgcgtaaaacggcgctgcaggtagtcactgaacagtaa

SEQ ID NO: 5707 - DNA, 711 bp, Klebsiella pneumoniae
ccgccctgcgcagccagggaaaagtctaactttccgcgaaaaacccgcattcatgtagcagagtgtgcagtcgggcgtgattgctgtttccgcgcccttgcctgttctgctatgattgccgttatctatgggcattgcgtccctaccacatcatttaagtttcaagaggttattttactcatggcaatcatcggcatcttttttggcagcgacaccggcaacaccgaaaatattgcaaaaatgattcaaaagcagcttggtaaagatgttgctgatgttcacgacattgccaaaagcagcaaagaagacctggaagcccacgacatcctgctgctcggtatcccgacctggtactacggtgaagcgcagtgtgactgggatgacttcttcccgacgctggaagagatcgacttcaatggcaaactggtggcgctgttcggctgcggcgaccaggaagattacgcagaatacttctgcgacgcgctgggcaccatccgcgacatcattgagccgcgcggcgcgaccatcgtcggtcactggccaacggcggggtatcattttgaggcttccaaaggcctggcggatgacgaccacttcgtcggcctcgccattgatgaagaccgccagccggagctgaccaacgagcgcgttgagaaatgggtgaagcaggttgccgaagagctgcacctcgaagaaatcaaaaacgcctga

SEQ ID NO: 5708 - DNA, 300 bp, Klebsiella pneumoniae
aggagatgcgcaatgagtaaaaagatcattgactgggatacgttaaaaacagaactgcttggccagcctgaggttcaggctgcattcgatgcgcaagaacgtcaacagcgattacgtactatgctggcgcaatggcgcgagcaggcggggctaacccgagcccaggtggcgcagaggatgggggtgagtgcgccgacggtctccagaatggaagccaatatcacccgcgccagtctggataccttaacgcgatacgcgttagcctgcggtataaagcacccgcaagttttactttactaa

SEQ ID NO: 5709 - DNA, 879 bp, Klebsiella pneumoniae
agccagtgcgcgcataacgatgtgacacggtgtcacatccccgcccgtcgtctggccctgtgccttgtcgtccggcgtttttatagtgaagggacaaccgcacaggagaatgagatggcaacgagcaacgtagtgtttatcaccggggcgacctcgggttttggcgaagcggcagcgcaggtgtttgccgacgcgggctggtcgctggtgctgagcgggcgccgctatccgcgactgaaggccttgcaggacagactcgccgccagggtgccggtgcatattattgagcttgacgttcgtgacagcgaggcggtggctgccgccgtggcgtcgctgcccgccgatttcgccgatatcaccaccctgatcaacaacgccgggctggcgctgtcgccgctgccggcgcaggaggtggcgctggaggactggaaaacgatgatcgacaccaacgtcactggtctggtgacgatgacccacgccctgctgccgacgctgatccgccatggcgccggggcgagtattatcaatatcggctcgatcgccggacagtggccctatcccggcagccatgtgtatggcgccagcaaggcgtttgtgaagcagttcagctataacctgcgctgcgatctgcttggcaccggcgtgcgggtcaccgatctggcgccagggattgccgagaccgaattcaccctggtgcgtaccaaaggcgaccaggcggcatcggataagctctatcgcggcaccacgccgctgagcgcgcacgatatcgccgagcagatgttttatatcgccacgttgccggcgcatatgaacattaaccgggtggaggtgatgccggtgcgtcaggcgtggcagccgttcgctatcgaccgggattaa

SEQ ID NO: 5710 - DNA, 198 bp, Klebsiella pneumoniae
tcagcgagcgctaagcatggcggctgtggtaggatacagttgctgtcaggagccttcctcaaaaatattaaggcttgggtaatatatgaatactccttcgttatattgaaggaacaggagcctgatttcacatgtcagatattgaacttgaaagatttaaggcaatgcttcgtgatgagtctattgatgacctgctaa

SEQ ID NO: 5711 - DNA, 1206 bp, Klebsiella pneumoniae
cgtcgcggcgctggccgaaacgcctccgctggcgcagacccgctatcagccgcgccctcaggcgcatgcccgctacgcggcgctgtatcccgtttaccgcctgctgcgcgagcagatgctgccggtatggcaggccagacaggccgcccttcaacctctttctcaggacctacaaccatgaaaatcgtttttaccgccgagcatgctggcgaccttagcgccttccaccagctgggcgaactgctggtggaggggtgggcgctgggcaaaccgaaactcagcgccggtcagctgattgagctggcccacgacgccgaggtgctggtgaccagctatgatgaggtgacggacgtggtgatggccgcctgtccgcacctgcaggtgatcgcctgcacccgcgcgaatccggtgaatattgatacccaggccgcccaggcgcgcggcatccgggtgctctacaccccggggcgcaatgccgatgccgccgcggagctgacgcttggcctgatgctcagcctggcgcgccatattccgcaatcccatgcggcgctgaagcggggggaattcacgcaggctgacaatgccgccgccgccactcagcagggtctgcggcgggatgtggtctgggacgtgagcccggaaagcccctatgaagtgtttaaaggcactgaactgcgcaataaaacgctggggctggtggggtatggcaacattggccgccgggtggcgcgtatcgcccgggcgttcggcatggcggtgttggtggtggatccgttcgtcgccgcagaggatatcaatgagccagggttacagaaaacgaccctggaggcgctgttccgcgaggcggatatcgtcagcctgcacctgagcagcgggccgcacagcgacgggctggtgaatgccgcgctgttaaacagcatgaagcccggcgcgctgctgatcaatacctctcgcgcggcggtggtcgacgaggcagcgctgattgatgccctgcgccacggcccgctgggcggcgcggcgctggatgtctatcaccgcgaaccgctgtggcgcgatcatccttttgtcatcgagttcgataacgtgattatcacgccgcatatcgccggagccactcgggagagtatcgccaaacacacggcgatgattgccgccgatcttcagcgctatgtcgccggggagccgctgctgtaccagtggcgttaa

SEQ ID NO: 5712 - DNA, 1257 bp, Klebsiella pneumoniae
cgacaaggcgctgtaatgaaccgacaatcctggctgctcaatctcagcctgctgaaaactcacccggcgtttcgcgccgtttttatcgctcgctttatctctattctgtcgcttggcctgctgggcgtggccatcccggtgcagatccagatgatgacccattcgacctggcaggtcgggttgtcggtgacgctgaccggggcgtcgatgtttgttggtctgatggtggggggcgtgctggctgaccgctatgaacgtaaacgcctgatcctgctggcgcgcggcacctgcggcgtaggctttgtcggcctgtgtctgaacgccctgctgccggagccgtcgctggcggcgatctacctgctggggatctgggatgggttcttcgcctcgctgggggtgaccgcgctgctggcggcgaccccggcgctggtggggcgggaaaacctgatgcaggccggggccatcaccatgttgacggtgcgcctgggctcggtgatttcgccgatgatcggcggcctgctgctggccaccggcggcgtggcgtggaactttggcctggcggcggcggggacctttatcaccaccttaaccctgctgcgtctgccgcagctgccgccgcctccgcagccgcgcgagcatccgctgcgctccctgctggcggggctgaccttcctctgccggagcccgcttatcggcgggattgcgctgcttggcggtctgctgaccatggccagcgcggtgcgggtgctctatccggcgctggccggtagctggcagatgtcggccggacagattggcctgctgtacgccgctattccgctcggtgcggcgctgggggcgttgaccagcggccagctggcccagacggtgcggccgggcgcgctgatgctggcgacgacggtgggatcgtttgtcgccattgcgctgttcagcctgatgccgcactgggcgttgggcgcgctgtgcctggcgctgtttggctggctgagcgctattagctcgctgctgcagtacaccctgatccagacccagacgccggaacatatgctcgggcggattaacggtctgtggaccgcgcaaaacgtcaccggcgacgccatcggcgcggcgctgctcggcggcttaggggcagtgatgacgccggcggcatccgccagcgccagcggctgggcgctggcgcttgtcggtgtgctgctggttgggctgctacgcgagctgcgccgtttccagcgcccggaaattgtcaacgaaagttaa

SEQ ID NO: 5713 - DNA, 288 bp, Klebsiella pneumoniae
gctggtttagctcagcaggtagagcgcctgccttgtaagcaggatgtcggcggttcgattccgtcaatcagcaccagacccagccagggtatcttcggcccaaagagccggcattgttcgaccctcattacatcttcccgccttgagcgggttttttattatcaggtcccgcaggaatcatcatcgacacgcttcgttgttaaatccagcctgacgggcctgacccttttactgactacagatagcaccccgaacattatcggaggtggagactatgaaaatgcctga

SEQ ID NO: 5714 - DNA, 1572 bp, Klebsiella pneumoniae
accggtttagcaaacattagcacactcactgatttacctttggatgtcaccaacatgtataaaaaacggaagttagccattcttattgctttgctaaccggcaccgccgcagcccatgggcagacagacctgaacagcattgaagcgcgtctcgccgccctggaaaaacgcctgcaggacgccgagacccgcgccagcactgccgaaagccgcgccgcctcagcggagcagaaagttcagcagttaacccagcagcagcagcaaacccaggccaccacccagcaggtggccaggcgcaccactcaactggaagaaaaagccgaacggcccggcggctttgagttccacggctatgcgcgttccggggtgatcatgaacgactcggccgccagtaccaaatccggcgcttatatgacccccgccggggagaccggcggcgccattggtcgcctgggcaaccaggccgacacctatgtggaaatgaacctcgaacataaacagaccctggacaacggggcgaccacccgtttcaaagtgatggtggccgacggacagaccacctataacgactggacggcaagcagcagcgatctgaacgtgcgccaggcgttcgtcgagctgggcaacctgccgaccttcgaaggcccgttcaaaggctcgaccctgtgggccgggaaacgctttgaccgcgacaacttcgacatccactggattgactcggatgtggtgttcctcgccgggaccggcggcgggatctacgacgtgaaatggaacgacagcctgcgcagcaacttctcgttatacggccgcaactttggcgatatcgccgacagcagcaacagcgtgcagaactatatcgtcagcatgaataactttgccggcccggtgcagatgatggtcagcgggatgcgggcgaaagataatgacgaccgccaggacgcgaacggcaatctggtgaaaggcgatgccgctaacaccggggttcatgccctgctgggcctgcacaatgagagcttctatggcctgcgcgacgggaccagcaaaacggccctgctgtacggccacgggctgggcgccgaggttaaaggcatcggctccgacggcgcgctgcgcccgggggccaatacctggcgcttcgccagctatggcaccacgcctctgagcgatcgctggtttattgccccggccgtgctggcgcagagcagtaaagatcgttatgtcgatggcgacagctatcagtgggccaccctcaacctgcgtctgattcaggaagtgacgcagaacttcgccctcgcctgggagggcagctatcagtacatggatctgcagcctgaaggctacaacgatcgccatgcggtcaatggcagcttctacaagctgaccttcgccccgaccttcaaggtgggcagcatcggcgacttcttctcgcggccggagatccgcttctatacatcgtggatggactggagcaaaaaactggacaactacgccaacgatgacgcgttaggcagcaacgggttcaaatcgggcggcgaatggtcgttcggtatgcaaatggagacctggttctga

SEQ ID NO: 5715 - DNA, 288 bp, Klebsiella pneumoniae
ctacagatagcaccccgaacattatcggaggtggagactatgaaaatgcctgacaaaatcttttcggcggcctcgtactgcacgtcaggcggcctgatatgtaccggactggcacaaacctatgactggttccacggactggactggaattttattgcgctggcaagcggtgtagtaatcggtgttgcgacatacctgaccaatctgtattacaagcgccgctggacgaagatgtatcagcagtcccttgaccgtggatacggaggacaaccaccgcaggacaactga

SEQ ID NO: 5716 - DNA, 207 bp, Klebsiella pneumoniae
agccacccagccagagacagcctttgcagctttctccgcagcgtctttgcctgtatttggctctccgggcttaatatcgttgtcggcagcaatgatgatctgcgcattcgggtaacgctgatgcatggcctgggcgacgggctgcaggttgcctgcgtctatggcacataccgtcagtgcttccgggcgtatcagatggacagataa

SEQ ID NO: 5717 - DNA, 2508 bp, Klebsiella pneumoniae
aggtttacagcaaagtggagtacatggtgcatggttcgatatgagttacagaggctgcctggagcgccgctgcaacggggaacggtaggcgcctgcaccacactggtgagcctgctggattctctgcagctgcaccgcgatgttatcgtgaaactgaatggccgagcgctgcctgacgattacgatatcagccggccactgcgatccggtgacgtggtggctgtgttcgaccagccagagggtggggttggcaaactcatcaccacgatactgcgcccggtcacgaaaattctctccggcgcgctgaaggtgttcggcctgtcaaataagcccagcgcgtcagtatcggtggcgacaggcgaatcacccaataacgacctgacaggccagacaaaccgggcgaggctctacaaggggcgcccgaacatttacggccagtgccgcgtctttcctgatctgattcaggaagcactgttcgagttcgtcgacaataacaagcaactcacggagtggtttgaagtcggttacggccggtacaccatttcctcgatccgctactcggaatcgaacctcggcagcctggcgggcgccagttctgcgatttataacccgggtgacgtgatcggcacgattgaggtggggtatcagttcgatgacgtcgataacgagacagtccccgggttaaatgaatcccaggacttcccagcccagacagcgaccacgacggcgccgacatcggtggcgatcgagagtaatcagctcaaagccattgtgctgtcgaacgatgataactttgcatacttcgccgcactggcggtgccacaccccgtgtcattcgtcattaatgctacctggaacgaaggcggcacaagcgtcacacgcaacgtcaccggcgccgggaatatcatctcctctgagagctttatcggcgacgatacgctctcgtacacgacgttttatattggtgagctctccggagagattacgtctcttccgggcaatgcggtcatcaacccgacactgttcacgctgaatgaccagaccccgctggttatcggaccgtcagtgtcgccaatcgtctcgactcaggtctgggtgcatgtgctggtccaactcggcgcgacggccggcacaacgcgataccggatcaagttctggcaggtcgatgacgaaaataatcaggtgccgggtacatccgagcagcacgattatttcttcgataacgacttccaggtgacgacccggtatttccgcacaacgcataagttcgttccggcagccggggcggggcgctacgcggtcaccatcgagcgcctcgacaacagcaatgacgctaacgttgtcacaatgatggcgatccatgcggtgaacgtgcgcgaaaacgtcgtgtatccggaggacacaattgcccgcatcacgatcaagggctcgaatgacagcaacagcacccgcgagcagaagtacaacatgctggcgcagcggcataccatcagctacgaccggacaaccggcgcggtcgattatacgctgcggccgagtcgctcgtttgctgatgcaatccttcacgaatgggtggttgtgggtaagcaggacgtggccagtattgacgtcgcggctctgtatgccattgccgattcgctgccggatgcccagcttgggtatttcgattacaccttctcggatgagaaacagccgttgggtgagcgcatagctacgatcgccaatgtggcccgcgttgacggcaataatatcggcgatgtgctgacattctggcgcgatgagaaagtggcaaatccggatgcagtttttgctcgatccaatatgttctgggacgagtacaaagtggcatggcaaatgtctctacccggtggttatgacggcgtggcgctggactacgtagacccgctgacgaacaagaaggcgtatatctacctgcagatcgacagcagcggcatcactgaggttgaggatgccacggttaacgcgatgcagatcagcctggacggttgccggaacgccactcaggcaaccgacagggcctggcttgaggcgaggaaaattctctactcacgcctgaccatgacggtgaaagtgctggagtcgactcaggtggtgcgcggtacggtggttcagtgtccggacatgtacgacaacgcgcagcagactggatacatcaccgggcgctccggggatgtattttcgacctcagagcgtatcgacttctcactcggggatatgtgggtggtgatgaccgacagcatcggcaattaccgcgggcgctggcgggcctatccggtaagcggcaagccaaaagcatttcaggctgcagccgataccttcgatctgaatatttatgaccgcgaaaatgtgcaaaaccccagccgttatttcattgctaccgactcggaactgaactccacaatctggcgcgtcgatagcgctaaacccaacggtgacgatactcaaaccctctcactcactgagtattcagactcgatttatccgtaa

SEQ ID NO: 5718 - DNA, 804 bp, Klebsiella pneumoniae
ccgattacagcactctgccggaagggatctggagcggcgacgtcagcgtacagttcgacgccacctggaccagctgatccttctgatgcaccagcagggggatccccccctgcttttttcacggacggaattgttatgaaaaagcaccttctggccctcgggctgctgcttgccggggtgtcgccggcgcaggcgctggatgtcggcgatatttcatcctttatgaacagcggcagcagcacgctgagcaaaacgatcaagaacagcacagacagcggtcgactgatcaatatccatctcgaacggctctcttccccgctggacggcgggcaggttatcccgatggacaaaccggatgaggtattgctcactcccgccagcctgctgctacccgcccaggccagcgatgtgatccgcttcttctacaaaggcccggcggatgacaaagagcgctactaccgcattgtctggttcgaccaggcgctcagcgatgcccaacgcgataacgccaaccgcagcgcggtggccactgcttccgcccgcatcggcaccatcctggtggtggcgccccggcaggtgaactatcgctttcagtacgccaacgggtctctgaccaacaccgggaatgcgacgctgcggatcctcgcctacggcccctgcctgaaggccgccgatggtaaggaatgtaaagagaattactacctgatgccgggtaaatcgcgccgtttcacgcgcgtggacacggcggataaaaaaggacgggtggcgctttggcagggtgagcagtttgttcccgtgaaatag

SEQ ID NO: 5719 - DNA, 1431 bp, Klebsiella pneumoniae
cccatcacagcacggcttcccgccgcagcctatcgttctaaagaacgtcattcttccggacgatattcaacgcccgcgcggcgtgctgtgatgagggtcttgagccaggcaagaccacagggtaacgcgatgaacatcaagatcgatgcgctgaactactacggcgcgacgaagaaatatcacctccatttcccggcgctacgggaagatattgaagccgatgtggtaattatcggcggcggcttctctggcattaacaccgcccttgagctggcggaacaggggatcaccaacgtggtggtgctggaggcgcgccatctcggctacggcggcaccgggcgcaacggcggccaggtgatggccggtatcggccacgatatcgaagcggtaaaaaagcacgtcggcaaagaggggctggagacgctgtttaaaatcgccaacctcggcgcgggcatcattcgcgaacgcatccgcaaatataacatcgacgccgatttcgtgcccggctacggctatctcgcctataaccagcgacagcttaaaacgctgcgccagtgggagaaggagtttaaagccgctaccccggatgaagagatcgaactgtataccggaaaagaggtgcagcaggtggtgggctccgaggtctactgcggcgcgctgaaacatatgggcggcggccagatccattcactcaatatgctgcttggttcggcgcaggccgcgcactcgctgggggtgaagattttcgaatcctcaccggtagtggaagtgaattacggcaaacaggtgcgggtacgcaccgcgatgggcagcgtcaaagccgccaaactgctgtgggcctgcgacagtttcctcaacaatatggagccggagatctacaacaagacgctggtcacttactcctaccaggtgtcgaccgagccgctctccgatgaactgatcgaacgcatcagcccactgcgcggcgccttcagcgatattcgcccggtaattaactactaccgcgtcacccgggaaaaccgcctgctgttcggcagcgccacccgctttgtggagtatacgccgaacgatttcgccgcctggaaccgcaccttgctggcggaggtcttcccctatctcagggatgtgaagatcgatttcgcctggggcgggccgatggcctgtagcgccaatctgttcccgcagatcggcaccttacgcgatcacaacaacgtcttttacgtccaggggtactccggcttcggcgtcaccccgtcgcacatcgtgtgcaaaatcctcgccgaagggatcaacggcggttccgaccgctatcgcctgctgagcagcatcccccacgcgaccatccacggtcgtgacagtctgcgcttgctattagtcacggccggaaaactgatgcatcaaaccgccggtttctggaaaggccggagttaa

SEQ ID NO: 5720 - DNA, 414 bp, Klebsiella pneumoniae
gctcatcaagcggggtttcacctggcagttgcccgcattcgccgtaaaccatcaccttcgcgccgagctgccggaggagctgggcgtgctcccgcaccgcctccagctccgcttccacgctgcggtcggccagcatgccgctgtaccagccggacgccaggcgcaggtcagccgccgccagcagcgggcccagggttgatgcctgacggggaaatttccgtcctaactcaatgccctgatagcccgcctcccgcgcctcgcgcaggcaggtatccaggggaatatcaccgcctaaatcctcgagtacatcgttggtccagcacagggggctcacgccccaccgcagttgctctgtcgccatcttgttctcctttccaccctgtggtcttgtctggcgtcactataagcaggtga

SEQ ID NO: 5721 - DNA, 477 bp, Klebsiella pneumoniae
gccgggcaagcgccgcgccgcccggcaaggtgttcaggccgcgttcccgtcctgatgcccggtggcggctgcgccttaccgggcctacggtctggactgggggacgctggcattgtaggccgggcaagcgcagcgccgcccggcaaggtgtgcaggccgagtgcccgtcctgatggcgcagcccgcgttagccgaacaggctggagagacgctggagcaccagcagagcgctgtagtagtcaaggcggaaggtctcggtgcccagcgggtagacgcgtttgcctgcgaccgccgggagatgcgccagcagcgggttggcgtagatggcatccgcatctttctggtcgccggcgaacaggaacaggctctggccgttcagaccggccgcgaggttctccccgcccagctgcacgatatcgtggcgtttaccctggctatggctggcgggcaggccgcccggcagcgtcgccaggctaa

SEQ ID NO: 5722 - DNA, 1551 bp, Klebsiella pneumoniae
aaaagcaaagccgctgcaccagggtgcgcgccgacagcgtgcagcctgccccatttttgcgcagcgccagcgggcgcgccacggactgacgccttatcgcggcagacaacgttctggcactctctttgcagcctgtcgttcagcacctttctatctggcgaggcaatacgtatgacagagcacaccaccaccttaaaaagaacgctcggcagttttcgtttatgggggatcgccgtcggactggtgatatccggggagtacttcggctggagctacggctggtcgcaggcgggcacgatggggtttatggtcgtcgccctggcggtcgccgccatgtactgcgcctttattttcagctttaccgagctgaccaccgccatcccgcacgctggcggccctttcgcctatgcctaccgcgccttcgggcccaccggcggctttatcgctggttttgccaccctgattgaattcgtcttcgccccgccggccatcgccatggccatcggggcctacctcaacgtgcagtttccggcgctggatccgaaatgggtcgcctgcggcgcctacgtgatctttatgacgctcaatattctcggcgtcggcatcgccgccaccttcgagctgatcgtcaccctgctggccatcttcgagttgctggtgttcatgggcgtggtcgcccccggcttctcctggagccacttcaccactaacggctgggcgggcgcggacagcttcagcggcctggcgctgccggggatgttcgccgccattccgttcgccatctggttcttcctcgccattgagggggcctccatggcggccgaagaggccaaagatccgcagcgcaccattccccgcgccctgggcggcggcattctgacgctgacggtgctggcgatcggcgtgatggtcttcgccggcggcgtcggcgactggcgcgcgctgtccaatattaacgatccgctgccccaggcgatgaagacggtcgtgggcaacggcagcggctggctgcatatgctggtgtggctggggctgtttggcctcgtcgcctccttccacggcatcattatgggctactcgcggcagatctactccctcgcccgcgccggctatctgcccgccgggctggcctccctcaaccgccgcacgcgcaccccgcatctggcgatcctcgccgggggcgtggtggggatcgccgcgatcttctccgactcgctgatcaccatcagcggcatgccgctgaccgcctgcatcgtcaccatgtcggtatttggggctattgttatgtatatcacttccatggcggcgctgttcaaactgcgccgtagcgagccgaagctgatccgtccgttccgcgccccgctctacccgctggcgccggcctttgccctcggcatggcggtgctctgcctggtggcgatggtctggtataacctgctgttggcgctgattttcgcggcgatgatgctcggcggctacctgtggttccgcaaaaccgcagcggcccgtgaacgggcgccagtggatcctcaactgcgcacggtctcctga

SEQ ID NO: 5723 - DNA, 1128 bp, Klebsiella pneumoniae
attcgccgagctggtcggtttatgcgaccgcatctgcgtactgtgggacggacggatcgtagcggagatccccggcgcggaagcccgggaagagacactgctttattattcaaccggaggagcggcagcgtgagcaaggccctggcagtaaacgcgacggtatcgggccgtcagcgattttttgattttctctataagtggggcatgttgctgaccgtggtgctgctggtggcggtctttggcctcgcctcggacaacttccttgacccgttcaacatcatcaacattctgcgctcgattgccatcgtgacggtgattgccattggggtgtcgatttccctcaccatcggcggcttcgatctgtccgtcggatcgacggcatcgctggctaacgcgctggtgatttccctgtttgtctggcatggcctggggaccaccgaagcgattctgataaccctcgcgctctgcaccctggtggggctgtttaacgcctttctgatcgtggtgctgcgcattcctgacatgctcgccaccctggccagcctgtttgtgattcagggcgtggcaatgacctacagctacggtgggtcgattaccgaaaacatggttctgccgagcggcgagatggcggagggtactatcccggcggcctttggcgcgctggggcaggtgccgaccatcgtcattatcatgctggtggtgacgctgatcgcccagctggcgctgtcgttcactacccacggacggcggatgtacgccatcggcggcaacccggaggcggcgcggctctccggcctgcggatcacgcgttacaaagtcgcagcatacgtgattgcctcgctgctggccgggctgggcggcattctgctggcctcgcgcatcggctcttcgcaggtcaacgccggcggcggctatctgatggacgcggtggcggcggcctggatcggcttttcgctggcgggctccggtaaaccgaacgccctggggacgctggtgggggcggtgatcctcggcgtgctctccaacgggctggtgatgctctcggtgccgtattacgcgatggacattattaaagggttggtgctggctggcgcgctggcactgacctattttcagcgccgtacttaa

SEQ ID NO: 5724 - DNA, 942 bp, Klebsiella pneumoniae
cttagaggagcttgtcgtatgaatggaaaaatctgggtactcggcgatgcggtcgtcgatctcctgcccgatggagagggccgcctgctgcaatgccccggcggcgcgccggccaacgtggcggtcggcgtggcgcggctcggcggtgacagcgggtttatcggccgcgtcggcgacgatcccttcggccgttttatgcgtcacaccctggcgcaggagcaagtggatgtgaactatatgcgcctcgatgcggcgcagcgcacctccacggtggtggtcgatctcgatagccacggggagcgcacctttacctttatggtccgtccgagcgccgacctgttccttcagcccgaggatctcccgccgtttgccgccggtcagtggctgcacgtctgctccatcgctctcagcgcggaaccgagccgcagcacgacattcgcggcgatggaggcgataaagcgcgccgggggctatgtcagcttcgaccccaatatccgcagcgacctgtggcaggatccgcaggaccttcgcgactgtctcgaccgggcgctggccctcgccgacgccataaaactttcggaagaggagctggcgtttatcagcggcagcgacgacatcgtcagcggcatcgcccggctgaacgcccgcttccagccgacgctactgctggtgacccagggtaaagcgggggtccaggccgccctgcgcgggcaggttagccacttccctgcccggccggtggtggccgtcgataccaccggcgccggcgatgcctttgtcgccgggctactcgccggcctcgccgcccacggtatcccggacaacctcgcagccctggctcccgacctcgcgctggcgcaaacctgcggcgcgctggccaccaccgccaaaggcgccatgaccgccctgccctacagggacgatcttcagcgctcgctgtga

SEQ ID NO: 5725 - DNA, 597 bp, Klebsiella pneumoniae
acgataacggctggtttggcgaagtcagcgcttcaggagagattcatgtccaggcgacgtggcgcaacattaactaaggccctgctgacgctgagctgcctgctggcggcgccgctggcgctggcgatctcggtcggcaatctgaccttttccctgccggctgaagcggatttcgccagcaaacgggtggtcaataacaataaaagcgcgcggctgtaccggatcactgtcagcgccatcgaccgccctggcggcagcgaagtgcgctcccggccggtggatggcgaactgctgttcgccccccgccagctggcgctgcaggccggggagagcgaatatttcaaattttattatcatgggccgcgggataaccgcgagcgctactatcgggtctcgtttcgtgaaattcccacccgtaacctgacgaggcgcagcccgaccggcggcgaagtcagcatggagccagtggtggtgatggataccatcctggtggtgcgcccgcggcaggtacagtgtaaatggtctttcgttaaggcggccgggacggtgagcaacaccggcaatacgtggtttaagctgctgattaaacccgggtga

SEQ ID NO: 5726 - DNA, 2307 bp, Klebsiella pneumoniae
cccgcaacggctctctctcccacgatgagagccgcttttccagaatcctcttccctccccttccgccagcggcttctatacttacccgtttacgttgcaacggaggtgcccatgccgtggatcctgcttttgctcgctgcactgtttactgccccgctttccgccgccaccctccccggcgtgccgacggctaacactgataaaaacagcgccagcgaacccgatgtggaacagaaaagagcggcttatgccgcactggccgatgtgctggccaacgactccgcccgtcaggagctcattgaccagctgcgtaaagcagccgccacgccgccgcccgacagcaccccgacgctgacgccaccggcggtgaaagaagagaccacggtactggagaacgtcacccagataagccgggaatatggcgaacagctctcatcacgcttttcccagctgtggcgcaatatcaccggctcaccgcataagccctttaatccgcaaacctttaccagcgcggcctggcattttttactgctggccgggctggtgtttgccttctggtggctggtacgcctcgcggcgctgccgctgtatcgcaaaatgggcgaatggggacggcataaaaaccgcgatcgcggtaactggcttcagctgcccctgaccatcgccggggcgtttatcatcgacctgctgctgctggcgctaaccctgtttgtcggtcagctgctaagcgatcgcctgaatgggaataaccctaccatcgccttccagcagagccttttcctcaacgccttcgcgctgatcgagttttttaaagctattctgcggctcattttctgcccgcgcattcctgccctgcggccctttaacctcagcgacgaggccgcgtcatactggagcctgcgcctgagcgcgctcagcagcctgattggttacggtctgatcgtcgcggtgccgattatttccaatcaggtgaatgttcaggttggcgcgctggctaacgtcgtcatcatgctgtgcattacgctgtgggcgctgtacctgatttttcataacaaaacggtgattactcaagggttgatccacctggccgaccactcactcgctttctttagcctgtttatccgcgccttcgcgctggtctggcactggctggcctgcgcctactttgtggtgctttttttcttttccctgttcgacccgggcaacagcctgaaattcatgatgggcgccaccctgcaaagcctggcgattatcggcggcgcggcgctggtgtctggcatcctgtcgcgctggatagccaaaaccatcaccctgtcgcccgccactcagcgcaactaccctgaactgcaaaagcggctaaatggctggatctccgcctcgctgaaggcggcgcgcattctcaccgtctgtgtcgccatcatgctgctgttgagcgcctggggcctgtttgacttccgggaatggctgcacaacgatgccgggcaaaaaacggtggatgtgctgatccgcatcgccctgatcctcttcttctccgccattggctggacggttctggccagcctgattgaaaaccggctggcatcggatattcatggccgtccgctgcccagcgcgcgggcccggacgctgctgacgctgtttcgcaacgcgctggcggtggtgatcagcaccatcacggtgatgatcctgctctcggaaattggggtaaacattgcgccgctgctggcgggcgccggggcgttagggctggccatttcgtttggtgcgcaaacccttgtcaaagacattatcactggcatatttatccagtttgagaacgggatgaacaccggcgacctggtcaccatcggccctttgaccggcaccgtggaacgaatgtcgattcgctccgtgggggtacgtcaggataccggcgcctatcacattattccctggtcctcgatcaccacctttgccaacttcgtgcgcggcattggctcggttgtggctaactatgacgttgaccgccatgaggatctggataaagccagccaggcgctgaaggcggcggtggacgatctgctggcccaggaggagatccgcggtctgatcattggcgaaccgtcgttcgccgggctggtggggctgagcaataccgcctttacgctacgcgtcagcttcaccaccctgccgctgaagcagtggacggtgcgttttgccctcgacacccaggtgaaaaagcacttcgaccgcgccggggttcgcgcgccggtacagacctggcagcagctgccgatgccgggcgccgacagcccggccgccgagtag

SEQ ID NO: 5727 - DNA, 1305 bp, Klebsiella pneumoniae
acgatagcggcgaaattacgcctgctggttcatcagttcgttgaaggaagtggctttttcagacactttggctttcgccagcacggcttcaacagcctgctcttccagcgccacgttgcgcatgttgtccatcagctctttgttcttgctgtagaactcaacgacttcagacggatcttcgtacgcagaagccatctcttcgatcagggcttttacgcgctcttcgtcagctttcagctcgttggtgcggatcacttcgcccagcagcagaccaacaacgacgcgacgtttagcctgctcttcgaacagctcgcgcggcagttccagagcctgtttctcgttgccgccgaaacgctgagcagcctgacgacgcagcacgtcgatttcgctgtcgatcagggcagccggaacgtcgatctcgttggctttaaccagaccttcgatagcctgagacttcacgcggttacgcacagcgcctttcagctcgcgttccatatttttacgcacttcagcgcgcaggccagcgacggaaccatcttccacgccgaaacgtttgatgaactcttcggtcagctcaggcagttcacgctcttcgactttcttcaggttgataacgaacttagccgctttacctttcaggttttctgcgtggtactcttccgggaaggtcacgtcgatggtgaactcttcacccgctttgtggcctttgataccgtcttcgaagcccgggatcatgcgaccctggcccatcgccagtacgaagtcagaggctttgccgccttcgaactcttcgccgtcaacagaaccggtgaagtcgatggttacgcgatcttcagcgtcaaccgcgccttctttttctttccaggtcgcctgctgcttgcgcagagtttccagcatggtatcaacgtcagcgtcggtgacttcaacaaccggtttttcaacttcgatcgcgtccagaccctgcagttcaacttccggatacacttcgaactctaccgcgtaggtgaagtcttcgcccagtttgtattcgcccggaacgtagttcggcgcgccggccggattgattttttctttgatgatcgcgtcaacgaaatgacggctcatcaggtcgcccagcacgtcctggcgaacggaagcgccatagcgctgagcaacaatattcatcggcactttgcctttacggaagccgtcaatgcgaacttttttcgctacgttgaccagctcgcttttgacagcattctcgatgctgtcagcggcgatagtaatcgttacacggcgcccaaggccctgagtggtttcaactga

SEQ ID NO: 5728 - DNA, 1278 bp, Klebsiella pneumoniae
gggaaacaggcgcactcagctgtactggcgtacccgcgccagcagctcgtcgacgctgtcgatacgctcggccagcacgatcagcgctctgcccagggtaatggcgtggcgcaggcactcatgacgcatggcgtcgtcctggatagtgtcgatatccgcgacgtgcgacagtccgacgctgcggcggatcagttcgctgccgcagaagccgaccgcgtcggcccacacctttttcagaaaggcggaggcgtagccggggtaagccagcgccgcgtcgcgggttttctccgccgccagcgcctggaagcgctcggcaaaggtggtccacagctggtggatgtcgttcagcctctgctcgcgcgcggcggcggcatcgcgaatgccgagctggcccggcaggccgcagtagttcagcagcaggttgccgatggcggtgccgatatcgaagccgatggggccgaagtagccgaactcggcgtcgatggccttcaggctgccttcggcaacgaagatcgacccgctgtggatatcgccgtgcagcagcgcttccgcatgggcaaagaaacggtgcttcagcgccgccaccgccagcttaagctgagcgtcgtcgcgcagggcggcgacatcggcctccagctccgccgggtagttattgcgctcgtggatctgatacgggtcgttaaagaacagatcctcggtgatctcgcacatcgccgggttaataaactgcgccacctgcgcctttttctcgtggggatggaggtagaaatcgctggtgtggaacaacacctgcgccagatagtcgccaagctggcgggccgcctggggatagtagacgttagcgataagctctccgcgccagatgcggtggtcggaaagatcttccatcaccatcaccgccagctcgggatcaaagtgatggatttttaccgtgtgctgcgggctgtgctgatagtgggcgataagagtttgcgcctccagacgggcgcggtcgagggtcagcggccaggattcgccgacgcagcgcacgtagggcagagcctgtttgacgatcgcccggctgacgccctggcgatcgaacactttaaacaccagattgaggttgccatcgcccacttcctgcgcgctgaccagctcagatgggttgtcgatgccggcgaactgctgcgcgtaagccacggcatcgtgggcggtgaaggtatggtattgcgacattgcctcgatcctcgaattctgattaagccgttcagacgtctatacttctggattccatcctga

SEQ ID NO: 5729 - DNA, 1179 bp, Klebsiella pneumoniae
cctgatgaggcgtatataccgggggtcgtaatgtatgcattaacccagggccgggtttataccggtcatgaaattctcgatgaccatgcggttgttatcgctaatggctttatcgaacgtctttgtccgctggcagatttgccgtctgacatcgagcagcgctcagtcaacggcgcaataatcgcccccggttttatcgacgtccagctcaacggctgcggcggcgtgcagtttaacgacagcccagaggcggtcactgtcgaaacgctggagatcatgcagaaggccaacgaacgctcaggctgcaccagcttcctgccgacgctgattacctccagcgacgatctgatgaagcaaggcgtgcgcgtgatgcgcgaatatctgcaaaaacatccgaaccaggcgctgggcctgcatctcgaagggccgtggctgaatatcgttaagaaaggcacccacaatccggactacgtgcgtaaaccgaacgcggcgctggtcgatttcctgtgcgacaacgccgatgtgatcaccaaagtgaccctcgcccctgagcgcgttgagccagaagtgatccgcaaactggtcgccgccgggatcgttgtctccgcgggccactccaacgctacgctgaaagaggcgaaagtcggcttccgcgcgggcattaccttcgccacccacctgtataatgcgatgccgtacattaccggccgcgaaccgggtcttgccggggcgatttttgacgagccggatgtctactgcggtatcatcgtcgacgggatgcacgtcgattacgccaacgtgcgcaacgccaagcgcctgaaaggcgacaagctgtgcctggtcaccgacgccaccgcgccggcgggggcgaatattgaccagttcatttttgccgggaaaacaatatactaccgcaatgggctgtgcgtagatgaaaacggcaccctcagcggatcttccctgaccatgattgaaggggtgcgtaatctggttgagcattgcggcgtggcactggacgaagtattgcgcatggcgacgctctatcctgcgcgcgctatcggcgtggacaagcagctcggcagcattgcgccgggcatggtcgctaacctgaccgcctttacacgcgattataaaatcaccaagaccatcgttaatggtaacgaggtcgtcactgagtaa

SEQ ID NO: 5730 - DNA, 201 bp, Klebsiella pneumoniae
ccttattgggcaagtgaaagtgccctaactatagtcagcgcggcggggaaaaaaattaaactttttgttatcagattacggttatttggcggggaatggtacaactgggtgtactctgaaacaggccgcaagcggcctcctgcacagagaagtcgactaacagatatggtttgcgaagccacttttcatcttgaaaagtag

SEQ ID NO: 5731 - DNA, 930 bp, Klebsiella pneumoniae
cgccggtgggcaaagtcgataaaaaacaattacgtcagtggctggccgaaggcaagctgggctgaaggagaacagagaatggcaatccctaaattacaggcatatgcgctgccggaagccagcgatatcccggcgaacaaggtcaactgggcctttgagccgtcgcgcgccgcgctgctgatccacgatatgcaggaatatttcctcaacttctggggcgaaaacagcgcgatgatggagaaagtggtggctaatatcgccgccctgcgcgacttctgcaaacagaacggcattccggtgtactacactgcccagccgaaagagcagagcgatgaagaccgtgccctgctgaatgatatgtgggggccgggtctgacccgctcgccggagcagcagcaggtgattgccgcgctggcgccggatgaagacgataccgtgctggtgaaatggcgctacagcgcgtttcatcgctcgccgctggaggagatgctgaaagagaccggtcgcgaccagctgatcatcaccggcgtttacgcccatatcggctgcatgaccaccgccaccgatgctttcatgcgcgatatcaaaccgttctttgtcgccgacgcgctggcagatttcagccgtgaagagcacctgatggcgctgaaatacgtcgccggccgctccggccgcgtggtgatgaccgaagagctgctaccgctcccagcctccaaagcggcgctgcgcgcgctaattctgccgctgctcgacgaatccgatgaaccgctggatgatgaaaacctaatcgactacggtctggattcggtgcggatgatggccctggccgcccgctggcgcaaagtgcacggcgatatcgacttcgtgatgctggcgaaaaacccgaccatcgacgcctggtgggcgctgctctcccgcgaggtgcactaa

SEQ ID NO: 5732 - DNA, 1482 bp, Klebsiella pneumoniae
ccccgtcgggcttgccaacgaactattgtcgctatgaagtttatcattaaattgttcccggaaatcaccatcaaaagccaatctgtgcggttgcgcttcattaaaatcttaaccgggaacattcgtaacgttctcaaaaactatgatgagacgctggccgtcgtccgtcattgggatcatatcgaagttcgcgcgaaagatgaaaatcagcgcccggctattcgcgatgcgctgacccgtatccccggcatccaccatattctggaagtcgaagacgtgccgttcacctcgctgcacgatattttcgagcagacgctgccgctgtggcgcgaggcgctggaaggcaaaaccttctgcgtgcgagtgaagcgtcgcggcaaacatgaattcacctcaattgaagtggaacgctacgtcggcggcggtctgaatcagcatattgaaacggcgcgcgtgaagctgaccgacccggacgtcaccgtcaatctcgagattgaaaacgatcgcctgctgctggtgaaaggccgctatgaaggcatcggcggtttcccgatcggcacccaggaagatgtgctgtcgctgatctccggcggctttgactccggcgtctccagctacatgctgatgcgccgcggctgccgcgttcattactgcttctttaaccttggcggcgccgcccatgagattggcgtccgccaggttgcgcattatctgtggaaccgcttcggcagctcacaccgcgttcgctttgtggcgattaactttgagccagtagtcggcgaaatccttgaaaaagtggacgacggccagatgggcgtcgtgctcaagcgcatgatggtccgcgccgcgtcaaaagtcgcggaacgctatggcgtgcaggcgctggtcaccggcgaagcgctcggccaggtctccagtcagaccctcactaacctgcgcctgatcgataatgtctccgatactctgatcctgcgcccgctgatttcgcacgataaagagcacatcatcgacctggcgcgtgagatcggcacggaagattttgcccgcaccatgccggaatattgcggcgtgatctccaagagcccgaccgtgaaggcggtgaaggcgaagattgaagcggaagaagaacacttcgatttcagcatccttgataaagtggtagaagaggcgagcaatatcgatatccgcgagatcgcccagcagacggaagagacggtggtggaagtggaaaccgtgaccggctttggcgccaacgacgcgatcctcgacattcgctccatcgacgagcaggaagacaagccgctgaaggtcgagggggttgaggttgtttccctgccgttctacaagctaagcaccaaatttggcgatctcgatcagagcaaaacctggctgctgtggtgcgagcgcggggtgatgagccgtctgcaggcgctttatttgcgcgagcagggcttcagcaacgtgaaagtgtatcgcccgtaa

SEQ ID NO: 5733 - DNA, 600 bp, Klebsiella pneumoniae
gaccggcgggctgtcgctggagatcctcgccaacaaggcccggtacgacgaagccgagctccgtcgccacatggcgcgactgaccgcgctgctggcgcagttcgccgccgatccgacgctgcgctgcggcgaagcagagatgctctccgccgacgagctggcccggctggcggcggtcaacgataccgctgtgccgttgcctgccaccaccctcagcgcgctggtggccgaccaggcgcggaagaccccggatgcgccggcgctggcggacgcccgctggcagttcagctatcgcgagatgcgtcagcaggtggtggcgctcgcgcagctgctgcgtcagcgcggcgtgaagcctggggacagcgtggcggtggccctgccgcgctcggtgttcctgaccctggcgctgcacggcattgtcgaagcgggggccgcctggctgccgctggacaccggctacccggacgaccgcctgcggatgatgctggaagacgcccggccgtcgctgctgatcgccacggaggatcaactggcccgcttcagcgatattccggggctggaaagtctctgctaccagcagccgctggccgccggggatga

SEQ ID NO: 5734 - DNA, 234 bp, Klebsiella pneumoniae
ccgctgagggcgccgctcaggggtaataccaccccaattttaatttctgctgcctgcgcgctgctggcgccgaccagcgcggcaaccagcgtggccattaaagacgctttcccggaaaacgatttcattggtatttctccgtcggtcgattatttatctttaaccatcaatgactgcataacattgaggaataatgcgccagcttatccggcgaattattggctgttatgttga

SEQ ID NO: 5735 - DNA, 744 bp, Klebsiella pneumoniae
ctaccgcattttaaagaaatttgtccgcatctatcagaccctgggagagacagcatgaacactcaatacctccagtacgtgcgcgagcagttgatagtagccactgcagatctgagcggagcgacgaaagggcagttggtagcgttcgcggaaaatgcgatgtttgaggcgacaccgcgcagccgaggacgcaagaaggtttatgacccccagaaaaaacgaatggtcaatccggatagcccaccgatagacggcagccagtcgcgcgctaaaggttcggcaattgcgctggtgctgcccgtggaatactcaacggcttcctggcgccgggctctgctgtcgctggaagaacatcaaaaagcgtggctgctttggaactacagcgacaatatccgctgggaacaccaggagacgatcacccggtgggcgtgggaacaattcagtcagcaactggccggcgtgcgcattgcaaagaaaacggtcgagcgtttgcgtcaacttatctggctggcggcgcaagaggttaaggctgaactgtcagggcgtgacgcatacgaataccaggtgctggcggagcttgttggtgttgcaaaatccacgtggacagaaacctatctgcctcattggctgaagatgcgcagcagctttgtgaggctagacagcgatgcgctcatctcggtaacgcgatcacgttcacaacaaaaggcgacaaatttagatgtaagtcttgcaaaaccgaactga

SEQ ID NO: 5736 - DNA, 1332 bp, Klebsiella pneumoniae
gaatggcatttgcgtcgtcgtgtgcggcacaaagaacttaaaaagaggtttggactcatgacagataaacgcaaagatggatcgggcaaattgttgtattgctctttttgcggcaaaagccagcatgaagtgcgtaagctgatcgccgggccatccgtgtatatctgcgacgaatgcgttgatttatgtaacgacatcattcgcgaagagattaaagaagtggcgccgcaccgcgagcgcagcgcgctgccgacgccgcacgagattcgccaccaccttgatgactacgtcatcggtcaggaacaggcgaagaaggtgttggcggtcgcggtatacaaccactacaagcgtctgcgcaatggcgataccagcaatggcgtagagctgggtaaaagcaacatcctgctgatcgggccgaccggttccggtaaaacgctgctggcggaaacgctggcgcgcctgctggatgtgccgtttaccatggcggacgccactaccctgaccgaagccggttatgtgggtgaggacgtcgaaaatatcattcagaaactgctgcagaagtgcgattacgacgtgcagaaagcgcagcgcggcatcgtttatatcgacgaaatcgacaaaatttcgcgtaaatccgataacccgtcgattacgcgcgacgtctcaggcgaaggcgtgcagcaggcgctgctgaagcttatcgaagggaccgttgccgccgttccgccgcagggcgggcgtaaacatccgcagcaggagttcctgcaggttgatacctccaagatcctgtttatctgcggcggcgcgttcgctggcctggacaaagtgatttcccaccgtgtggaaaccggctccggcattggttttggcgcgacggtaaaagcgaagtccgacaaagcgagcgaaggggaactgctggctcaggtcgagccggaagatctgatcaagtttggtctgatcccggagttcatcggccgtctgccggtagtggcgaccctgaacgagctgagcgaagaagccctgatccagatcctgaaagagccgaaaaacgccctgaccaagcagtatcaggcgctgtttagccttgaaggcgcagagctcgaattccgcgacgaagcgctggacgctatcgccaagaaagcgatggcgcgtaaaaccggcgcccgtggcctgcgctcaattgtggaagcggcgctgctggataccatgtatgacctgccttcgatggaagatgtcgaaaaagtggtcattgatgagtcggttatcgccggtcagagcaaaccgctgctgatctacggcaaaccggaagctcagcaggcatctggtgaataa

SEQ ID NO: 5737 - DNA, 1017 bp, Klebsiella pneumoniae
cgttgttttttcgcttttccctatgctgtacatcccggctgcgccacgctgttcgctattttcttttattcgcgcgccgcgcaggatgccgccatgagccaaccgctacccaataaaaatctgccgatgccctctttacgcaatatccaggcttttattgaagtcgccgctaccggcagccttaatctggccgcagagaatctcaatattaccgcctcggcggtcagccatcagatagccagcctggagcactttctggggaaaaaactgttctcccgcagcagcaaaggcgtcacgttaacggcggtgggagaaaaatatctcaaagaggtctccggggcgctgaatatgattggccaggccaccagccaggtgatcaacgatatccatcaggattatttacgcattcattcggcgccgagcttcggcctgctatggctgatgccccgtctggataaattccgccaggcgtggccggcgttaaaaatcagcctgacctgttcatacgaaagcatccagttctcccgggataatattgatatcgatattcgtcacgggctgtcacagtggccgacgctgctggtcagaaccattaaaaatgagcgcgtcctgccctacagcgcagcgtcttatttagccagccatcctgtgcaggctgtggaagatctgctggcctgcgatctgatccactccgacagcaccttaattaactggagcaactggctgtcgtggcacaaggtccgcggctggcataaaaacttcatttttaatttcgaccggtcatatatgagcatcgaggcggccagaatggggatgggcgtgatcctcgagagcaatctgctggccggcggacacgtgcgccaggggcagctgacgccggtatttgccgacgagcggagcatgccggtcggcgcgcaccacttcgtcctcccccacgctaatgaacagaaggagaaggtccagcgcttcttcgcctgggtcgccggagagctgaaagaggaagggttccatatttga

SEQ ID NO: 5738 - DNA, 1758 bp, Klebsiella pneumoniae
tacctattttacgtaactaatagttgtcactacgccctgcttgtaagatcatgtgccgttatacgttgtttacgctttgaggaacccgtgatgagtgaggcagaagcccgcccgactaactttatccgtcagattattgatgaagatctggctaccggtaaacataccaccgttcacactcgcttcccgccggagccgaacggttatctgcacattggccatgcaaaatccatctgcctgaacttcggcatcgcccaggattatcagggccaatgcaacctgcgtttcgatgacaccaacccggtgaaagaagatatcgaatacgttgagtcgattaaaaacgacgtgcagtggttaggtttccactggtccggggacgtatgctactcgtctgattatttcgatcagctgcatcagtatgcggttgagctgatcaacaaaggtctggcctatgttgatgaactctctcctgatgaaattcgcgaataccgcggcaccctgaaagcgccgggtaaaaacagcccgtatcgcgaccgcagcgtggaagagaacctggcgctgtttgaaaaaatgcgcagcggcggcttcgaagagggtaaagcctgcctgcgcgcgaagatcgatatggcgtcgccgtttatcgtgatgcgcgatccggtgctgtaccgcattaagttcgctgagcatcatcagactggcaacaagtggtgcatctacccgatgtacgacttcacccactgcatcagcgatgcgctggaaggcattacccactcgctgtgtaccctggagttccaggacaaccgccgcctgtacgattgggtgctggacaacatcagcatcccggtgcatccgcgtcagtacgaattctcgcgcctgaatctcgaatacaccgtgatgtccaagcgtaagctgaaccagctggtgactgagaagcacgtggaaggctgggacgacccgcgtatgccgaccatctccggtctgcgtcgtcgcggctacaccgccgaatccatccgcgagttctgcaagcgcatcggcgtgaccaagcaggacaacaccatcgagatggcgtcgctggagtcctgcattcgtgaagatctgaacgaaaacgccccgcgcgcgatggcggtgatcgatccggtgaaactggttatcgagaactatccgcagggcgaaagcgaaatggtgatgatgccgaaccatccgaacaagccggaaatgggcagtcgtgaagtgccgttcagcgccgaaatctggatcgatcgcgcggacttccgcgaagaagccaacaaacagtacaagcgtctggtgctgggtaaagaagtgcgtctgcgcaacgcctacgtcatcaaagcggaacgcgtggagaaagatgccgaaggcaatattaccaccatcttctgcacctacgatgccgacaccctgagcaaagacccggccgacggccgcaaggtcaaaggcgtgatccattgggtaagcgcggcgcatgcgctgccggtagagatccgtctctacgatcgtctgttcagcgtgccaaacccgggcgcggcggaagatttcctcgcagtgatcaacccggaatcgctggtgatcaaacaggggtacgcggagccgagcctggcgcaggccgaagccggtaaagcttaccagtttgagcgtgaaggctatttctgcctcgacagccgctatgcaaccgcaaccagtctggtgttcaaccgcaccgtcgggctgcgtgatacctgggcgaaagcgggcgaataa

SEQ ID NO: 5739 - DNA, 723 bp, Klebsiella pneumoniae
cgcattgtttattgcgaggaggtgggtgtgccggaaattaatgagtatggccagcaggtgaacgacctggtccctggctggcagggggcgcaagtcctgcggcggacggcgttaaatggccgtttttgccgcctggagccgctggacgttgaccgtcatgcggcggatctgtttgccgcctatgcgctcggcgacaaccgcgactggacgtggctggcgtctacgcggccggagagcgtggcggcgaccgcccactggatcgcgggcaaggtgaatgatgatgccctggtgccgtatgcggtggttgacctgcgtagcgagcaggcggtgggcatcgtcagctatatggcgatcgagcgggaaatgggcacggttgagatcggccatgtcacctggtcgcgacggatgaaaaacaccccgctgggtaccgaagcggtctggctgctgctcaaaaacggctttgaccatggctatcgtcggctggagtggaaatgcgattcgatgaatgtcgcctcgcgccgcgccgccgagcggctgggctttagctgggaaggacgtctgcggcagaggctggtgcgtaaagggcggacgcgcgacagcgatatgctgtccatcatcgacggcgagtggcctgcgcgcgatgcggcgctgcgggcgtggctggcggcggagaactttactgccgacggtcagcagattaagcgcctggaggcgtttcgctaa

SEQ ID NO: 5740 - DNA, 261 bp, Klebsiella pneumoniae
gtagtgtttctcgtgaaaattcgctcatttccggtccaccttaattttgctgagcgcctcaaagtgcctgcgcatagttgcctgtacttcgggatgctgccagttggtatggattccgccgtcttcgtcgatggtgaatttaccggcgttttctgtgagaacccgcttgaggcgttgttcggaactttcgattttgaacatcactcatcctccaccttgatgccagcggcggccagcgctacctttacgtcctggctgtag

SEQ ID NO: 5741 - DNA, 2457 bp, Klebsiella pneumoniae
cggcgatattacgaggataaccctatgactaccctgaagctcaacaccctcagcgcccgtatccaggcccataaaatggcgctggtgcatatcgtcaagccgccggtctgtaccgagcgcgcccgccactatacggagatgtatcagcggcatctcgataaaccgatcccggtgcgccgcgcgctggcgctggctcaccacctggcggagcgcaccatctggatcaagcacgatgagctgatcgtcggtaaccaggccagcgaagtgcgcgccgcgcctattttcccggaatacaccgtcagctggattgagaaagagatcgacgatctcgccgaccgccccggcgccggcttctcggtcagcgaggagaataaacgcgtattgcatgaagtgtgcccatggtggcgcggccagaccgtacaagaccgctgctacggtatgttcaccgatgagcaaaaggcgctgctcgccaccggcattattaaggcggaaggcaatatgacctccggggatgctcacctcgcggtcaattaccccttgctgctggagaaagggctcgacgggatgcgtgcgaaagtcgccgaacgccgctcgcgtatcaatttgacggtactggaagacctgcacggcgagcagttcctgaaagcgattgatatcgtgctggaagcggtcagcgatcacagcaaacgcttcgccgcgctggcgcgcgagatggcgacagcagaatcccgcgaatcacgccgccacgaactgctgacgattgccgaaaactgcgacgtcatcgcccatgagccgccgaaaaccttctggcaggcgctgcagctgtgctacttcattcagcttatcctgcagattgaatccaatggccattcggtatcctttggccgtatggaccagtacctctacccgtactaccgccgcgacgttgagttgcaacagtcgctggatcgcgaacaggccattgagctgctgcacagctgctggctgaagctgctggaggtcaataagatccgttccggctcgcactccaaagcctctgccggcagcccgctataccagaacgtcaccatcggcggccagaatctggtggatggtaagccgcaggacgcggtcaacccgctgtcgtatgcgatcctggaatcctgcggtcgcctgcgttctacccagccgaacctcagcgtgcgctaccacgccgggatgagcaacgacttcctcgacgcctgcgtccaggtgatccgctgcggtttcggcatgccggcgtttaacaacgatgaaatcgtcatcccggaattcattaagctgggcattgagccgcaggacgcctacgattacgcggctatcggctgtatcgaaaccgcggtcggcggtaagtggggctaccgctgcaccggcatgagctttatcaacttcgcgcgggtgatgctggcgacgctggaaggcggccgcgatgccaccagcggtcaggtattcctgccccaggagcatgccctgtcgaaaggcaacttcgctaatttcgaccaggtgctgacagactgggataaccagatccgctactacacccgtaaatccattgagattgagtatgtggtcgataccatgctggaggaaaacgtccacgatattctctgctcggcgctggtcgatgactgcatcgaacgggcgaaaagcattaagcagggcggcgcgaagtatgactgggtttccggcctgcaggtgggtatcgccaacctcggcaacagcctcgcggcggtgaaaaaactggtcttcgatcagggcgccatcggccagcaggagctggcgaaggcgctggcggaagatttcgacggtctgacccacgagcagctgcgccagcggttgatcaacggcgcgccgaagtatggtaacgatgatgacagcgtcgaccaactgctggcgcgggcctaccagacctatatcgacgagctgaagcagtatcacaacccgcgctatggccgcggcccgattggcggcaattattacgctggcacctcctctatttccgctaacgtcccgttcggcgcgcagaccatggcgacgccggatggccgtaaagcgcataccccgctggcggagggggccagcccggcctccggtaccgaccatctggggccgacggcggttatcagttcggtgggcaagctgccgaccggggcgatcctcggcggcgtgctgcttaatcagaaactgaatccgtcaacgctggagaacgagtccgataagcagaagctgatggtgctgctgcgcactttcttcgaggtgcacaaaggctggcatatccagtacaacatcgtgtcgcgcgacacgctgctggaagccaagaaacatcctgaccagtaccgcgatttagtggtccgcgtcgctggatactcggcattcttcaccgccctgtcgccggatacccaggacgatatcatcgcccgtaccgaacatacgctgtaa

SEQ ID NO: 5742 - DNA, 1656 bp, Klebsiella pneumoniae
agcatgcattatttcaaacacagcgtagcgctggcgttattcgccgccttatcgctgggcagcctgtcggcacaggcctatgagcaggataaaacctataaaattaccatcctgcacaccaacgatcaccacggccatttctggcgcaatgactacggcgaatatggcctggcggcgcagaaaacgctggtcgatggcatccgtaaagaggtggcggcggaagggggaagcgtcctgctgttatccggcggcgatattaataccggcgtaccggagtctgatttacaggatgcagagcccgattttcgcggcatgaacctgatcggctacgacgcgatggcggtgggaaaccatgaattcgataatccgctgagcgtactgcgccagcaggaaaagtgggctaagttcccgttcctgtcggccaatatttatcagaaaagcaccggcgaacggctgttcaaaccctgggcgttgtttaagcgcggtgggctgaaaatcgcggtgattggcttaaccaccgacgatacggccaagattggcaatccggaatatttcaccgatattgaattccgcaaaccggcggaagaggcgaagctggttatccaggagctgcagcagaatgaaaagccggacgtgatcctggccaccacccatatgggccattacgacaatggcaaccacggctctaatgcgccgggcgatgttgaaatggcgcggagtttacctgcgggatcgctggcgatgatcgtcggcggtcactcgcaggatccggtatgcatggcggcggaaaataaaaagcaggtcgattatgtgccaggcaccccgtgcgctccggatcgtcagaacggcatctggatcgtccaggcgcatgagtggggcaaatacgtcggccgcgccgattttgagttccgcaacggcgagatgaagctggtgcactatcagctgatcccggtcaacctgaagaaaaaagtgacttacgataacggccaaagcgagcgggtgctgtatacgccgcagatcgccgagaacccgcagatgatgtcgctgctgacgccgtttcagaacaaaggcaaggcgcagctgcaggtcaaaatcggcagcgtgaatggtcatctggagggcgaccgcagtaaagtgcgctttgtgcagaccaatatgggccacctgctgctggcggcgcaaatggcgcgcagcaacgcggatttcgcggtgatgagcggcggcgggatccgcgactccattgaggcgggggatatcacctacaaagatgtgatgaaggtccagccgttcggcaatgtgctgacctatgtcgatatgaacggcaaggaggtagtggattacctgaccgccgtcgcgcagatgaagccggattccggcgcttatccgcagtttgccaacgtcagtttcgtggccaaagacggtaagctgaacgatctgaaaatcaaaggcgaaccggtggatccggcgaagacctatcggatggcgacgctgagctttaacgccaccggcggcgatggctatccgaacatcgccgataaacccgggtatgtgaataccggctttattgatgccgaagtgctgaaagagtatatcgagaagaactcgccgctggatgccgccgcctatgagccgaaaggcgaggtgagctggcagtaa

SEQ ID NO: 5743 - DNA, 1464 bp, Klebsiella pneumoniae
cctctttgttatgcaggtctattgtctgacttgttatgcggttttcgtgcggatcaggtagtcgaaagcgctcagcgacgcttttgccccttcccctgccgcgataataatctgtttgtacggcacggtggtgcaatcgcccgcggcgaacacgcctttgacgttggtttcgcacttcgcatcgatgatgatctcacccatgcggttgcgctcaacggcgccttccagccaggtggtgttaggcagcaggccaatctggacgaagatccccgccagcgcgacatgatgctcatcgccgctcacccggtcacgatactgcagaccggtgactttgctgccatcgcctttcacttccgtggtctgcgcattaagaatgatgtcgacattcttcaggctgcggactttatcctgcaacacctggtcggctttcatctctggggcaaactccagcagggttacgtgctctacgacgcccgccaggtcaatggcggcttccacgccggagttcccgccgccgattaccgctacgcgtttgcccttaaacagcggaccatcgcagtgaaggcagtaggtcacgcccttggtgcgatactgatcttcgccccggcacgttcatattgcgccatttcgcccccggtggcgatgatgacgctacgcgccttgagcaccgcgccccgaagcggtttcgatctgatgcaggccgccctctgtcgccgccggcgtcagtttggtcgcactctgggagtcgatcacgtcgacgttatagtcattgacgtgcgctttcagcgcgcctgccagcttctggccttcggttttcggcaccgaaatatagttttcgatatccacggtatccagcacctgaccgccgaagcgttcgcccatcaggccggtaagaatccctttacgtgcagagtagaccgcccccgccgcgccggacgggccggagccaacgatcagtacatcgtaagcgtcacgctgattcagctcttccgctgcgcgtttttccgcaccggtatccactttggcgacgatttcagtcagcgtcatccgtccctgaccaaactcctgaccgttcatgaacaccgctggcacgcccatgacgttacgctcggtgatctcattctggaaggtcccgccgtcaatcgccgtgtgtttgatgcgcgggttgagcaccgccatcaggttcagggcctggaccacgtccgggcagttatgacaggagagcgaatagtaggtttcgaattcgaaatcgccatcaatatcgcggatctgctccagcagcgactgggcctctttcgacggatgaccgccggtccacagcagcgccagcaccagcgaggtaaactcgtggcccagcggcgagcccgcaaaacgcggcccctggtcggaacctgggttagtaatcaggaacgagggcttacgtaccgcgagcgtgttgtcttctttaaaggtgactttgtctga

SEQ ID NO: 5744 - DNA, 858 bp, Klebsiella pneumoniae
ttagaatgttactggtcgaagttaagccaggagcactctcttatgaccgttaaagttatcgtcaccgatatggacggaacttttctcaatgacgccaagcagtacgaccgcccgcgtttcctcgcccagtttgcgcagctcaggcagcaaggtattgaattcgttgtcgccagcggcaaccagtactatcagctgatctccttcttcccggagattcgcgagcagatttcattcgtcgcagaaaacggcgctctggtttatgaacatggcaagcagctgttccacggcgaactgacccgccacgaatcacaagtggtgattggcgaattgctcaaagatccgcagctcaactttgtcgcctgcggcctgcagagcgcctacgtcagcgataaagctccggacgcctttgttgagctgatgtcgaagcactaccatcgcctacagcgggtgagcgactatcacgccatcgacgatacgctgtttaaattctctctcaacctgccggacagcgagatcccacagctgattgataaactgcacgtgtcgctcgacggcatcatgaagccggtcaccagcggctttggctttgtcgatttgattatccctggcctgcataaagccaacggcatcagccgtttgctcaagcgctgggatctttcgccgcagcaatgcgtcgccatcggcgacagcggcaacgacgccgaaatgctgaagctggtgaaatacgctttcgccatgggtaacgctgccgacagcatcaaggccatcgccggctacgctaccgacgataataaccatgacggcgcgctgaacgttatccaggccgtcctcgataacaccccgcccttcaacgcctga

SEQ ID NO: 5745 - DNA, 780 bp, Klebsiella pneumoniae
aggagtattctgtatattctcaggggtactgtaggaaatcttggcttagatatggacaatattgagatagcaaccctcttacccggggctacattgtttagtgatagcaacataaaccagacgtggaaagcccatgtcagaacagcaacgaatacggttgtagtgtttgcgaagatcattgatccccgggaaatttgcgtggaagcattctgcgctattcttggtagagagctaggaataccaattcctaagcccttcctcgttctcgcagataacactacgttggatgttatcccaccagggcagcatgcactgatgtatggttctgaagatgcggattatcctagttttcggcggtacgccgattgcagtcaagcatacgaaaaactacagaattttaaagcatccctagatgttggcgttttcgatgaatggattgccaatcatgacagaaatgttggtaacattctttatgatggatgtgatgattttttattcattgaccatgggctcgcgctcccagaagggctgcctgctagcgaaccggcaatcgataacaatatcttgagagctctattctcattcaaatccgaattagaaaaattccgcgatttacgaaccgcctcacagatgattacccccatgtatcgagctttaaatttggaagatgtaatgtctagcgctcaggcaacaatgtatgttccccgatgcggtgatcgctcaaattttagcttttctaaccgagagattgtcatcaatcgagactctgataagatctag

SEQ ID NO: 5746 - DNA, 1086 bp, Klebsiella pneumoniae
agagacattctatgtctgcaaaccgtcacagggggccgggcaatgctaacgcaaaccaccgcgctggccccggacggtcagccatggcagcaggtgaccctgcgcaataagtcggggatgaccgtcaccgtggcggactggggcgcgacgctgctcagcgccgaggtgccattggccgatggcagcctgcgccgaccgctgctgggctgcgcaaagctggaagactatgctcgccaggccgcatttcttggcgcctcggtaggccgctacgccaaccgtatcggccacagccgcttctcgcttgacggccaggtcgtcaacgtcacgccgtcaaacgacgcgggccaccagctccacggcggcccggaaggatttgataagcgccgctggcgcattgtccgcgccgacgagcaggaagtgctgttcgccctgacctcgcccgatggcgatcaaggctttccgggcaccctgcaggccaccgcgcactatcgtctgagcgacgataaccgcatcgcgattacctatcgcgccaccgtggaccaaccctgcccggtgaatatgaccaatcacgtctatttcaacctcgacggtgagcagggcgatgtgcgccagcatcagctccagatcctcgcccagaggtatctgccagtggaaagcgacggtatcccgggtggcgaactgaaagatgttgctaacaccagctttgatttccgccagccgaaaaccatcgccgccgacttcctcgcggatgccgatcagcaaaaggtgaagggatacgatcatgccttcctgctggatgccaaaggcgacgccagccagcctgcggcacaggtctggtcgcaggatggcaagctgcagatgacggtctatacctccgctccggcgctgcagttttactccggcaactatctcggcggcaccccgtcgcagacgacggagccctacgccgactggcagggactggcgctggagagcgaattcctgccggattcgccgaaccatccgcaatggccgcagccggactgtgtattacgtccgggccaggagtacgtcagcctgacggaatatcagtttatcgcccgataa

SEQ ID NO: 5747 - DNA, 1365 bp, Klebsiella pneumoniae
ccacagcgctatcgcccccagcaacagcatcatggccacctcgaccagcagaaaatcaatcagcgcctgcggatagtttccgccgccgcgacgggccagcgccaggaacagcgaaccaaggatagccggtccgagaccgagggtcgcctgctgcagggtgctgaggattgcgctcccggccccggcgtcgctggcgctgatatcgcgcataccaatccgataaaagctgttgacgatcagcgcctggccatagccgatcagcgccgtggcgggaaccagcgtcagggcgttggtggcgacgccgaagcgggagaaggtggcgcacagcagcaggagaccggcgatctgcaccgccagaccggtcagcaggatccgccccatgctgtagcgggcgataagccgcggggcatacagcgccgaaataaaataggccacgccgagggcgataaagctattgccggactgccacggcgccatccccagcccctcctgcatggtcagcgccatgcagaacataaagccggaccaggcgctgaaaaacagcagggcgatggccatcccgaagcggatgctggtcaactgcagcagacgcggcggcagcagaggatggtcgccacgctgctgctggcgcagggcgctctgacgcatggcgaacagcagcggcaggaccgccaccagcatcagctgcagccacagcggccagtgcagctccggaccgagggccatcgggaacagcaggcagcagaggatcagcgcgaggtacagcgtaccctgccagtcaatccgcgacggcgtctcgcgacgggtttccggcacatagcggcggctcagagccagcaccagcaggcagatcggcacattgataaaaaaggcgttgcgccagcccagcccggcgatgtccgccgacaccagccagccgccgcccatctgaccgacgataaaggcgatcccgccgatcccgccatacaggctgatggcccgggcgtgggcggggcctttgagggtgacgtgcagggtcgcgaggatctgcggcacaatcagcgccgccccggcgccctgcagggtgcgggccgccagcagggcgccgatgctgttcgccatcccgcacagcagggaagcgatgccaaagagggcgacgccccacataaacaggcgccggcggccatagttatcgccaagcttactgcccatcgccaggcagacggcaaaggcgacgccgtacagagcgacgataagctccagctgcgtggcgctggccgccagggtgtgggtgatggcgtccagcgccacattggtgatcgaggtatcaataagcggcagcatctggccgctcagcagcagcaacagaccggcgcggccgggtga

SEQ ID NO: 5748 - DNA, 1368 bp, Klebsiella pneumoniae
cgctgtggctacgccatcatctcaaccgacaaccggcgacggtggcctcgtaataccggcggcggtaatttgcataatagctatccagcggtcatcatacccgctggatattcaggagacgttatgcaggaattaatatcgcaaattgccgccttaggaatcgaaataacccccacccgctcgctgatgattatcttcggcattatcttgttcaccgccgtggtcgtgcatctgatattgcacaaagtggtcctgcgcgcatttgaaaaacgggcgctggccagcagccatctgtggctgcaaatcatcacgcagaataagctctttcaccgactggcctttaccctgcaggggatcatcgtcaacgtccaggcggtgctgtggctgcaaaaaggcagcgaggccgcggaaatattaaccaccgtggctcagctatgggtgatgatatatgccatgctgtccttcttctcgctgctggatgtcattttaaaactggcgcagaaatttcccgcagcctctcagctgccgctgaagggcatattccagggaattaagctggtgacggcgattattatcggcattctgattatttcgctactgataggtcagtcaccggcgatcctgattagcgggctcggcgccatggccgcggtgctgatgctggtgtttaaagatccgatcctcggtctggtggccggtatccagctctctgccaacgatatgctcaagcttggcgactggctggagatgccgaagtacggcgccgacggcgcggtgatcgatatcggcctcaccacggtcaaggtgcgcaattgggacaataccatcaccaccattccgacctggtcgctggtctctgactcgtttaaaaactggagcggcatgtcggcctccggcggccgccgcatcaaacgcagccttaacatcgacaccaccagcattcatttcctcgatgaacaggagcagcagcgcctgatccgggcgaagttacttaaaccctatatggattcacgccacgaggagattagcgcctggaaccagcagtacgccggggagcaatcgatcctcaacgagcggcggatgaccaacgtcggcaccttccgcgcctatctgcaggagtatttacgccatcatccgcgcatccgccaggatatgaccctgatggtgcgccagctggcgccggatgccaacggcttgccgatcgagatctactgcttcaccaacaccgtggtatgggcggaatatgaggggatccaggcggatattttcgaccatgtattcgctgtggtggatgagtttggcttacgcattcatcaaacgcccaccggcaacgatattcgcgcgctgaccggcgccttctcccgctga

SEQ ID NO: 5749 - DNA, 753 bp, Klebsiella pneumoniae
cataatctatattccaaatcattccgaatgccgccatgcggcaaccgaatgccttaccggtggcaaaggtgccgcgcgcggccagacagcatgccattcggccaccgaggcgccgttcagcgcaacatcagtgtttccacctgcccgctcgtatttaaaggatgtcgttttatgaattttctcgcccacctgcacctggcccatctcgccgacagttcgttgcccggcaacctgatggccgacttcgtgcgcggcaacccgcagggcgactatccggcggagatcatcgacggcatctttatgcatcggcggattgacgtgatgactgacaacctggcggaagtcaaagaggcgcgggagtggtttcgcccgcagacccgccgcgtcgcccccatcaccctcgacgtcatgtgggatcatttcctgtcccagcactgggcgcagctctcccctgacctgccgctggacgagttcgtacgctacgccgagcggcagatcgtccccatcctgcccgactcgccgccccgcttcgtcaatctcaatcaatatctgtggtcggagcgctggctggagcgctatcgggaaatggattttattcagcgcgtgctgaacggcatggccagccgccgtccacgtctcgaggcgctacgcgactcctggcaggatctggatacccattacgaccgtctggagacgcagttctggcgcttttatccgcagatgatgcgcctggcagaaaacaaacagctgtaa

SEQ ID NO: 5750 - DNA, 279 bp, Klebsiella pneumoniae
  unsure (96),(254): Identity of nucleotide at the above locations are unknown.
tgcccggtatacgtccgcacccggggggcttttcgctgggcttttagtctcgctactgccattttcggcgacctgacgccagctatttccaccgcnctggtcgagctcagcggcgataaaagcgcgccgggctggtggctaatgtgcgccgcgctgtgcggattcattgccaccgcgctactgttcgtgcggctgagccgcggctatcagccggcggagagtcagcgcaaaaaacaaacgggcggagatatgcnccgcccgtttgccgctgtcgtctga

SEQ ID NO: 5751 - DNA, 1008 bp, Klebsiella pneumoniae
tgccggaaatactgcacctataacaactcaggggaagcagacattatggcattcacatcgcgaattactcttctggcggcgctggctgttgccgccttccaggcgcaggcggtcaacgttaccgtggcgtatcaaacctccgctgagccggcgaaagtcgcccaggcggacaacaccttcgccaaaaccagcggggcgaccgtcgactggcggaaatttgacagcggcgccagcgtggtacgcgccctggcctccggcgatgtgcagatcggtaatattggctccagcccgttggcggtggccgccagccagcaggtgccgattgaagtgttcctgcttgcctcaaagctcggcaactccgaagcgctggtggtgaagaaaagcattaccaaaccggaagatctgatcggcaagcgcatcgccgtgccgtttatctccaccacccactacagcctgctgtcggcgctcaaacactggggcatcaagccgggccaggtacagattattaacctgcagccgccggcgattatcgccgcctggcagcgcggggatatcgatggcgcttacgtctgggcgccagcggttaacgaactggaaaaagagggcaaggtgctgaccgattcttctcaggttggggagtggggcgcgccgacccttgacgtctgggtggtccgtaaggacttcgccgagcagcatccggagatcgtcaaagcgtttgctaaaagcgccatcgacgcccagcagccctacatcgccaacccggaggcatggctaaaacagccggacaacatcagcaagctggcgcgcctgagcggcgtgccggaagccgatgtccccgggctggtgaagggcaatacctatctcaccgccgctgagcaggcgcaggcgctgaacgggccggtcaatcaggccatcgtcgataccgcgcgcttcctgaaagagcagggcaaagtgcctgcggcgggaaccgattatcgtcagtacgttactgaccgctttgtgaagtaa

SEQ ID NO: 5752 - DNA, 390 bp, Klebsiella pneumoniae
atgaggaaatatatgatggaaaaatgcattcgtgccgctacagtccaattttgtcaccgggccgatgacaagcagtacaatttatcggtcatagaaaatttcattattcaggctcatcgagaaaatgtgcagctccttgtatttccagaaatgtgcattactggatattggcatgtaccaaatctcacaactgaaactttaaatgacctggcagaacgagttgaagacagtccatcgttgtccagaattgtcactaatgccgtaaattatcatatggccataggtgtaggtttcatagagaagggaagcgacgatatattatataattcttacgcagtctgtatgccggacggtaagagtcttctccacagagcgagatccggagtaata

SEQ ID NO: 5753 - DNA, 444 bp, Klebsiella pneumoniae
aaatgccctctttgcgtcgctcctccgggaccagcgccaggccgcgccccaccgagtcggctggatcgcgcggtcgccacggctggccgttcagctcgccccgctgcacccggcttttgctggcgccgaacagcgctttgcacagctcggttttgcccgcgccggccagcccggcgataccaagaatttcccccttccgcaggcgcagcgaaatatcctgcagcagcgcctcatcatgcagaccgtcaacctgcagcagcacctcttcgccgtgcggcgggcgcggcggcgggaagatatcgctcagctcgtggcccagcatcttttcgacgatctgttcgccgctcagcggcgccatcgggccgctctcaatcagccgcccgtcgcgcagcaccgtcagggtgtcgcagatcgccttcagctcatggatacgatgcgaaataa

SEQ ID NO: 5754 - DNA, 267 bp, Klebsiella pneumoniae
cacgatggatataaagcaagggctatgccagaaatgaaaaaaggccgcaaagcggccctttgttggcaaaaaacaggggacaggtcaggcaatatcctgcgcaacggcgcctggcgcgcaaaaatgcaccacaacagtgcatttgatgtaacgtttttgcaccatggcaggccgcccagcgttccctgcctgctggtggtgcatcaggcgctgagcgactcctctctggcgctggccgccagctcttcgccggccagctgcagctga

SEQ ID NO: 5755 - DNA, 756 bp, Klebsiella pneumoniae
acacatatgtacttctctaaagagacgctggcgactaactcccgccttggcggccactggaacgaactgtgggctaaccgcaacatgtggaatgccaaccacgatgccatgattgccgccaaccgtgcgcacatgacgcctgactggctggctgccaatgccgccggcggtttcacccgagatttctgggctgagattgaccgacaggtgctacaactgcgcgatcaggaagtcgggatggaaatcatcaacgacctggtcggcgtgcagaccgtcctgtctgtcggtaagacggccaagctttacagcgtcgttggcgatatcgctgacgatgtatctgtgagcattgacggccaggcgccgttctcgttcgaccacaccgagtatgccagcgatggcgatccgatcccggtgttcacggctggctacggcgtcaactggcgtcatgccgcaggcctgagcaccgttggtatcgacctggtgctggactcgcagatggcgaagatgcgcaaattcaacaaagagcgcgtcaattactacctgaacggcaacccgaacatccaggtgcagtcatacccggcacagggaatcaaaaaccaccgcaacaccaaaaaactgaatctcggctctggtgcgggtggtgcaaacatcgatctgaccactgccgatatgaccgctctgtttgcgtttttcggaaaaggcgcgttcggctctctggcccgcacaaacaaagttgctcagtaccatgtgatgtga

SEQ ID NO: 5756 - DNA, 426 bp, Klebsiella pneumoniae
ccgcacgcgtatcctgtgcctgagcctgttctggcacttcctggacgtcgtgtggatctgcgtgttctcggttgtctatctgatgggggcgatgtaatgagtcattctaccgatcatagcggcgcttctcacggcagcgtgaagagctacatgacaggatttatcctgtccatcatcctgacggtcattccgttcgccatggtgatgagtggctccgcctcgcatgcggttatccttggcaccattctggtgaccgctgtggtgcagatcgtggtacacctcgtgtacttcctgcatatgaacagcaagtccgatgaaggttggaacctgaccgcatttatcttcaccgtaatcatcattgcgatcgtggttgtcggctccatctggattatgtggaacctgaactacaacatgatgatgcactaa

SEQ ID NO: 5757 - DNA, 1260 bp, Klebsiella pneumoniae
accatggcgtatgtgaatcatctactgacgtttattgagagtaatccggcgctggcggtggggtttaatcttattctgctgctgctctccggcatatttgcccatcttttatgcaagttcttgctgattaaagtggtgcgtaaggtcttctttagtagccacaaacaggatgtgccgctggagaaggatcgacgcatcgccgaaaagctgtccaatttcattccggttattatcgtctattacgttctgcagtttatgccggcgatgccggcatcgctggtgacggcgattaatactatctgcgggatcttgttttttatttttatgtcggtgtttttcaacgagatgctggatattgtcaacagctcctatctgcgaaagaccaaacgtaaaaatcattccattaagggctatatccagataggcaaaatcttagtccacatcctggcggcgattatgatcctcgccgtgatgtcgaacaaatcgccgatcattattatctccagtctgggggccgtggcggcggtactgatgatcgtgttccagcatactctgctgtcgctggtggcgaacgttcagctgtcgtccaacgacgtgctccagctgggggactggattgaaatgcctgacaagaacctcagcggtgaggtgacggatatcgcgctgcacaccattaccatccgcaactgggacaataccatctcccgtatcccgaccaagaatttcctcaccgagacctataccaactggcaggcgatgttctcctccggggcgcggcggatcatgcgcagtatcgccatcgatcaacactcggtgcgttttctcgaccaggagatgctctcctcgatgctgaccatccgcggggtgagtgagcctctggcgacgctgcttgacggccgggatcccggcggcgtggccgaccgctggtttgtcgataacgggctgaccaacctgaccctgtttcgccactatctgatgcactatctcgccgagcggccggatattattaaggagatgtacattgtggcgagaacgctgaaaccttcgccgtcgggcatcccgctggagatttactgcttcaccacctcaacgctatggaaagactacgaaaacacccagtcggcgatatttgagtacattactgcggtggccggacagttttccctgcgcctctatcagtatcccgccgggcacgatttctggcgtctctcccaggagcacgccgcccggacgggcctgccgccgtcggccgaaggctaa

SEQ ID NO: 5758 - DNA, 1101 bp, Klebsiella pneumoniae
accatggctctgtttgcaactgaaacctggaccatgcgccaccggctgctgctgaccatcggcgccatcctggtggtctgccagctgataagcgtcttctggctatggcatgagagcaaagagcagatccagctgctggtggccagcgccatcgaagggcacaacaaccagaaacatgtggagcatgaggtacgggaagcggttgccagcctgctggtgccgagcctgctgatcgttggcctggcgctgtatatcagcatgctggcggtgcgcaagatcacccgcccgctttcacgtctgcaaagcgaactggagaaccgcacgccggacaacctcacccctatcgtactcagcgaatcggtgcccgaagtcacggcggtgaccaccgccctgaatcagttggtttcccgcctcaatctgaccctcgaccgcgagcggctgtttaccgccgacgtggcgcatgagctacgcaccccgctggccgggctgcggctgcaccttgagctgctggcgaaagtgcatggcgtgggcgtcgacccgctgatccagcgtctcgatcagatgaccaccagcatttcccagctgctgcagctggcgcgcgtcggccagtccttctccgccggcagctaccagcaggtgctgttgctggatgacgtggtaaaacccctgcaggacgaactggaggctatgctggcgcagcgtcagcagcggctgctgctgacggatatcgaaaacgagaccgtcgtctctggcgatgcgacgttaatccgcgtgatcctgcgcaatctggtggagaatgctcaccgctacagccctgaagggtcgacgatccgcgtgtcggtgaaagcaggcctgatgccggtgatggcggtggaagatgaagggccggggatcgatgaggcgaaaagcggcgaactcagtaaagccttcgtgcgcatggacagtcgctacggcggcattggcctcggactgagcatcgtcacgcgcatcgctcagctgcatgacgcccagttttttttgcataaccgacagccagggccaggggtccgcgcgtgggtgctattcccgcagcgcgggggtcagaacgtcagcacccattga

SEQ ID NO: 5759 - DNA, 417 bp, Klebsiella pneumoniae
acgggtaagtatagaagccgctggcggaaggggagggaagaggattctggaaaagcggctctcatcgtgggagagagagccgttgcgggtcaggcgacgtgttgcaggaattcacgcaggcgcgggctgggcgggttcttcaccagctcctggggattgccgtcttcagcaattcgtcctttgtcgataaagattagtcgcgaggccactttttcggcaaagccgatttcgtgggtcacaatcaccatcgtcatgccctcttccgccaggtcctgcatcaccttgagcacttcatggcgcagctccgggtcgagcgcggaggtcggttcatcaaacagcatcatcttcggcttcaccgccagcgcgcgggcgatggccacacgctgttgctggccgccggagagttcggacggatag

SEQ ID NO: 5760 - DNA, 651 bp, Klebsiella pneumoniae
ttaagaaggtatttaatgtctattcgtgaactgctcgatcccactaattccgcgcttatctttattgaccatcagccgcaaatgtcctttggcgtggcgaatatcgatcgccagaccctgaaaaataacaccgtggcgctggcgaaagcgggcaaaatttttaatgtaccggtgatttatacctccgtagagaccaaaagctttagcggctatatctggccggaattattggccgtgcatcctgacgtcaagccgattgaacgtacctccatgaactcctgggaagacgatgcgtttgtggcagcggtgaaagcgaccggccgtaaaaagctggtgatctccgctctgtggaccgaagtctgcctgactttcccggcgttgatggcgctggaggcgggctacgaggtctatgtagtgacggatacctccggcggcacctctgtcgacgcccatgagcggtctattgaccggatggtgcaggcgggggcggtgccggtgacctggcagcaggtgctgctggagtaccagcgcgactggtcgcgcaaagcgacctacgatgcggtaatggacctggtgcgcgaacacagcggcgcctacgggatgggcgtggattacgcttataccatggtgcatggcgcgccggaggcgtaa

SEQ ID NO: 5761 - DNA, 444 bp, Klebsiella pneumoniae
aaggattatctcatgtataaaaatatcgttgttcccgttgacgtgtttgatgcgggcctggccgacaaagcgctctctcatgcgaaattcctcgcccaacattctgccgggcaaattcatcttatccatgttattccggccttttctcctgtattaacccgcggatttatctctgatgcccgaaagatggaagaccatttgcttaataccgctaaggaaaagctgagcgagctggtgaagaaaaatgggcttgcggaagacgccagccatctttatgtgcgcagtggcaatgttcgcgatcaagtgattgccctggccgatgagctgaaagcggatgtggtgattgtcggttcgcgcaatccgggtatccagactcatctgctgggctcggaagcggccaatatcgtgcgctatgcccatgtaccagtgttcgttgtgcgctga

SEQ ID NO: 5762 - DNA, 1239 bp, Klebsiella pneumoniae
cccatggattttaccgccggactgatgccgctcgacacagccctcgcccagatgctcgatcgtattacgccgctgaacgcgacggaaactgtaccgctgttgcaggccttctcgcgtgtgaccgcccatgacatcgtctccccgctggatgtgcccggctttgataacgcggcgatggatggctatgccgtccggctgaacgaccttcgcgacggcgcggcgctgccggtcgccggtaaggccttcgccggccagccgttcaacgacgcctggccgtcggggacctgtatccgcatcatgaccggcgcgccggtgccggaaggctgcgatgcggtggtgatgcaggaagagactgaacagaccgaggccggcgtgcgctttatcgcgccggtaaaagccgggcagcatattcgccgccgcggagaagatattgcccacggcgcggtggtcttcccggcggggacacccctgacggtggccgagctgccggtgctggcctcgctgggcattgccgaggtcgaggtggtgcgcaaggtacgcgtcgcggtcttctcaaccggcgatgagctgcagctgccgggtcaaccgctcggcgacggccagatttacgataccaaccgcctggcagtgcacctgatgctgcagcagttgggctacgaggtcattaacctcggcattattcctgacgacccggcgaagctgcgtgacgcttttatcgacgccgaccagcaggccgatgtggtcattagctcaggcggcgtctcggtgggcgaagccgattacaccaaaactatcctcgaagagctgggggagatcggcttctggaagctggcgattaagccggggaaacccttcgccttcggcaagctcagcagcagctggttctgcggcctgccgggtaacccggtgtctgccaccgtcaccttctgtcagctggtgcaacccctgctggcgaaactctcgggcaagcacggcccgcttcaggcgccccgcctgcgggtccgcgccgccacgcgcctgaaaaagtcgcctggccgcctcgattttcagcgcggtattctgcagcgtaacccggacggcgaactggtggtgaacaccaccggccatcagggctcgcacattttcagctccttcagcctcggcaactgctttatcgtgctggagcgtgagcgcggccatgttgaagcaggtgaatgggtcgaggtcgaacccttcagtcacctgtttggggggctgtaa

SEQ ID NO: 5763 - DNA, 903 bp, Klebsiella pneumoniae
gctatgcatctctcaaacggacatgtttcaatgacatttgacatctcactgttcccagctaaaccaacctacgcaggtaagtggtggtcagtgtcctttgagcccatcatcggttcaggcgaacgaattaatgcaatcattgtggctcggggagttgatggtaagcatgaaatcatacagtccatcagagatgaggttctcgattcaatctacgggacgaaatcagaatcaatcaaatcaatggtatcttgggtgagaagctctctccattctcacctagaatcccacattaacttagaacattgggcaccaccgatttctggtttcgcaatttcaaaaaattcagacgctctcgacgatagcttatcagggatcttaaggcaggctgtcaggctaacagcgagcctaggtactttaacccttgaggcagaacgcttagaagatgatgacagatctagtcagaagcagtctgagcaatggtcaaccagaatatctgacgaagccagaaagctaaacccgaagctttcagattattttggtacccgagtccagctatcaagtgcgcagttgcacacgcgctttgggttttataatgatatctatgcgtctaattttgggttaatggtacctagtcgtttatcggcatcgattaactctattaaagcaaaagtgtatgatttagaatcactttctcgctccagtatggttttaaagccaaagactcttgacgttatcgtcggtattccttcattcgacgatccaacgatcccacctaaaaccgttgcaagcatgcgtggttatgttaatgaactcaccgagttagccttaaaggaagatattaatttcattcctgtaaacagtgcattcgaagccgctcaaagaattattaaaatagcagcctga

SEQ ID NO: 5764 - DNA, 1824 bp, Klebsiella pneumoniae
aaatccaatcttagccatttttttgtactatacattgctcagaattgggagattatacatatgccgcaactttacagctatatccgttggtcctcggaacggcagcaaaaagggacgaccagacaacgccaggtcatcggtgcgaaggagtttgctatagctaatgggttagaacttgttgaaattgaagatcctggtgttagtgcctttcgtggtaagaacaccacccacggtaaactgggggatttcattgatgctgtgaggcagggagctataccaccggattcgtggctatatgttgaaaacttagatcgactcactagacaagaagttaccacagctcagaagctgtttattgaattgttggatttggggttaacgttggttacagggatggataaacgggtttatacccttgagtctgtgaacaaaaatccaaccgatttgatgatttcgcttttactgtttagtcgagcaaatgaagagagtaaaaccaagcaagctcgcacgataggtaatgttgaatcgttgatcgaacgtcatcgccaaggattgccggtgaacattaaatcatgtggtaaacacccattttggatagatgattctggttcacagtatgaatccgttaagcgtcatacaatttattgggagatagcacgagaagcgattgaattgtttttatcaggatatggtatttacaaagtgaagcgctttcttgatgaaaagtatcctaacggcctgaatggtaaagaatggggctatcaagtactcaaaaagatgcgtgagagtagagccctcattggagaaaggcaaattaacataggctcacatacatatacattacgtgattactatccctgtctatgtaaaaacgaggttgaattcctgcatttacaagagttaaagggacaaaacagctacaaatcgaagaaaaaccccttaaaggaacaaatcaagttattgtccggtctggcaatccttagatgtagtaagtgtggtgggactatgtctagtttcatgaataaaggtaaaccaagatatatctgtcttaatggtcgacatttacaaaaaggttgtgttggttggtcgcttactgctcccttagttgatcattgtgtcattattgccttacttatgggttatatggatgcaaaccgtaaggaaaggcaagatacatcagatatttccgcattgattgaagcgaaaaatacgagcgttggagaattgaatgtaagtattacgaaccttgttgcggttattgaagctggtgtgaatgtatctgagctagcaagtaggttaaaggttctatcaacagagcgtgagacatttctgaaagaaattgagcgattaaaggaacgaaaagcattaattgatagcaaaggatcgtttgaagtatcaatgatggatttcattaatctgatacattggaatgtattatcagactatgcacatgaatcacgtgataagattcgctcgacaatcaataaaattattgaacatgtaattattgataaaactgatggctgtataacaatcaagattaaatgtcgtggttcagatgaacaattgattttttgtggtattgggcgcaaacctcactggaagtttgatattgcgttatatgttgaacaagacactgatggagatacaaccttcgaagaaaaatctattttgccaatggcaaaccagttgatggaagaggctacaaagcagtttgcattgataagagaaggctacattagctactttgacaaaatatgtaaaattttagctgcaattggttatccagatattgatggttcagccttctggcctaatagatag

SEQ ID NO: 5765 - DNA, 357 bp, Klebsiella pneumoniae
tcggcctttcaaacaccaccagaggaagtatcacagatggagaatgcaatagcccgaaagttagagccgccaatcctcaacccaattgagattgaaggcattttgttaaaccggcttttatccattggccaaaaggtttttgcggaaatgcggggagttagcgagtcgacaatcagtcgccgcaagtcggaggggtattacgccgagatggcgaaggaaatatcagcgttgggtctacaggttgttccgccagaggcggtggtagtttcccgccactacctgcagtcagtagagacgctggcagatattggtttacgtgcggagcggtgccgtcctggtccgcttgggtgggactga

SEQ ID NO: 5766 - DNA, 486 bp, Klebsiella pneumoniae
actactcttcagtttaactacctgtcaggacgcgctatgcattgccctttctgtttcgccgtggataccaaagtgatcgactctcgtctggtgggggaaggctcttccgtgcgtcgccgtcggcagtgcctggtctgtaacgaacgctttaccaccttcgaagtggcggagctggtgatgccgcgggtggtgaagagtaacgatgtgcgcgaacccttcaacgaagacaagctgcgcagcgggatgctgaaagcgctggagaaacgtccggttagcgccgacgacgtggaaatggcggtcaaccatatcaagactcatctgcgcggcaccggcgagcgcgaagtggccagcaaaatgatcggcaacctggtgatggagcagctgaaaaagctggataaagtcgcctatattcgcttcgcgtcggtctatcgcagcttcgaagatattaaagaattcggcgaagagatcgcccgcttacaggactaa

SEQ ID NO: 5767 - DNA, 546 bp, Klebsiella pneumoniae
aatagccttcaggctgagcctgccgcgcctggtccgccgggcgcggcaggctcattgcagaattcgaggaccaagatgacagaaatacaacgcctgctgattcacaccattgacgaactcaacgtccaggaaaaacgcgataatcgcccgcgttttagcatcagttttatccgcaaccatccgggactgtttgttgccatgtatgccgcgtttctggcgacgctggtggtcatgctgcgctctgaaacgctggtagactcggtctggttgctggtggtgctgttcattctgttcaacgcctttttcttctttgacgtctatccacgctatcgctacgaggatatcgatgtcctcgactttcgcgtgtgctacaacggggaatggtacaacacccgctttgtcccccagcagctgatcgaccgtatcctgcagtcgccagacgtcgatagcgagcagaaggcgcagctcaaaaagatggtcgccaccaaaggcgagctctccttctacgacgtctttaccctcacgcgcgccggtgctgcgcaataa

SEQ ID NO: 5768 - DNA, 1287 bp, Klebsiella pneumoniae
cgtttcattcatcgccatggccagcggtcgcgtcgccaggttccagacgaactcctttgtttcgacgatatttcgcacgctgtcttttcagccgctgctggcgaaaccaatgatcggcggccgatagttaaagcagttaaaaaagctgtatggcgccagattacgctggccctcggcgtcctgcgaggcgatccagcctatcgggcgaggcccgattatcgcgttcagcgggtcatgcggcaggccgtggccctgcgaaggttgataaaagtacatgctgcacctgtcacggataatggagatatccagactcccttatttaccgcgccgccgtcaacgggtatcttacgcggctgttcaaaggagattgtcatgaaagcccagaaaccggggttacacccgcgtaaccgccaccatcaacgctacgacctgcccgcgctctgccaggcccatcctgacctgcagggctacattacgctcaatccgctgggtgagcagaccattgattttgccaatccgcaggcggtgaaggcgttgaataaagcgctgctggcgcatttctacgcggtcaaacactgggacattcctgacggctttctctgtccgccagtgcctgggcgggccgactatattcatcatctggcggatctgctggccggggatagcggcgaggtgccgaaggatgccacgatccttgatattggcaccggcgctaacctcatctatcccctgatcggcgctcacgagtatggctggcgctttaccggcagtgaaatcaacccgcaggcgttcgccagcgcgcaggcgattatcaatggcaacccgggcttgacccggcagatccgcctgcgccggcaaaaagagagccaggctatctttcacggcgtgatccataaaaacgagacctacgacgccacgctgtgtaatccgccgttccatgactccgcagagagcgcccgggcggggggcgagcgcaagcgccgcaacctcggactcggcgccgaaagtggcctcaattttggcggtcagcagcaggagctgtggtgcgaagggggcgaagtagcctttatctcgcagatgatccgcgaaagccaggccttcgcccgccaggtgaaatggtttacctcgctggtgtcgcgcggcgataatctgccgccgctctaccgcctgctgaccgaggtcggcgcagtgaaagtggtgaaaaaggagatggcccaggggcaaaagcaaagtcgctttatcgcctggagctttatggacgacgccaaacgccgtcgtccattctaa

SEQ ID NO: 5769 - DNA, 225 bp, Klebsiella pneumoniae
aaattttctcatcggcgggatggcgtcagtccaccgaatgcgattgccgccgccgaggtggggctctccttttttgactggatgaagtgcggtttcccggcaatgatcgttttactgcttgtcgctattgcgattctttacctcttattcaggccagaacttaagggaacctttgaaatgaatagtgaacaggtcgattgggataaaggcaaagatgatgcatag

SEQ ID NO: 5770 - DNA, 1098 bp, Klebsiella pneumoniae
ccgactcctcacccgggcccggtcggcatcgcgccgccgggtacaatgctgatataccaggaatttccattctccatgccatcgttttccactcaccttacccgcctgctgcaggggctgtttacgctgctgctcacgctgttcgggctgttgctagtcaccttctcgctctccgcgctgtcgcccgtcgaccgcgtactgcagatcgtcggcgaccatgccagccagtcgacctatgaccaggttcgccatcagctgggtctcgaccagccgctgccggtgcagttctggcactacctggtcaacctggcccatggcgatcttggcatcgccagcgccaccggccagccggtgctccacgacctgctggcggtctttccggcgacccttgagctggcgaccctggcgctgatcgtcggcgcggtactgggcatcgtcgccggggtgctgtgcgcccgttacgccggttcgccgtgggatctggcggttcgcacctttaccctgttgggcaactcggtgcccattttctggctcggcctgctgatgctggccctgttctacgcccggctgcagtgggcgccaggcccgggtcgcctcgacgatatttatcagtacaccgtcgagccacgcagcggttttgcgctgatcgacacctggctctccggcgataccgcggcgtttaaaaatgcgatcggccatctggcgctgccggtgctggtgctggcctattactcgctggccagcatcacccgcctgacccgctccgcctgcctgagcgagatgaacaaagagtacattctgctggcgcgggccaaaggggccggagagatgacgattctgctgcgccacgtcctgcccaatatccgcggcactctgctgacggtgaccgctctcgcctggacctccatgctcgaaggggcggtgctcaccgaaaccgtcttctcgtggccggggatcggccgctacctcaccacggcgctgttcgctggggataccacggcgatcatgggcggcacgctgctgatcggcgtgagttttgtgctgatcaataacctgaccgacctgctggtacggttaaccgacccgagggtgcgctga

SEQ ID NO: 5771 - DNA, 660 bp, Klebsiella pneumoniae
acatcacatcattcagccaacagcaaccctgtaaccggtttcttttttatactgctacggccatcaacagtcaggtataaggaagacccatgcatgagtgaagaaaaacgcaaaatgatcgccggtgagctctatttatctggcgacccaacgcttcgcgccgatcgcctgcgcgccagacagttgttgcaccgttataatcattccgccccggatgaccaggaacaacgtcagcatattctggccgagctgttcgctcgcgccggcgatgcgtatatcgagccaagctttcgctgcgactatggttataatatttttctcggcgccggtttttacgccaattttgactgcgtgatgctcgacgtctgccctatccatattggcgataactgtatgctggcgccaggcgtccatatttataccgccactcatccgctggacgccgatgcgcgtaatagcggccaggaatacggcaagccggtaactattggccacaatgtgtggattgggggtcgggcagtgatcaatcccggcgtgaccattggcgataatgcggtcattgcgtccggcgcggtggtcaccaaagacgtccctgcctgtaccgtcgtcggcggtaacccggcgcagatcattaagcgccttccgccgacaaatccgtaa

SEQ ID NO: 5772 - DNA, 393 bp, Klebsiella pneumoniae
attattaatcattcaaaaaattcgatgaagactgtgaatttccttcgattttatctcccgcaaaaaagcgtgatacttatcacatcgacggaacatcgtcccctgaacagaacaacctgcgagagattaactatgaaaaacatcaaatatgctgccgctgccatcgctctgaccgctctttccttcggcgcctttgccgccgaaccggttacccccgctcaggctgaaagcatgaataagatcggcgtggtgtctgcgcaaggcgcaaccactttagatggtctggaagcaaaactggctgctaaagccgaagccgctggcgcgaccggctacagcattacttccgctaacaccaacaacaaactgagcggtactgcggttatctataaataa

SEQ ID NO: 5773 - DNA, 1191 bp, Klebsiella pneumoniae
ctacggaatcattccgtggcgagtatgaaaacgtcggactgtttttctgacgcaggagcaagcatgaaatttgaactggataccaccgacggtcgcgcccgccgcggtcgcctggtgtttgagcgcggcgtggtggaaacaccggcctttatgcccgttggcacctacggcaccgtcaaagggatgacgccggaagaggtggaagccaccggcgcgcagattattctcggcaacaccttccacctgtggctgcgcccgggtcaggagatcatgaagctgcacggcgatctgcacgattttatgcagtggaaaggaccgatcctgaccgactccggcggtttccaggtgttcagccttggcgatatccgtaagatcaccgagcagggcgtccacttccgcaatccgatcaacggcgatccgatttttctcgatccggaaaaatcgatggagattcagtacgatctcggctctgacatcgtgatgatcttcgacgaatgtacgccgtacccggcggactgggattacgccaagcgctcaatggagatgtctctgcgctgggcgaagcgcagccgcgaccgtttcgatagccttggcaataaaaatgcgctgttcggcattattcagggtagcgtttacgaagatttacgcgatatctcggtgaaaggtctggtagagattggctttgatggctacgctgtcggcggtttggcggttggtgagccgaaggaagacatgcaccgtattctggagcacgtctgcccgcagatcccggccgataaaccacgatacctgatgggcgtcgggaagccggaagatctggtggaaggggtacgtcgcggtatcgatatgttcgactgcgtcatgccgacgcgcaacgcgcgtaacggccacctgttcgtcaccgacggcgtggtgaaaatccgcaacgcgaagcacaaaagcgataccgcgccgctggacgccgagtgtgattgctatacatgtcgcaattattcacgcgcttacttgcatcacctcgaccgttgcaacgaaatattgggcgcgcgtctcaataccattcataacctgcgctactatcagcgtttaatggctggtttacgcaaggctatcgaagagggtaaattagagagcttcgtgaccgatttttaccaacgtcaggggcgcaccgtgcctcctttgaacgttgattaa

SEQ ID NO: 5774 - DNA, 975 bp, Klebsiella pneumoniae
cgccgtgatcatgttcatcttcatgcgtcctctctcccggaatgggagggagcgatgctgaattatgtgattaagcgcctgctgggcctgatccctactctgcttatcgtcgcggtgctggtgtttctgttcgtccatatgctgcccggtgacccggcgcggctgattgccggacctgaggccgatgcccaggtggtggcgatggtgcgccagcagctggggcttgaccagccgctgcatgtccagttctggcactacatcaccaacgtgctgcgcggcgattttggcatttccatggcctcgcggcgtcccgttgccagtgagattgccagtcgctttatgcccacgctgtggctgacgctggccagcatgagctgggcggtactgttcgggatggcggcggggattgcggccgcggtgtggcgcaatcgctggcccgaccgtctgggaatggcgctggcggtgagcggtatttcgtttccggcttttgcccttggtatgctgctgatgcaggtgttttcggttgagctgggctggctgccgacggtgggggccgacagctggcggcactatattttgccgtcgttgacccttggcgcggcggtggcggcggtcatggcgcgctttacccgcgcgtcattcgtcgatgtgctgcatgaagactatatgcgtaccgcccgggcgaagggggtgagcgaaacgcgggtggtgctcaagcatggtctgcgcaatgcgatgatcccggtggtgaccatgatggggctgcagttcggctttctgctcggcgggtcgatcgttgtggagaaggtgtttaactggccggggcttgggcgcttgctggtcgattcggtggagatgcgcgattacccggtgattcaggcggaagtgctgctcttttcgctggagtttattcttatcaatttagtggtggatgtgctgtacgcggccataaacccggctatcaggtataagtaa

SEQ ID NO: 5775 - DNA, 243 bp, Klebsiella pneumoniae
ctatcggatcagcgcgccaccgggggtcaatggtctgcgcctcaacgcccggggctggttcgacttcgccagcgcctggctgccggcctcgtcgacgtgagagagctggtgatggagggcgtctggcgctaccatatcgcctttattcatttagtcaggaattgccatgaaacgcgccgtagttgtcttcagcggaggacaagattcaaccacctgtctggtgcaggctctgcaacagtatga

SEQ ID NO: 5776 - DNA, 189 bp, Klebsiella pneumoniae
ctccagcgtcaggccgatagcgttaagcctttcactcaagttatcgaaggcaccatttatctgttcctcgataggttttccgatgttcccgagacagtaactcacaaagaccagaccacgggtttcgaccacaccggatattgccaggctttcattgacttcgtgccttataatagtaaccattattaa

SEQ ID NO: 5777 - DNA, 495 bp, Klebsiella pneumoniae
cattggcgtcacttattgcaggtaacaggagctggcatggccatttgggtggatgcggacgcgtgtccgaacgtgattaaagagattttgttccgcgcggcagagcggacccagactccgctgacgctggtggcgaaccagccgctgcgcgtgccgccgtcgcgtttcatccgcaccctgcgggttgagcagggttttgacgtggcggataatgaaatcgttcgccagtgcgcggcgggagatttagtgatcaccgccgacatcccgctggcggcggaggtgctggcgaagggcggggcggcgctgaatccgcgcggggaacgttacagcgaggcgacgatccgcgagcggctgacaatgcgggattttatggagacattacgggccagcggcgttcagaccggcggcccggatagtttatcgcagcgcgatcggcaacagtttgccgccgagctggagaagtggttgctggcggttaagcgtcgccagggttaa

SEQ ID NO: 5778 - DNA, 1404 bp, Klebsiella pneumoniae
atgactagtcatataccgaggcgcagcatgaagaacagactaccggcagattttttatggggaaactccgtctccagcatgcagacggagggggcgtggaacgagggtggcaaggggatgtcggtgtatgatatccgtcaaccggcggagttcgcctccgactggaaggtggcgaccgactcttatcatcgttatcgggaagatttcgatttgatgcaggatctgggcatgaactgctaccgttttcagatcgcctggagccgggtgtgccctgacggagatggcgaattcaatgaacaggggatcgccttctaccatcaatttatagatgaactgatcgcccgcggcattgagccgatgatctgcctgtaccacttcgatatgccgctgtcgctggcggagcgctacaacggttttaccgaccgccgggtgatggacgcttttatccgctacggccagaagatgatcgcctgctatggcgacaaggtgaaatactggctcacctttaatgagcagaatctgtaccattcgccggaagcgtttctgatttccggctatctgcagggggagaagaccctgcgcgaactgtatctgatccagcatcatgtgatgatggcgcacgtccatctgactcactatctgcaccagacgaagccgcagtgtctgatgggcggaatgctggctcacgctctggtctatccggctacctgcaaaccacgcgatatcctctgcgcccagcagctggatgagttcttaaaccagaacctgctgcgcgcctacgcgggtgagggttatagcccggaggtgatgcattttgtcgccgcggaagggttcgatgatatctatcgcccggaggatctcgccctgatggcgacggtgaaggtcgattatctggcgttcagctattacgccagccgcacattgaacagcgacgcgatcccgccgggaacggcggtcaacaactatatgctgtttggcaaccaggataacccgttcctgaaagcgacggaatggaactggcagattgatccgctgggcttccggacgatcatcactcgttactataacgactggcgcctgccggtgttcccgattgaaaacggcatcggggtgattgagtcctgggacggcgaacatcccattgccgacgattaccgcatcgcttaccatcgcgaccatatcaacgccatgaaagcggccatctttgaggatggggcgcaggtgatcggctatctcggctggggattaatcgatatcctgagctcacagggcgatatgcgtaagcgctacggcgtggtgtacgtcaatcgcgaaaaccatgacctcaaggacctgcggcgggtgccgaagaagagctatgcatggctgaagcaggtgttccgcagcaacggcgaagcgatgtaa

SEQ ID NO: 5779 - DNA, 357 bp, Klebsiella pneumoniae
cctaattgtcttactgcttcttcgatggctggggtacctggattcgaaccagggaatgccggtatcaaaaaccggtgccttaccgcttggcgataccccaataccgtcgcggtgaaccgcaaatatcgaagaaatatggctggggtacctggattcgaaccagggaatgccggtatcaaaaaccggtgccttaccgcttggcgataccccatccgtacaacgctaactggtgaatggtgcgggaggcgagacttgaactcgcacaccttgcggcgccagaacctaaatctggtgcgtctaccaatttcgccactcccgcaaaaaagatggtggctacgacgggattcgaacctgtga

SEQ ID NO: 5780 - DNA, 1059 bp, Klebsiella pneumoniae
ccgcgtctccaccacgctgggtcaatgatgattcggttgtacccggaacagctccgcgcgcagctcactgaagggctgcgcgcggcctatctgctgcttggcaacgatcccctgctgttgcaggaaagccaggacgccattcgcgaagctgctgccgcgcagggctttaccgagcaccatactttttcaatcgacaacagcaccgactggcaggcgattttcgccttaagccaggcgatgagcctgtttgccagccggcaaaccctgctgttgatcctaccggaaaacggccccaacgcggcgatcaatgaacagctcgccacgctggttggcctgctgcacgacgacctgctgctgatagttcgcggaaataagctgaccaaagcccaggagaatgccgcatggctcaccgccctggctcagcgcgcagtccaggtcagttgccagacgccggaatacgcgcagctgccgcgctggctggccgcccgggccaaacagcatcagctgcagctcgacgacgcggccagtcagctgctgtgctactgttacgaaggcaatctgctggcgctggcgcaggcgctggagcgtctggcgctgctctggccggacggtaagctaaccctgccccgcgttgagcaagcggtaaacgatgccgcgcactttacgccttaccattgggtcgatgccctactggcaggcaaaagtaagcgcgtgctgcacgtcctgcagcagttacgccttgaaggctgcgagccggcgatcctgctgcgtactctgcagcgggagctgctgctgctggttaccctcaagcgccaggcgacgcacacgccgctgcgctcgctgtttgataaacatcgggtctggcaaaaccgccgtcagctgctcagcgacgctctcacgcgcctgagcggggaacagctgcgccaggcggtgacccttctgacccgcgcggagctcacctttaaacaggattacgggcacgacgtctggcccgaactggaaagtctttcgttgttgctctgccacaaagccctggcggacgtttttattgatggttga

SEQ ID NO: 5781 - DNA, 291 bp, Klebsiella pneumoniae
  unsure (12),(13): Identity of nucleotide at the above locations are unknown.
actgatgtccanntcaatcgaccccatgtgggccttcatgccaaagtgccactgattgcctttcttggtctgatgcatctccggatcgcgttgctgctctttgttcttggtagagctgggtgcctcaatgatggtggcatccaccaaagtgccttgggtcatcatgacgcctgcttcggccagccagcgattgatggtcttgaacaattgacgggccagttgatgctgctcgagcaggtggcggaaattcatgatggtggtgcgatccggcagggcgctatccagggataa

SEQ ID NO: 5782 - DNA, 261 bp, Klebsiella pneumoniae
ccgccggtccacagcagcgccagcaccagcgaggtaaactcgtggcccagcggcgagcccgcaaaacgcggcccctggtcggaacctgggttagtaatcaggaacgagggcttacgtaccgcgagcgtgttgtcttctttaaaggtgactttgtctgacagttcagcgatttcagccaacagttccttgatttctgccgatttagcgctgtcatccagcgtggcaatcagctcaacaggcttggtcagcttctcaaggtag

SEQ ID NO: 5783 - DNA, 294 bp, Klebsiella pneumoniae
gctatgtcccatgcggtttatgaggatatgctgatgaaattcgtctcgctgctgttcgccgcggcgctcaccgctcatgccaccgcggcctctcccctgccaccgccacccgtactgccctataacgggccgctccgccctgtcggcaccgtctccgccttcggcgccagcaccctggacgacctggcggccgcccttgcggataaggcccaccgtcatggggcgatagcctggcggatcaatgccgccagcagcggtaaccggctgtacggttcagctataatttatcaataa

SEQ ID NO: 5784 - DNA, 417 bp, Klebsiella pneumoniae
caatctccccacttacccaccgctggcggaacgcctgagcgatgcgcagctgagcgagctagaggcgcgagccggcgagctgggcctgtcggtcgggctgttcgacagccagccgctgtggcaggtggcgatggtcctgcaggccacccaggcgcagaagctggggctgcgaccagattacggcatcgattatcagttgctgatggccgcccgcgagagcaacatagcggtgatggagctggaaggcgccgacagccaaatcgcgctgctgcgcgatctgcccgacggggggatggcgctgctggaggatacgctgacccactggcgcaccaacgcccgtttactgcaggtcatgatcggctggtggctggagcaaccgccgtcgcgcggcgcggtatcgctgccgacgacctttag

SEQ ID NO: 5785 - DNA, 690 bp, Klebsiella pneumoniae
tatactccccaacctgaattctctcttcccggcggagatgttgttttgcagcacaataaaattcttatccggcagcttggcctgcaaccttacgaacccgtctcgcaggcgatgcatgaatttaccgacgcccgtgatgaagataccctcgacgagatctggctggtggaacatcaccccgtattcacccagggtcaggccggcaaagcggaacacgtgctggtgcccggcgatattccggtgatccagagcgatcgcggcggccaggtcacctatcacggtccgggacagcaggtgatgtacgtcctgttggacctcaagcgccgtaagctgggcgtgcgggagctggtgacgctgctggagcaaacggtcgtcaataccctggctgaatatagtatcgagtcgcacccccgcgccgacgcccctggcgtctatgtcggcgaacgcaaaatctgctctctgggattgcggatccgtaaaggttgttctttccacggtctggcgcttaatatcgccatggatctcacaccgtttctgcgtatcaacccctgcggctatgccggtatggagatgacgcaaatgcgccagtggcagcctgcagcctccccggagacggtcgctccgcggctggtcgccaatctgctggcgctgctaaatcatccaccgcacgaatatcttccccgggattaa

SEQ ID NO: 5786 - DNA, 1341 bp, Klebsiella pneumoniae
catcgcccccaacagcacgctggggctggactttgccggcgccctgcagctcaccgtcaatcgcgacggcctacgtctgtcgcgccgcggcctgcagacggcagagatgcatcaccgctactggcgcggcgaggcgcgacgcctgcggatctttatcgaccgctccagcgtggagattttcatcaacgatggcgagggggtgatgagcagccgcttctttccgggctatccggggcagctcatcttcagcggtgcgacgccggtggcattctgccgctggctgctgcggccatgcatggtagaataagcgttttgctttcaggctcccgggtgctgatgaaaaccaaacgcgtaactatcaaagatatcgccgaactggcgggcgtctccaaagcgaccgccagcctggtactcaacggtcgtggtaaagagctgcgcgtggcgcaggagacgcgcgagcgcgtgctggcgatcgctcgcgaacagcactatcagccgagcattcacgcgcgctcgctgcgcgataaccgcagccataccattggtctggtggtgccggagatcaccaactacgggtttgccgttttctcccacgagcttgagacgctctgccgggaagccggcgtgcagctgcttatctcctgcaccgacgaaaacccaggccaggagagcgtggtggtcaataacatgatcgcccgccaggtcgacggcctgattgtcgcctcttgtatgcacagcgatgccgactatcagaagctcagcgaacagctgccggtggtgctgtttgaccgctcccccagcgacagcgccctgccgctggtgatgaccgactcggtcaccccaacggccgagctgatctcccgtatcgcgcctcagcatgcggacgagttctggtttctcggcggccagccgcggctgtcgccgtcgcgcgaccggctggcggggttcacccagggcctggcccaggcggggatcacgctgcgccctgagtgggtgatcaacggcaactaccaccccagctccggctatgagatgttcgcggcgctctgcgcgcggctggggcgtccgccgaaggcgctcttcaccgcggcctgcgggctgctcgaaggggtgctacgctatatgagccagcatcatctgctggattccaatattcatctcgccagcttcgacgatcactatctgtatgattcgctttccctgcgcattgataccgtgcagcaggataatcgccagctggcctggcactgctacgatctgctcagccagctgatcgacggtcaggccccggagccgcttcagcgctacctgcccgccaccctgcagattcgccatccctga

SEQ ID NO: 5787 - DNA, 1533 bp, Klebsiella pneumoniae
ggtgccgcccagcgaatacccgaacaggtaataagggccgtgcggctgctgcgccagcagcgtgcgcagatgatgctcgcacacctcgtcgaggctggcggcgctggccatcggcccctgcgggcgcggcgactgaataccggtaatcgaccagcgcgggctgagatagcgcgccagcacgctgaactgccaggcgaagccggaggccggatggaagcagaacagcgtcgggccgtcgctctcgcgcagcggcagaagcgtatccagccccaggcgctgagcctgctcatcgctgagatcggcggccagcagcgcgctcagtttgcccaccgtcgaggccaccatcacctgccccggggtcacctgccgcgccagctggcggctgagctgtgccgccaggcgcatcgccagcagcgaatgaccgccaagggcgaagaaatcggcgtcgatatcgttcacctcgcagcccagcagctggctgaaggccgtggcgacaagggtttccatcccgggctccggcggccggccgctgcgctccccgccgagggtcggcagcggcagcgctttgcggtccagtttgccgttggcgctcagcggcagctcagcgagctgcatcagcaccaccggcaccatatgcggcggcagctgttccgccagttgcgctttcagcgccgcggtatccagcggcaggccggagtcagagaccagatagcccaccagctgtcgggcatcgccgccggtcgccgccgcctggttgaagacgcaggcgtgactcaccgcctgccccacgtccggcagggccgacatcacccgatcaatctcgccaagctcgatgcgctgcccgcggatcttcagctgatcgtcgctgcggccaaggtactccaccgcgccgttcgccagccagcgcgccacgtcgccggtgcgatacatccgctcgccgggggcaaacgggtcggcgataaagcggctggcggtgagatccgggcgccccagatagccctgcgccagctggatgccggtgagataaagatcccccgccacccccggcggtaccgggcgcatcgcggcatcgagaatgcgcagcccggtgttccacaccggccagccaatcggcacgctgctgccggtcaccgccgccagctcagggccgcaggccggataccagctgacgtccaccgccgcctccgtcgggccgtacaggttatgcagcggcgcgccggtcaagcgctcccactcgcggcacaattccgtcggcagcgcttcgccgctgcagaatacccgccgcagcgtgcggcaggcagcgacgctgtcggcatccagcgaggcgacaaacgccgccagcatcgacggcacaaagtgggtggtggtcacgccgtagcgggcgaagaactgctgcatcgcctgcgggtcgcggtgcgcctccggctcggccatcaccagctgcgcgccggcgataaacggccaccagaattcccacaccgacacgtcgaaactgcacggcgttttctgcgccaccacgtcgtcggcagataa

SEQ ID NO: 5788 - DNA, 1665 bp, Klebsiella pneumoniae
catttgcaccagaaggatcaggcaatggcaatcgataaacgtgcggggcagcctgcgcaacagagtgatttgattaacgtcgcccaactgactgctcagtactacgtgctgaagcctgaagtcggtaatgcggagcatgcggtaaaattcggcacctctggccatcgcggtagcgcggcgcgccacaacttcaacgaaccgcatatcctggccatcgcccaggccattgcggaagatcgtgcgaaaaacgggatcaccggtccgtgctatgtcggcaaagatacccacgccctctccgagccggcgtttatttcggtgctggaagtgttaaccgccaacggcgtcgacgtgatcgtgcaggaaaacaacggcttcaccccgacgccggcggtctccaacgcgattctggtgcataacaaaaaaggcggtccgctggcggacggcattgtgatcaccccgtcacacaacccgccggaagatggtggtatcaagtacaatccgccaaacggcggcccggctgataccaacgtcaccaaagtggtggaaaaccgcgccaacgaactgctggccgcgggcctgcagggcgtgaaacgcatttctctggacgcggcgctggcttctggccacgttaaagaacaggatctggtgcagccgttcatcgaagggctggcggatatcgtcgatatggccgcaatccagaaagccggcctgacgctgggcgtcgatccgctgggcgggtccggtatcgaatactggaaacgcattggcgagcactacaagctcaatctgaccattgttaacgatcaggtggatcagaccttccgctttatgcacctcgataaagacggcgccatccgcatggattgctcctcagagtgtgcgatggccggcctgctggcgctgcgcgataagttcgatctggcgtttgctaacgacccggattacgaccgccacgggattgtgaccccggcggggttgatgaacccgaaccactacctggcggtagcgatcaactacctgttccagcatcgtccgcagtggggcaaagaggtggcggtgggtaaaacgctggtctcctccgcgatgattgaccgcgtggtgaacgatctgggccgcaagctggtggaagtgccggtgggctttaagtggtttgtcgacggcctgttcgatggcagcttcggcttcggcggcgaagagagcgccggggcctccttcctgcgcttcgacggcacgccgtggtccaccgataaagacggcatcatcatgtgcctgttggcggcggaaatcaccgcggtgaccgggaaaaacccgcaggagcattacaacgaactggcggaacgcttcggtgcgccgagctataaccgtctgcaggcttccgcgacctccgcgcagaaagcggcgctttccaagctctctccggaaatggtcagcgctgacaccctggcgggggatccgatcactgcccgtctgaccgcggcgccgggcaacggggcggcgattggcggcctcaaggtgatgaccgacaacggctggttcgcggcgcgtccgtcaggcactgaagacgcctacaagatctactgcgaaagcttcctcggcgaagagcatcgcaagctgattgaaaaagaagcggtagagattgtcagcgaagtgctgaagaacgcttaa

SEQ ID NO: 5789 - DNA, 1320 bp, Klebsiella pneumoniae
tttccagaccacacagtgatggggaacgaaacaatgaaaatggcaacaatgaaatcgggtctgggggcattagcccttctgccggggctggcgatggccgcgcctgcggtggcggacaaagccgataacgcgtttatgatgatttgcaccgcgctggttctgtttatgactatcccggggattgcgctgttttacggcggcctgatccgcggtaagaacgttctgtccatgctgactcaggtgattgtcacctttggcctggtctgcgtattgtgggtgatttatggctataccctggccttcggcactggcggcagcttcttcggcagctttgactgggtgatgctgaaaaatattgagctgaaagcgctgatgggcaccttctatcagtatatccacgtggccttccagggctcgttcgcctgcatcaccgtcgggctgattgtcggggcgctggcggaacgtattcgtttctccgcggtactgatcttcgtggtggtgtggatgacactctcctacgtgccgattgcgcatatggtttggggcggcggtctgctggcgacccatggcgcgctggacttcgccggcggcaccgttgtgcacattaacgccgcggtcgccgggctggtgggcgcctatatgatgggcaaacgcgtgggcttcggcaaagaagcgttcaaaccgcataacctgccgatggtgttcactggcaccgctatcctctacgtgggctggttcggcttcaacgccggctctgccagcgcagcgaatgaaattgcggccctggcgttcgttaacaccgtcgtggcgaccgctgcggctatcctggcgtggacctttggcgaatgggctctgcgcggcaaaccttcactgctgggcgcctgctcgggggcaattgccggtctggttggcgttacgccggcgtgtggttatatcggtgtcggcggggcgctgatcgtcggtatcgcctctggcctggcgggtatctggggcgtgactgcgctgaaacgctggctgcgtgtggatgatccttgcgacgtcttcggcgttcacggcgtctgcggcatcgtcggctgtatcctgacaggtatcttcgcggcgacttctctgggcggcgtcggttatgcggaaggcgtcaccatgggccatcagctgctggtgcaactggaaagtatcgccatcaccgtggtctggtccggcgttgtggcgttcatcggctacaaagtggcggatatgaccgtcgggctgcgcgtgccggaagagcaggagcgcgaagggctggacgtcaacagccatggcgaaaacgcctataacgcctga

SEQ ID NO: 5790 - DNA, 381 bp, Klebsiella pneumoniae
ctgaactgccagcgggcgtccgccagcgccggcgcatccggggtcttccgcgcctggtcggccaccagcgcgctgagggtggtggcaggcaacggcacagcggtatcgttgaccgccgccagccgggccagctcgtcggcggagagcatctctgcttcgccgcagcgcagcgtcggatcggcggcgaactgcgccagcagcgcggtcagtcgcgccatgtggcgacggagctcggcttcgtcgtaccgggccttgttggcgaggatctccagcgacagcccgccggtctcatccgggaacagcgccagctcgagatcgttgaccgggccggtggcgagggtgtgggtcactgcctgcacaccatcgatatccagctggtaa

SEQ ID NO: 5791 - DNA, 1212 bp, Klebsiella pneumoniae
aagcatcgccatgaagattggccgaagcgttgcgtcggtatccagaactttaagccgcatgagaaaggcagacacgaaaagaggtgcgcaatgacatatcaattacatgtcggacgctgtgaagaagttctcaagacgctgccggataactcagtcgatgccatcgttacagatcctccatatgggctgagcttcatgaaccaaaaatgggattacgacgtcccgaccgtcgaccagtggcgggaatgtctgcgcgttctcaaacctggtggacacctgctggcatttggtggatcacggacctatcaccgacttgttgttaacgctgaggatgccggcttcgaaatcagggatcaaatcctatggatttacggtagcggcttccctaagtcacataaccttgatggtgattttgatggctggggaacggcgctgaagcctgcgcatgaaccgatcgtaatggctcgaaagccattcaagcaaaccgtgtccgccaacatgaacgagcacggtaccggagcaattaacatcgacgcctgccggataccgaccgatgaggcgcttaatggaggcactggcggcctgctttcgcatcagcgtgacggtacccaaccggttgccgactacgagcaggcaccggaaggacgctggccggccaacattattcacgacggcagcgaagaggtgatcgcctgcttccctgctaatgctggagctgcagcaccagtaaccggcaacgaaccttctgcagcatcaacaggtcaggtacttggaatgcgcaagcgtgtggccaccgtccaccatggcgataagggaagcgcagcacgattcttctattgcgcgaaggtcaaaccgaaggagcgcgacgaaggcctcgagcgattcatagcgacatcagccagcgatatgaccggcggacgcaaagagggaagcgtcggcattaacgacccgcgggccggtgcagggcgtacaaatggcgctaagaacaaccaccctaccgttaagccgatcgctctcatgagctatctctgccgactaataacccctccaggtggaaccgtgcttgatccgtggatgggaagcgggagtactggccgggctgccattgaggagggttttaacttcatcggaatcgacctgaacccggattacgtaaccattgcttccgcgcggatcgcttactccttcaaaaaatcgacggaggcagcatga

SEQ ID NO: 5792 - DNA, 1692 bp, Klebsiella pneumoniae
cgccaccgccaccgcgcagccctgcagctgcaggcgccatttctccagcgccggacggctgtcgctggcgcgtgcggcaagggggaagggtttctcatcgagggcgatcaccaccagatcgaggtccggcgcatggcgagccagacgatcggcgaagccgctgcgatcccaccagcggcgcttgctttggcggccaatgacgattttgccgaggttatgttcgcgggcgtaatggaggaccgctttctcttccgacgggtcggagagggtggcggtttcggcccccagctcctgggccagacgcagcgcggcgagaatagcccgccgccggccttccggcagccggtgcagggaaggggtctcgacatacaccgcatgccagacgctgcccaggcgggcggcgagccgggcggcggcgcgcaccagcttttcgctgccggtgttgtgcccgatacagagcaggatcgcatcgcgggtgtgccagactttctcctggccctggcggtcgcgccaggcgcgcatctgctcatcgacgcggtcggcggtgcggcgcagggccaactcgcgcagcgcaatcagattgcccttgcggaaaaagttttcgatagcgcgctcggcctggccgccgatgtagactttgccctcattgagccgctggcgcagatcgtcaggggggaggtccaccagcaccacgtcgtccgcggcgtcaaagaagggatcgggaaccgtctcccgcacctgcacgccggtgatcccgctgacgacgtcattcaggctttccagatgctggacgttaacggtagtgaaaacatctatcccggcctccagcagttcatccacatcctgccagcgctttggatggcgggagcctggcgcattgctgtgcgccagctcatccaccagaatcaacgccggacggcgggcgagggcggcgtcgagatcgaactcatagacgtaccgcccgcgatgggcaagccgccgcggcggcagagtgctcaggccctgcagcatcgcggcggtctctttacggccgtgggtctccgccacgccaatcagaatatccagcccctgggcgcgcagccgctgcgcttccgccagcatcgcccaggttttccccaccccggcgcaggcgccaaagaacactttcagtttgccgcgatgcggggcggcggtgtgctgcagcaggcggtcagggtccgggcgcagcggctcgtcactcatttacttatccttcagggcatccagcgccatattgagttgcagtatattgatcaccggctggccaaggaagctcagcagcggggtttgtgtggcctgattcaccaactgggttacctgctcaacgctcagctggcgcgcttgagccacccggggcacctgccacagcgcggcggccggagtcaggttgttatcgagaccgctcgccgaggtggtgaccagttcgaccggcacccgcgggtcggcgtccgggttggcggcgcgcagggcctgcacgcgctcgctcaccgctttatccagcgccgggttgctggcggcgaggttgctgccgccagaggccatgggattatccgccgtctccgcggtggccgacgggcggccctggaaatagcctgcggcggtgaagttctggccaatcagcgccgagccgcgcacttcaccgttcaggcggatcagcgagccgttggcctgtga

SEQ ID NO: 5793 - DNA, 1713 bp, Klebsiella pneumoniae
tggatgcgccaccaaaccaatgaaacaaatggatattgcttcatgttaattcgatctcgcacgctcaccgggctgctgtttatcacgctggcgggcacctcagccgccggggccgcgccattgacctcttctactcaccagacggagcaggataaagcccgccaggaggcgctggcgccgcagcaacaggattttcagtcttcacaacagcgcgtggcgccgcaggggatcccttttcctgaggaaacgcattgcaaattgatcaaccgggtcgatatcgactccgataaccaggcgctcacccggaaattactggcgaaaaccgcacggcaggcgcagggacgctgtctgggtagcgaaggcattcgcctgctggcctataccttgcaaaatgagctgatcgcgcaaggctacatcacctcgctgattgatgtgccctcccagtcgctggagcacggcatactcaggttcacgctgcactatggcaaagtgggcgctatcgactatgccgacggctcggacaccacccgcctgtggaattccctgcccacctcttccggtactatcctgcgcttaagcgaccttgagcaagggatggccaacctgcagcgtctgcccggcgccaccgcgcacatgaaactgctgccgggccaacacgagggagaaagcgatatccagatcgcccgcagcctggcgaaaaaatggcagcttggcgcctggcttgacgacgccggcagcaaagccagcggacgctaccaggccggcggggccctctatctctatgacctgaccaccctcaacgatatcctgtacctttccggcgggggcgatattgaattcaatcagcataacgacggcaaccacaacggcagcctgtattactccattccctttggctactggacactaagcgcctacggggcatacagccagtatcgtcagcagtttaacggcaactggtcgacgatggattataagagtaaaaatcgctactacagcgccacgctgagtcgtctgctctcccacacccggcagcaaaaaactaccgccgacctgcggatcgccaagagtacctcgcattattacttcggcggcagtgagctactggtgatgcgcaagcagaacccctcatgggaattcaccctcaaccaccagcactactttaacaaaaagattgttgatgccagcatcggcatccagcgcagcctgccgtggctcagctcgacagcaacgccggaagagcaggccgggctgtatagcccgctgtcgcggattgtgcatggtaatctgcaggcaatgatgaaatttgacgccaccggcgacaaatttacctgggctccccgcctcagcgcccagttcagcccggacaaactcgcttccgataacaaattcaatattggcagccgctggagcgtgcgcggttttgacggtgaaaacagcctgtccggcaatcagggatggtactggcgcaacgattttatctgggatctggccacccacgagcggcaattctatttgggcgcggatataggccgccttatcggcgccgatctatatcaaaaaggcaaagtgctctccggcgccgtcagcgggctgcgcggtcagctatggtcaacgcagtacgatctgtttattagtaccccgctgagtaaaccggataagtttcatagcgacgccctgaatatgggcttttcattacagtggaggtattaa

SEQ ID NO: 5794 - DNA, 390 bp, Klebsiella pneumoniae
gcgcagcgccaccgggcgatgctatcaggcacagagccgctttattgccgggtggcggctggcgccttagccggcctacaggagcctctcacaggatcacacctcgtaggcccggtaagcgcagcgccaccgggcgatgccatcaggcacggagccgctttattgccgggtggcggctggcgccttacccggcctacaggagcctctcacaggatcacacctcgtaggcccggtaagcgcagcgccaccgggcgatgccatcaggcacagagccgctttattgccgggtggcggctggcgccttacccggtctacgattcgcgcaacctgtcgttaatttattcaccagtcttgctgaaactgccggtgttgcggcctcaacatcgctga

SEQ ID NO: 5795 - DNA, 228 bp, Klebsiella pneumoniae
tttatcagccagtgtttgtacttgctgaagcaactcttcgtcagtgatattcatttcatagttacctttattaaccctaaaacacttaacatctgcatgaataataagcagttagttattttgctttgtatcaacaagttagagcctttagcccaaatgctgttgcaaggctttgtccaccagcccccttgcgatttcatggatagttggcgcaacaccgatacctga

SEQ ID NO: 5796 - DNA, 681 bp, Klebsiella pneumoniae
aaaaatggccaatattgctattggcccgtcaaagaggaatttcatcattattattatcccgggatttgcatcccggatcgtctgattgtcgctcaaagtgaccatcactgccaacactattgcgcaagatggtactattttttagacaacctgcgggcgtattctgacgtcacgcaaaaccggttggtaagaaggatagctatgactcccgccgttaaattactcgaaaaaaacaaaatttcctttcagatccacagttacgatcacgatcccaatgagaccaacttcggagatgaagtggtgcgcaagctcggcctcaatgccgaccaggtttacaagaccttgctggtcgccgtgaacggcgatatgaagcatctggcggtggccgtcactccggtcgccgggcagctggatttgaagaaagtggcgaaagcgctgggcgctaagaaagtcgacatggccgacccgatggtggcgcagcgtatcaccggctatctggtgggcggcatcagtccgctggggcagaagaagcgcctgccgacggtgattgacgccccggcgcaggaatttgccaccatctatatttccggcggcaaacgcgggctggatattgagctggcggcgagcgatctggcgcagcttctcgatgcgaagttcgccgatatcgcccgccgcgattga

SEQ ID NO: 5797 - DNA, 1095 bp, Klebsiella pneumoniae
ttagccggccacgcgccgcgtccggccacctgcgtaaagaggaatagtttgaacatagacactcgtgagattaccctggagccagcggataacgcacgcctgttagccctgtgcggcccgtttgacgacaacattaaacagctggagcgtcggttaggcattgagatcaaccgccgtgacaatcactttaagctgaccggtcgcgccctgtgcgtgcacgctgccgccgatattctgcgcagcctgtatgtcgacacagcgccaatgcgcggtcagattcaggatattgaaccagagcagatccacctggcgatcaaggaagcgcgcgtactggagcagagcgccgaaagcgtgcctgagtacggtaaagccgtcaatatcaagaccaagcgcggggtaatcaaaccgcgtacgccgaaccaggcgcagtacatcgccaatatcctcgatcacgacatcactttcggcgtgggtccggcaggtacgggtaaaacctatctggcggtggcggctgcggtcgatgcgctggagcgccaggagatccgccgtattctgctgacccgtccggccgtcgaggcaggcgaaaagctcggcttcctgcccggcgatctgagccagaaggtcgacccgtatctgcgcccgctgtatgacgcgctgtttgagatgctcggctttgagaaagtggagaagctgattgagcgtaacgtcatcgaagtggccccgctggcctatatgcgcggacggacgctgaatgacgcctttatcattcttgatgaaagccagaacaccaccatcgaacagatgaagatgttcctgacccgcatcggctttaactccaaggcggtgatcaccggcgacatcacgcagattgacctgccacgcagcaccaaatccggtctgcgccatgccatcgaagtgctggcggaagtcgatgagatcagctttaacttcttccatagcgaagacgtggtgcgccatccggtggtcgcccgcatcgtgaacgcctatgaggcatgggaagccgcagaccagaaacgtaaagcagagctggccgccgagcgcaaacgcgaagcccaggaacaggagcaaaaatga

SEQ ID NO: 5798 - DNA, 561 bp, Klebsiella pneumoniae
actgcaggccaacggccaacccgcatggcgtgtggtacttggcgcctggcacatcgaaggttcgatggtcaaggtgacgccggacgacgtcgaactaatccactttccgttctaattcctgcgcgagcacaattccgaaagcggcttttgcccgggcgaaggtgcgcgcttccccccgccctgcatgctagtcttccacaacgtcactctcaaggaacgagcatgagcatgaaaaagtggagtcagccgctgatgtggggaatgatcatcgcgatcctcaatccgttaggggtaagttatatcgccttaatcggcgtcgttatcggcaacacgctgacgtttgtctggtgtgcgatgctggcgtgggctatctatttttatgccatttatttgctctgcacccgccctcacgatagccggctggtacaaatctatttactgcttatgggcactctgatgctcccgtggggggtagtgctgcttatcacctgtatcatgagggagataaaggtcaatcaggcccccacgccatcacctccaggcgagacaaaagacggctaa

SEQ ID NO: 5799 - DNA, 1182 bp, Klebsiella pneumoniae
ggaatattacaacgcggcggcgctatgagctggcagcagcgaatcgatcgggcgctggacgagcggcgggcggcggaagcttttcgccgccgcctgccggtgacgcacggcgccgggcgctggctggagcgggaaggggagcgctggcttaacttctccagcaatgactatctgggcctgagtcagcatccggcgattatcgccgcctggcaacagggggccacgcgctatggcgtcggtgccggcggctcgggccacgtgagcggctatagcgaagcccaccgcgcgctggaagaggcgctcgccgactggctgggctatccgcgcgcattgctgtttatctccggctttgccgcgaatcaggcgctgatcgccgccctggtggaaaaagacgatcggattgtcgccgatcgcctgagccatgcctccctgctggaggcggcaagcctcagcccggcgcagctgcgccgctttacccacaacgatccgcagcagctcgcgcaactgctggctaagccgctggcgggcgaacagttggcggtcactgaaggcattttcagcatggacggcgacagcgcgccgctggcggccattcacgccgcgacgcaggccgcaggggcagtgttgctggtggatgacgcccacggtgttggcgtggtcggcgacgaaggacgcgggagctgcgccgcgcaggcggtgcgccctgagctgctggtggttaccttcggcaaggccttcggcgtcagcggcgcggcggtgctgtgcgacgaagcaatggccgattatctgctgcagtttgcccgtcatctgatctacagcaccgcgatgccgcccgcccaggcggtggcgttgagcgctgccctgcggatcattcgcagcgatgaagggcagcagcgtcgcgacatcctggccgcccgcatccgtcagttccgtgaggggatgggcgaggtgtcgctggggttgaccgactccgtcagcgcgatccagccgctgatcgtcggcgacaacgcccgggcgctgaacctggcctgccgtctacgcgacgcgggctgctgggcaacggcgatccgtccaccgacggtgccggtcggcagcgcgcgtttgcgcctgaccctgacagccgcccatcatgctgaagacattaaccgtttactggaggtgctgcatggccacagtgaataa

SEQ ID NO: 5800 - DNA, 492 bp, Klebsiella pneumoniae
tctatgttacaactgacccatattaacgccgcgggtgaagcccatatggtcgatgtctccggcaaagcggaaacggtgcgcgaagcgcgcgccgaggcttacgttgaattgcaggcgacgaccctggcgatgattatcgacggcagccaccataaaggcgacgtgttcgccaccgcgcgtatcgccgggatccaggcggccaaacgcacctgggagctgatcccgctgtgtcatccgctgatgctcagcaaagtggaagtcaatctgcaggcgcagccggaacataaccgggtgcgcattgaatcgctctgccgactcaccggtaaaaccggcgttgagatggaagcattgaccgccgcctcggttgccgcgctgaccatttacgatatgtgcaaagcggtgcagaaggatatggtgattggcccagtgcgcctgctggcgaaaagcggcggcaagtccggcgattttaaggtgggtgaatgccatgattaa

SEQ ID NO: 5801 - DNA, 810 bp, Klebsiella pneumoniae
cgtctactacactattttattcaggaaagtgacatttactggagaattatggctgagccaacggcgggattttcgttgaacgtgctgacaattaacacccataaaggctttacggcgtttaatcggcgttttattttgcccgaactgcgcgacgccgtgcgcagcgttagcgcggatattgtttgcctgcaggaggtgatgggcgctcatgaggtacatccgctgcacatcgaaaactggccggatacgacccattatgaatttctcgccgacaccatgtggagcgactacgcctacgggcgcaatgcggtttatccggaaggccaccacggcaacgccgtgctgtcgcgctttcccattgaatactacgaaaatcgcgatatctcggtcggcaacggggagaagcgcggcctgctgtactgccgcatcgtgccgccacggagcgggataactattcacgtgatttgcgtccatctcggtctacgcgccgaccaacggcaggcgcagttgaccatgctggcggagtgggtcaataccctgcccgcgggcgagccggtggtggtggctggcgattttaacgactggcgtcagcaggctaaccagccgttaaaagcccaggccgggctggaagagatctttacccgcgcccgcggacggccggcgcgcacctttccggtcagttttccgctgctgcgcctcgaccgcatttacgtcaagaacgcccacgccagtcgcccgaaggcgctggcccttaaacaatggcggcatctgtccgatcatgcaccccttagcgtggagatacatttgtga

SEQ ID NO: 5802 - DNA, 1005 bp, Klebsiella pneumoniae
acatcgtcacaccgatttgttacacgtaatacaaatcacactcaacatagcgataagccaacggcaaataacagctactcactccggggaatgtggatgtccaatatacgactgaggaatgtcaccaaaaggttcggcagcacggtgacgctgcaccaggtcaatctcgatattgaagatggcgagtttgccgtcttcgtcggcccttccggttgtggaaaatcgacgctactgcgcatgattgccgggctggaagaggtcagcgaaggagaagtactgatcggcgatgaggtgatgaatgatgtcgtgcccgcccgccgcggcgtggcgatggtcttccagtcctatgcgctctatccgcacatgacggtggcagagaacatgggctacgggctgaaggtgaataaagtgccgaaaacggagatccgtcgccaggtggaaatggtggctaaaacgctgcagctctcgcacctgctggatcgtaaaccgaagcagctctctggcggccagcggcagcgcgtggccattggccgggctatcgtgcgtaatccccgggtgtttatgttcgatgagccgctctctaaccttgatgcggagctgcgcgtcgatatgcgcctgcatattgcccgtctgcaccaggagctgaagaccactatggtgtatgtcacgcacgatcaggtggaggcgatgacgctggccgataaaatcgtggtcatgaactacgggaaagtcgaacaaatgggttcgccgatggcgctgtactacaatccggtcaacaaattcgtcgccggctttatcggctcgccgaaagatgaactttctgccggctatcgtcagcgactggcagccggaacgcttaacggtcaccctcgcgcaggaccatcagctggccctgaatatcgccacccagccgctgaagcccggcgctgcggtgacgctagggatccggccggagcacctcaccccggaagtcgccaccggtaccgtggtggagtttcaatgtga

SEQ ID NO: 5803 - DNA, 561 bp, Klebsiella pneumoniae
ataaccccacagcctcttgctaattacttatcaggactggttgggttattttattctgacgccaacgggagaatacaccaacgtgtatccctctctctggcccggcacgccgctatcgcgatgagaaacaataagatgaataagacctggcttttcaccaccctcaccctggcgctggtcgccgccgcgccggcccacgccattagcgcgaaataccgggaacagcttgaacgttccggctgcacgcagatgaccgacgggatcacctgcgatattcataaaaccaaagccgagaatgccgccgccgcgcagcaggccgacagcggcttcggcccctgggtgggcacctggtatgtttatacggagtatggcgataaaattgatgagattaccgtcaccgctaaaacggtgaaaacccgcggccatctggttgaggcggcgaaagccagccagggtaaactgaccttccgggtgaaaagctcagcctttacgctgaacgacgcctttaacggcgtatgggcaaacggcagccagcgcggcacgttgcaaaaagtcctgtaa

SEQ ID NO: 5804 - DNA, 189 bp, Klebsiella pneumoniae
acagcgacacatagccgagcgccgcccaggaggaggccgagatggcatgccaggacgcgggctgaaccagcagcgaggcggggagcatcaacggcagggctatcaccagcgcccagcagatcacctgccagccgccgagctcccgcgtcagctttgccccttccgcatagccgaggccgcaggcgataa

SEQ ID NO: 5805 - DNA, 795 bp, Klebsiella pneumoniae
cggcgcgcacaactgccgccgtgtggagatcgacccaagcctgctggaagacgacaaagagatgctcgaagatctggtggctgccgcgttcaacgacgccgcgcgccgtatcgaagagccccagaaagagaagatggcttccgtttctgccggtatgcaactgccgccaggcttcaagatgccgttctgatgcaaaccagcccgctgttaactcagcttatggaagcgctgcgctgtctgccgggcgtcggcccgaagtcagcgcagcgcatggcgtttaccctgctgcagcgcgatcgcagcggcgggatgcgcctggcgcaggcgctgacgcgtgcgatgtcggagatcggccactgcgccgattgccgcaccttcaccgagcaggaggtgtgcaatatctgcagcaacccgcgtcgccaggaaaacggccagatctgtgtggtagagagtccggcggacatctatgccattgagcagaccgggcagtattccggccgctacttcgtgctgatggggcacctgtcgccgctcgacggcatcgggcctgatgacatcgggctcgatcgcctggagcaacggctggaggcggagtcgatcaccgaggtgatcctcgccaccaacccgaccgttgagggcgaggcgacggccaactacatcgcagagctgtgcgcgcagtatggcgtcgacgccagccgaatcgcccacggcgtgccggtgggcggcgagctggagatggtcgacggcaccacgctgtcccactccctggccggtcgccacaagattactttctga

SEQ ID NO: 5806 - DNA, 798 bp, Klebsiella pneumoniae
agctggcaacaggcagcgggccccgggcaggttaagcggtttgcccccgcggagcggccgccacagtggcggcagattttgccgccgaccaccaggcaggtgctggcggccggcagccacctgcagcgcagtcagggagcaaccaccccaaaaaagagtgaaccggcagccgcttcccgcgcgcggccggtgaataacgctgcgctggagcggctgagttcgattaccgagcgcgtccaggctcgtccggccgcggccgcgctggagcaggccccggcgaagaaagaggcctatcgctggaaggcgacgacggtggtggaagagagcaaagtcgaagtcgccacgcccaaagcgctgaaaaaggcgctggagcatgagaagacgccggagctggcggccaagctcgccgaagaagcggtcgagcgcgacagctgggcggcggaagtgagccagctggcggtaccgaagctggtcgagcaggtggcgctcaacgcgtggaaagagcaggagggcagccgcgtctgtttgcatctgcgtcccagccagcgccacctcaattccgccagcgcgcagcaaaagctggctgaagcgctgggggtgttgtacggtacgccggttgaattgaccatcgtggaagacgataatcccgcgatgcgtacgccgctggagtggcggcaggctatttatgaagagaagctcgcgcaggcgcgcgaagccattatcgcggataataacattcagaccctgcgtcgtttcttcgacgccgatctggatgaagagagtattcgccccatttga

SEQ ID NO: 5807 - DNA, 348 bp, Klebsiella pneumoniae
tcgggcaaacaggcgcatggaggcgatttcgtacagggcatcttccatggcaccgtcgctcaggttgtaccaatgctgcatgcagtgaatacgcagcatggtctccagcggatagggccgtcggccattgcccgccttgggataaaacggctcgatgacttccaccatgttttgccatggcagaatctgctccatgcgggagaggaaaatctcttttcgggtctgacggcgcttagtgctgaattcactatcggcgaaggtgagttgatggctcatgatgtccctctgggatgcgctccggatgaatatgatgatctcatatcaggaacttgttcgcaccttccttaa

SEQ ID NO: 5808 - DNA, 891 bp, Klebsiella pneumoniae
catataaaacaccatgaccgtgttaagccgccgacaggccatactgacggttgtagagttaagccagtaaaacgagattgcatgatgagcgtaatgtttgatcctgaaacggcgatttatcctttccctgctaaaccgcagccgctgaccgtcgacgaaaagcagttttaccgcgaaaaaatcaagcgcctgctgcgcgagcgcgatgccgtgatggtggcgcattactacaccgatcctgaaattcaacagctggcggaagagaccggcggctgtatcgccgactcgctggagatggcgcgctttggcgcccgccattcggcctccacgctgctggtcgccggggtgcgttttatgggggaaaccgccaaaatcctcagcccggaaaagaccattttgatgccgaccctgaacgccgagtgttcattggatctgggctgtccgattgaggaattcaacgccttttgcgacgcccatcctgaccgcaccgtagtggtctatgccaatacgtccgccgcggtgaaggcccgcgccgactgggtggtgacctccagcatcgccgtggaactcattgaccatctggatagtcttggtcaaaagatcctctgggcgccggaccgccaccttgggcgctacgttcagcgtcagaccgacgcagacgtgctgtgctggcagggggcgtgcatcgtgcacgacgagtttaaaacccacgcgttgatgcggatgaaggctctgcatcccgaagccgccgtgctggtccatcccgagtcgccgcaggcgatcgttgagatggccgatgccgtaggctccaccagccagctgattgcggcggcgaaaagcctgccccagccgccagctgatcgtggccaccgatcgcggtattttctataa

SEQ ID NO: 5809 - DNA, 1464 bp, Klebsiella pneumoniae
taccaaaaacaattctttcccacgccgcttcgggagcatatctcgctgagtttaccggcaatggccgctgtatcgtccctgagaggggagcgcggtatttttccatttttttacaacaccacatccacaggcagtaatgaatttatgacccatcagttaaaatctcgcgacatcatagcgttgggctttatgaccttcgcgttgttcgttggcgcaggcaacattattttccctccgatggttggcttacaggcgggcgagcacgtctggacggcggcgatcggcttcctgatcactgcggtgggtctgccggtgctgacggtggtggcgctggcgaaagtcggcggcggcgttgaaagcctgagcaccccgattggtaaagtggccggtatcctgctggcggtggtgtgctatctcgcggtaggaccgctgttcgcgacgccgcgtaccgcgaccgtctcctttgaagtcggtattgcgccgctgaccggcgacggcccgctgccgctgctgatctacagcgttatttacttcgcgctggtgattctggtctccctctatccgggcaaactgctggacaccgtgggcaatttccttgcgccgctgaaaattatcgccctgattgtgctggcggtcgccgccatcatctggccagcgggcccgatcagcgacgcgctggaagcgtatcgtacggcaccattctccaatggcttcgtcaacggctacctgaccatggataccctcggcgcgatggtatttggcatcgtgattgttaatgccgctcgctcacgcggcgtcagcgaagcgcgtctgttgacccgttataccgtctgggctggcctgatggcgggcgtcggcctgaccctgctgtatctggcgctgttccgtctgggctctgacagcgctactctcgtggatcagtccgccaacggcgcggcgatcctccatgcctacgtgcagcacaccttcggcggggcgggcagtttcctgctggcggcgctgatcttcatcgcttgcctggtgacggcggtgggcctgacctgcgcctgcgctgagttctttgcccagtatctgccgttctcctatcgcacgctggtctttgttctcggcctgttctccatggcggtctccaatttgggccttagccatctgatccaggtatcgattccggtgctgaccgctatctatccgccgtgtatcgcactggttgtattaagctttacccgcagttggtggcataattcgtcccgcgttatcgcgccggccatgtttatcagcctgatgtttggtatcattgacgggattaagtcatcggcatttgccgcgattctgccggactggaccgcgcgtctgccgctggcggagcagggcctggcctggctgatgcccaccgccgtgatgaccattctcgcggtgatctgggatcgcgcagccggacgtcaggtgacttccagcgcgcattaa

SEQ ID NO: 5810 - DNA, 2058 bp, Klebsiella pneumoniae
ttacaaaaacagtggggatactggatgacagatctttcgcaaagcagagaaaaggacaaaatcaatccggtggttttttatacctcggccggactgattttgttgttttccctgatgacgatcttttttcgcgatttttctgccgagtggattgggcgcaccctggactgggtgtcgaaaaccttcggctggtactatctgttggcggcgacgctgtatatcgtcttcgtcgtctgcattgcctgctcgcgcttcggctcggtgaagctcgggccggagcagtcaaagcccgagttcagcctgctgagctgggcggcgatgctgttcgccgccggcatcggcatcgacctgatgttcttctcggtcgccgagccggtgacgcaatatatgcagccgccggaaggggcggggcagaccatcgaggcggcgcgccaggcgatggtctggaccctgtttcactatggcttaaccggatggtcaatgtatgccctgatgggcatggcgctgggatactttagctatcgttataatttgccgctcaccatccgctcggcgctgtacccgatttttggcaaacggatcaatgggcccatcggccacagcgtcgatattgcggcggtgatcggcaccatcttcggcatcgccaccaccctcggtatcggcgtcgtgcagctcaactacggtctgagcgtgctgttcgatattccggactcgctggcggcgaaagcggccctgattgcgctgtcggtgatcatcgccaccatctcggtcacctccggggtggacaagggcatccgcgtgctctccgagctgaacgtcgccctcgcgctggggttgatcctgttcgtgctgttcatgggcgatacctccttcctgctcaatgcgttagtgctcaacgtcggcgactacgtcaatcgctttatgggcatgacgctgaacagcttcgccttcgaccggccggtggaatggatgaacaactggacgctctttttctgggcgtggtgggtggcctggtcgccgtttgtgggcctgttcctggcgcgcatttcgcgcgggcgcaccatccgccagtttgtgatgggcaccctgattattcccttcacctttaccctgctgtggctgtcggtgttcggcaacagcgcgctgtatgagatcatccacggcgatgcggcctttgcccaggaggcgatggcccacccggagcgcggcttctacagcctgctggcgcagtatccggcgtttacctttagcgcgtcggtggcgaccatcaccggtctgctgttttacgttacctccgccgactccggcgcgctggtgctggggaatttcacctcgaagctgaaggacatcaacagcgacgccccgaactggctgcgcatcttctggtcggtggccatcggtctgttgaccctcgggatgctgatgaccaacggcatctcggcgctgcagaacaccacggtgatcatggggctgccgttcagctttgtgattttcttcgtgatggccggactgtataaatctctgaaagtggaagattaccgccgggtcagcgccagccgcgacaccgccccgcgcccgatgggcctccaggatcgtctgagctggaagaagcgcctgtcgcggctgatgaattacccgggcacgcgctataccaaactgatgatggagacggtgtgctacccggcgatggaggaggtggcccaggagctgcggctgcgcggcgcggcggtggaactgaagagcctgccgccggaagagggcgagaaccttggccacctcgatctgctggtgcacatgggcgacgagcagaattttatctacaagatctggccgcagcagtactcggtgccgggctttacctatcgggcgcgcagcgggaaatccacctattaccggctggagaccttcctgctggagggcagtcagggtaacgacctgatggactacagcaaagagcaggtgatcaccgatattctcgaccagtacgagcggcacctgaactttatccatctgcatcgggaagcgccggggaacagcgtgatgttcccggatggctaa

SEQ ID NO: 5811 - DNA, 1773 bp, Klebsiella pneumoniae
tctgaacgacatctccaccttctactgtctgggcaggacggaggaggagccactatgtttagtctcgacaacgtactcgatgacctgtggcctcaggcgaggcccgccccctggcaaaagaaactgttaaaaaagctattttatgaggaagagtttcaacaatttgccgaccgtcaccgccacctgaaggggcttgatacggtcgaacaggtgctggaatacctcaatatccgctgcgccatcccggcgcacgatctcgaacaaatccccgaatatggcccgctggtcattatcgccaaccaccccaccggcaccctcgacggcctggcgctcctgtatgcggtatcccgcgtgcgccgcgatgtcaaagtggtcaccaaccgcatgctcacccaccttgagcccctgagctcgctgtttatcccggtagataatattcatggccgcaccgctaaagcggcgctgcagcagatggaccagcagctgcaggccggcggggtgctgatcttcttcccggcgggggaagtctcccgtctgacccgccacggtatccgcgataaaaaatggcactccggctttattaagctggcggcaaaatatcgcgccccgctgctgccggcgtggattaacgcccgcaacagcgccctgttttacgccagcacgctggtctccgacgacctgccgctactcctgctgatgcagcagatgtttcgccggcgcaacagcagcctgccggtgcgtatcggccagcagatcccctggtcgaactggttcgatgcgcagtccagcgctcgcgagcttaccggccgctgctatcagcaccttgaacagctgcgcaaagggctgccggggcggtttaaaacagaaagcgccatcgcccgtccggaagaccgggcgctgctcaaacgcgaactgcacaaggccgaatgcctgggccgcaccgccgatggcaaagtgatttacctctggcagcgcaacggccaggaggacgcgccgctgctgcgcgagctgggacgcctgcgggaaatcgccttccgcgcggtcggggaaggcagcggcaaaaggcgggatatcgacgggtatgacgacgactatctgcatctgatcctgtgggatgaagaagacctcgagatcgtcggcgcttaccgctttatgccgacggctatccagttggcaaagcgcggcctggaggggatctacagttacagtctgttccattacgacgggcggatggacgatgtcctgcagcacggcattgagctggggcgcagctttatccagccgcgctactgggggcgtcgcgggctggactacctgtggtccggcatcggcgcttatctggcgcgctatccgcactatcgctatctgtttggtccggtgtcgatttctggcggattgccgcccgccgcccgcgatctgctggtggcgttctaccggatgtggttcccggcgacgcatccgctggcggagtcgcgtcgcccttatccggcgtcgctgcccgacgtgctggcgcagtttggcggggaggattacaacgacgacctggcccggctgaagtctctgctcggcaatctcggctgcgcgatccccccgctgtataagcagtactcggaagtgtgcgagccgggcggcgtgcagtttatcgatttcggcagcgacccggatttcaacaactgcgtggatggtctggtgctggtggatctcacctacctgaaggccaatcgctaccagcgctatattggcgcgcatctgggtgcgcaaaaatcggcataa

SEQ ID NO: 5812 - DNA, 2301 bp, Klebsiella pneumoniae
aggcccggacagcgtcgtacgtatcgacctgaacgcgcaataaaaataacgggtccggcgacgggccctttgattcatttatcctcatccatggggcaaattatgcacaccacgcactattcatccttcccgctgcgtaaaacgctgctggccttagccatcggcgccgccagtcaaacggcgatggccgcggacgctgccgccgcgaagcagcctggcgaagagaccctcatcgtcgaggctaacgaaaccagcgattttaaatccggcggcgacctggtggttccggcattcctcgatggccagatcgcccacggcggccgtctggggatgcttggcgaacaaaaagcgatggacgtcccgtttaacgtcatcggctatacctcgaagctgattcaggatcagcaggcgaaaactatcgccgatgtcgtcagtaacgacgctggcgtgcaggccgtacagggctacggcaacttcgccgagacctatcgaatccgcgggtttaagctcgatggcgatgacatgacgatgggcggcctggcgggcgtggtgccgcgtcaggtgatggacacccagatgctggagcgcgttgaaattttcaaaggggctaacagcctgcttaacggcgcggccagcagcggcgtcggcgggatgattaacctcgagccgaagcgggcggaagatctgccgaccgcgcgcgttggcgtcgactatacctctgattctcaggtgggcggcaccctcgacctggggcgccgtttcggcgacaacaaccagttcggcgcccgggtcaacctggtgcatcgcgagggtgaaggcgctatcgataatgataaacgccgtaccacgctggcttcgctggggcttgattaccgcggcgaccgtttccgctcctcgctcgatttcggctatcagaagaaaacgttccacggcggtacgatgggcgtcaatatcagcggcgtggatttcgttccggcgctgccggacaacagcaaaaactacagccagaagtggggctatagcgatattgaaagcgagttcggcatggcgaaggcagaatatgacctgaccgatagctggacggtatacagcgccctcggcggccagcattcgcatgaaattggtacctacagcgcgccgaagcttctgaataaaaacggcgatgcgacggtgggccgcctggatactaaccgcattatcgacgcgatcagcggcatgggcggggtacgcggcgatttcaataccggcgcgatttcgcataaggtgaacctcggctatgcggcgcaggtgcataccgatgcgaccgcctggcggatgtcggccaggaacccgaccactaatatctatgacaaccatgatgtggcgatgccggataacgcctattttggcggcaactaccacgatccgctggtcacctcgcgcagccgtacgcagggctggctgctgagtgataccctcggcttctttaacgataaagtgctgtttaccgccgctgctcgtcatcagaaagtggttgtgcgcaactacagcaacgccaccgggctggaagatacctcttcgcgttatacccaaagccgctggatgccgacgtttggcctggtgtacaagccgtgggagcagctgtcgctgtatgctaaccataccgaagcgctgcagccgggctctgtggcgccgacgacggcggccaatgctgggcagagtaccgggatcgcgcactcgaagcaggacgaagtgggcgtcaagatcgactacggtacgatcggaggatcgctggcgctgtttgaaatcaaaaaaccgaacgccatttccgataccgctggcaattacggcctcgacggcgagcagcgtaaccgcggcgtagagatgaacgtctttggcgagccgatgctgggactgcgtcttaacgccagtaccgtctggctggatgccaaacagactaaaaccgctgaaggcgcaaccgacggtaaagatgccatcggggtggctaacttctacgcggtactcggcgccgaatatgacatcaagccggtggaaggcctgaccgccaccgcgcgcgtcaatcatagcggctcgcagtatgccgatgcggccaataccaagaagctggatagctacaccaccctggatttaggcctgcgctatcgtatgcgtctgaacgccgaccagaacgaaatgatctggcgcgtcggggtgaccaacgtgaccaacgagaagtactggtctggcattgacgataccggtacttacctgttcgaaggcgatccgcgtaccgtccgcgtctcaatgagctacgaattctga

SEQ ID NO: 5813 - DNA, 1365 bp, Klebsiella pneumoniae
ccaaacggacaaaccatgactgacaaattaactctcgccgtcaaccatgcgttgaacgatgcgcggatggcgcgcgcccgtatgggtttgctgaatcccactatgggcctggataataagcgcggctctgcgtggtgcgaatacggcttccctgagcagatcacttacgacaacctgtactcgctatatcgccgcggtggcatcgctcacggtgcggtagagaaactcgtcggtaaatgctggcagactaacccggaaattatcgagggtgacgacgccgacgagagcaaggacgaaaccccttgggagaagagcgccaaaaaggtttttactaaacgactctggcgcgcttttgcggaagcagaccgccgccgtttggtcggtcgctatgctggaatcctgcttcacatcaacgattccagaaaatgggatcagccggttgttcgcgggaagtcactcaaaaaggtaacgatcgcatgggccggttcgttaactgtgagtcagtgggtcactgacgagaattcggcagactacgggcagccaaagcagtggaaatacgttgagagtctgccaaatggagggacaaatcagcgttttgtacatccagatcgcgtcttcatccttggtgactactctaacgatgctattggctttcttgagccaccttataacgcctttgtcagtctggagaaagtggagggcggttctggtgagtcgttcctgaaaaacgccgctcgccagcagaacatcaacttcgataaagagattaattttagcgagttggcctcgatgtatggcgttacggttgacgagcttcaggagcgatataacgatgccgcccgagaactaaaccgaggtaatgacactctgctcattacgcaaggagccagcatcacttcgctagtttcaccagtatcagacccatcgccaacttataacgtaaacctgcaaaccgctgccgccggggtggatatccctacgcgcatcttagtaggtaatcagcaggctgagcgttccagcactgaagatcagaagtatatgaatgctcgctgtcagtcgcggcgcggagatttgtcattcgaaattgaagacttcagcgacaagttaatcgacctgaagattattgatgcagtcagcgagaagacggtgatctgggatgaccttaacgagcagactggcactgagaagctcaccaacgctaagactatgggcgagataaaccagaccatgatgggaagcggtgaagaaccggcattcagtcgcgaagagatccggaccgccgctggttatgaaaacgatggtgaaataccgttaggagaagaggatggcagcgaagaagacgaagccaccgattctaccgcgtaa

SEQ ID NO: 5814 - DNA, 426 bp, Klebsiella pneumoniae
tgttcgttgcaccttgtgcggcggttattacaaagccgacgatccagaaagtcacgaatgcgagggtgcagcatgactgatatcaccgaactggcgcagaggttaaaacttgaagtacatcgcgcagtaagcaatttcaaccctcagatgaatattaaaaccagagacctaaaggagctggtagaggcgctggagaaggcgcaggctcaatcatcgaaatggcttgaggcctaccataaagccgtatcgattggcgctcggtatgaggagcgcatcgccgagctggagtcccgcaccgtgaagctgccagacttacggcaaattgtatctggggacagatatgtctggtctgatggagtttataactacagccaggacgtaaaggtagcgctggccgccgctggcatcaaggtggaggatgagtga

SEQ ID NO: 5815 - DNA, 189 bp, Klebsiella pneumoniae
aatctgctgcaaagaattgaattagttgttgacagattttcgctcaaacatgatatgctgcctaaaatgtataacggattaccatctacaaggcttactatatttttaggctttttctcaacggttattacaccatacacatttgatcttgggaacccgtcgtgtctgataattggagatgtagtataa

SEQ ID NO: 5816 - DNA, 765 bp, Klebsiella pneumoniae
gcgaatatgcaaaacaccattcatccacgcgatctgatcgtcggtttacaaaaagggctggcgctaattcagcttttttccaaaacctgcccaaagctcaccgtcgcccagacggcgaaaatgagcggcctgacgcaaagcgccgcgcgacgttttctgctgacgctcctgcatgagcgctatctgcaaaccgacgggcgctattactggcttaccccaaagacgctgcggcttggccaggcctatgtcgattcggcgcagtttcctcgcatggtacggccgattgtcgaatacatcgccagccggaccgaagagcacgcctcggtgggggtggtggatgaagatgaactggtctatatcgcccgcagtcggcatacgccgttcaactctacgtcggtgcggcttggggagcgggtgcccattttctgtaccgccggggggcgattgtggctggcttcgctgccggaagcagagtgtgagaccgtcctgcagcgcataacccgggaacaacgtaccccttatacggtgaccgatattgcgtcgctgatggagaaaatcgcccaggtacggcgccagggatacgccaccattgagcaggagtttgagattggcatgctggtgctggcggtgccgttaaccgacagagaagggacctggtggggggcgctgagtctgaccagtcatcaatcgcgcacttcgctggaagcgttatgccgcgatcacctcgatctgctctacagcgcgcaggcgatgctggtgggttaa

SEQ ID NO: 5817 - DNA, 372 bp, Klebsiella pneumoniae
gcgccagtgcagtatcagaggagagagcatatgacgatttccgctcaggtgattgatactatcgtcgagtggattgatgataacctgcatcaaccgctgcgtattgatgatatcgctcgccatgccgggtattcgaaatggcatctgcaacggctgtttttacagtacaaaggggagagcctggggcgctatattcgcgaaaggaagctgctgctggccgcccgcgatctgcgcgacaccgatcagcgggtctacgatatctgcctgaagtatggcttcgattcgcaacagacctttacccgcgtcttcacccggaccttcaatcagccgccgggcgcctaccgcaaagagaaccacagtcgcgcccactga

SEQ ID NO: 5818 - DNA, 1005 bp, Klebsiella pneumoniae
gccggggtgcagtccgctctggcatcgcgttgttcaaggagaattgcaatgatgctgtggcaagctacgccagccagtctctggcagggacgcgacgacagcgcggaagcgcccaatgcgctgcgcctgttccagaccatcgcccgcgcggaacgcttcgcgccgcaggagatgcccggcgatatcgcgctgctcggcttcgcctgtgacgaaggggtccggcgtaacaaggggcgtaccggggcagcggacggcccggcgaccctgcgccgggcgttggccaatatggccagccatcagggtcatgaccgctgcgtggatatgggcaccatcagcgtcgacggcgagcagttagaagccgcgcatcaggcgctgcgcgaggcggtggccgactgtcagcgggcgggtaaacgcacgctggtcctgggcggcggccacgagacggccttcggccacggcgctggggtactggatgccttcccaggcgaaaaagtgggcattattaatctcgatgcgcatctggatctgcgctttgccgactgcgccagctccgggacgccgttccgccagttggcgctggagtgtgacgcgcagcagcgcggttttcactatacctgcatcggggttagccgggcggcgaacacccaggcgctatgggatgaagcggcgctccgccaggtggctatcgttgaagatctggaggtgctgacagccttcgaaactcgcgtgttgccggagcttgagcgcaatatcgcgcaattcgaccgcctgtatctgactatcgatctcgacgtgctgccggcgcgagaaatgccggcggtgtcggccccggcggcgctgggcgtgccgctgggcacgctgctgcgcatcgttgagccgctgtgccgcagcggtaagctgcaggcggtggatctggtggagtttaacccgctgtttgacattgacggtcagggcgctcgcgcggcggcccgtgtggcatggcaaatcgcccattggtggcgctag

SEQ ID NO: 5819 - DNA, 951 bp, Klebsiella pneumoniae
ggcgtcccgcattggcgctaccactccgggacggccccccggtggcgctacgcttaccggggctacgtaacaccgccgaaaggtagcccggataaggcgcggcgcaccaccatccgggaagccaggctcccgacgttcgacactatattgaagagaataatcattatgatcggtaaagactttgcacaacacctatttagcctgcgggatcgcgtcgccttcgtcaccggcgccggcagcggcatcggacagaccatcgcctgcagcctcgccagcgcgggtgcacgggtagtctgttttgatcttcgcgacgacggcgggctggcggaaacggtcagccatattgaatccatcggcggtcaggcttgctcttataacggcgatgtccgccagattgccgacctgcgcgccgccgtcgcgctggccaaaagccgctatggccgcctcgatatcgccgttaacgccgccgggatcgccaacgccaatccggcgctggagatggagagcgagcaatggcagcgggtgatcgatatcaatctcaccggcgtatggaactcctgcaaagcggaagcggaactgatgctggagtccggcggcgggtcgattatcaatatcgcctcgatgtcggggattattgttaaccgcggcctcgaccaggcgcattacaactgctccaaagccggcgtgatccatctgtcgaaaagcctggcgatggagtgggtgggcaaagggatccgcgtcaattccatcagtccgggatataccgccacgccgatgaatacccgtccggagatggtgcaccagacccgcgagtttgaaagccagacgccgatgcagcgaatggcgaaggtggaagagatagccggcccggcgctgttcctcgccagcgacgccgcctcgttctgcaccggcgtagacctggtggtcgacggcgggtttgtctgctggtga

SEQ ID NO: 5820 - DNA, 315 bp, Klebsiella pneumoniae
aacaagccgcaagtggtggcagccatgaaagtaacagctgagtcaatcctgtccatcctgcgcaaggacgcgcggaacaacataacggtctttcatcgctggcagaccgcggctggcgccctagggtacaacgcagggataaccctgaactttcatgaaccttattacgccgggtgggcgccagcacttgagatgaaagaagtgttcatctcggcgcctgaactggaaatggttaagccattcctgaccgtcgagcgctggggaaacggaacgcttggcggagaaatttaccggttaccacgggaggcacaatga

SEQ ID NO: 5821 - DNA, 444 bp, Klebsiella pneumoniae
accttccagcaaggggaaggtcaaggagaaaaaatgaatatcagcgatgtggcgaaaaaaaccggcttaaccagcaaagcgattcgtttttatgaagagaaggggctggtaacgccgccgttgcggagcgaaaacggctaccgcacctatagtcagcagcatctcgatgagctgacgctgctgcgccaggcgcggcaggtggggtttaacctggaagagtgccgcgaactggtggccctgttcaacgacccgtcgcggcacagcgccgatgtgaaaaaacgcacgctggagaaagtggcggatatcgagaaccatatccgcgagctgcaaaatatgcgcgcgcacctgctggcgctggccgaatcctgccccggcgacgacagcgcggagtgcccgattatcgataatctttccggctgctgccatcgcaaggcgcaggcttaa

SEQ ID NO: 5822 - DNA, 1224 bp, Klebsiella pneumoniae
tatcaacagcaccggtcattaaccgaggataagccgatgctgaatatcgccgccctgcgccagcagcaaattccgctggccgctgagccgcgctcgccggtgccgtttcatattctgatgaagccgattggccccgcctgcaatctcgcctgccgctattgctattacccgcaggacgaaacgccggtcaacaagatggatgacgcgcggctggagcagtttatccgccgctatattgccgcccagcccgccggcgcgcgggaaatcaactttgtctggcaggggggcgagccgctgctggccggcctgagcttctacaaaaaagcgctcgccctgcaggcgcgctatgcccccgacggcgtgactatcagcaacagcctgcagaccaacgggacgctgatcaacgacgcatggtgccgactgttccgcgaacatggctttattatcgggttgagcctcgaaggcaacgaagcgctgcaggactaccatcgtccggataaacgcggccggtcgacctggtcggcggcgctgcgcggcattgacctgctccatcagcatcaggtggactttaatctgctggtggtggtgcataacgagatggcggcccacgcggcggcgatttatgaccggctggtcagcctcggcgcgcgctatctgcagtttcagccgctgatgagcgaaggcgcggccctgcgcgaaggataccagctcagcgccgataactggggacgttttatggtcggcatctggcgacagtggcggaagcgctgcgatagagggcgggtgttcgttatcaatatcgaacaggcgtgggcgcagtatttcactcataccagcggcagctgcgtgcacagcgcccgctgcggcagcaacctggtgatggagcccgacggacagctctacgcctgcgaccacctgatcaacgccgaacatcggctgggtcgccttgacgagcagacgcttgccgccgcagttgacgcctcggtgcaactgcctttcggtcagcagaaaagtctgcgccgcgaatgccagacttgctcggtaaaaatggtctgccagggcggctgcccggcgcatctcaacgccgcaggcaacaaccgtctctgcggcggctactaccgcttctttagcgacatcctcgcaccattacgccccttttcccgcgaccttaatggcctgaaggcctggcgggccgcgtttgttgggactgcgcatactgcgtag

SEQ ID NO: 5823 - DNA, 834 bp, Klebsiella pneumoniae
cgaaaaaagcagaggggaatggtgatggataagaaaattggctttatcggctgcggcaatatgggtaaggccattctgggcgggctgatcgccagcggtcaggtacagccgggacaaatctgggtctacaccccgtcgccggacaaggttgcagctctgcgcgaccagtatggcatcaacgccgccagcagcgcccaggaagtggcgcagattgccgatatcgtcttcggcgcggttaaaccggggatcatgaccaaagtgctgggcgatatcgcctccagcctgaataaagagtcgctggtggtctctatcgccgccggcgttacgcttgagcagctggcgcgcgcccttggccacgatcgcaaaatcattcgcgcgatgccgaatacgccgtcgctggttaacgccggtatgacctccgtcacgcctaacgccctggtgagcagcgaagatgttgccgaagtgctgactattttccgttgctttggccaggcggagcaaattgccgagccgatgatccatccggtggtgggggtaagcggttcggcgccggcctatgtctttatgtttatcgaagcgatggccgatgccgccgtcctcggcggaatgccgcgcgctcaggcctataaattcgccgcccaggcggtgatgggctccgccaaaatggtgctggagagcggagaacacccaggggcgctgaaagatatggtctgttcccctggcgggaccactatcgaagccgtgcgcgtgctggaagagaaagggttccgctcggcggtaatcgaagccatcacccagtgtatggaaaaatcagagaaattgagccgctcctga

SEQ ID NO: 5824 - DNA, 1170 bp, Klebsiella pneumoniae
atattatggcagccaggcagcggtttcacatggtatgttatgccctttgatgttatctggatggaagttgaaatggcaaagatgagggttgggatcgtttttggcggcaagtcggcggagcatgaagtgtcgctgcagtcagcgaagaatatcgtggaagcgattgataaatcgcgcttcgatgtggttctgttgggtattgataaacaggggctgtggcatatcaacgacgccggcaactacctgctcaacgcacaggatcctgcccgcattgccctgcgcccttccacggtgactctggcgcagatcccgggccgcgaagcgcagcagctgattaacgccgaaagcggccaaccgctggcggccatcgatgtgattttcccgatcgtccacggcacgctgggtgaagatggctccctgcaggggatgctgcgcatggcgaatctgccgttcgtcggctccgatgtgctgggctctgcggcctgtatggacaaagacgtgaccaaacgtctgctgcgcgacgccgggctcgccgtcgccccgtttatcacactcacccgcgccaaccgcgcgcagttcagctttgccgatgtcgaagcgaagctgggcctgccgctgttcgttaagccggctaatcagggctcgtcggttggcgtcagcaaagttaaaaacgaagagcagtaccatcaggcggtggccctggccttcgaatttgaccataaagtggtggtggagcaaggcattaaagggcgggaaattgagtgtgctgtgctgggtaacgaccacccgcaggccagcacctgcggtgaaatcgtcctcaacagcgagttttacgcctacgacaccaagtatatcgacgatcagggcgcgcaggtggtagtcccggccgctatcgcccctgagatcaacgacaaaattcgcgctatcgcggtgcaggcctaccagaccctgggctgcagcggcatggctcgtgtcgacgtgttcctcaccgccgacaacgaggtggtgatcaacgagatcaacaccctgccgggctttaccaacatcagcatgtatccgaagctgtggcaggccagcggtctcgactacaccagcctgatcacccgcctgattgagctggcgctggagcgccatgccgcggaccgggcgctgaaaacctccatgaactaa

SEQ ID NO: 5825 - DNA, 324 bp, Klebsiella pneumoniae
  unsure (91): Identity of nucleotide at the above locations are unknown.
cttctacggcagaaggcagacggatttcgctgcgggcttagcttgatcattcagttgcaacattccggtgacaatttttccttgacctatntttccgatcatggtttggcgttcaaggagcgggtcaaagagttgcagtatctggcgcatgatgataagttccagcagaactttcaggtgccgtttatggtgctatccagcgatgacaaagcgcatatagtgattaaggcgcagcgttcggcgaatgatttcctcagtgtctttctcccagtggaccgggatccaggcggcggaaatcaccccacgctatcggtttatctctga

SEQ ID NO: 5826 - DNA, 1164 bp, Klebsiella pneumoniae
ttgtggcggcatccgccgccgggaaggcttagcccacgggaggatagagtgaaaagaaaaaccggtttcttttttgatgaacgttgtttctggcacagtaccggtctgcacgcggtgacgctgccggtgggcgggtgggtacagccgcccgccggcggcggtcatgctgaatcgccagagaccaaacggcggatgaaaaacctgatggatgtctccgggctgacgccgcagctggcgctgcgcagcgcggcgccggcgagccttgaggacctgcggcggatccaccccgacagctatctggagcgcttcaaggcgataagcgataacggcggcggcatgctcggcaaagaggcgccgctggggccgggcagttatgaaatcgcctgtctttccgccgggctggcctgtgcggcggtggaagcggtgctgaagggggagctggataacgcctattcgctgtcgcgcccgcccggacaccactgcctgccggaccagtcgatgggattttgtttcctcgccaatattcccattgccgtcgagcgagcgaaagcgcagctggggctgggcaaggtggcgatcattgactgggatgttcaccacggcaacggcacccagcatatctacctgcagcgcgacgatgtactgactatctccttgcatcaggacggctgcttcccgccgggctacgccggcgaggacgatcgcggcgtgggcgcgggcgaaggttacaacatcaatattccgctgttggccggggcgggggatgacagctggcgctatgcgctggaaactatcgttattccggcgctggcgcgttttgagccggagctgattattatcgcctgcggctatgatgctaacgccatggatccattagcgcggatgcagctgcacagcgatagcttccgggcgatgaccgaacaggtccagcaggcggcggatcgcctgtgcggcgggaaactggtgatggtgcacgagggtggctacgccgagtcctacgtgccgttctgcggcctggcggtgatggaagccctgagcggcatccgcaccgaggtccaggatccgctgctggaatttattcaacagcagcagccgcgcgccacgttcgcgcagttccagcgccaggccatcgatcggctggcgcagcagtttggcctgcaatag

SEQ ID NO: 5827 - DNA, 1029 bp, Klebsiella pneumoniae
gctatcaggcagccattacggtgccgggcgtttcacaaccaaatttcaggggaaaccatgagcgaaataatggatttaaccgtcatcgaaataaaaccagagcaggcgcctgccctgtaccgggctggcggtcttgacgcttacctggagcagattcgccaggccgtgaacgaggttccggacctgaccaccaagaaaggtcgtgaccgtgtcgcttctctcgcggcgcaggtatcacgcagcaagacggcaatcgagaagccggggcgagagtacctgaaacgccttaaagaggctgtgcgccctgctgaggcggaaattaagcggtttgttgatgcatgtgacgagctgcgcgacgcgacacgtaagccgctgaccgaatgggaagccgagcaggaacgcattaaggccgaagaagccataaacgcccttcacgtcgaagcactggccatgaatgaagagttcgatcggcagctggcagctcggattgagtctgaccacgaaatggccctgctgatgaatgacgctttcgaccgagagcaggcagataaagcagctgaggctgagcgccagcgcattgcccatgaagaagaaattaagcgaatggcagccgccgcagcagcccgagaagttgagcagcgcgcacagcgtgaacgtgaagaagcggcgcatcgcgaagctgtgttgaaagcacaagctgagcaggcagagcgagatcgcattgcagccgagaagaaagctgaggctgacaagcaggccgctatcgaagcggagcgccgcaaagctcaggaagaagccgatcgcatccgccgcgaggcagagcaacgcgaacaggcccgcctggctgaggagaaacgtaaagccgatgagcaggctcgccgcgaagccgacgttaagcaccgcaaggctgtaggcactgaaatcgtcaaagctcttctggccaataccagccttactcgggatcaggctatcgaggtgctcaccgcggttaaagacggccgcattcctcataccggtatcagttactga

SEQ ID NO: 5828 - DNA, 213 bp, Klebsiella pneumoniae
acgggcaggcaattacagaggcttttccttctcgcaatcgttgcgctggcgggctgcagcgcgccgatcgccgccgcttccagcggcgcggcgtcagataccgcctcgttgctctcgaaggtcaacgtttatcatctgaccgaaaaagggctggccgcccaggcaacgatcaatggttataaatactggccggatgctgcgctggatccgtag

SEQ ID NO: 5829 - DNA, 825 bp, Klebsiella pneumoniae
acacttttccttactttgagcgatgcggagcaccctgttatgagtcgcaaacaattagccctgctggagccgacgctggtgcgccaggcgctgctggatgccgtgaaaaaactcagcccgatggtgcaatggcgcaatccggtgatgtttatcgtctgggtgggcagtctgttaaccaccctgctggcgatcgccatggctggcggcgccctgaccggtagcgccacctttaccgccgccgtcagtatctggctgtggtttaccgtgctgttcgccaactttgccgaagcgatggcggaaggccgcagcaaagcccaggccaacagcctgaaaggggtgaaaaaaacggccttcgcccgcaaactgcgcgccccgcagcatgacgcgccggtcgaccacgtgccggcggaagatctgcgcaaaggcgacgtggtgctggtggaagccggggatattatcccctgcgatggcgaagtcatcgaaggcggcgcctcggtggacgaaagcgccattaccggcgagtctgccccggtgatccgtgaatccggtggcgattttgcctcggtgaccggcgggacacgcattctctccgactggctggtgatccgctgcagcgtgaacccgggagaaaccttcctcgaccggatgatcgccatggtggaaggcgcccagcgccgtaaaacgccgaacgagatcgccctgacgatcctgctgatcgccctgacgctagtgttcctgctggccaccgccacatctggcccttctcggcgtggagcggcaatgcggtcagcgttaccgtactggtcgccctgctggtgtgcctga

SEQ ID NO: 5830 - DNA, 2223 bp, Klebsiella pneumoniae
cccgttttcctgaggctccttccatcacctgtcatcacgcgacgggaggggctttctacatctggagatttgactatgaacgttattgcaatcatgaatcacatgggggtttacttcaaagaagaacccatccgtgaactgcatcgtgctctcgaacgcctggacttccgtattgtctacccgaacgaccgtgacgacttattaaaacttattgaaaacaactctcgtctgtgcggcgtgatcttcgactgggataaatacaatctcgaactgtgcgaagaaatcagcaaaatgaacgagtacatgccgctgtatgcgttcgctaacacctactccactctggacgttagcctgaacgatctgcgcatgcaggttcgcttcttcgaatatgcgctgggcgctgcggaagatatcgcgaacaaaatcaaacagaacactgacgaatacatcgacaccattctgccgccgctgaccaaagcgctgttcaaatatgtccgtgaaggtaaatataccttctgtaccccaggccacatgggtggtaccgcgttccagaaaagcccggtaggcagcatcttctatgatttctttggctccaacaccatgaaatccgatatctccatttcggtttctgaactgggttccctgctggaccacagcggcccgcacaaagaagcggaagagtatatcgctcgcgtgtttaacgcagaacgcagctacatggtgaccaacggtacttctaccgctaacaaaatcgtcggcatgtactccgcgccggccggcagcaccgtgctgattgaccgtaactgccacaaatcgctgactcacctgatgatgatgagcgacattacgccgatctacttccgtccgacccgtaacgcctacggtatcctcggcggtattccgcagagcgaattccagcacgcgactatcgccaagcgtgtgaaagagacgccgaatgcgacctggccggtacacgcggttatcaccaactcaacctatgatggtctgctgtataacaccgacttcatcaagaaaaccctggatgtgaaatccattcactttgactccgcgtgggtgccttacaccaacttctcgccgatctatgaaggcaaatgcgggatgagcggcggccgcgtcgaagggaaagtgatttatgaaacccagtccacgcacaaactgctggcggcgttctcccaggcgtcgatgatccacgtgaaaggcgacgtaaacgaagagaccttcaacgaagcctacatgatgcacaccaccacctctccacactacgggatcgtggcctccaccgaaaccgcggcggcgatgatgaaggggaacgctggtaagcgtctgatcgacggctctattgaacgttccattaagttccgtaaagagatcaaacgtctgaaaggcgagtctgacggctggttcttcgacgtctggcagccggagcatatcgatggtcctgaatgctggccgctgcgttccgacagcgcatggcacggtttcaaaaacatcgataacgaacacatgtacctcgacccgatcaaagtcacgctgctgactccggggatgaagaaagacggcaccatggatgacttcggtattccggcaagcatcgtggcgaaatacctcgacgaacacggcatcgtggttgagaaaaccggtccgtacaacctgctgttcctgttcagtatcggtatcgataagactaaagcgctgagcctgctgcgtgcgctgaccgacttcaaacgcgcgttcgacctgaacctgcgggtgaaaaacatgctgccgtcgctgtaccgtgaagatcctgaattctatgaaaacatgcgtattcaggacctcgcgcagaacattcacaaactgattgagcatcacaacctgccggatctgatgttccgcgcgtttgaagtgctgccatcgatggtgatgaccccgtatgccgcgttccagaaagagctgcacggtcagacggaagaagtgtatctcgaagagatggtcggccgcgtcaacgccaacatgatcctgccgtatcctccgggagtgccgctggtgatgccgggtgagatgatcaccgaagagagccgtccggtgctggagttcctgcagatgctgtgcgaaatcggcgcccactatccaggcttcgaaaccgatatccacggcgcctatcgtcaggcggatggtcgttacaccgttaaagtgctgaaagaagagaataacaagtaa

SEQ ID NO: 5831 - DNA, 1818 bp, Klebsiella pneumoniae
tcattatttaaaggaataaagaaaatgtttaagtttaaggcttcttatgtcgcactggcggcagtattaacctcgtcggtagtttatgccgaccccacaagctatacgcactcttccggcgccacggttatcgatattgaaaagccgaacgccgccggtgtctcccataacctgtaccgcgacttcaacgtcggcaccaatggcaccatcctcaataacagcggcgatgatgtcagccacagcacatttggcaatatcgcccgcaacaataatctgaccgccggcagcgcttcggtgattttgaacgaggtgacctccaaaaacgccagtagcctgaagggctttatcgaagtcaacggtcagaaagcggatgtggtaatcgccaacccgaacggcatcacctgttccggctgtagctttgttaataccaacaaggctatcctgaccaccggcaaggttaatatgaccgacgatggcgccatcggcagctataccgtaacgggcggcaccctcaccatcggcgaaaatggcatgaacgccgccaacggctacgcggttctgctcgccgacgcgattaagattaacggtaaagtgcaggccaacaacgccctggtcagcgcgggcaacttcaccatggataacagctctggctcggtgacctccgccggtaaaaaggccaccctgatccagatgacggttaacccgcagtacagcatcgacgtcagcagccttggcggcattgaggccaacagcatcagcatggtcggcaataacatcggctttggcgtacgtaataaaggctctatcgtcgcgaatagttcgctgcagctcaccagcaacggtaatctgctgaacaaaggcacgatcaaaagcaacggtctgctgagtcaggtcgccaccgcctcgggcatcaccaatgacggtagcatcgccggcgcctattatttaatgctctccagtggcgattatatcgttaacaccggttctctctccggcggccagctcattgccaccgccaacggcaacatcaccaacggcgactcaggcacgatgaccggcaccagtggattaagcctgaccagcggcgggaaaatccgcaacgaagaaaaagcctccctgctgtcaaataaccagattgccgccacggcaatcggtgatttcctcaatgaaggcaaaatcagcgccaaaaacaccagcctgacgtttgtcggcgacagctttaaaaacaccggcaatattaactctactggccaaaccaccattcagtcgcttaaacaggacggcagcgccaatacgggcgaaatctataacctcggcaatatcaccggcgaaaatatcaatctgcagaccaacggcacgctggcgcaaagcagcagtggtcgtattgaggcaaccaacgccattaccgcccacagctactggctgaaccaaaatggttatatgaaagccgccgatatcaccaccgatcacggcgtagtgaataattatggcaatattactgccaaaaatatttcaattacgacctactcagatatcaccaacgaagggcagatcagcagcaccggcgacctgaccttaaataccaaaaataaaggcgcgatctacaattattcaaccctcagcgcgggcggcaacatgacgttaaccgccaccaaagtggtcaatggtggtaaaagttgcggcatactgggcctggcgaaatgcggcgtcgggacgttaactgctgacaagctggtactgaactcatcgcagaaatatgttagcgacatgggtggaaaacagtatttcaagagcaccgaagtcaacacggtgaaataa

SEQ ID NO: 5832 - DNA, 408 bp, Klebsiella pneumoniae
tcgtcgtttaaaccactcaaaaggggatgcgttatggacgaatactcgccaaaaagacatgatattgcacagctacgctttctctgcgaaacgctgtatcatgactgccttgcaaacctggaagagagcaaccatggctgggtcaacgacccgacgtcggctgtcaatctccagttaaatgaattgatcgagcacattgccacattcgctcttaattataaaattaagtatgcagaggataataagctgatcgctcaggttgacgaatatctggacgacacttttacgttgttcagtaactacggcattaactctacggatttgcaaaagtggaaaaaatccggtaaccgactatttcgttgctttgtcaacgccagccgggaaaacccggccagtctatcgtgttag

SEQ ID NO: 5833 - DNA, 1698 bp, Klebsiella pneumoniae
ggttgtcttaaaatagggctggcactataccctcatctttttctgtgggtgtgcattatgtcgttattgcctctgcgtcggccggtggtcagccgcacgacttatctgattctctttgcttgctatatcggtatctgtctcaacctggctttttatcgccaggttttcccgttactgccggtaaatagcctgcataactggctggtattcctcagtatgccgatcgtggccattagcgtgatgaatatcctcaccactctcgcctcgttcctgaagctggaccggctggtgattagcctgttcattctgctcagcgcctcggcgcaatacttcatctggaactttggcgtggtgatcgaccgcagcatgatcaccaatatcctcgacaccactccggcggaaagctttgctctactctccggcgaaatgattgccgtcctcggcctttccggggttttggcggtattcatcgcctggtgggtgaaaatccgtaagcccgccacgcggtggcgcggcgcggcgatgcgcctgctcaatatcgccgtttcggcgctgctgattattctggtggccgcgctgttctacaaagattacgcctcggtgttccgtaacaacaaagagctggtgaaatccctgagcccttccaacagcattgtggccgtgaactcctggtatgctcatcatcggatggacaacctgccgctggtgaagattggcgaagatgccacgcagaaagcggtgatgcataacgctccccgtaagaacctgacgatcgtcgtgctcggcgagacttcgcgagcggataacttctcactgggcggctatttgcgcgacaccaacccgctgatgcggcaggacggcgtgatctattttccgcataccacttcctgcggcacggcaaccgcagtttccgtgccgtgcatgttctccaatatgccgcgcgcgcattatgacgaagagctggcgcaccatcaggaaggcgtcctggatattctacagcgcgcagggatccaggtactgtggaacgataacgacggcggctgcaaaggcgcctgcgaccgggtaccacaccagaacgtcaccaacctgaagctcaccgggcagtgcatcgatggcgagtgctacgatgacgtcctgttccataatctcgacagctatatcgataacctgcaacaggatggcattattgtgctgcataccatcggcagccacggtccgacgtactacaatcgctatccagcggcgtttcgcaaattcacgccgacctgcgataccaatgagatccagggctgtacccgggagcagttgaccaatacctatgacaacaccatcctttatgtcgactatgtcgttgataaagcgataaaactactgcaatctaaacaggataaatttaccactagtctggtttatttgtccgaccacggcgaatcgctgggagaagatggcgtctatttgcatggtctgccgtattccatcgcgccggatacgcagaaacatgtgccgatggcgctgtggctctccgccgactaccagcagcgctacggcatttccgcgcactgtctgcagcagcgggcgcaaaaagagaattactcgcaggataatctgttctccaccctgctcggcctgctcggcgtcagcacccgcgagtaccaggcggcagatgatatcttaacgccatgtagagaggctggttga

SEQ ID NO: 5834 - DNA, 549 bp, Klebsiella pneumoniae
ttgattattaaaggaatcaaagaaatgcaactgaacaaagtgctgaaagggctgatgatcgctctgccggttatggcaatcgcggcatgttcttctaacaagaacgccagcaacgaccagagcggtgaaggcatgctgggtgccggcactggtatggacgctaacggtaacggcggcaacatgtcttctgaagagcaagctcgtctgcagatgcagcagctgcagcagaacaacatcgtttacttcgatctcgacaagtacgatatccgttctgacttcgctgctatgctggacgcgcacgctaacttcctgcgcagcaacccgtcctacaaagtgactgtagaaggtcacgcggatgagcgcggtacgccggaatacaacatcgctctgggtgagcgtcgtgctaacgccgttaagatgtatctgcagggcaaaggtgtttctgccgatcagatctccatcgtttcttacggtaaagaaaaaccagcagtactgggtcatgacgaagcggcatatgccaaaaaccgtcgcgccgtactggtttactaa

SEQ ID NO: 5835 - DNA, 888 bp, Klebsiella pneumoniae
  unsure (852): Identity of nucleotide at the above locations are unknown.
agacctattaatagtggccagttaatgacgaacctggacactcttatgaacagctctcttgccgcggtggccgaaactgatttccagccgttcaccgatctcgctgccggccggcagcggaaggtcttaagcgtgcgtaatctgagtaaagcttatcaagcccagcacaaagtgctggacggcatcagctttgatctgcacgccggggaaatggtcggggtcattggccgctccggcgccggtaaatcgacgctcctgcatgtcctcaacggcacccacagcgccagcggcggagaaattcttagctacccggaagtcggtaccccgcacgatgtctcacagctgaaaggccgcgcgctcaatgcctggcgtagccactgcggaatgatttttcaggacttctgcctggtgccgcgcctcgacgtgctcaccaacgtcctgctgggccgcctcagccagacttcaaccctgaaatcgctgtttaaaatctttcccgcagccgaccgggcgcgcgccattgcgctgcttgagtggatgaacatgctgccgcacgcgctgcagcgggcggagaacctctccggcgggcagatgcagcgggtggcgatctgccgggcgctgatgcaaaaccccgggatcctgctggccgacgagcctgtcgcctcgctggatccgaaaaacactcagcgcatcatggatgtgctgcgcgaaattagcgagcagggcatcagcgtgatggtaaacctgcattcggtggagctggtcagggcctactgcacccgggttatcggcgtcgccagcggccagcttatttttgacgatcacccctcccggctgacgcaggatgtgctgcancggctgtacggcgatgaagttagccaattgcattaa

SEQ ID NO: 5836 - DNA, 366 bp, Klebsiella pneumoniae
acgttgattaattttaataatgagggaatttcaatgagcttttttatttctgatgcggtagcggcaacgggtgcaccggcgcagggcagcccgatgtctctgattctgatgctggtggtgttcggtctgattttttacttcatgatcctgcgtccacagcagaagcgcaccaaggaacataagaacctgatgaactccatcgccaaaggtgatgaagtgctgaccaacggcggtctggtcggtcgcgtgaccaaagtggcggaaactggctacattgctatcgcgctgaacgataccactgaagtggttatcaaacgtgacttcgttgctgccgttctgccgaaaggcaccatgaaggcgctgtaa

SEQ ID NO: 5837 - DNA, 729 bp, Klebsiella pneumoniae
tactttgttaatcaggagagagtcatggacagatatccgcgttccgattcaatagtgcagggccgtaccggcctgcagacttacatggcgcaggtgtacggctggatgacggtcggcctgctgctgacggcgtttatcgcgtggtttgcagcgaatactccggcggtgatgatgttcgtcttttcgagcaaaatcactttcttcgggctgattattgcccagctggcgctggtgtttgtgctgtcgggaatggtgcagcggctgagcgccgggatggccaccacgctgtttatgctctattcggcgctgaccggactgacattatcgagcatttttatcgcctatacctattcatcgatcgccagcacctttgtggtcaccggcgggatgtttggggcgatgagcctgtatggttacaccacgaagcgcgatctgagcggcttcggcagcatgctgtttatggggctgattggcatcgtgctggcgtcgctggtcaacctgtggctgaagagcgaggcgctgatgtgggccgtgacctatattggggtggtgctgtttgtcggtctgacggcgtatgacacccagaaactgaaaaacatcggcgagcagattgatacccgcgacagcgccacgctgcgtaaatactcgatccttggcgccttaacgctgtatctggacttcatcaacctgttcctgatgctgctgcgtattatgggcaaccgccgctaa

SEQ ID NO: 5838 - DNA, 1059 bp, Klebsiella pneumoniae
tcatccgttaaggagctgaaaatgctggaacaaatgggcattgccgccaaagcggcctcctggcagctggcgttactctccagccgggaaaagaatcaggtactggaaaagatcgccgattatctggaagcgcagaccgacgatattctgcgcgccaacgcggaagatttagccgaagctcgcgccaatggcctgagtgaagcgatgctcgatcgcctcgcgctgaccccggcgcgtctgagcggcatcgccagcgatgtgcgccaggtgtgcaatctggccgatccggtcggccaggtgatcgacggcgggctgctggacagcggtctgcgtattgaacgtcgccgcgtcccgctgggggtgattggcgtgatttatgaagcgcgtcccaacgtgacggtcgacgtcgcctccctgtgcctgaaaaccggcaacgcggcgatcctgcgcggcgggaaagagacctggcgcaccaacgccgccacggtgaaggtgatccagcaggcgctgcaggagtgcggtctgccggccgccgcggtacaggctatcgagagcccggatcgcgcgctggtgggcgaaatgctgaagatggataaatacatcgatatgctgatccctcgcggcggcgcgggcctgcacaagctgtgccgtgagcagtcaacgatcccggtgatcaccggtgggattggcgtgtgccatatcttcgtggatgaaaccgccgagatcgcccccgcgctgaagatcatcgtcaacgccaagacccagcggccgagcacctgcaataccgtggaaacgctgctggtgcaccgcaacatcgccgataccttcctgccggcgttgagcaagcagatggccgagagcggcgtcaccctgcacgccgccccttccgccctccccgcgctgcaaaacggcccagcgaaggtcgagccggtgaaagcggagcagtatgacgacgagtatctgtcgctggatctaaacgtcaaagtggtggctgatatggacgagggctatcgccccatatccgcgaacatggcacccagcaatccgacgccatcctga

SEQ ID NO: 5839 - DNA, 513 bp, Klebsiella pneumoniae
gaagacgttaaccccaccggaggcgaaatgatgaacaaggttgctcaatattaccgtgaactggtctcctcgctcagcgaacggctccgccatggagagcgcgatatcgacgcgctggtgacgcaggcgcgggaaaaaatcgtccgcgccggcgatctgacgcagagcgagatcgagtcggtgattgcggcggtcaaacgcgacctcgaggagtttgcccgcagctacgaagagagtcacgaagacgagagcgacagcgtgtttatgcgggtgatcaaagagagcctgtggcaggagctggctgatatcaccgacaaaacccagctcgagtggcgggaagtctttcaggatctgaatcatcacggcgtgtaccacagcggcgaagtggtcggtctgggcaacctggtctgcgagaagtgccactatcacctggcggtatacaccccggacgtgctgccgcgctgtcgaaaatgtggccacgatcagttccagcgtcggcccttcgagccctaa

SEQ ID NO: 5840 - DNA, 1896 bp, Klebsiella pneumoniae
ccatcagttaatttgtgcctttgtcatttttatactttttttacaccgcacccgcggatttttgcgaaatctttgcgccgtaatttctatcctccaggtaaatcgaaaacacacccggaggtggattgtgactgcaggcgtactcactggcgttgggctggtgttcctgttactggcttatctggtttatgccttgatacatgcggaggcattctgatggctgcccagggatttttattattagccagctatctgctggtattgctggtgctggcgcgcccgatggggatgtgtctggcaagaatggtgaacgatatcccgcttcccggcctggccggcgtcgagcgcgtcctgtggcgcgtggccgggatccgcgccgaagagatgggctggctgcagtatttgctggcgctcctgctgtttaacgccctcggcggcctggcgctgtttgccctgctgatgctccagggcgtgctgccgtttaacccgcagcacctgccggggctgtcatgggatctggcgctcaataccgcgatcagctttgtcagcaataccaactggcaggcttacgccggcgaaagcaccatgagttatctcagccagatggtcggcctgacggtgcagaatttcctctccgccgccaccggcatcgccgtggtcttcgccctgacccgcgccttcgcccggcagaaaatgtcgaccctcggcaatgcctgggtcgacctgacgcgcattaccctgtggctgctgctgccgctctctctgctggtggccctgttctttattcagcagggcgtgccgcagaatctgcaggcctaccagccccttaccaccctcgaaggggtgcaccagctgctgccgatggggcctgtcgcctcacaggaagcgattaagctgctgggcactaacggcggcggtttcttcaatgccaactccgcccatccgtttgaaaacccgaccgcgctgaccaatctcgtgcagatgctggcgatcttcctgattccggcggcgctgtgcttcgccttcggcgaggtggtaagcgatcggcgtcagggacgcgccatcctgtgggcaatgacgctgatctttatcctctgcgtcgccgtggtgatgtgggcggagacccgcggcaacccccacctgctgacgctgggtgccgacagcagcctgaatatggaaggaaaagagagtcgcttcggtattctcgccagcagtctgttcgcggtgatcaccaccgccgcctcctgcggcgcggtcaatgccatgcatgactccttcaccgcgctgggcggcatggtgccgatgtggctgatgcagattggcgaagtggtattcggcggcgtcggctcgggcctgtacggcatgctgctgttcgttatgctggcggtatttatcgccgggctgatggtcggccgcaccccggagtacctcgggaagaaaatcgatgtccgggaaatgaaaatgatcgccctcgccattctggtcaccccgacgctggtgctgcttggcacggcgctggcgatgatgaccgacgccggccgcgccgggatgttcaaccctggaccgcacggctttagcgaagtgctatacgccgtcacctcggcggccaataacaacggcagcgccttcgctggcctgggcgcggcgacgccgttctggaacctgctgctggcgttctgcatgctggtcggccgcttcgccgtcatcattccggtgatggccatcgccggctcgctggtggcgaagaaaattcaaccggccagccccggcaccctggccacccacgacgccctgtttatcggtttactgatcggcaccgtgctgctggtgggcgccctgacctttattcctgcgctggcgcttggcccgctggctgaacacttttccttactttga

SEQ ID NO: 5841 - DNA, 1203 bp, Klebsiella pneumoniae
ttcgcggttaatattcaactggaaaatataaggtggcttattaatcaaggaaaaactatggcacacacaataaaagcgctggcgatctcgatcggcgcagcattagcgttaacgtcattgccttcccatgcggagattacgctgctgaaacaagatccgcaggcgggcgatccgttaagccgacttaactttaccgtcggcggcagtatccggccgcagttcaacatgatgaccggcgatggcgacaaaggctcctataagcgtaacggttttgacggcggcacccgcttccgcttcgcggcggattactacctgttcgatgatattagctggatcagctactatgagctgggcgtgaacattccggcgctgtttgactgggataaccactacgcggaaggcgcgaacaataccacccgccgcatgctgtataccggcctgaaaagcgatacctggggtacgttaacctacgggcagcagaacagcatttactatgatgtggtgggggtgaaaaccgatatctgggactacgatatgatcggtcaggccccggggaacggtattaatggcgattacgatggctcctatcgttcacgtaatatgctgaaatataagaaaactgtaggtgatgtcgatctttacggctcttatctgttcgaagacagcgaatacctgccgggtaacggcctgcgctacaagcgtaaaggcggtggttctgttggcgcggactaccacatcatgaaggatctgacctggggtaccgcgtggaactacacccgcgccgaaatgcgcgacccgtcaagcgccgacagcaaaacctatgaccagaatatcgtcggtaccgcgctgagctggaccccggataactggaccttctccttcggcagcggctggtatcagaacttcctcaccaccaagaaaaccgatgtgcataattactttgccggtgacgcctgggggattgaatattttgcgggctataaattcccgatcaatcaatacgctgttaaatctattcagccgtactttatgggcgaccgtctggaatatgtgaacggccgcaactatcagcgtatcgataacggtctggggattagcttccagctggattacggtttccgcgttgactacgaacacgtgtttacctccagcaccgacaaccttggcgatatgaacctggtccgtctgcgctacgacttctaa

SEQ ID NO: 5842 - DNA, 936 bp, Klebsiella pneumoniae
cgcgaggttaacgtggtagattcaacactggataaatcggcgcccggtccctggtccggatggcttcatggtttactgggggtgatcattttcagcggttcgctgcccgcgacgcggctggcggtgcaggatatggatccgttgttattgacctttctgcgcgcctctatcgccgggctgcttgccatcgcgctgctggtgggctttcgccagaaacgcccgcgcctggcgcagcttgtgtccctgatcatcgtctcatccggggtggtgctcggctttccgctactcacggcgctggccctgcagcgcatcacctcggcgcattcgattgtgtttattggtctgctgccgctgatgaccgccctctttggcgtactgcgcggcggcgaacgcccgcggcgggctttctggatcttttcgctgctgggcagcctgctggtggtgggattcgccctgacgcaaagtgcggcggcctcactcagcggcgatctgctgatgctggcggcggttatcgcctgcggcctcggctatgcggaaggggcaaagctgacgcgggagctcggcggctggcaggtgatctgctgggcgctggtgatagccctgccgttgatgctccccgcctcgctgctggttcagcccgcgtcctggcatgccatctcggcctcctcctgggcggcgctcggctatgtgtcgctgttcagcatgctgatcggtttcatcttctggtacaaagggctggccgcgggcgggatcgccgccgtcggccagctccagctattacagccgttcttcggactaggcctgtcggcggcgctgttgcacgaaaccgtcagccccttgatgctggcggtcacgctgggcgtggtgctgtgcgtggtgggctcgcgcaaatttggccgccagcgggttggcgaagagaacgggggcaacaattga

SEQ ID NO: 5843 - DNA, 3150 bp, Klebsiella pneumoniae
gacatgcctaatttctttatcgatcgccccatatttgcatgggtgatcgccattatcatcatgctggctgggggattatcgatcctcaaattgccggtggcgcaatatccgacgattgcgccgccagcaatttccattaccgccatgtaccccggtgctgacgccgaaacggtgcagaacaccgtaactcaggttatcgaacagaatatgaacggtatcgatcacctgatgtacatgtcctcaaatggcgactccaccggtacggcaaccattacgctgaccttcgaatccggtaccgatccggatatcgcccaggttcaggttcagaacaagctggcgctggcgacgcctctgctgccgcaagaagtacagcagcaagggattagcgttgagaaagcgtccagcagcttcctgatggttgtcggcgtcattaacaccaacggcaccatgaaccaggacgatatttcggactacgtggcggccaacatgaaggatccgattagccgtaccagcggcgtcggcgacgttcagctattcggttcccagtatgcgatgcgtatctggatggatccaaacaaactgaacaacttccagcttacgccggtggatgtgatcagcgccctgaaagcgcagaacgcccaggtggccgcgggccagttaggcggtacgccgccggtgaaaggccagcagcttaacgcctcgatcatcgcacagacgcgtctgaccaatacggaagagtttggcaacatcctgctgaaggtgaaccaggacggttcccaggttcgtctgcgtgatgtcgccaaaattgagctgggcggcgaaagctatgacgtagtggcgaagtttaacggccagccggcatccggtctgggtattaaactggctaccggcgcgaacgcgctggataccgccaacgctattcgcgctgaactggcgaagatggagccgtttttcccgtcggggatgaagatcgtttacccgtatgacaccaccccgttcgtgaaaatttctattcacgaagtggttaaaacgctggtggaagcgatcatcctggtgttcctggtcatgtatctgttcctgcagaacttccgcgccaccctgatccccaccatcgcggtaccggtggtcctgttaggcaccttcgcggtgctggcggcgtttggcttctcgataaacaccctgacgatgttcgggatggtgctcgccatcggcctgttggtggatgacgccatcgtggtggtagagaacgtcgagcgcgtgatggcggaagagggtctgccgccgaaagaagcgacgcgtaaatcgatgggacagattcagggcgcgctggtaggtatcgctatggtgctgtcggcggtatttatcccgatggcgttcttcggcggctcaaccggggccatctatcgccagttctccatcactatcgtttccgcgatggcgctgtcggtactggtggcgttaatcctgacgccggcgctgtgcgccacgatgctgaaacccattcagaaaggcagccatggcgcgaccaccggcttcttcggctggtttaaccgcatgtttgataagagcacgcaccattacaccgacagcgtaggcaacattctgcgcagcaccggtcgttatctggtgctgtatctgatcatcgtggtgggtatggcatggctgttcgtccgtctgccgagctcgttcctgccggacgaggaccagggtgtattcctgagtatggcgcagttgcctgccggcgccacccaggagcgtacgcagaaagtgctggatgagatgacgaattactatctcaccaaagagaaggacaacgtggaatccgtgtttgcggttaacggcttcggtttcgccggccgcggccagaacaccggtatcgcgttcgtttcgctgaaagactggagccagcgtccgggtgaggaaaacaaagttgaagcgatcaccgcgagagcaatgggctacttctcgcagattaaagatgcgatggtcttcgcctttaacctgccggctatcgttgaactgggtaccgcgaccggctttgacttcgagctgattgaccagggcggtctgggccacgaaaaactgacccaggcgcgtaaccaactgtttggcatggtggcgcagcatcctgacgtgctgaccggcgtgcgccctaacggtctggaagatacaccgcagtttaaaatcgatatcgatcaggagaaagctcaggcgctgggcgtctccatcagcgacattaacaccacgctgggcgcagcctggggcggaagctatgtcaacgactttatcgaccgcggccgcgtgaagaaagtgtacatcatgtccgaagcgaaataccgtatgctgccggaagatatcggcaagtggtatgttcgcggcagcgatggtcagatggtgccgttctctgctttctcgacctcgcgttgggaatacggttcgccgcgtctggaacgctacaacggtctgccgtcactggaaatcctcggtcaggccgcgccaggcaagagtaccggtgaggcgatggcgctgatggaagagctggcgggtaaactgccttccggtatcggctacgactggaccgggatgtcttatcaggagcgactgtccggcaaccaggcccctgccctgtatgccatctcgctgattgtcgtcttcctgtgtctggcggcgctgtatgagagctggtcgattccgttctcggttatgctggtcgtccccctgggtgtggttggtgcgctgttagccgccaccttccgcgggctaaccaacgacgtttacttccaggtgggtctgctgaccaccatcggcctgtcggcgaagaacgcaatattgatcgttgaattcgccaaagacctgatggagaaagagggcaaagggctgattgaggcgacgcttgaagcagtacgtatgcgtctacgtccaatcctgatgacatctctggcgttcatcctcggagtaatgccgctagttatcagctccggcgccggctccggtgcgcagaacgccgtcggtacaggcgtaatgggcgggatggtgaccgcgacgatcctggcgatcttcttcgtgccggtgttctttgtggtggttcgtcgccgctttagcaaaaaatcggaagatatagagcacagccatcaggttgagcatcattaa

SEQ ID NO: 5844 - DNA, 228 bp, Klebsiella pneumoniae
attaatactaaccatcagttaatttgtgcctttgtcatttttatactttttttacaccgcacccgcggatttttgcgaaatctttgcgccgtaatttctatcctccaggtaaatcgaaaacacacccggaggtggattgtgactgcaggcgtactcactggcgttgggctggtgttcctgttactggcttatctggtttatgccttgatacatgcggaggcattctga

SEQ ID NO: 5845 - DNA, 1341 bp, Klebsiella pneumoniae
  unsure (336): Identity of nucleotide at the above locations are unknown.
cattctgctaaattatcgtgggctttccgcccggataagggagatatgatgaagcaggcattacgagtagcatttggttttttaatgctgtgggcggcggtgctgcacgcagaagtacgtatcgagatcacccagggggtggactcggcgcgccctatcggcgtggtaccgttccagtgggccggccagggcgctgcgccggaagatgtcggtggtatcgtggcagctgacctgcgcaacagcggtacattcaatccggtggatcgctctcgtctgccgcagcagccgaccagtgcccaggaagtgcagcctgctgcctgttctgcgctgggtatngacgccgtagtcgtcggccaggtcacgcaaaatccggatggttcttatcaggttgcgtatcaactggtggacaccggcggagcgccgggcacaacgctggcgcaaggttcttttaaagtcactaagcagtacctgcgctatgcggcgcacgcggccagcgacgcggtatttgagaagctgaccggcatcaagggcgccttccgtacccgtatcgcctacgtggtgcagaaaaacggcggccagtacccttacgaactgcgcgtgtccgactacgatggttacaaccagttcctggttcaccgttcctcccagccgctgatgtccccggcctggtctccggacggttctaaactggcctacgttacctttgaaagcggtcgttctgcgctggtggttcagaccctggcgaacgcctctgtgcgtcagatcgcctccttcccgcagcacaacggcgccccggcgttctcaccggatggttctaaactggcgttcgcgctgtcgaaaaccggtagcctgaacctgtacgtaatggatctgggatcgggtcagattcgtcaggtgaccaacggtcgcagcaacaacaccgaaccaagctggttcccggacagccagaatctggccttcacttctgaccaggcaggtcgtccgcaggtatataaagtcaacattaatggcggcacgccgcagcgtatcacctgggaaggttctcagaaccaggacgccgacgtgagcgcggatggtaaaaccatggtaatggtcagctcggccggcggtcagcagcacattgccaaacaagatctggaaacgggtggtgtacaggttctgtcatcaacgtttttagacgaaacgccaagtctggcacctaacggcactatggtaatctacagctcttctcaggggatgggatccgtgctgaatctggtttctacagatgggcgtttcaaagcgcgtcttccggcaactgatggacaggtaaaatcgcctgcctggtcgccgtatctgtga

SEQ ID NO: 5846 - DNA, 990 bp, Klebsiella pneumoniae
catgaccataatagaaagactgtagtgggtttgtggttgtttgagccactgaacattttgaaattggacactcgaggtttacatatgaacaaaaacagagggttaacgcctctggcggtcgttctgatgctctcaggcagcttagcgctaacaggatgtgacgataaaccggctcaacagggagcccagcacatgccggaagtcggtattgtgacgctcaaatccgcacctctacaaataaccaccgaactgccaggccgcaccagcgcctatcgcattgcggaagtccgtcctcaggtcagtggcattattttaaaacgtaacttcgtggaaggtagcgatatccaggccggcgtctccctgtatcagatcgatccagccacctatcaggccagctatgacagcgccaaaggcgacctggcaaaagcccaggcggcggcaaacatggatcaactgacggtcaagcgttatcagaaactgttgggcaccaaatatattagtcaacaagactacgataccgccgttgcgacggcgcagcaaagcaatgcggccgtggtcgcggcgaaagctgccgttgaaaccgcgcgcatcaatctggcctacaccaaagtcacctcgccgatcagcggccggatcggtaaatccgccgtgaccgaaggggcgctggtacagaatggtcaaacgaccgccctggcaaccgttcagcagctggatccgatctatgttgacgtcacccagtcgagcaatgatttcctgcgcctgaagcaggagctagccgacggccgcctgaaacaggaaaacggcaaagcgaaagtggagctggtgactaatgacggtcttaagtatccgcagtccggcacgctggaattctcggatgtcactgttgatcagaccaccggctcaatcacgcctacgcgctattttcccgaacccggatcacaccctgcttccggggatgttcgtccgtgcccgtctggaagaagggattaa

SEQ ID NO: 5847 - DNA, 1452 bp, Klebsiella pneumoniae
ataacacataaatataaggttcgcggcgcctgccacggctggcgccgcccacgccatatcatcatgcatttagagggtactatggattttgaacagatttcccgctcactgcttcccctgctgggcggcaaggaaaatatcgccagcgccgcgcactgcgccacccgcctgcggctggtgctggtcgacgacgcgctcgccgatcagcaggcgattggcaaaatcgacggggtgaaaggctgctttcgcaatgccggacagatgcagatcatcttcggcaccggggtggtcaataaagtctatgccgcctttatccaggccgcaggcatcagcgaatcgagcaaatccgaagccgccgacctggcggggaaaaagctgaacccgttccagcgcatcgcccgcctgctgtccaacatcttcgtgccgattattccggccatcgtcgcctccggcctgctgatgggcctgctggggatggtgaaaacttacggttgggtcgacccgagcaacgctctctatatcatgctggatatgtgcagttcggcggcgtttatcattctgccgatcctgatcggctttaccgccgcacgcgaatttggcggtaacccctatctgggcgcgaccctcggcgggatcctcacccatccggcgctgaccaacgcctggggcgtcgccgccggcttccacaccatgaatttcttcggcatcgaagtggcgatgatcggctaccagggcaccgtcttcccggtgctgctggcggtgtggtttatgagcatggtcgagaagcggctgcgccgcgtgatccctgacgcgctggacctgatcctcactccgttcctgacggtgattatctccggctttatcgccctgctgctgatcggcccggccggtcgcgcgctcggcgacggcatttcgtttatcctcagcacgcttatcagccacgccggctggctggcgggcctgctgttcggcggcctctattcggtgatcgttattaccggtatccatcacagcttccatgccatcgaggccggactgctgggcaacccatcgattggcgtcaacttcctgctgccgatctgggcgatggccaacgtcgcccagggcggcgcctgctttgcggtgtggtttaaaaccaaagatgccaaaataaaagctatcaccctgccgtcggcgttttcggcgatgctggggatcaccgaggcggcaatcttcgggattaacctgcgctttgtgaaaccgttcatcgccgcgctggtgggcggtgccgccggcggcgcctgggtggtgtcgatgcacgtctacatgaccgcggtgggcctgacggcgatcccgggaatggctatcgtgcaggccagctcgctgctgaactacattatcggaatggcgatcgccttcgccgtggccttcgcgctctctctgacgctgaaatacaaaacggacgctgaataa

SEQ ID NO: 5848 - DNA, 720 bp, Klebsiella pneumoniae
atccccaataaggaaaccgcaatgtgcgaatataatcagtttggccaggcgctcggcgtcgcgctgcctgactggcagccgcgcccttggccgacacgacaggtattacagggcagccgttgtcgactcgaaccgctgactcttgctcatgccagcgatctgttcgccgctcaccagctggcgccagacgcccgcagctggacgtggctgctgcgtgaacctgagagcaaccttgcagaattcagtgcctgggtggagcaggtcgccacgctggcagacccgattcattttgccgtcgttgaccagcagcgagggaaagcggtcggctcgctggcgttaatgcgtatcgatatcgctcacggtgtggtagaggtggggcatgtgcatttttcaccgttactgagccgaacggccatggccaccgaagcgcactggctgttgatgcagtatgtctttgatacgctcggctaccgtcgctatgaatggaaatgcaacagtcttaatatcccatcagcccgggcggcaaggcggctggggtttcagtacgaaggacgttttcgccaggcgctggtgagtaaaggacacaaccgggacacggactggttttcggtgatagacggcgaatggccggagctggataacgccatgcgccaatggctggccgccgacaattttaccgccgacggccaacagcgccgctcgctggagagtttccgttaa

SEQ ID NO: 5849 - DNA, 420 bp, Klebsiella pneumoniae
gtctcaaataagtcgctgccggtggcgaaattgcgtcaccggctggttttttttctatctgcgtccagacttacaacgttccactcacagaaggatggtgcgatgaaaataactttattgatgaccctactgtttggcttgatctttatcagcgcggttggcgcggcagaaaaaacgcccactcctcagcagcaaaggatgacggactgcaatcagcaagcgtcagccaaaatgctgaaaggtgaggagcgcaaaacctttatgagccagtgtctgaaaaaagagaccacgacctcgcagggaaaggcgctcacccctcagcagcagaaaatgagcgactgcagcaaagcggccacggcgaaatcactgaagggcgatgaacgcagtaccttcatgagtagctgcctgaagaaagcctga

SEQ ID NO: 5850 - DNA, 831 bp, Klebsiella pneumoniae
aagcgaaataatatgttctcgggtttactctcccactccgcggctccggccgcggatttttcacgtctgcagcgcgccagcattacgttccgtgatgtggccaagcgctacggcgatcatcaggtacttaacgccatcaacctacaggtcgagtccggcgaagtggtggcgatcctcggcccttccggttcgggaaaatcgacgctgatccgcttgatcaaccagctcgaatccttaagcggcggcgagatcctgatcgacggcaaacccaccagccggctgagcggcagcgccttgcgccagctgcgcagccgcgtcggctttgtcttccagcagttcaacctttatgcccacctgacggcgcaggagaacatcactctggcgctggagcgcgttcatggctgggggaaaagcgcggctcaggcgcgggcgctggcgctgctgcgtcaggtcggactggaagaaaaagcgcagcagatgccggcgcaactctccggcggccagcagcagcgggtggccatcgcccgcgccctggcctcctcgccgcagattatcctgttcgatgagcccacctcggcgctcgacccggagatgatcggcgaagtgctgcaggtgatgaaaaccctcgcccacagcgggatcaccatgctggtggtgacccacgagatgcagtttgcccgcgaaattgccgaccgggtggtgtttatcgacggcggcgacatcctcgaagtcgccccgccggctgagtttttcgcccatccgcagcatgcccgcgcacggcgttttctgcagaaggtgctggatccgctgcaccaggagagcctcgagtga

SEQ ID NO: 5851 - DNA, 1629 bp, Klebsiella pneumoniae
aaagatgataacgaaatgtcacagcatggcctgcacagacgcaggagacggtgggagatattcctcgtcttcgcggttccaggacaccgagtgaccgaggagagcacgatgcaggcgacagcaaaagagttcatcattgccctggatgaaggcaccaccaacgccaaagcggtggtgctggatagccggggcaaagttatcgtcaaattctcgcagccgctggcgatccaaacgccgcgcgacggctgggtggagcaatcgggcgaagcgctggttaccgcctcactgacggtgatcgccagcgcggtggcccacgttggcgcggaaaacgtcgccgcgctggccatcagcaaccagcgggaaaccgccatcggctggtatcgcgacagcggcgaaccgattaacgcggccattacctggcaatgcacccgcagcgccgcgttctgcgacacactgcgtcacgatcgtcaggaacagcacattaagcgtgccaccggcctgccaatcgccccgctgttctcggcctccaaaatgcgctggctgctggatgcgactgtcgatggccacctgcgcgccgaacgcggcgaaatttgcctcggcaccatcgacagctggctgctgtggaatctgaccgccggagaagccttctgctgcgactactccaacgcctcccgcacccagttgttgaatctgcaccgcggcgagtgggacgacgagatgctggcgctgttcggcattccgcgcgcggcgttgccggacattaaaccatcgagcggcctcttcggccataccaaaggactggccgccattccggacggtattccgatcatgtcgatgatcggcgactcccacgcggcactgttcggccacgcgctcggcgaggcaggctgcgtcaaagccacctacggcaccggctcttcggtcatggccccggtcaaatcggcgcagtgcgatatcgacgcgctggcgaccactgtcgcctggcacgatggcgaccagctggtgtggggcctggaagggaatattcctcacaccggcgatgctgtcgcctggatggcggacagcaccggactgagcgaactctctgctgccgagctggcccatgagctgaataccctccccgcctccgtcgattcaaccctcggggtctacttcgtgccggcgctgaccggtcttggcgcgccctggtgggacgacagcgcccgcggcgtgatttgcggcctgagtcgcggggtgaaacgcgcgcatatgatccgtgcggcgctggagtccatcacctatcagatagccgacgtggtggtggcgatgcgtcagcatgaggagttcaccctgacggcgttgatggtggacggcgggccgaccaacaatgactggctgatgcaataccaggccgatctgctcggctgcccggtgatgcgcagcgacgtgccggagctgtccgccatcggcgcggcgttgctggcgcgcaaagcgctccatccgggatcgaccgccgatctgcaggccttcttaaccgaacatagcacctttcagcccgacatggtccgccaccagcgcttacaaacgcgctggcaggagtggcgccatgcggtcgaccgaacattatggaaaccggactcgccagcctga

SEQ ID NO: 5852 - DNA, 1893 bp, Klebsiella pneumoniae
gtcagcctcctcaaggagtgcgttatgtcgcaaactgccacactgattctgacccacggtcagattcataccctcgatcgtgcgaatcccctggcggaagctgtagccatcgccgacggaaaaattgttgccaccggaagtcacgatcggatcatgagctttgccgccgaggggacgcaaatcgtcgatctcaaagggcatacggtgatcccgggcctcaacgattctcatctgcacctgatccgcggtgggttgaactacaaccttgagctccgctgggagggcgtcccctcgctggcggatgccctgcgaatgctgaaggatcaggcggatcgcacgccgtccccgcagtgggtgcgggtggtcggcggctggagcgaatttcagttcgccgagcggcggatgccgaccctggaagagctgaacgaggcggcgcctgatacgccggtgtttgtgctccatctctacgatcgcgcgctgttgaaccgtgcggcgctgaaagccgtgggatatagcaaagagacgccggatccggcgggcggcgagatcgtccgcgatagccacggcaacccgaccgggatgctgatcgccaaaccgaacgccatgatcctttacgctacgctggccaaggggccgaagctgccgctggatctgcaggtgaactccacccgtcaatttatgcgcgagctgaaccgactggggctgaccagcgccatcgacgccggcggcggcttccagaactatccggaagattacgaaattatcgaacagctgcacgcgaaagatcagatgaccgtgcgcatcgcctacaacctgtttactcagcggccgaagcaggagctggaggattttgaacgctggaccgacatgctgaagccggggcaggggactgacttctatcgcgccaacggcgccggcgagatgctggtattttcggcggcggattttgaagatttcctgcagccgcggccggatctgccgcaaggcatggaggatgagctggagcgggtggtacgccatctggtggagcatcgctggccgttccgcctgcatgccacctacgatgagtccatcagccggatgctggacgtgtttgagaaggtgaaccgcgatatcccgtttaatggcctgcactggttcttcgatcatgccgagaccattaccgagcgtaacattgagcgggtgaaggcgctggggggcggtattgcggtgcagcatcggatggccttccagggcgaatattttgtcgatcgctacggcaaagaggcggtgaaacataccccgccggtagcaaagatgctggcgctggacgtgccggtggggctgggcaccgatgcgacccgcgtcgccagctataacccgtggaccgcgctgtactggctggtctccgggcgcaccgttggcgggatggcgatgtatgacgacgccaaccgcctgccgcgcgatgtcgcgctggagctgtggacggcgggcagcgcctggttctccagcgagcagggcaagaaaggccgtctggccgccggtcagcttgccgatctggtggtgctgtcgaaagactacttcagcgtcgcggaagaggagatcaaaggcattgagtcggtgctgacggtggttgacggcaaagtggtgtacgccgccggtcacttctcgccgctggcgccgccgccgatcccggtgctgccggagtggtcgccggtggtgaaggtcccgggccattaccgttccgctccgccggcgacggctaaaatcggcgccatggtgcagatgcaccagtgctgcggtagctgtggcgtccacggccatcagcatgatattgcgcgtaagtcgtcgattccggtctctgacgagcaggccttctggggcgtgctgggctgttcctgctttgctttttga

SEQ ID NO: 5853 - DNA, 747 bp, Klebsiella pneumoniae
  unsure (473): Identity of nucleotide at the above locations are unknown.
cgccaggataaggagaacccgtccatgttgaatttacaggcagtaaatcatttttacggcaaccagcattcgctgtggaatgtcgatcttgtactacgcccgggagagtgcattggcgtactgggacgcgagggcatgggaaaaaccaccctggttaactgcattgctggccacctgccggtggccagcggccggatgacctggcatgacattggcgccccgccgcaggatctcacccccctgtccgctcaatcgcgcagcgccattggtatcggctacgtgccacaagataaacgcattttttcccaactcagcgtggaagagaacctgcacatcgccctggcggccgggaaacccggggctaacgccagcggcggcgagatttatgagcattttcccgagctctatgccctacggcagcgcaaaggcgcctcgctgagcgacgacgatcagtaccagctggcgctggccanggcgctgatcgtccagccgcggctgctgatccttgatgaaccctcgcgcggcagagggccgcgctgcctgcaaaagctggcggatctgctgttgcggttaaatcgcgatatcggcctgacggtgctgctcgccgagcagcacctgccctttatccgccgggtggcggatcgcttctgtgtcttgcaccggggccgtaacgtcgccgaaggcgatattatggcgctggatgagccgctgctggcgcagtggataacgccggatccagcgccctga

SEQ ID NO: 5854 - DNA, 327 bp, Klebsiella pneumoniae
tcttcactcctgaacaaagggccgctaccgcggcccttttttatcactggctggcaaggcacatattgccattgtttatttttcgttctgcatttaatatatattgatatggcgcaggctatttttagcagcttgttcaacaactcgggatcggcaaacactcatttaccaggaataatcctactatcattatccacgggtcggcggtttctgaacgcgacagctgcctgccttaaaccaatgattcataagatttctctatttctccggctgtgggccagcgcctgcgaaattaattcgtctatttttaagataatttctcgctga

SEQ ID NO: 5855 - DNA, 2736 bp, Klebsiella pneumoniae
ggaaaatgtaaattgaccaagatgaataacccaaagtttacgacgccctcgggcgacaccgcgccacggcaggtctggcagcagaccgttgacgcagtgctggcgcagaccaaaagccaggccgctgggttaagttccgcagacgccgccgagcgcctgaatacctgtgggccgaacgcgctgccggaaaagaaaggcaaaccgggctggttgcgctttctcgcccactttaacgacgtactgatttacgtgctgctggccgccgcggcgctgactgccatcatggggcactgggttgataccctggtgatcctcggcgtgacggtgattaacgccctgatcggccatatccaggagagcaacgccgaaaaatcgctgcaggggatccgcaacatgctctccagcgatgcccgcgtccagcgtaacggcaagcatgagactatcccgacgcgcgacctggttccgggggatatcgttatcctgcgcgccggcgaccgcgtgccggcggatatgcgcctgattgaaacccacaacctgcgggtggaagaggcgatcctcaccggcgagtcgacggtggtggataaaatcaccgacgcgctggagggcgatctgccgctgggcgaccgggtgaacatggtcttctccgggaccaccgtcagcgccggcggcggcgtcggcgtggtgaccgccaccggcgcgcagaccgaactcggccatatcaaccagatgatggcgggtattgagaagcaccgtaccccgctgctggtgcagatggataagctcggcaaagcgattttcgccattattctcgccatgatggtggcgctgtttatcttcagcctcgcgctgcgggatatcccgatgggcgagctgctgctgtcgctgattagcctggcggtagccgcggtaccggaaggactgccggcgatcatctcgattattctgtcgctcggcgtgcagacgatggcgcgcaagcgggcgattattcgtaagctgccgaccgtggaaaccctcggcgccatgaccgtggtctgctcggataaaaccggcaccctgacgatgaacgaaatgaccgtcaaagcgatcatcaccgccgactgctgctatcgggtggaaggcgacagctacgagccgcaggggcggatcttcctcgaggggagcgatgagcccgtgcaggttcagcccggcaccgtgctggagacctggctgcgcaccatcgacctgtgtaacgacagccagcttacccaggatgagcgcggtctgtgggggatcaccggcgggccgaccgaaggggcgcttaaagtgctggcggcgaaagcgcagctcccggcggtggaggcccgtctggtggccaagatcccctttgactcgcagtacaaatatatgtcgaccctgcagcacatcgatggcaatgcccgggtgctgatcaccggtgcgccggacgttatcttcgccatgtgccgcgagcagatgagccgccacggcgcggtgccgttcgaggcgcagtactgggaagaggagatggcgcgcttcgcccgtcagggactgcggatggtggcggcggcctgtaagccggccagccttgatgccaccaccctcaaccatgaggacctgcaggagggactgattttcctcggcatcgccgggatgatggatcccccgcgtccggaagccattgacgccatccacgcctgccagaccgccggcatccgcgtgaaaatgatcaccggcgaccacccgcagacggcgatgagcatcggccagatgctggggatcaccaacagtagccaggccatgaccggctaccagctggagcacatggacgatgcggcgctggcgaaggcggcggtggagtacgacatctttgcccgtaccagcccggagcataagctgcgcctggtgaaagccctgcaggataacggcgaagtggtcggcatgaccggcgacggcgtcaacgacgcgccggcgctgcgccaggccgacgtgggtatcgccatgggtatcaaaggcaccgaagtcaccaaagaggcggccgacatggtgttaaccgatgataacttcgcgaccatcgccagctcggtaaaagagggccgtcgggtctatgacaacctgaagaagaccatcctcttcatcatgccgaccaacctggcgcaggggctgctgatcatcatcgccctgctggcggggaacattattccgctgaccccggtgctgatcctgtggatgaacatggcgacgtcggcgacgctctccttcggcctggcctttgaggccgcagagcgcaacgtgatgaaccgtccgccgcgtaaaaccggccagcatgtgatggatggtttcgccgtgtggcgagtggctttcgtcgggtcgatgatcgcgattgccgcctttatccttgaggcctggctggcgccgcgcggccacagtccggagtttatccgcaccgtgctgctgcagatgctggtgacggcgcagtgggtctacatgatcaactgccgcagcagcgacagcttctccctgagcatgggtctgctgcgcaacaaaggcatctggctggtgaccggcgtcctgctgctgatgcagctggtcattatctatgtcccgctgatgcagagcatgtttggtacggaagcgctgccgctgcgctactggtttgtcactctggtcatcggcgtcgccatgttcctggtggtggaaatcgagaagcgtctgacgcgccggttccgcaaaacggcctga

SEQ ID NO: 5856 - DNA, 294 bp, Klebsiella pneumoniae
tccgtccgtaaggttacaatcagtgcagcaggtattttaaaattactccaggagacggaaatgtcatacagtggcgaacgagacaactttgcaccccatatggccctggtgccgatggtcattgaacagacctcacgcggtgaacgttcttttgatatctactcccgtctgcttaaggaacgcgtcatttttctgaccggccaggtcgaagaccacatggcaaacctgatcgtggcgcagatgctgtttctggaagcggaaaacccggcaaaaagacatttacctgtacattaa

SEQ ID NO: 5857 - DNA, 2025 bp, Klebsiella pneumoniae
ttgatgagtaaatcgtttgtactgcattccgcctttcgcccctccggagaccaaccggaagccatccgccgcctggaagaggggctggaggatgggcttgcgcatcagacgctactgggggttaccggctccggtaaaacctttaccatcgccaacgtgattgccgacctgcagcggccgacgatggtgctggcgccaaacaaaaccctggcggctcagctctacggcgagatgaaagagtttttcccggagaatgccgtcgagtatttcgtctcctactacgattactatcagccggaagcctacgttcccagctcagataccttcattgagaaggacgcctcggtaaacgaacatattgagcagatgcgtctgtcggccaccaaagcgctgctcgagcggcgcgacgtagtggtggtggcgtcagtctcggcgatctacggcctcggcgacccggacctgtatctgaaaatgatgttgcatctgacggtcggtatgctgattgaccagcgggcgatcctgcgtcgtctggccgaactgcagtatacccgcaacgatcaggccttccagcgcggcacttttcgcgtgcgcggcgaggtgatcgacgtcttcccggcggaatccgacgatatcgccctgcgcattgagctgtttgacgaagaggtcgagcgtctgtcgctgttcgacccgctcaccggccacgtcgaagggacggtgccgcgctataccatttatcccaagacccactacgtaacgccgcgggagcgcatcgtccaggcgatggaagagatcaagctggagctggcggagcggcgcaaggtgctgctggccaacaacaagctgctggaagagcagcgcttaacccagcgtacccagtttgacctcgaaatgatgaacgagctgggttactgctcgggcattgaaaactactcgcgctttctctccgggcgcgggcccggcgagccgccgccgaccctgttcgactatctgccggcggatggcctgttggtgattgacgaatcccacgtcacggtgccgcagatcggcggtatgtaccggggcgaccgggcgcgcaaagagacgctggtggaatacggtttccgcctgccgtcggcgctggataaccggccgatgaagtttgaagaattcgaagcgctggcgccgcaaaccatctatgtgtcggcgactccgggcgcctatgagctggataaatccggcggcgaggttgtggatcaggtggtgcggccgaccggtctgcttgacccaatcatcgaagtgcgcccggtggcgactcaggtcgacgatctgctgtcagagatccgcctgcgcacggccatcaacgagcgcgtgctggtcaccactctcaccaagcggatggcggaggacttaaccgagtaccttgaggagcacggcgagcgcgtgcgctatctgcactcggatatcgacaccgtcgagcgcatggaaatcatccgcgacctgcgtcttggcgagtttgacgtgctggtggggatcaacctgctgcgtgaggggctggatatgcctgaggtgtcgttggtggcgatcctggatgcggataaagagggcttcctgcgttctgaacgctcgctgatccagaccatcggccgcgcggcgcgcaacgtcaacggcaaggccatcctctacggcgataagatcaccccctccatggccaaagccattggcgagaccgagcgtcgacgggagaaacagcagcgctacaacgaagagcacggcatcgtgccgcaggggctcaataagaaagtggtggatatcctgcagctgggccagggcctggcgaaaaccaaagccaaagggcgcggtaaagcgaaggccgttgagcctgccgggcttagcgctgtggatatgacgccaaaagcgctgcagcagaaaatccacgagctggaagggcagatgatgcagcacgcgcagaacctcgagtttgaggaggcggcgcaaatacgcgaccagctgcatcagctacgcgagctgtttatcgccgcctcctga

SEQ ID NO: 5858 - DNA, 939 bp, Klebsiella pneumoniae
aagatgagtaatgcagaacacctggctaacgtcatggtcgaagcctttatcgccgccgtggagcgcggcgtcgatctggtgccggtggtagccgactccacgtcaacggccaaaatcgcgccgtttattaaacagttccccggccggctggtgaacgtcggcatcgccgagcagagcatggtcggcaccgccgccggtctggcgctgggcggaaaagtggctgtgacctgtaacgccgcgccgtttcttatctcgcgggccaatgagcaaatcaaagtggatgtctgttacaacaacaccaacgtcaagctgtttggcctaaacgccggggccagctacggtccgctggccagcacccaccattcaattgatgacctggcggtgatgcgcggcttcggcaatatccagatcttcgccccctccacgccgcgcgaatgtcggcagatcatagactatgcccttgcttatcagggcccggtctatattcgtctcgatggcaaggcgctgccggagctgcttgacgagtcgtatcgctttgttcctggcgctgtgctgaccctgcgtgaaggcgaggacgtcgcgctggtggccaccggttcgacggtgcatgaggtggtggaggcggcgcagcagcttgccgacctcggtatccaggcgaaagtggtcagcgtgccgtcgattcgcccctgcgataccgcggcgctgctggcggcgctccagccatgtggttcggtgatcaccgtcgaagagcataacgtcaacggcgggttgggtagcctggtggcggaagtgctggcggaagcgggcgtgggcattgccctgcagcggttggggatcccggacggggagtacgccgccgccgccgatcgcggctggatgcgtcagtaccatgggtttgatgccgccgccatcgttgccctggtgcaaaaaagagactga

SEQ ID NO: 5859 - DNA, 207 bp, Klebsiella pneumoniae
agcgtgagtaaaagaggtattggtcgagaggctgaggcaaatgtactggctattttatcgacaatcggccgagccgtagaggttaggtttatttatttatgcattaaacaggaaattttacgcgttgcgtctaataatagagtagtccccagcgtaagggctgaatttatcctggaatcggcttataataacgcgctttgtgattga

SEQ ID NO: 5860 - DNA, 243 bp, Klebsiella pneumoniae
agggtgagtaaggtcgaattgcttgagaagatatcggcgctcgctactgaatgccacgcgctggcctgtgagcttgatattggtgatgagcgaaccgaaatgttcgaaatctacggcgtgctgcacaacctcggtcgccgaggctacgccagtcaggtagggcggcgaatgaatccattgctctcatcctgcgatgatgacgaggatgaggaagatgacgattgggatgaggatgaagactga

SEQ ID NO: 5861 - DNA, 267 bp, Klebsiella pneumoniae
ccacagagtaataaacagtcggtcctgttgcaccttgataaagggtgcaaccggaaggtgccatgccttcaacatcgtgaatcctcattgtgcagaatgggcacaccttgccatagccgccgggcgcagaactcatcatctcagaactttttgggggaggataacgggggaggacgcgggaccgcaacccgccccggccgcgcgatgctgaccggggcgatgtcgattactgagcctgcgccaggcggcgctcacggcgggtcttaa

SEQ ID NO: 5862 - DNA, 786 bp, Klebsiella pneumoniae
caggagagtaagatggcaggttcttggttacgcggggttgtcggggtatcactcacgctgtgcgtcgcgggtcaggcgctggcggcagagggtaaagtgaccgttttcgccgccgcatcgttaaccaacgcgatgcaggatattgcccaggcgtacaagaaagaaaaaaacgtcgaggtcgtgtcgtcgtttgcctcgtcttcgacgctggcgcggcagatagaagcgggtgcgccagcggacctgtttatctccgccgatcagaaatggatggattacgcggcagataaaaaggccatcgatccggcaacccgcgccactctgcttggcaacagcctggtagtggtcgcgccgaaagccagtgcgcagggggcgataaccattgatgagaaaaccgactggaccagcctgctgaaaggaggccgtctggcggtgggcgatccacagcatgtcccggccggtatctatgccaaagaggcactgcagaaactcggtgcctgggagacgttgtcgccgaagctcgccccggctgaagacgtgcgcggtgcgctggcgctggtggagcgcaacgaagcgccgctggggattgtctatggctccgatgccgtggccagcaagggggtgaaagtggtcggcaccttcccggaagcctcgcatcagaaagtcgagtacccgctggcgattgtcgatgggcaccgcaatgcggccgtgagcgccttctatgactacctgaaagggccggaagcgtccgctatctttaaacgttacggatttaccacccgctga

SEQ ID NO: 5863 - DNA, 210 bp, Klebsiella pneumoniae
caggtattcaatttgactaatcatatttctatgattgccgctctgctggagtctcttcaggtatcgcctgagagaaaactcattaaggggaatttctttagggaccttggcttctacattacatttattgctatttttttaattgggagcggatgccattccgaggtgggttgtatggttttccttcgttatagagaccgcatcggctag

SEQ ID NO: 5864 - DNA, 243 bp, Klebsiella pneumoniae
cgcatgttcaaactgatacagcgcggtcagatttacgccgattgccacggatggccggtaattatcgccagcagcgacgacaagacggtttgctactggcgccaggggcggatcaacaccgcaagcatagaccgctttaacaatgacttcgagccgctctctcacgaagaggcccagcagataaaggcagagctggagcagagcgaacacattaagaaactgcgcgcccagcgggcagcgtaa

SEQ ID NO: 5865 - DNA, 939 bp, Klebsiella pneumoniae
tcctgcctcaacgccgcctgcttgccccagggtaagcggcggcgctacgttgaagatccccgacgcatgaagacaacccacaccgaatttgaacgctattaccagcaggtacgctcgcggcaaaagcgcgatgccgtctgctggtcgctgctgctgctggcgctctattttgccgccggcagcgccgcggaatttaatctgctgactatctggcactcgctgccccatttctttgactatatggcagagaccattccgcccctgagcgctggcaacctgttcgccgatgtgcagaccaaagggtcgctggcctggtggggctatcgcctgccgatccagctgccgctgatctgggaaactctgcagctggcgctggcctcgaccctggtggcagtcgccatcgccacggttttcgcgtttcttgccgccaataacgcctggtccccggcgccggtgcgctttgccattcgcgtgctggtggcgtttttacgcaccatgcccgagctggcgtgggcggtgatctttgtgatggcgttcggcatcggcgcgatcccgggctttctggcgctgatgctgcataccgtcggcagcctaaccaaactgttctacgaggcggtggaaagcgcgcaaaacaaaccggtacgcggcctggcggcctgcggcgcgtcgccgctgcagaaaatccgcttcgccctgtggccgcaggtgaaaccgctatttctctcctacggctttatgcggcttgaaatcaacttccgctcgtcgaccattctcgggctggtgggcgcaggcggcatcggccaggagctgatgaccaacatcaagctcgaccgctacgatcaggtgagcatcaccctgctgctgatcattctggtagtgtcggcgctggacatgctgtccggtcgtctgcgcctgtgggtactggaggggaaaaaatga

SEQ ID NO: 5866 - DNA, 945 bp, Klebsiella pneumoniae
ttttcgaccaatggtggatcgccgccatccccggcgcggcgatcctgctcgccagcctggcgtttaacctgctgggcgatggcctgcgcgatattctggagccgcaacatgactgacatccgactgaccgtccagggactcgccgtcgactatcccaccgcccgggtggtggacaacgtcagcttcaccctcggcaacgagcggctggcgctggtgggcgaatccggctccggcaaatcgatgaccgcccgggcgctgatgggcctggtgcgcaagcccggggtggtgagcgctgaacggctggaggtgctggggcgcgatgtgctgaccctcagcgcccgcggctggcgcgcgctgcgcggcaacgatatcgccatggtgctgcaggacccgcgctatgcgctgaatccggtgcagaccattcagacgcagctggaggaggcgttaaccctccatcagcgtctcagccgccgcgcgcgcgccgaggcggtcaaagacgccatcgccgccgtcggtctggatctgccggtcctcagccgctatcccggcgaactctccggcgggatgggacagcgggtgatgatcgccctcgcgctgctcaataacccgaaggtgctgatagccgacgagccgacctcggccctcgacgcccgcctgcgcaaccagatcctcgagctgctggtggagcagagcgcgcagcggcagatggccatgttactgatcagccacgatctaccgctggtagccgcgcattgcgatcgcgtgctggtgatgtaccaggggagacaggtcgacgagatgccggcgcgggcgctgccgagcgcgacgcacccttacacccgcaccctgtggacctgccggccaaatgcgcatacctacggccagatgctgccgaccctcgacagaacccaggactttacggagacagcccatggcgatcgttaa

SEQ ID NO: 5867 - DNA, 1194 bp, Klebsiella pneumoniae
atagccgtccttacgaggaagaataaaatgaagtggtttgtttttatgttcgcggcaatcgcggcgacgctgatggtcacccctgaggctaatagcggatcgtttgatccggtaactggcgcttatactacggatccgataaccgtcacgctgacgccaaagaccgtagctgccagcacgtcggtaatcgcgaatggtgaaaaggtttactgggccactagtacatatgcccaactatcaggcccgttttactggggaccgcatacttacaccatggatagcgccgctattgctacaacagcagccacccgtatgaatgctggtggattgtgtactgcaaccgccagcggtacatctcttaccataagcggatgtttctcctttacggacatttacactatctacgtgggcaaaagcgcctcttgtaaatctttttttaatttctttaacgatataaatagttcgttaacctctttcggcgattttgttggacttacttttagctctggtacaggaacagtagtcaataggcagttgaacaagacgtctataccagatgtccatacgacttctattacttatccaagtcagaccctattaccacctaattcctggcccacctacaatacaaatttgcaggcgacactatccgcaaaaacgccgccttatatccacctttattgcaacgtatcgcaaggtggccagatctcgcgggagaatggcgcttacatgtcaagatctttggatatagtgcctgcggccaataaacccgcttatcccccgacgattagttactcgctggcgctccctatcaccaacaatatcaccgtaaatatccgtaatatcaccgcgattgacattctcccaaggacggtatttaacaccgggactatctccgcctggcgcacaacctatatggaacaaccgcttaccgtaaccgggcaggggaatatcacccgcaattttggcgcataccagaactttaacgttcttgaatcctggacctgcgcgacaacagggcaaatcgattttcgaataatgcgcgacaataccaacgccaacgtttgtacgggggcgacctatacccatccggtgcagacgccacagtcgttgacggcgcagtggaaagcgcaaagttcgaccgcatcaggcgcatggagcgccagggctacggtgacctttacgctgccgtag

SEQ ID NO: 5868 - DNA, 912 bp, Klebsiella pneumoniae
cgaggctacaaaatggacggcgccatttttctccagcaagtggtcaatggaatgagtcttgggggcatgtacgccctgattgccatcggttatacgatggtttatggcgtgctgcggctgatcaacttcgcccatgcggacgtgatgatggtcggcgcgtttagtacgctgtttttattttcttcggttgggctacccttcggggtagccgttttcctgaccctcgggctgtgcggcctgtttggtatgctgattgaccgggtcgcctatcgtccgctgcgtcaggcctcgaaaatctccatgctgatcactgccatcggcgtcagcttttttctcgaaaacctgtttaacgtactgtttggcggcagctcgcgcttcttctccgcccctgactttttcaaccagacccgggccttcggcagcgtcatcattaccaacgtggcgtggattgtgccgctgatcaccgtcctgctgctgctggcgatcctctggctgctgtaccgcacccgctatgggatggcgatccgcgcggtggcctttgacgtcaacaccgtgcgcctgatgggcattgacgccaaccggatcatctccctggtcttcgccctcggcagtagtctcgcggcgctcggcggcgtgttctactccatcagctacccgacgatcgatcccctgatgggcgtgcttatcggcctgaaggccttcgccgccgccgtgctgggcgggatcggcagcgtcaccggcgcggtgctgggcggctttatcctcggttttaccgaggtggtcgccgtggcgatcttccccgaactgggcggctataaagacgctttcgccttcctgttcttgattctggtcctcttgttccgcccggtcggcattatgggcgacgaacgtctggaaaggagccgtttctga

SEQ ID NO: 5869 - DNA, 939 bp, Klebsiella pneumoniae
tttaacgacaaagccgtggaaattatcatgctgtggttcaaaaatttaatggtttaccgtctcagccgcgatatcgaattgcgcgccgaggagatggaaaaacagctggccgagctgacatttaccccttgtggcagccaggatatggcgaaaaccggttgggtgtcgccgatgggatcgcacagcgacgcgctgacgcatacggcaaacggccagatcattatctgcgcgcgtaaagaagagaagatcctgccgtcgccggtgattaagcaggcgctggaggcaaagatccagaagctggaagccgatcagggccgcaagctgaagaagaccgagaaagattccctgaaagatgaagtgctgcactcgctactgccgcgcgccttcagccgcttcagccagacaatgatgtggatcgacaccgtcaacggcctgatcatggtcgactgcgccagcgcgaagaaagcggaagataccctggccctgctgcgtaaaaccctcggctcgctgccggtggtgccgctgaccctggagaatccgattgagctaacgctgaccgagtgggtccgctccggcaccgtggcgcagggcttccagctgctggacgaagccgagctgaaagcgatgctggaagatggcggcgtgatccgcgccaagaagcaggatctggttagcgacgaaatcgctgtacacattgaggccgggaaggtcgtcaccaagctggcgctggactggcagcagcgtattcagtttgtgatctgcgacgacgcgtcaattaagcgcctcaagttctgcgatgaactgcgcgaccaaaacgaagatatcgatcgggaagatttcgcccagcgctttgacgccgactttatcttaatgaccggcgagctggctgccctgatccaaagcctggtggaagggctcggcggcgaagcgcagcgctaa

SEQ ID NO: 5870 - DNA, 825 bp, Klebsiella pneumoniae
ttacgctgcaacctgccggcggaaatatgcaggaggtacagcatgaacgggcataacattacgaacgaatcgctggcgctgtcgatggtgctggtgctgatcgctattctggtcagctatcgggaaaagctggcgctggaaaaagatattatctggagtatttgccgggcgatcgtgcagctgataatcgtcggctatgtgctgaaatatatctttaacgtcaatcatgcggttctgacgctgttgatggtgctgtttatctgctttaacgcggcgtggaatgcgaagaagcgcagtaaatatatcgacaaagcttttatctcgtcgtttatcgccatcactactggcgctggactaacgctggcggtactggtgttttctggctcgatcgccttcgtgccgatgcaggtgatcccgattgccgggatggtggccgggaacgccatggtggcggtagggctgtgctacaacaatatgggccagcgcttcagcagcgagcagcagcagattcaggagaagctgagcctcggcgcgacgccgaagatggcctcagcgcggctgattcgcgagagcattcgcgcgtcattgattcccaccgtcgattcggcgaaaacggtcggtctggtgagcttgcctgggatgatgtcggggctgatttttgccggtattgacccggtgaaggcgattaagtaccagatcatggtgacctttatgctgctgtcgaccgccagcctgtcgacgattatcgccggctatctgacctaccggaagttcttcaacgcccgccatcagttggtggtgacgcagctgaaaaagcgcccgtga

SEQ ID NO: 5871 - DNA, 975 bp, Klebsiella pneumoniae
aaaaatagcaataaatgtaatgtagaagccaaggtccctaaagaaattccccttaatgagttttctctcaggcgatacctgaagagactccagcagagcggcaatcatagaaatatgattagtcaaattgaatacctgttaacgcttgcgaaagcgagtaaaagtggtttattaccgataacatacgtgcaaagtaacgggggacgtttatatgcagaaggcgctgtaaatcttcaaaattgtaagagagagattcgtaaaactgcgttggctggcatgtttgatgtggatatcgagaattgtcactacaacttactggaacagatgtgcgctcggatcggtataaaaacgccgcgtataagccattatgtccgtaacaaaaaacaggtccgtaaagaagtagccactacgttacaatgcacagaagaacaagcgaaggtagttttgattgcccttatctatggcgccaatctagggcctcgtggggtactaaaaaagctggacattgataccagtgacgaggctctcaaagatacctggattagcaaactaactgaggaaatcaccaatgtgagacgttatgtgattgaggattatacagcgcggactagaggctattgcaaaatcaaaaacgacgctggaatgattgttaagaccataacagaaaacggagaatcggttaagaaatcaaaattattagctcatcttctccacggtgcagaatcactgatacttcagtacatgattagctttcttggtgataatgttgtcttgcttcagcatgatggtgtcacatgccccaatcctgtagatacagatgaactcagtgactatatcgcagagaaaacaggctatcgtgttcaatttgatattgagcagctgaaaccagacttctatgtcgatgccactgatagatttcaacaacaagacctggaagacatttttgaaatctttaaatatgaaatggctgcgtga

SEQ ID NO: 5872 - DNA, 858 bp, Klebsiella pneumoniae
actttattaaaccggtttagctcattaaagcacagcccaccggtaagcggaacgattgggtcacgaaacagggaggcgagggtaaaaaatgtgagccaggcggaatatttcgccactccagatctggacttttccttccccacccgcttaggtatagttcaacaggtcgcggttagccccgccgcggtggccaaaggtaaaggagtgcgtagcgcgatgaaccccagttttggcgatatttacgatcggtaccagaagctgacgctgactacgcatctgccggcggtgatcgcctgcagtgaaacgctgagtttgggcaaagaccagggctttattccgcagccgggctatctctactttctgctgcaggggcaaatgacattggcctttggcgatgagcagaacctggtcgggattgttatcgcgcatatgccgttaggattactggaacattattgtccgtcggtcgcgctctattatcagtgtctgggcgagtgccagctggcgaaaataaccgccagcgattttgagcgaatattctttcattcgtcgccgggctatatgcaagagctgaccacgatcctggcctatatgggcatatttgcccttgatgcccactatgaacgcggcagccagaccagctttcagaccattaaatcgatgctgtcgcgctatttatatcgcggcgaaattgatgggggtcagcatgagagcctgtcggcatttattattaaacgaaccaatctctcgcgcagctatgtgtaccaggtgctggccgcgctgcgcgaggggggatatatcacggtgaaaaaaggcaagctgatctccatcgaccgtcatattcctgagaaattctaa

SEQ ID NO: 5873 - DNA, 207 bp, Klebsiella pneumoniae
gtgaaattaaaattactgtataaatatcaggaggtggtcatgtcaaaacagtccgtcaaacctgtcttgctcagcgaggcacaaattcaggcaatcagaaaaattcaggaaaagcagcgccagcaatcaggtatcggtgttgcgccaactatccatgaaatcgcaagggggctggtggacaaagccttgcaacagcatttgggctaa

SEQ ID NO: 5874 - DNA, 1443 bp, Klebsiella pneumoniae
tatctgttaaacaaacatttatttacgcttcttaccccccgccgctacactaggcgcagtttttatattgaggtggtaatgaacgataacaaaatgacgccaggggaactgcgcgcgacctggggtttggggacagtattctccctgcgcatgcttggcatgtttatggtcctgccggttctgaccacgtatggcatggcgttgcagggtgccagtgaagcgctgattggcctggcgatcggtatctacggcctggcgcaggcggtgttccagatccccttcggactgttatctgaccgtattggccgtaagccattgatcgtcggcggcctgcttatcttcgtgctcggcagcgtcatcgccgcgctcaccgactccatctggggcatcattcttggccgcgccctgcagggctccggcgccatcgccgccgcggttatggccctgctgtccgatctcacccgcgaacagaaccgcaccaaagcgatggcctttatcggcgtcagcttcggcgtcaccttcgccatcgccatggtgctggggccgattgtcacccaccagctgggtctgcacgcgctgttctggatgatcgccatcctggcgaccgtcggcatcctgctcaccctgtgggtggtgcccaacagccataaccatgtccttaaccgcgaatccgggatggtgaagggctgctttagcaaggtgctggcggagccgcgcctgctgaagcttaactttggcatcatgtgcctgcacattatgctgatgtccacttttgtcgccctgcccggacaactggaggccgccggcttcccggccgccgaacactggaagatttacctggtcaccatggttatctcgttcatctcggtggtgccgtttatcatctacgccgaagtgaagcgcaagatgaagcgcgtcttcctgctctgcgtcgccatcctgctgattgcggaaattgtcctctggggcgccggaggctacttctgggagctggtggcgggcgttcagctcttcttcctggcgtttaacctgctggaagcgctgctgccgtcgctaattagcaaggagtctccggcgggctacaaaggcaccgcgatgggcgtctactccaccagccagtttctcggcgtggcgattggcggcgcgcttggcggctgggtcgatggtttctttgattcgcaaaccgtgtttctgctgggcgccctgctggcgatgctgtggctgctggtggccagcaccatgagcgagccgccgtacgtcagcagcctgcgggtggaggtgccggacggcgtggtggtcgacagcgcgctgcaggcgcgtctgctgagcgccagcggggttcatcaggcgctggtggtacccgaggagcgttcggtgtatatcaaaatcgacagcaaggtcaccaaccgcttcgagatagagcagctcatcaaaggggtataa

SEQ ID NO: 5875 - DNA, 810 bp, Klebsiella pneumoniae
tcaggaataaaaatgttcaggaaggatttcgccgcgattgcccttgtgcttaccgccactcaggccggtgctgaaccgctcaccgcgatgcgatacgctgattttgaccgctacgtccttgccctctcctggcaaaccggattctgtcagagcatgtatgaccgcaatcgcaacgaaccggaagagtgtcgcctgcagcaggacaccgcgaataaagccgactttctgaccgtgcatggcctgtggcccgggctgccaaagtccattgccgcgcgcggagtggatgaacgtcgctggatgcgctacggctgcgccacgcgtccggtgcccaacatgccggaggtaaaagcgaaccgcaaatgccaggcggcggagaccggactgtcgctggagatggccaataaacttaataatgtgatgccgggatcgggcggcacctcctgtctggaacgctacgaatatgccaaacatggcgtctgcttcggcttcgatcccgacagctactttggcgccatggtgcgactaaacggtgaaattaagcgcagcccggtgggggattttctcgcgaagcactatggccaaacggtcagccgcgccgacttcgacgccgccgtggcccgcgcctggggtccgcagagcgtgaaggcgtttaagctaacctgcaacggtaatccggcctatctgacggagatgcaaatctcgctcaacgccgcgaccatcaacgccccgctggccacttccgcttttctgccccagcctcacccgggtaactgcggcgcacagtttatcctcgataaggttggccactag

SEQ ID NO: 5876 - DNA, 630 bp, Klebsiella pneumoniae
cggtgcgtaaaaaagacttttttacgctttcggataccggcttttttcgccggcgcgtatgatgaccgtttggctgaaggttcgtgggagagaacaatgacggctcaacgggtagtgatggtcgtggatatgcaaaacggcgtgttcgccacgccgcgtctggcgcgcgagcgctgcgtcgcgcaaattaatcgtctggtgcgcgcggcggacaaggttattttcattcagcatgatgaagccggcggcctcgaagccggcagcgaaggcttcgccctgcttcctgagctggagcagccggctggcgcgctgtatgtcaccaaaaccgcctgcgatgccttctatcacacctcgctggcgcaggtgctggacgaacacgacattcagcagttcgtcatctgcggctgcgccaccgactactgcctcgataccaccattaaaaatggcgccagccgcgggtacggtattgttatcgcggaagatgcccacaccaccgccgaccgccccgccgcgcaggccgcgacgcttatcgcccactacaatgaggtgtggcgtacgctgaccattcctggcaatcctttacaggtgaaacccacagaaacaattctgcacgcatggcagcagaactaa

SEQ ID NO: 5877 - DNA, 354 bp, Klebsiella pneumoniae
cctgcagtaaacgggcgttggtgcgccagtgggtcagcgtatcctccagcagcgccatccccccgtcgggcagatcgcgcagcagcgcgatttggctgtcggcgccttccagctccatcaccgctatgttgctctcgcgggcggccatcagcaactgataatcgatgccgtaatctggtcgcagccccagcttctgcgcctgggtggcctgcaggaccatcgccacctgccacagcggctggctgtcgaacagcccgaccgacaggcccagctcgccggctcgcgcctctagctcgctcagctgcgcatcgctcaggcgttccgccagcggtgggtaagtggggagattgctaa

SEQ ID NO: 5878 - DNA, 1869 bp, Klebsiella pneumoniae
cttttcccaaagggaactgccgtgttaaaccgttatcctttgtggaagtacgtcatgctggtcgtcgtcattgtcgtcggcctgatctatgcgcttcccaacctgtatggtgaggatccggctgttcaaatcactggcgcgcgcggcgtcgccgccagtgagcaaacgctgatccaggtccagaaaactttacaagaagaaaaaataaccgcgaagtctgtggcactggaagagggcgctattcttgcgcgcttcgacaccactgatacccagctgcgcgcgcgcgaagcgctgcttaacgtgctgggtgacaaatacgtcgtggcgctgaaccttgctccggcaaccccacgctggctggcggcgctctatgccgagccgatgaagctgggtcttgatctgcgcggcggcgtgcacttcctgatggaagtcgacatggacaccgcgttaggcaaactgcaggaacagaacatcgatagcctgcgcagcgagctgcgcgacaaaggcattccttacgcgaccgtgcgtaaagaagacaactacggtctgagtatcgtcttccgcgacagcgcggcgcgcgaccaggctatctcttatctcagccctcgccatcgcgatctggttatttcctctcagggtgacaacagcctgaaagcggtgatgaccgatgagcgcctgaaagaagcccgtgagtacgcggttcagcagaacattaatatcctgcgtaaccgtgtgaaccagctgggcgtcgccgagccgctggttcagcgtcagggcgctgaccgcatcgtggttgagctgccgggtatccaggataccgcgcgtgcgaaggaaatccttggcgcgaccgcgaccctcgagttccgtctggtcaatactaacgtggaccagtccgccgccgcctctggccgcgtgccgggcgactcggaagtgaagcagacgcgtgaaggccagccggtagtgctgtacaagcgggtgatcctgaccggggaccatatcaccgactcgacctccagcatggatgagtacaaccagccgcaggttaacatctcgctggacagcgcgggcggtaacatcatgtctaacttcactaaggacaacatcggcaagccgatggcgaccctgttcgtggagtataaagacagcggtaagaaagacgctaacggtcgcgctatcctggcgaaagaggaagaggtgattaacatcgccaacatccagtcgcgtctgggtaacagcttccgtatcaccggtatcagcaatccgaacgaagcgcgtcagctgtcgctgctgctgcgtgccggcgcgctgattgcgccgattcagatcgtcgaagagcggactatcggcccaaccctgggaatgcagaacatcaagcagggtctggaagcctgtctggccggtctggtggtctctatcctgttcatgatcctcttctataagaagttcggcctgattgcgacctcggcgctgattgccaacctgatactgattgtcggcattatgtccctgatcccgggggcgacgctgaccatgccgggcatcgcgggtatcgtgttaacccttgcggtggcggtcgatgctaacgttctgatcaacgagcgtatcaaagaagagctgagcaacgggcgtaccgttcagcaggcgattgatgaaggttatcgcggcgcgttcagctcgatcttcgacgccaacgtgacgacgcttatcaaagtgatcatcctgtacgcggtcggtaccggtgccattaaagggtttgcgattaccaccggtatcggtatcgcgacctcaatgtttaccgctatcgtcggcacccgtgccatcgtgaacctgctgtacggcggcaagcgcgttaaaaagctgtctatctga

SEQ ID NO: 5879 - DNA, 1800 bp, Klebsiella pneumoniae
cccattacaaaatcaggattttattgcttgcgattatttgctcaactcagctggtacttccgccgggagtggcgccgctatcttggcgcaattgccctgctggtcattattgccgtcctgcagcttattccaccgaaggtggtgggcattgtggtcgacggcgtgacgcaacagcattacaccgcggagaaggtgtggatgtggatcggcgcgctggtgctgatcgcggtgatggtctacctgctgcgctatgtctggcgcgtactgttgttcggcgcttcttaccagttggcggttgagctgcgggaagatttttaccggcaactgagccgccagcatccggcgttctatttgcgccatcgcaccggggatcttatcgcccgcgccaccaatgacgtggaccgggtggtgtttgccgctggcgaaggagtattaaccctggtggattccctggtgatgggctgtgcggtattgattgtgatgtcgacgcagattagctggcagcttactctgctggcgctgctgccgatgccgctgatggccctggcgatcaaacgtaacggcgatgcgcttcacgaacgttttcgcgttgctcaggcggccttttccagcctcaacgatcgcacgcaggagagcctgaccagcatccgcatgattaaggcgtttgggctggaggatcgccagtcggcgcagtttgctgccgatgctgccgataccggcgcgaaaaacatgcgcgtggcgcgcattgacgcccgcttcgaccccaccatctatatcgccatcggggccgctaacctgctggccatcggcggcggcagctggatggtgatccacggcagcctgaccctgggccagctgaccagcttcgtgatgtatcttggcctgatgatctggccgatgctggcgctggcgtggatgtttaacatcgtggagcgcggtagcgcggcctatggtcgtatccgcacgatgcttgaagaggcgccggcggtggatgacgggaccgaggcggtgccggcaggccgtggcgtcctgcaggttgctattcgcgatttcatctatccgcaggcgagcaaaccttcgctggagcaggtaaattttactctccagccggggcaaatgctgggcatctgcgggccgacgggcgccggcaaaagcaccattctggcgctgctgcagcgccattttgacgtcactcacggcgagatccgctttcacgatctgccgctgccgattctgcagctcgacagctggcgcgcccggttggcggtggtcaatcagacgccatttttattctccgataccgtcgccaataatatcgcgctgggaaaaccggacgcgacgcaggcgcagattgagcgggttgctcaactggccagcgtgcatgacgacattctgcgtctgcctcagggctacgagaccgaagtgggcgagcgcggcgtgatgctctccggcggccagaaacagcgcatctctattgctcgcgccctgctgctggaggccgaaattttgatcctcgacgatgccttatcggcggtggatggccgcaccgagcaccagatcctgcataacctgcgccagtggggggaggggcggacggtcattatcagcgcccaccgcctgtcggcgctcaccgaggccagtgaaattttggtactgcagcatgggcatattgcccagcgcggccgccacgaggcgctggccgtgcagcccggctggtaccgcgacatgtatcgatatcagcagctggaggccgcgctcgacgaggttccgcagacgcaagaggaggccctggatgcgtag

SEQ ID NO: 5880 - DNA, 201 bp, Klebsiella pneumoniae
tcgacggcaaacggcatcatggacagcatcctgcaggcgcaccccgacgtgaaaggcgtcatctgtggcaacgggccggtagcccttgccgcgaatgcggcgctgaaagcggccaaccgtagcgatgtgattgtcgtcggcatcgacggcagcaacgatgagcgcgacgccgggaaagccgcaccctgcaggcaaccgtaa

SEQ ID NO: 5881 - DNA, 345 bp, Klebsiella pneumoniae
aagacggcaaaggcgatgaagacgatgaaggcggctggcctgagctttggcgcgccgcagacgctttctcgtaccggccaggatccgctgagccagctggcatttaccctgccgctgccgcagcagggtaaaccggtctacggcgtgggcagcaatatgcaaggcgatgtggtgctggtagcgctggatgaggtgaaagccggcagcatgccggaagagcagaagaaggccatggttcaggggatcacccagaacaatgcccaaatcgctttcgaagcgctgatgagcaacctgcgcaaggcggcgaaaattaagctcggcgacagcatcgaccagcagcagtaa

SEQ ID NO: 5882 - DNA, 942 bp, Klebsiella pneumoniae
cggtcacaaaaaaggccacctgacggtggccaaccatgtcgaaatcggacagatttctgcttgcggacaagcagagagggtttacttgataatagctttcagcgcttcgccgatgtcggccaggctgcgaacagttttcacacccgccgcttccagcgctgcgaatttctcatccgctgtacctttaccgccggcgatgatagcgcccgcgtggcccatacgcttgcctttcggcgcggtaacacccgcgatgtagccgacaaccggcttagtgacatgatctttaatataagcagccgcttcttcttccgcgctgccgccaatctcaccgatcatgacgatcgcttcggtctgcggatcttcctcgaacatcttcaggatatcgatgaagttggagcccgggatcgggtcgccgccgataccgacgcaggtagactggccgaagccgtagtcggtggtctgcttaaccgcttcataggtcagggtgccggaacgggaaacgatgcccactttacccggcttgtgaatgtgacccggcatgatgccgattttgcactcgcccggagtgataacgcccgggcagttcgggccgatcatacgcacgcccgcttcgtccagcttcaccttcacggtcagcatatccagcgttgggataccttcggtgatggtgatgataagcttaatgcccgcgtcgatcgcttccaggatggaatctttgcagaacggcgccggaacgtagatcacggtcgcggtcgcgccggtcgcttcaacggcttcgcgcacggtgttgaacaccggcaggcccaggtgagtggtgccgcctttgcctggcgtcacgccgccaaccatttgcgtaccgtaagcgatcgcttgttcagagtggaaggtcccctggctaccggtgaagccctggcagataaccttggtatctttattaattaa

SEQ ID NO: 5883 - DNA, 588 bp, Klebsiella pneumoniae
cgttgtaaaaatgattacttcaaggactatgaggttaaaaactatatggaatataaaagctgttccgataagtatatttggtctgccgatgactcctatttctataaaggactgtccgaactgattgtagacatcgacgaattaatttatctctcactggagaaaatcagaaaagattttgtgtttatcaatctcaatacggcttcattaaacgaatttatcaggcgcgacagcgaatggctatccgcggtaaaggggaaacaggtcgtattgattgcggccaggaaatcagaggccttagcgaactactggtattacaatagcgatattcgcggcgtggtatatgttggtctgagtcgcgatattcgaaaagaactggcctatgtaattaatggcaggtttctccgcaaagatattaagaaagataaaattacagatcgggaaatgaaaattatccgcatgaccgcccagggcatgcagccgaaatcgatcgccagaattgaaaattgtagcgtgaagacagtgtatacccatcggcgtaatgctgaggccaaactgtattccaaaatatataagttagttcagtaa

SEQ ID NO: 5884 - DNA, 1083 bp, Klebsiella pneumoniae
cgcgcaaaaaacggaacagattttcgaagtcattacctgtcatatcgatttcatcctgcatgggttatcgcaaaggagtttgggctgatgaaaaaacccgtcgtcgtcattctgctgatcgtgattcttctcgccgcgctgggcggcggctggtggtggtaccagagcagccggcagcagccgctgaccctgtatggcaatgtcgatatccgcaccgtcaacatgagcttccgcgttggcggtaggttggcctcgctgaccgtcgacgaaggcgacaacatccgcgccgggcaaactctcggcgagcttgaccgcgcgccgtatgaaaatgccctgctgcaggcccaggccaatgtctccaccgcccaggcgcagtatgacctgatgatggccggctaccgcgcggaagagattgcccaggccgcggcggcggtgaaacaggcgcaggccgcttacgactatgcgcaaaacttttatcagcgccagctcgggctgcgcgccagcagcgccatttccgccaacgatctggagaatgcccgctcctcgcgcgatcaggcgcaggcaacgctcaaatcggcgcaggataagctgcgtcagtatcgcgccggtaaccgcccgcaggagattgcccaggccaaagccagtctggaacaggcgcaggcggcgctggcccaggccaaactggacctgcacgataccgtgctcaccgccccttctgacggtacgctgatgacccgcgccgtcgagcccggcactatgctcaacgccggcggtaccgtactgacgctgtcgttaacgcatccggtgtgggtccgcgcctatgttgacgagaaaaacctcggccaggcgcagccgggacaagaagtgctgctctataccgacagccggccggataagccctatcacggcaaaatcggttttgtctcgccgagcgctgaattcacgccgaagaccgtcgagaccccggatctgcgcaccgatctggtctaccgtctgcgcattgtggtgactgatgccgacggcgcgctgcgccagggaatgccggtgaccatctcctttagccacgggaacggacatgagtga

SEQ ID NO: 5885 - DNA, 1452 bp, Klebsiella pneumoniae
aacaaaaaaaagcgccgctgggagcgacgctttgacagaaaagaaatgttattcgcccgctttcgcccaggtatcacgcagcccgacggtgcggttgaacaccagactggttgcggttgcatagcggctgtcgaggcagaaatagccttcacgctcaaactggtaagctttaccggcttcggcctgcgccaggctcggctccgcgtacccctgtttgatcaccagcgattccgggttgatcactgcgaggaaatcttccgccgcgcccgggtttggcacgctgaacagacgatcgtagagacggatctctaccggcagcgcatgcgccgcgcttacccaatggatcacgcctttgaccttgcggccgtcggccgggtctttgctcagggtgtcggcatcgtaggtgcagaagatggtggtaatattgccttcggcatctttctccacgcgttccgctttgatgacgtaggcgttgcgcagacgcacttctttacccagcaccagacgcttgtactgtttgttggcttcttcgcggaagtccgcgcgatcgatccagatttcggcgctgaacggcacttcacgactgcccatttccggcttgttcggatggttcggcatcatcaccatttcgctttcgccctgcggatagttctcgataaccagtttcaccggatcgatcaccgccatcgcgcgcggggcgttttcgttcagatcttcacgaatgcaggactccagcgacgccatctcgatggtgttgtcctgcttggtcacgccgatgcgcttgcagaactcgcggatggattcggcggtgtagccgcgacgacgcagaccggagatggtcggcatacgcgggtcgtcccagccttccacgtgcttctcagtcaccagctggttcagcttacgcttggacatcacggtgtattcgagattcaggcgcgagaattcgtactgacgcggatgcaccgggatgctgatgttgtccagcacccaatcgtacaggcggcggttgtcctggaactccagggtacacagcgagtgggtaatgccttccagcgcatcgctgatgcagtgggtgaagtcgtacatcgggtagatgcaccacttgttgccagtctgatgatgctcagcgaacttaatgcggtacagcaccggatcgcgcatcacgataaacggcgacgccatatcgatcttcgcgcgcaggcaggctttaccctcttcgaagccgccgctgcgcattttttcaaacagcgccaggttctcttccacgctgcggtcgcgatacgggctgtttttacccggcgctttcagggtgccgcggtattcgcgaatttcatcaggagagagttcatcaacataggccagacctttgttgatcagctcaaccgcatactgatgcagctgatcgaaataatcagacgagtagcatacgtccccggaccagtggaaacctaa

SEQ ID NO: 5886 - DNA, 522 bp, Klebsiella pneumoniae
tgtatgaaaaaattatcagcagctgcgtttgcatttggtctgttatctgtgtctgtatctcaggcattggcggcggatgccaccgttaacttcagcggaaccattcttcaagaagcctgcagtgtacatacttcagacaatactgttaacgttcagctaggcacctacggtgctgctcaattcccgacggtagggacaacgacccttcctgttcctttcgccatcaacttaacgggttgtccggcttcaggtggcccgacggctgcactggtgaccttttcaggggccgcggatgcggccggtgacctggcgttgaccgcaggcggcgcatcgggcgtttccattaatatcaaaaaagcagatggtaccaacattgatattaactctaccgattccggtattgcactgactagcgctacgacccaacagctccgctttaccgctaattacatcagtactgcggcttctgtcaccgcaggcgcggctaacgccgtcgcccaggtaaacatctcgtatatgtaa

SEQ ID NO: 5887 - DNA, 252 bp, Klebsiella pneumoniae
ttaatgaaaaaagcttttggtaggaaagagttgttgctggtggtgccgttatcgatgagtactatcgaccgccttgaacacaaaggtcagttcccaaaacgcttttatattaccgacggacgctgtgcctgggatggagatgaagtcgaacagtggcttgacgaaagaaaggccgcaaacaccggtaattttggtgggaaaaagccacctgttgacaagagagtttctcgcccggtaagtaaggcaacgtga

SEQ ID NO: 5888 - DNA, 1056 bp, Klebsiella pneumoniae
ataatgaaaaagagtactctggcattaatgatgatgggctttgtggcttcaacagcgacgcaggcagcggaagtttataataagaacgcgaacaagctggatgtgtacggcaagatcaaagccatgcactatttcagcgactatgacagcaaggatggcgatcagacctacgtgcgtttcggtattaaaggcgaaacgcagattaacgacgacctgaccggctatggccgttgggaatctgaattctccggtaacaaaaccgagagcgactccagtcagaaaacccgtctggcgttcgccggcgtgaagctgaagaactacggctccttcgattacggtcgtaaccttggcgccctgtacgacgtggaagcctggaccgatatgttcccggaattcggcggcgattcctctgcccagaccgataactttatgaccaagcgcgccagcggcctggcgacctaccgcaacaccgacttcttcggtctggtggatggcctggatctgaccctgcagtaccagggtaaaaacgaaggccgtgaagcgaagaaacagaacggcgacggcgtcggcacctcgttaagctatgatttcggcggcagcgacttcgccgtcagcgcagcctacaccagctccgaccgtaccaacgatcagaacctgctggcccgcggccagggttcgaaagcggaagcctgggcgaccggcctgaaatatgacgccaacaatatctacctggcgaccatgtactctgaaacccgcaagatgaccccgatcagcggcggctttgccaacaaagcgcagaactttgaagcggtggcgcagtatcagttcgacttcggtctgcgtccgtccctcggctatgtgctgtcgaaagggaaggatatcgaaggggtggggagtgaagatctggttaactacatcgacgtgggcctgacctattacttcaacaaaaacatgaacgccttcgtggattacaaaatcaaccagctgaaaagcgataacaaactcggcatcaacgatgacgacatcgtcgcgctgggtatgacctaccagttctga

SEQ ID NO: 5889 - DNA, 312 bp, Klebsiella pneumoniae
  unsure (143): Identity of nucleotide at the above locations are unknown.
agctggaaaaagggcttgaggatcgctacggccttaagcaggcggtggtggtggataccgaggaagaggccagcgatcataacatcaagcgggcgattggctccgccgccgcccactatctggaaacccggctgcggccaaanagatctgattggcgtctcctcgtggagctcaaccattcgcgcgatggtcgatgaagttcatgcgcaaaacctgaaagccagcggcgtgatccaactgctcggcggcgtcgggccaaacggtaacgtgccaggcgacgattcttacccagaccctcgcccagcggcctga

SEQ ID NO: 5890 - DNA, 1413 bp, Klebsiella pneumoniae
aaggtgccccttcgcaaaaacacacaggggaacgacgtgaaagacgcgtcaacgtcgtcggatgccgtagaagagagcggcccgacgcttcatcgcggtttacagaaccgacatattcaacttatcgcccttggcggcgcgattggcaccggcctgtttctcggcattggtcccgcgattcaaatggccggcccggcggtcttactgggctacgccgtggccgggattgtcgcttttctgatcatgcgccagctgggcgaaatggtggtggaagagccagtatccggttcctttgcccactttgcctataagtactgggggccgttcgccggctttctctccggctggaactactgggtgatgttcgtgctggtagggatggcggagctgaccgccgccgggatctatatgcagtactggcttcccgacgtgcccacctgggtttgggcggcggctttcttcatcattattaacgccgtcaacctggtcaacgtacgcttgtatggcgaagcggagttctggttcgcgctgatcaaggtgctggcgattatcggcatgattgccttcggcctgtggatgctgttcggcggccacggcggcagcaaagccgggttcgacaatctgtggaaacacggcggcttcctcgccaccggctggcacggacttattctgtcgctggcggtgatcatgttctccttcggcgggctggagcttatcggcatcaccgccgccgaagcgcaaaacccggaaaagagcattcccaaagcggtcaatcaggtggtctatcgtatcctgctgttctatatcggttcgctggtggtgctgctggcgctctacccgtgggtggagatcaaatccgacagcagcccgtttgtgatgattttccataatctggacagcaacctggtggcctccgcgctgaacttcgtcattctggtggcctcgctgtcggtgtataacagcggcgtgtactccaacagccggatgctgttcggcctgtcggtgcagggtaatgcgccgaaatttctcgcccgcgtcagcaagcgcggcgtgccggtgaactccctgctgctctccgggattatcacttcgctggtggtggtgctgaactacctgctgccgcatgaagcgctggggctgctgatggccctggtggtggcgacgttgctgctgaactggatcatgatctgtatggcgcacctgaagttccgcgccgcccagcgccgcaaagggcgcgaatcgaagttcaaagcgctgctggcgcccgccagcaactacttctgcattgctttccttgggctgatcctggcgctgatgtgcactatcgacggcatgcgtctgtcggcgatcctgctgccggtgtggatcctgttcctgtttatcgccttcaaactgctgcgccgcccggcgtaa

SEQ ID NO: 5891 - DNA, 291 bp, Klebsiella pneumoniae
  unsure (228): Identity of nucleotide at the above locations are unknown.
taccggcgaaatgcacatcttcctgaccaaagtagaggcctggtgcgctcagtttggtctggctctcaccattccaaacggttgcgaatatcagcaactgcagcaaaagcaggaggcctgatgaacagccttctcgccaaagtaatggagcgcggcatcttccgtgtgcctacgcgccgcaagcgcaaggtcgaagttaagccttccgacatcccgaccctgaaagantacaccgcccgcctggtcgataagaagtggctccgcctgagagcaaggaggccacatgcttaa

SEQ ID NO: 5892 - DNA, 663 bp, Klebsiella pneumoniae
acgcatggaaaaacatcgccaacaatgggggatattatgcaacaacaactgacgcaggcgctggaagcttacctgcaaaagctggatgacgaggcgcgcattgaggctatcaacgcgtttcgccaggtgctccaccactacagccccttccgctcgcagcccgtcgactgcgtgctgtgggtcaaacaggagctggtcgcccccaacgattacaacccgaataacgtggcgccgccggagaagcgtctgctgcaaacgtcgctggaggccgacggctttacccagccggtcgtcgtcatccagcaacgcccacaggcgtatacgattgtcgatggttttcaccgccatgagctggcctgcagcaaagccgcgctgaaaaaaacgctgaaaggctatttgccggtgacctgcctgacgagtgaagctgcctcgcgtgacgggctgatggcagcgaccatacgccataaccgggcgcgcggtcgccaccaaatccacgccatgtcagagatcgtccgcgagctgacccagctcggctggacgccgcagaaaatcggcaaagagctggggatggatgccgatgaagtgctgcgtctgaagcaaattagcggcctgacagagatgttcgccggccgccagttctcccaggcgtggacgattaagtaa

SEQ ID NO: 5893 - DNA, 348 bp, Klebsiella pneumoniae
tcgggaggaaatatggcgtctgacaaaccgataacagcacagcaggctgccgatttgctcatcgtgtcggcgcgggtgatctatcgtctcattgaatctggggagctcgccggccgcaaggtcggcaacaagtacagaacgactgaggcggcgtgtattgcatatttgaaaaccccgcgcgatcctgtcatcgcgaacgcgggtgaacataaaggagaagttttatgtcaatcaccctcaggggcggcgtgtggcactgtcatttctttacgccgtcaggaaaaagagttaggcgatctcttggcacgggggacaaaaagcaggctcaggagctccacgacaaactga

SEQ ID NO: 5894 - DNA, 489 bp, Klebsiella pneumoniae
actacgggaaagtcgaacaaatgggttcgccgatggcgctgtactacaatccggtcaacaaattcgtcgccggctttatcggctcgccgaaagatgaactttctgccggctatcgtcagcgactggcagccggaacgcttaacggtcaccctcgcgcaggaccatcagctggccctgaatatcgccacccagccgctgaagcccggcgctgcggtgacgctagggatccggccggagcacctcaccccggaagtcgccaccggtaccgtggtggagtttcaatgtgaagtggtggagcgtctgggcaacaatacctatctgttcggccagtgctacggccacgacaacgtcaagattctgctgcccggcgacgtccatttccgcccctggcagaaaattaagctggctttcgatgagcgcttctgcatggtgtttgatgagaacgacctgcgcatcagcgctgatatcccggcgccggatgcacactag

SEQ ID NO: 5895 - DNA, 183 bp, Klebsiella pneumoniae
ccccgcaccctgcgtaacgccaaccgctttatcaatgaagtggactcttccgcggtatatgtgaacgcctccacgcgcttcaccgacggcggccagttcggcctccggcgcggaagtggcggtcagcacccagaagctgcacgcccgcggcccgatggggctggaagcgttaaccacctataa

SEQ ID NO: 5896 - DNA, 1167 bp, Klebsiella pneumoniae
tctccgttgaaacgtagtttgctcatttttgctgcgctgtgcgcggcgtcgtggacctcggtgcaggccgcacagcctaccgttgacccggttttcgcctcggatgtggtcgatcgttacgccaatcatatctactacggcagcggcgccaccggcatggcgctggtggttatcgatggcaatcagcgtgtttttcgcagctttggcgaaacccgcccggggaataatcagcacccgcagctcgactcggtgatccgtatcgcctccctcagcaaactgatgaccagcgagatgctggtgaagctgctcgaccagggggtggtgaaactcaacgatccgctgagtaaatacgccccgccgggcgcccgggtgcctgactggcagggaaaaccaatcaccctggttaacctcgcgacccataccagcgccctgccgcgcgagcagcctggcggcgccgctcatcgtccggtgtttgtctggccgacccgccagcagcgctggaactggctctctaccgcgaccctgaagaccgcgccgggctcgcaggcggcctactccaacctggccttcgatttactggcggacgcgctcgccaccgctgccggcaaaccgtatccgcagctgtttgaagagcagatcacccggccgctggggatgaaggacaccacctttaccccgtcaccggatcagtgccagcggctgatgatcccggaaaaaggcgccagcccgtgcaacaacaccctggcggcgatcggcagcggcggagtctactcgacgccgggggatatgatgcgctggatgcagcagttcctgtcatccgatttctatacccgcagccagcaggccgaccggatgcagacgctgatttatcagcgtaaccagctgacccgggtgattggtatggacgtgccgggccgcgcagacgcgctgggcctcggctgggtgtatatgaagccgaagaacggccatccggggattattcagaaaacaggcggcggcggcgggtttatcacctatatggcgatgaatccgcaggctaacgttggcgcctttgtggtggtaacccgctcgccgttaacccgcttcaacaatatgagcgatggcatcaacgacctggtcagcgagctgagcggcgcacagcccaacatgcagacggccagccagtaa

SEQ ID NO: 5897 - DNA, 1677 bp, Klebsiella pneumoniae
cgcacgctgaaggtgacggcggtggcgtcgttcaagcgcagcagcgcgctgcgttcgctcagcttttcactgggccagcccgccagatcgcgctgcaccgcgttcattaacggcgtttcaaaccaggggacggaggacatctggcgtcatctccccgcgggtctgtttttcataattgttgatggcgcgctccaccacctcttccactaccagcggcttgaacggattgacgcgctgcacgcacaccgtccagaacagggcgtaagcggcggtcaggccgagcattatgccgaacggcaccagcacctggcggctgtccatcccgggcggcgtgatattgacgatagcgatgatgatcccgacgctggagataatctgcggcagcgggaaccacggcgagcggtaggcgcgcggcaggtccgggcggcgaatgcgcagcatcaccaccgacagagtaaccagcagataggcgacgccccaggcgcagaccgcggcgaggatcagcggcacgatgcggtccagatcgccgttcagataccaggcgtgcaggcaggggatcgccaccccgatggcaatggcgatcaccggcgtcttaaagcgcggatgcagccaggtcaggaaatggggcagcgcgccgtccagcgccatgccgtagataatacgcggcacggcggccatcagcgtattgatggtggcgcagccggccaacagcagcccgacccccagccagtactggccggcgtggcccatcacccgttcggcgaaggccgggatcgccatcggtgtatccagcagatggacgttgttggccgcgtcgagcacggtattctccacctggcggttgatcgccgcgccgtagataaacatgcagctggcgacccccagcaggcccagcgccatcgcccgcggtatggtgcggtgggcctgtttgatctccggcgccatcggcgtcaccagttcgcaaccgacgaacataaacatcgccatgccgatatagccgaacaggccgttgatatcgctaacgttcagcggtgtgccgaaccagccggacagatgggtgaccggcgccataaaaatgccgcacaggccgaaaatggtcagcgtggtccacatgccgaaggtcagcaccacttcgaccttgccgaagatttccacgccgatggcgttgagcaagccgaaaatcaccaccatgccgacgcccaccatccaggtattctggtgagcggccatctgggcgttaatcgactcgaagttcaccagcgccataatgcccgccaggatcgtctccgccgtcccggcgaagatatggacgatcaaataggcgcacagcgcgccggtgatagcgaagaagcggcccatgccgcaggagatatagtcgtacaccgaaccggtggtgggaatgagcgtcgccgcctcggcaaaggtggtgacctgcgcctgcatcataataaaggccagcagcaccgccagcgcgaaggtatcgccgcccatgccgaagccgctggtgaccgtcaggatcaccgggctggccatgatcagcccgacggagctggcgagggtggtcgggaagccgacgacgccgcgctcaagatggctggcgagtctgttactaaacatagtcaacctctgcacaataatggggtagggcagggaatagccagcgccactcccggatag

SEQ ID NO: 5898 - DNA, 255 bp, Klebsiella pneumoniae
catgacatgaaacatccactggaaacgctgctctccgccgccgggatcttactgctggccctgctctcctgtctgctgttgcccgcgccttcgctgggcctgacgctggcgcaaaagctggttgagacattccatatgatggatctcaaccagctctatacggtgctgttttgtctgtggttcttagcgctgggcgccattgagtatctggtgctgcgctgggtgtggcgtcgctggttttccctcgagcggtaa

SEQ ID NO: 5899 - DNA, 1212 bp, Klebsiella pneumoniae
ttgctaatgaaaaatatcgacctcatccgtgaagttaccctggctgcagctgatcgctggcctacagtgctggctgggctgcatatcgatgtgccggattcaccgcgccggcacgcaccgtgcccggcctgcggaggctcggatcgcttccgtttcgatgatggcggccgaggtagctttatctgcaaccagtgcggcgctggtgacgggctggacttaatcaagcgggttaacaactgtgacaccacggaggcggcgcagcttgccgctgatgtgctgggtattgattaccggacggtgaaacaggacgaagcgacagctagccagaagcgggaacaaatgaaagccgaaagccagcagcgcgagcaggaacgccaacggcgcaaattggctgaaatagaacagcgccgcggtttatttgtgagccactggcaggggcttgcagaaacagctttcgagggtgaaagcgaatacctcatgaacaagggtttggttgggtttaccttccctgttctgccggatggttcgcttttgttagggctggttgatgaatctggcacagtaacagctgcacggacaattacacagcagggtgaaaaacgtcttctagccggctcggcgaagcgaggtgcataccatgctgtaaacgcagcagacgcaccgcagagtgttttaattgctgaagggttggcaacagccttatctgtccatctgatacgcccggaagcactgacggtatgtgccatagacgcaggcaacctgcagcccgtcgcccaggccatgcatcagcgttacccgaatgcgcagatcatcattgctgccgacaacgatattaagcccggagagccaaatacaggcaaagacgctgcggagaaagctgcaaaggctgtctctggctgggtggctttacctccaacggtgaaaaaggccgactggaacgactaccaccagcagtatggactagaagccgctacaacggcgtttaagaattcgatgtatcaaccgcaggagcctgaagtgtccgcgaaactgcaagtgatcaacggagggaaaaagggcgcatcaaaacctgaatctctgcgacctcatgtcgaaagccgtgctgatggtatttattgggttgaacccaaatcagacaaagatgccggagagatcatctgccgtgagagttggctatgttctgctcttaaggttatcggcatcggccattga

SEQ ID NO: 5900 - DNA, 2562 bp, Klebsiella pneumoniae
tactcgatgaaagagtgggtctggtcaatcgttgaccggaaaattattcaggagttatttatgtctaacactatcgacctgacgctggatggtctctcctgcggccactgcgtcaaacgcgtgaaagagagtctggagcagcgtcctgacgttgagcaagcggaagtcaccctcactgaagcccatgtgacgggcagcgccagcgcgcaagcgctgattgataccgttaaacaagccggatacggcgcggagctcagccacccaaaggctaaaccgctggcagaatcatcaatcccgtcggaagcactgacagcggccactcctgagcttccggcagcccatgacgaagatgacagtcaacagctgctgatcaacggcatgagctgcgccagctgcgtctcccgggtacaaaacgcgcttgccgcggtgccgggcgtctcacaggcgcgggttaacctggcggaacgcacggcgctggtgatgggcagtgcgtccgccgcagaattagtgcaggcggtggagaaagccggctatggcgcggaggcgatcgaagacgatctgcaacgccgcgaacgccagcaggaaaccgccctcgcgacgatgaaacgttttcgctggcaggcgattgtcgccctgctggtcggcgtgccggtgatggtctggggcatgatcggcgataacatgatggtcagcgacgacaaccgttcgctgtggctggttatcggccttgtcaccctcgccgtcatggtcttcgccggcggccacttctaccgcagcgcgtggaaaagcctgaaaaacggcaccgccaccatggacacgctggtggcgctcggcaccggcgtcgcctggctgtactcgatgagcgtcaacctgtggccgcagtggttcccgatggaagcccgccatctctattacgaagccagcgcgatgattatcggcctgattaacctcggccatatgctggaggcccgagcgcgtcagcgctcctcgaaagcgctggaaaaactgctcgacctgacgccgccttcggcgcgggtcgtcacgcccgagggcgagaaagatctgccgctcgcggaagttcaggccggcatgaccctgcgcctgactaccggcgaccgcgtcccggtcgacggcatgataagccagggcgaagcctggtttgatgaagcgatgctcaccggcgaaccggtgccgcagcaaaaaggcgatggcgacgctattcacgccgggaccgtggtgcaggatggcagcgtgctgtttaccgccagcgccgtcggcagccagaccacgctggcaagaattatccgcatggtgcgccaggcgcagagcagcaaaccggagatcggccagctggcggataaaatctccgccgtatttgttccggcggtggtcgtcattgcgctgatcagcgctgcgatctggtacttcttcggcccggcgccgcagatcgtctataccctggtcattgccaccacggtactgattatcgcctgtccgtgcgccttaggcctggcgacgccgatgtcgattatctccggcgttggccgggcggcggagtatggcgtgctggtccgcgatgccgatgcgctgcagcgcgccagtgaactcgacaccctggtgttcgataaaaccggcaccctgaccgaaggcaagccgcaagtggtggcggtgaaaactttcgctggcgttgatgagcataccgcgctgcgtcttgccgccgcgctggagcagggctcaagccatccgctggcgcgagcgatccttgataaagctgccgacggcccattgccggaagtcagcggcttccgcaccctgcgcggccttggcgtcagcggcgaggcggaaggtcatcgtctgctgctcggtaaccaggcgctgctcaacgagcagcatatcaataccgctgaggtggaaagcgagatgacagcccaggcctcacgcggcgccacgccggtgctgctggcggtggatggtcaggccgccgcgctgttcgccatccgcgacccgctgcgcgaagacagcgtcgacgccctggcgcgtttgcatcggcagggctaccggctggtgatgcttaccggggataaccccaccaccgcgaaggctatcgccaaagaagccggcattgatgaagtgatcgccggcgtgctgccggacggtaaagccgatgccattaagcgtctgcagagccaggggcacaaagtggcgatggttggcgatgggattaacgacgccccggcgctggcccaggcggatgtcgggatcgccatgggcggcggcagcgatgtcgctattgaaaccgcggcgatcaccctgatgcgccatagtcttcacggcgtggccgatgcgctggcgatttcgaaagcaacgttacgcaatatgaagcagaacctgctgggcgcatttgtctacaactcgctgggtatcccgattgccgccgggatcctctggccgctgaccggcaccctgctcaacccggtggtcgccggcgcggcgatggcgctgtcgtcgatcaccgtggtgagtaacgccaaccgcctgctgcgctttaaaccaaaagagtaa

SEQ ID NO: 5901 - DNA, 708 bp, Klebsiella pneumoniae
ccagcgatgaaaaatattaatgccctcatagggcagggcttaactcaccctgtagacagccagagagagtttattaccctacacaaacaggaagttcgaattgattcacgagtatttgctcatcgtatagggattaaatcaactaaccttcatgcacttattcgaaaacacaaaacagaacttcttgaactgggaacactgcccacgtttgaaacagcagcagtgaaaaagggaggggctcgtggaattaaacatgagcgctgctttttgttgaacgaagctcaatttgattacatgtgtcgtgttgttcgtgggcgcgatcctttgcgaatgaatcaatttaaactcgatgtaaccaaagcattttctaaacgccgtaccgttgaaccccttcgtcgcgaatatttgcctggttatcatgaaagtcgtgatggtcttaaggctttgggtgcgcagcgtcatcattacatcaatttggctcgagccgaaaatcgcgtagctggcctgtcggatggtgagcgtggatccgccgacgagcagcaattagggttgctggtagtaatacagaaaattgaacaagcggcttttaacgaagcggtgcataacggaatgagtccgggggatgctgtacgggaagtcgcacgcagaatggatacatttgcgtcattactcagcacaaaatcgttactggggggagaaaatgtttaa

SEQ ID NO: 5902 - DNA, 1521 bp, Klebsiella pneumoniae
cgaaggatgaatacaagaaagctcgacaggagatgctggaggatgacgactgttgagcagcggaactttgcccgcaagatagagtgtgaagaggacgggctttactactcccgctatttcttcaagcagcgcaccggcggcaagatgatcatcgcgccgcaccacctggcgatacagcgcgcgctcgaccgagttatcaatggcgagattacgcggctggttatcaacgtgccgcctggctacaccaagacggaactggcgaccatcaacatgatgggccgggggttagcgctgaataagcgcgcccgtttcatgcacctgtcctactcgcacaatctggcacttctgaactcgtcaaccgcacgcggcatgatcaagtcaaagctctatcaggcaatgtggccgatggagttgcgcgacgatgccgacagcaaggcgatgtggtggaacgagcacggcggaggagtctacgcttcgtcagctgcagggcaggttacaggttttcgtgccgggcatatggaaccaggctggcagggcgcgttaatcattgatgaccccgttaaacctgacgatgcttattcagatatcgttcgtaacggagtcaacaaccgctttaacgagacaatcaaatcacgactggcgatcgagacgacgccgatgattgtcatcatgcaacgaatccactaccacgacctgagcggctatctgttgcgcggcgggagtggtgagaaatggcatcacctgaatctgccggtgattatcgacaatagtcagccatacgctgcgcagtaccctgaaaactcccacgctataccgattgaccatggcttacctgacggctggctgtggccgtttaagcacaatgaatcgcatcgtgtatcgctgttctcgcaccggcgcaccgcagaagcccagtacatgcagaagcctcgcaggtttaatgctgagggcgctctctggacagaggtgatgatcagcgcggcacgcgagctgcaaattcatcacgataaggttcgcactgtcgtggctattgacccgcaggcaacaaacagcgacgaaagcgatgaaacagggattgtcgctgccagctcatatggcgccggtgacaaaaagcagttctccgtggatggcgattacagcggaaaatattcacctgctggatgggccaagaaagccatatcggcctatgagcaacacgaagctgacgcgatagtcattgagacgaaccagggcggggacatggcggaggagacactccgcaacgccgggttcaaaggccgcatcattcgtgtccatgccagcaaagggaagtatgcgcgagctgagccgatatccgcgttatacgagcagggccgagtggcaaatcacggcaatctctacgtgttggagaaccagttgatggaatacatccctgccaccgcgaagaaatcacctgaccgcctcgatgcgatggtttacgcactgactgaactgaatggatcgcaacctgtggggatgatgattcctaaacgccttcgctaa

SEQ ID NO: 5903 - DNA, 639 bp, Klebsiella pneumoniae
aacagctcgaacaggagcggctgcaggcgcaggaagcggcgaaagaagcgaaggagcagcagaagcaggctgaagaagcggctgccaaggccgccgcggcggcaaaagccaaagcggacgcacaggcaaaagaagcgcaggaagccgctgccaaagcggccgccgaggcgaaagcgaaggcggatgcccaggcgaaagcggcagaacaggcggcggccaaggcggctgctgacgcgaagaagcaggccgaagccgctgcagcgaaagccgctgccgaggcgaagaaacaggcggaagctgaagcggcgaaagctgcggccgaggcgcagaagaaagcggaagcggcggctgcgaagaaagcgcaacaggaagcggagaaaaaagcccagcaggaagcggctaagcaggcggcagctgaaaaagcggctgccgaaaaagccgctgagaaagccgccgcgcaaaaagcggccgctgagaaggccgccgccgagaaagccgcagccgctgaaaaagcggctgcagcagagaaggctgcagctgataaagcggccaaggcggcagcagcaaaagccgcggcggcgaagaaagcggcggctgcgaaagaagcggacggcgttgacaacctgctcggcgatctga

SEQ ID NO: 5904 - DNA, 606 bp, Klebsiella pneumoniae
tcagcgtcgaatgcgccgacgatcccggcgacagcacctggcagcagtttactcccagcggccccacgcgctttcctgccgctgttcgaccactgggcctcgctggtctggtacgacgccccggcgcggatccgtcagctgcagagcatgaccatggcgcagctccagcaggagatcgccagtcactttccggcgcggctgggacgggtgacgccgcaggcggccggcgccttcccgctcacccggcgtcatgcgctgcagtatgttcagcccggcctggcgctggtgggcgatgcggcgcacaccattcatccactggcggggcagggggttaatcttggctatcgtgatgtcgatgccctgctggagatcctggcggaagcgcgcggccgcggcgaagactgggccagcctgccggtgctgaagcgctaccaggcgcggcggcgagcagataattttatcatgcagtcggggatggatctgttttatgccggattcagcaatgacctggcgccggtgcggatgctgcgtaatattggcctgatggcggctgaacgtgccgggatgctaaagcgtcaggcgctgaagtatgccttaggcttgtaa

SEQ ID NO: 5905 - DNA, 426 bp, Klebsiella pneumoniae
cccgccacgaacgcctgccgacagacatttcacccgactttttcatcagttcaggtatactgtcaggctctttatgattatcaatcttcacgcacccagggggaacacttgcagggtaaagcactccaggattttgttatcgacaaaattgatgacctgaaaggtcaggacatcgttgccattgatgtacatggcaaatccagcatcaccgattgcatgattatctgcaccggcacctccacgcgtcatgtgatgtctatcgccgaccacgtggttcaggagtcccgcgccgccggcatgctgccgctgggcgttgaaggggaagccgccgccgactggatcgtcgtcgacctcggcgacgtgatggtccacgtcatgcaggaagagagccgtcgtctgtacgagctggaaaaactctggagttaa

SEQ ID NO: 5906 - DNA, 1587 bp, Klebsiella pneumoniae
cacccggcgaacgataaggacacaggcatgaggacccggcatctgatggcgctgtttacaggagtgctgatactggccatcatcctgcccatttcactcagcatctggcaggcggcgcggcaggccaaaatgcagttctatcgtgaactggatgactattccaaccgtatcgtcgttcggacgctgcaggttgccgaccaggcccgggaagcgttacgagaggctgacgcacacaccgccgcctcctgtagccctgaacatctgcttacgctccgccgcatcgcctatacccatcgctacattcaggaagtgctctggctgcgtgattccgtgccgcaatgctcctccctggaagaccatagcgtcgcggtcaccttccccccgccggaccacattgcccccgacggctatcgcacctggctgacctcaattaacgatcttggcctcgatcatcagatgacggccatgggcagccggcagcacatggtgatgatcgaccccgtctcctttattgatgtcgttcccgccagcgaagagaagatccataccatgctgtttggcctggaccaccagaaaatggtgatcagcagtcagccgctgccggcgaaagtctggcaacgcattaaagatccgcatgtggatatgcttactctggataacacagtctaccggatccagcgcattcccgagctgggctctggcatcgtaacctggtcttcaaccttgccgctgcagcagcgcattcgacagcagctgttcttctggctccctgccggcattttcaccagcctgctcgccaccgggctgctgctgcgtctgctaaggcacctgcgctcaccgcgcaacagcatgctggacgccctcaattccgaagcgattcaggttcactatcagccgattatttcgttgcaggaagggaaaattgccggggcggaggccctggcccgctggcagcagcccgatggcacttttttatcgccggatatctttattcccctggccgagcagaccgggctcatcacgcagctgacggaagatatcgtcaggaaaatttttgccgatctcggcccctggctgcggcagcggccggaagtgcacatctccatcaacctgtcggtagatgatttacgctcgcccaccctgccgacgttgttgcacaatcagctacagcactgggggatcgccgccgaacagatcatccttgaaatcaccgagcgcggttttgtcgacccggagacgactatgccggtgatcgctcactatcgtcaggccgggcatcggatctcgattgatgactttggcaccggctactccagcctgagctatctgcagaaactggacgtcgacacgctgaaaatcgataaatcttttgtcgataccctcgagtaccggccgctgacgccgcacattattgaaatggccaaagcgctcaatctggccaccgtcgccgaaggggtggaaaccgaaagccagcgcgactggctgcgccagcatggcgttcagtacgcccaggggtggctttacagcaaagcgctgccaaaagagcagttcattctgtgggcagagcataacctccatgcgcattaa

SEQ ID NO: 5907 - DNA, 252 bp, Klebsiella pneumoniae
ctgtcacagaatacagataaaactgtaggaggtaacatggaaaccatttcgcaacgcctcaaaaaaaagcgcgaagagatgaatctgtctcaggcgcaattagcaaaaaaagttggcatgagacagcagtctctgcaggcaattgaggccgggacaaccaagcgcccacgttatttgttcgaactggcaactgcgctccattgcgaccctaagtggctgctttatggcgagatgccatctcaatctcaataa

SEQ ID NO: 5908 - DNA, 594 bp, Klebsiella pneumoniae
aaaacgcagaaaaccggcggtgatcgccggttcttctgtttgcaggtgcaaatctgcaataaaaagtgtcgccacgaattactcgctgacggtgacgcttttgatgatcacatcatctttcggcacatcctggtgcatgccgctgcggccggtggcaaccgctttgattttgtcaaccacgtccatgccttcaaccacttccgcgaagacgcagtagccccaaccctgcaggctttcgccggagaagttcaggaagtcgttgtcaaccacgttgataaagaactgcgcggtggcagagtgcggcgcctgagtacgggccatcgccagcgtgccgcgggtgtttttcagaccgttgttcgcttcgttctgaatcggagatttggtcgctttttgtttcatgccaggttcaaaaccgccgccctgaatcatgaagccgttgataacacggtggaaaatggtgttgtcgtagaaaccttcgcggcagtagtccaggaagtttttaactgtttccggcgctttgtcgtcaaacgttttgattacgatatcgccatgattggtgtggaaagtaaccatttttgcatcctgttccgatga

SEQ ID NO: 5909 - DNA, 651 bp, Klebsiella pneumoniae
acacaaaagaaactattcaaaagaaagaaagaaaagatccccctaaatcccccaaggggggaaaactcactcgctcaggaagtgatggattacttcaacgagctaacgggtagtcgttgtgctgcgctggcgccttttgagaaagctctctccacggtgaagagcaaagaccagtgctacaccgctgaagagctgaagctggttatccgctgggcccatgtgaactggggtcacagcttcaagccagagaacctgtgtcgtatgacccgatttgatggatacctgtcagacgccctgatatgggcagatggtcatggaagcaacccgaaagcctgtccgcacgaagagatcatcaagctctggaatgaaaaattcccttcgaaggccgtttcactgcatgagtggaaccgccgccgtccggcctatcgagacctggaagctgtgtggaacggcaaaaccacccagggcaactggcgagaactgaagcacatgggaatggccttcgagctgattagcaagtcttccctgttcggcaccagaggcgatcagccatggctgactctcgactggatactgaatccgaagaactggggatctgtctacgagcaggccatcaacgagcaccgtgagcgcaagggggtcaaagcatga

SEQ ID NO: 5910 - DNA, 2331 bp, Klebsiella pneumoniae
gctgagaagaacgcgggcgctatgaagaaacagcataattatacggtgatgcactggggaacctggcaggtggagagcagtgagggcgagatcgtggcggttaagccggtgccctgggataaaaatccctcacgcatcggccagtcgcttcccgacgcggtgaccagccaaacgcgcattcgccgtccggcggtgcgcgccggctatctccagcacgggccggtgtcacgagaagggcgaggtaaagagccctttgtcgaagtcagctgggaggtggccctggacctgctggcgcgcgagctgcgctcggtcaaggcgcgctgcggcaatgaggcgatctacggcggctcctacggctgggccagcgctggacgctttcaccatgcgcagagccagctgcaccggtttctcaagggctttggcgggtacaccgccagcaccaatacctatagcagcgccgcgggcgagcgtattctgccgcatattctcgggccgctgagcccgctgcaccgacagcatacccatttttccgagctggcccgggagtgtcagctgtttgtcgccattggtggtctgccgctgcgcaatgcccaggtcaacggcggcggcgccaatgaccatatgctccagtactggctggataagatgcaggccaacggcacgcggtttatcaatatcagtccggtgcgcaatgacctcagcgcggtgcccgacgccgagtggctggccattcggccgggcaccgataccgcactgctgctggccctgagctatgtgctgatcgctgagtctctctacgaccaggcgtttgttgccagccataccgtcgggtttgccccctatcgcgcttatctgttgggcgagcacgatggcgtggcgaaaaccccagcgtgggcggcggcgattaccggcctggacgcccagcgcatcgccgatctggcgcgggagatggcccgccaccggacgatggtgaatatctcctggtctatccagcgcgcccgtcaaggggagcaggcctactgggcgacggtggccctgactgcgctgctgggacagctcggcaccccgggcggcggcctcgggtttggctacgcctgcaccaacctggcgggcgcggtgcgaaaagcgttttccggcccgcgcttacccgccggagagaatgcggtggacagcgttatcccggtggcgcggctgtccgatatgctgctgcacccgggagaaacctatgagttcgacggtcagcagcggcgctatcccgatatccgtttagtctactgggcgggaggcaatgcgtttcatcatcatcaggacatcaaccgactgtgcgaggcctggcgccgcccggagacggtggtggtgcatgagcagtactggaccgcgcaagccaaattctccgatatcgttctgccggccaccacctcgctggagcgagaggatatcggcagcggcggtcacgacgggtttatgatcgccatgagcgcgcagatcccgccggtgggcgaagcgcgtgacgattacgccattttctgcgatctcgccgggcggctgggcttcggggaagcgttcagcgaagggcgtgacgccgggcagtggctacgtcatctctatgaggagtcaagaccgcgggcgcaggaggagggtattgcgctgccctcgttcgatgacttctggcagcaaggggtgctggaatactgcgcgccggagcggccgcaaatttttctcgccgattttcgcgccgatccgcagcgctatccgctctccaccccctccggcaaaattgaactcttttccgccaccgtcgccgggtttggctatcgcgaatgccctggccatccgtggtgggatgaacaggaggccgcccgccagcggcaggaggcggcgcgctggccgcttcatctgctctccagtcagccgcgcgcccgcctgcacagtcagtacgaccacggcagcgtcagccgggcgacgaaaattcagggacgcgagccgctgtggatgcatccgagcgatgcgcaggcaagagacatccgcgaaggcagcgtggtgaaggtctataacgaccgcggggcgattctggcgggcgtgcacctgagcgagcagattttgcccggcgtggtacagatgtccaccggcgcctggtatgacccgctggatcccaatgaaaaaggaacgctcgataagcacggtaatcccaacgtgttaaccgaggatcgcggcagttcgcgcctggggcagggctgtagcgcccagagctgttgggtggagatcgccccgtggcgtgaggaactgccgccgatcaccgcctttgatccgccgaggtttattgaggtttag

SEQ ID NO: 5911 - DNA, 801 bp, Klebsiella pneumoniae
cgggagaagaacatgcgggtagcggcaggacaatttgccgtcacgccagtatggcggacgaatgcgcaaacctgtgtggcgatgatgcagcaggcggagcgagaaggggcagcgctgctggtgctgccggaggcgttgctggcgcgggatgacaacgacccggatctgtcagttaaatcggcccagccgctggatggcgcatttttgcagccgctgttggccgagagcaggcgtaacagcctgaccacggtcctgacgctccatgtgccgtcaggggaggggagagcgaccaacaccttggtggtattgcgggaaggcgcagtgattgcccattatcataaacttcatctatatgacgccttcgcgatgcaggagtcccggcgggtggatcctggtcagcagatcccgccggtgattgaggtggcgggattacgcgttggcctgatgacctgctacgatcttcgctttccggaactggcgctttcgttggccctgaatggggcacagctgctggtgctgcccgctgcatgggtgaaagggccgcagaaagagcatcactgggcgacgctgctggcggcacgcgctctcgatactacctgctatatcgtggcggcaggcgaatgcggaacgcgcaatatcgggctgagccgcatcgtcgatccgctggggaccactctggcgggggccgggagcgagccgcagctgatctttgccgatctctctgcggatgaccttgcgcgcgttcgcgagcgtttaccagtgctgcggaaccgacgatttgcgccaccgcaattattatga

SEQ ID NO: 5912 - DNA, 348 bp, Klebsiella pneumoniae
ctgagagagaagcctatgtttggtggaaaaggcggcctgggtaacctgatgaagcaggcccagcagatgcaagaaaaaatgcagaagatgcaggaagagatcgctcagctggaagtaaccggcgaatccggcgcgggtctggtgaaagtgaccattaacggcgcgcacaactgccgccgtgtggagatcgacccaagcctgctggaagacgacaaagagatgctcgaagatctggtggctgccgcgttcaacgacgccgcgcgccgtatcgaagagccccagaaagagaagatggcttccgtttctgccggtatgcaactgccgccaggcttcaagatgccgttctga

SEQ ID NO: 5913 - DNA, 618 bp, Klebsiella pneumoniae
ttacaggagaatcaaatggttctggtcactcgtcaagcgccggattttactgcagccgctgtgctgggtaatggtgagatcgttgagaaattcaatttcaaacagcacaccaacggtaaacctaccgttctgttcttctggccgatggacttcaccttcgtgtgcccgtctgagctgatcgcgttcgacaaacgttacgaagaattccagaaacgcggcgtggaagtggttggcgtttccttcgactccgagttcgtgcacaacgcatggcgtaacaccccggtagaccagggcggtatcggcccggttaaatacgcgatggttgctgacatcaaacgtgaaatccagaaagcttacggtattgagcatccggacgaaggcgtagcgctgcgcggctccttcctgatcgacgccaacggcatcgttcgtcatcaggtggttaacgacctgccgctgggccgtaacatcgacgaaatgctgcgtatggtagacgccctgcagttccacgaagagcacggcgaagtctgcccggcgcagtgggaaaaaggaaaagaaggtatggccgcctctccggaaggcgttgcaaaatacctgaccgaaaacgtttccagcctgtaa

SEQ ID NO: 5914 - DNA, 414 bp, Klebsiella pneumoniae
ccgtgggagaagccaaacacgacatcaccgagagcatgctggagatcgccaccggggtgtgccgcgacatcagccatgcgcaaatccagctcagcgccatccagcaggcggtccagcgcgcggcgctgcgccatcatctgcagatctgcggcgggggttcccacccctttcatgcctggcagcgccagcaaatcagcgataacccgcgctatgtcaaaaccgtcgagcattttggctatctggcgcagcaggcgacggtctttggccagcatgtgcacgtcggctgccagagcggcgacgacgccatctatctgctgcatggcctgtcgcgctttgtaccgcacttcatcgcccttaacgccgcctcaccgtggtttgacagcaccgacagccgcttcgcctgttcgcgcctga

SEQ ID NO: 5915 - DNA, 414 bp, Klebsiella pneumoniae
atggcctggaagcgagagcttacgctggcggcgctgaacgccagcagcgaaaataccatggtggcgcatcttggcatcatctacacccgactggaagaggggctgctggaggcggagatgccggtggatgcgcgcacgcatcagccgtttggcctgctgcacggcggcgcttccgcggcgctggcggagacgctgggctcgatggccggttggctgatgaccgaagaagggcagtgcgtcgtcgggactgagcttaacgccagccatcaccgggccgtctccagcgggaaagtgcgcggcgagtgccgtccgctgcatcttggccgccagagccagagctgggagattgtggtgtatgacgagaaggggcggcgctgttgcacctgtcgtctgggcaccgcggtgctgggctaa

SEQ ID NO: 5916 - DNA, 810 bp, Klebsiella pneumoniae
ggtaatcggaaaccccattacaggagagtgcggatggcgagagtcgtagtaattaccggcggtggaaccggaattggcgctgcctgcgcgcggctgatgcgcgccgtgggcgaccgggtgtttattaccggacggcgcgaagcgccgctgcaggctgtcgccaatgagaccggcgccacggcgctggtgggcgatgccgccgacggcgaggtgtggcgccagcggctgctaccggcgatcctcgaccagaccggcgggattgatgtcctcatctgcagcgccggcgggatgggcaacagccccgccgccgagaccagcgaccgccaatggcgcgaggcgctggacggcaatctcaccagcgccttcgccagcgttcgcgcctgcctgccttcgctgattgcccgccgcggcaatgtgctgtttgtcgcctccatcgcctctctggccgccgggccgcaggcctgcggctacgtcaccgccaaacacgctttaatcggcctgatgcgctccgtcgcccgcgattatggcccccagggggtacgcgctaacgctatctgtcccggctgggtcacgacgccgatggcggatgaagagatgcgcccgctgatgcaggcggaagggctgtcgctggctgaggcttatcagcgggtctgtcgcgatgttccgctgcgccgccccgccagccccgaggagatagccgaggcctgtcagtttctctgctctccgcaggccgccatcatcagcggcgctacgctggtcgccgacggcggggccagtatcgtcgatgttcccactctggcgtttgcctaa

SEQ ID NO: 5917 - DNA, 2034 bp, Klebsiella pneumoniae
gccacgcggaaaccgctcactaaggggccgaggaagaaaacgatgttcggaaaacttacactggatgcagtgccctaccacgaacctattatcgtggtaacggtggctgcgattatcattgggggactggcgcttctggcagccatcacttacttcggtaagtggtcctacctatggaacgagtggctgacttctgtcgaccacaaacgtctcggtatcatgtacgttatcgtggcaatcgtcatgctgctgcgtggctttgctgacgccatcatgatgcgtagccagcaggtgctggcttcggccggggaagccggcttcctgccgcctcatcactacgatcagatctttaccgcccacggcgttatcatgatcttcttcgtggcgatgccgtttgttatcggtctgatgaacctggtggttccgcttcagctcggcgcgcgcgacgtagccttcccgttcctcaacaacctgagcttctggttcaccgttgtgggcgtgattctggttaacctgtctctgggcgttggtgagttcgcgcagaccggttggctggcctatccgccgctgtcgggaattgagtacagtcctggcgtaggggttgattactggatttgggcgctgcagctctccggtatcggtactaccctgaccggtattaacttcttcgtgaccattatcaagatgcgcgccccgggcatgaccatgttcaagatgccagtattctcctgggcatctctgtgcgctaacatcctgattatcgcctctttcccaattctgaccgtcaccatcgcgctgctgaccctggatcgttacctgggcacccatttctttaccaacgatatgggtggcaacatgatgatgtacatcaacctgatttgggcctggggtcacccggaagtgtacatcctggttctgccggtgttcggggtcttctccgaaatcgccgcgaccttctcgcgtaagcgtctgttcggttacacctctctggtatgggcaaccgtctgtattaccgttctgtcgttcatcgtttggctgcaccacttcttcaccatgggtgctggcgcgaacgtaaacgccttcttcggtattactaccatgattatcgcgatcccgaccggggttaagatcttcaactggctgttcaccatgtatcagggtcgcatcgtcttcaactcggcgatgatgtggactatcggctttatcgtgaccttctccgtaggtgggatgaccggcgtgctgctggcggtaccgggcgcggacttcgttctgcacaacagcctgttcctgattgcgcacttccataacgttatcatcggcggcgtagtgttcggttgcttcgcaggtctgacctactggtggccgaaagcctttggcttcaccctgaacgaaacctggggcaaacgcgctttctggttctggatcatcggcttcttcgtggcgtttatgccgctgtacgtgctgggcttcatgggtatgacccgtcgtctgagccagcagatcgatccgcagttccacccgatgctggttattgcagcttgcggtgcagcgctgatcgcctgcggtattctgtgccagctgattcagttctacgtgtctattcgcgaccgcgatcagaaccgtgacctgaccggtgacccgtggggtggccgtacgctggagtgggcaacctcttctccaccgccgttctacaacttcgctatcgttcctcaggttcacgaacgtgatgccttctgggaaatgaaagagaaaggtgaagcgtacaaacaacctgctcactatgaagaaattcatatgccgaaaaacagcggcgccggcatcgtgattgccgccttcgctacggtatttggtttcgccatgatctggcatatctggtggatggcgatcgccagcttcatcggcatcgtagcgacctggattattaagagctttgacgaggacgtggattactacgtaccggttgcagaagtcgaaaaactggaaaaacagcatttcgatgagattaacaaagcagggctgaaaaatgggaactga

SEQ ID NO: 5918 - DNA, 1017 bp, Klebsiella pneumoniae
aaaacgcggaaagcgggtcgcaaaacccagagaagtaggatgttgtctccggcagtgtgctggcagtctggtcctctgcgcatgacgccactggagacaatattgatggaaaaagtcagtcaaaccccacacgacgcggtgtttcgccagatgctcatgcatcaggcggtcgcgaaggattttttgcagttgtacctccccgcgccgtttctggcgatctgcgaactggattcgctgcagctggtctccggtagctttgttgaagaggacctgcgcgccagctattccgatatcctttactcactgcgcacgcgtcatggaccgggctatgtgtacgcgctgattgagcaccagagtaccccggacaagctgatggcgtttcgcctgctgcgctatgcgctggccgccatgcagcgtcatctggacgccggccacgacacgctgccgctggtggtgccgattctgttttatcacggcaaagtgagcccctggccctgggcccgcaactggcaacagctattcgccgatccggcgctggcgaaggcgctctatagcaatgattttccgctggtggacctcaccgtaatgccagataatcagatcgcccgtcatcggcggatggccatgctggagctgctgcaaaagcatatccgccatcgcgatctggccgagctgcaggtgccgctgattgcgctgatgacgcaaggctatctgacagaagcgcagctgaatacgctgctgcgctatatgttgcaggcgggaactacggaacatccgggggcgctgatccgcacgctggcggcgcagtcgcccaggcataaggagctgatgatgaccattgccgaatggctggaagagaaaggccgtaaacagggacagcaagagggtgagcaggaaggtcgagaagccgccactcgcagcatcgccgccagaatgctggcgcgcggcctcgaacgtcaaaccgtgcaggagctcaccgggctgagcgatgaagaactcgccgcgctggcgccctga

SEQ ID NO: 5919 - DNA, 717 bp, Klebsiella pneumoniae
aaatacaggaacagagtcatgaaattacgtataacccttttaaccgctgctaccctgaccgccttctcctttgccgcgcacgccgcggagaaaggcaccattatgatcatggtcaactcgctggataacccgtattacgcctcggaagccaaaggcgccagcgaaaaagcgcaagctctcggctacaaaaccaccgtgctgtcccatggcgaagatgtcaaaaagcagaatgagcttatcgacaccgcgattggtaaaaaagtgcagggcattattctcgataacgctgactccaccgccagcgtcgccgccattgaaaaagccaaaaaagcgggcattccggtggtcttaattaaccgcgaaattccggttgatgatgtggcactggaacaaattacccacaataacttccaggccggctctgaggtcgccaacgtcttcgtcgagaaaatggcggagaaaggcaaatacgccgagctgacctgcaaccttgccgataataactgcgtcacccgttctaaatctttccatcaggtcattgaccagtatccggatatggtcagcgtggcgaaacaggatgccaaaggcaccctgatcgacggcaaacggcatcatggacagcatcctgcaggcgcaccccgacgtgaaaggcgtcatctgtggcaacgggccggtagcccttgccgcgaatgcggcgctgaaagcggccaaccgtag

SEQ ID NO: 5920 - DNA, 486 bp, Klebsiella pneumoniae
acccgaaggaagagtatgaacattattgaagctaacgttgctaccccggacgctcgcgtcgccatcaccattgcgcgtttcaacaactttatcaatgacagcctgctggaaggcgcgattgacgccctgaaacgcattggtcaggtaaaagatgaaaacatcaccgtcgtttgggttccaggcgcgtatgagctgccgctggcggctggcgcactggcgaaaaccggtaaatatgacgcggtgatcgcgctggggacggtgattcgcggcggtaccgcccactttgaatatgtggcaggcggtgccagcaatggcctggcgcatgtcgctcaggacagcgaaatcccggtagcctttggtgttctgaccactgaaagtattgaacaagccattgagcgcgctggcaccaaagctggtaacaaaggtgcagaagctgcgctgaccgcgctggaaatgattaacgtattgaaagccatcaaggcctga

SEQ ID NO: 5921 - DNA, 396 bp, Klebsiella pneumoniae
  unsure (123): Identity of nucleotide at the above locations are unknown.
aaagccaacctgccggttggcttttttatgggcgcctctggcgcccttcccgctcacgcccctggggtgactttcctcatccccgctttgtccggagagttgatatggaacttcaccagcggngctatctctgaccgaatcgggcgtcgtccggtgctgataggcattaccgtgctggcgctgctcaccacctggccggtgatgcactggctcaccgtcgcgcccgatttaacccggatgacgctggccctggtatgggttctcggtctttctttggcatgtataaacggggccaaggtcgcggcgctttcccgaagtaatgcccggtatacgtccgcacccggggggcttttcgctgggcttttagtctcgctactgccattttcggcgacctga

SEQ ID NO: 5922 - DNA, 201 bp, Klebsiella pneumoniae
cttatgtttgacaccctctccaaagcaggaaaatatttaggccaggccgccaaaatgatgatcggcgtgccggattacgataactacgtcgagcacatgcgaataacccacccggatcagacgccgatgacttatgaagagttctttcgcgaacgccaggacgcgcgctacggcggcaagggcggggcgaagtgctgttaa

SEQ ID NO: 5923 - DNA, 1140 bp, Klebsiella pneumoniae
gcgtctgttgaccaaaaactacggcgcgcgtctactgaacgcgttacctgtttttcccatagagcagccgggcgttccggaggttatagtaaaacggaaagcaaaacagacagcaaaacagacgggccgcaaacgtcgctgacgccggcgcgtgatgcaccagggggagccatggagtacagcaaaattataaaagaggtgggtcgcggtaagaatcatgcccgcgatctcgatgaagagaccgcccgtgcgctctacgcgcggatgctgaacggcgaggtgccggagctggagctggggggaatattaattgccctgcgcattaaaggcgaaggcgaagcggagatgaaaggtttttacgccgcgatgcagcagcatacgctgcgcctgaccccgccggccggcaagccgatgccgatcgttatccccagctacaacggcgcgcgcaagcaggcgaacctcacgccgctgctggcgatgctcctgcacaagctgggatttccggtggtggttcacggcgtcagtcacgatcccacccgggtgctgaccgaaaccatttttaccctgctggacattccggccaccctgcacgccggacaggctcaggcgcagctggagggccatgaaccggtgtatatcccggtgggggccttctgtccgccgctggagaaacagctggcgatgcgctggcggatgggcgtacgcaacagcgcccataccctggccaagctggccacgccgtttggcgaaggggaggcattgcgtctctccagcgtgtcgcatccggaatatgttccccgggtggcgaacttctttcgcgagaccggtggccgcgcgctgctgatgcatggtaccgagggcgaagtgtacgccaacccgcagcgctgtccgcagatcagcctgattgatgagcagggcgtgcgggtgctgtacgaacgccagactgagatggcagcggaggcggtggtcctgccgacctcgaaagaccctgaggtcaccgcgcgctggattgaacgctgcgtcgctggcgtcgaaccggtgcccaactcgttgaagatccagcttgcctgctgtctgctggcctgcggggaagtgacctcgctggagcagggcctcagccgcgtcaacgactgctggtga

SEQ ID NO: 5924 - DNA, 1014 bp, Klebsiella pneumoniae
cacaaagttgaaaatgagacgcatttatcacctttcaaatcaggatgcgatgacgtgaacttcttttctttctgccgccgcggtgcgctgaccggcatgctgttgcttttaggaattacctcagcccaggcggcggactggccgcgccaggtcaccgacagctacgggacgcataccctgccgagtcagccgctgcgcattgtctccaccagcgtgacgcttaccggttcgctgctggcgattgacgctccggtggtcgccagcggcgcgaccacgccgaacaaccgcgtcgccgatagccagggctttctgcgccagtggagcgaggttgccaaagcccgcaagctggcgcggctgtacatcggcgaaccaagcgccgaagcggtggccgcccagatgccggatctgatcctggtgagcgcgaccggcggcgactccgccctgccgctgtacgatcagcttaaaaccatcgccccgacgctggtcatcaactatgacgataaaagctggcaaaccctgctcacccagctggggcagatcaccggtcatgaacaacaggccagcgcgcgcattgccgacttcaataaacagctcgtttcgttaaaagaaaaaatgaaactgccgccgcagccggtgaccgccctggtctataccgccgccgcgcacagcgccaatatctggacgccggaatcggctcaggggcagatgctcgaacagctgggctttagcctggcgacgctgccgggcggcctgcccgccagccatagccagggtaaacgccacgatatcgtgcagctgggcggggagaacctcgcggccggtctgaacggccagagcctgttcctgttcgccggcgaccagaaagatgcggatgccatctacgccaacccgctgctggcgcatctcccggcggtcgcaggcaaacgcgtctacccgctgggcaccgagaccttccgccttgactactacagcgctctgctggtgctccagcgtctctccagcctgttcggctaa

SEQ ID NO: 5925 - DNA, 624 bp, Klebsiella pneumoniae
tgtgagtctgagactgggcggtggatttcatcgttccgctcttggctgcccatgtctacgcgaacaggctcgcaccacagaaaggtaaatacgatgaagtatccaaccgtatcagtgaacggcgtctccgttcgtgtcgatggcgatggtcgctataacttcaacgatcttcatgctgcggcagtagcaaaaggggaggcaactgagtcgcagaggcccagtaaattcctccgcagcgctcagattaaaagattcatcaaagcattgcagtccaaagcccaaaaaagtgctttggaacaaattcaaccacttaaggtagttaaaggtggggatgagcctggtgtctggggagtggagctgcttgccattcgctatgcagcatggattaagcccgagttcgaaatcgaggtgtatgaggtatttcggacggttgttcgtatggggatcggcgccatgtcccgcctgaacaaaatcgaacatatcatcaatacagaaacgaaggtgatcagccagtgtgctagccagatggcgaaatggggagtcggcggacgtaagcaattgctccatgctgcgcgcgatcgtgctgccgatgaagtgcagttgtatttgccaggtatcgcataa

SEQ ID NO: 5926 - DNA, 381 bp, Klebsiella pneumoniae
gccattcctgaccgtcgagcgctggggaaacggaacgcttggcggagaaatttaccggttaccacgggaggcacaatgaataagcagagcatcacaccagagcaattccgcgccgtcgccggaaccatgcctgcctgtcgcgcagcggatgcgctggggattagccaggcgaacttctaccgcctggcacagagctattccatcagcacagcgtttgtctacaagccctggaagccagaagagaagcagatcgccgctgaaatgcgcgatgcaggcgagtcgcataaaagcatcgccatgaagattggccgaagcgttgcgtcggtatccagaactttaagccgcatgagaaaggcagacacgaaaagaggtgcgcaatga

SEQ ID NO: 5927 - DNA, 1194 bp, Klebsiella pneumoniae
ttacaccctgaaggatggactgaacacatgaacttacatgaatatcaggcaaaacaactttttgcccgctatggcttaccggcgccggtgggttatgcctgtactactccgcgtgaagcagaagaagccgcttcaaaaatcggcgcgggtccgtgggtagtgaaatgtcaggttcacgctggtggccgcggcaaagcgggcggtgtgaaagtagttaagagcaaagaagagatccgcgcatttgccgagcactggctgggcaaacgtctggtgacctatcaaacagatgcgaacggccagccggttaaccagatcctggttgaagcggcgaccgatattgacaaagagctgtacctgggcgcggttgttgaccgtagctcccgtcgcgtggtgttcatggcgtctaccgaaggcggcgtggaaatcgagaaagtggcggaagagaccccgcacctgatccacaagatcgccatcgatccgctggcaggcccgatgccttaccagggtcgtgaactggcgttcaaactgggtctggaaggtaaacaggttcagcagttcaccaagattttcatggggctggcgaccattttccttgagcgcgacctggcgctgatcgagatcaacccgctggtgatcaccaagcagggcgacctgatctgcctcgacggcaaactgggcgctgacggcaacgcgctgttccgccagccggatctgcgcgaaatgcgcgatcagtctcaggaagacccacgtgaagcgcaggcggcgcagtgggaactgaactacgtcgcgctggacggcaacatcggctgcatggttaacggcgcaggcctggcgatgggtaccatggacatcgttaagctgcacggcggcgaaccggctaacttcctcgacgtaggcggcggcgcgaccaaagagcgcgtgaccgaagcgttcaaaatcatcctctctgacgacaacgttaaagcggtgctggttaatatcttcggcggcatcgtgcgttgcgacctgatcgctgacggcatcatcggcgcggtagcggaagtaggggttaacgttccggttgtggttcgtctggaaggtaacaacgccgaactgggcgcgaaaaaactggctgacagcggcctgaatattattgcagcgaaaagtctgacggacgcagcacagcaggttgttgccgcagtggaggggaaataa

SEQ ID NO: 5928 - DNA, 714 bp, Klebsiella pneumoniae
tatttacctgatcaattgacgggagtgggcgtgagaggaaagacgctgctggtgctggccgggctgctcggcgcgggcctgttgggataccgcaatctgccgccgcacctgaatccgctggcgccgctggcgctggacgatcccccgggctggctgacgtcgtttaagctgcgcaggctgacggcagaccagtgcgcctccctgctggcggaagccaatcgccggcggcttatcgccagccggccggtggccgacagcgagggaagctgccctctgcgtaacgtggtgcgggtggcgaattttggctcggtgcagctgagcagtagttttctcgccagctgcccgctggcgctgagcagtgcgctgtacatcgagcagcaggcgaagccgctgacccggcagctgatggcgagcgatctgcgtcagatcgatcatctcggcagctttgcctgccgcaatatttaccatcgtcaacaggcgcggcgcagtgaacacgccacggcggacgcgctggacgtcagcggtttccgtctggcggacggtagacgcgttagcgtcctgcagggctggtggagcgagacctcgcatccctggctggcggcgctgttgagcagcagttgccattacttcggtaacgcgctggggccaaagtacaacgcggctcacgccaaccattttcatttcggcatgcgcggccagggcttctgcttttga

SEQ ID NO: 5929 - DNA, 330 bp, Klebsiella pneumoniae
ccagcacctgatccggctgcgcggcggcggcgcggtctgccagccgggcgtcccactcccgacaggcggccagcagctggccggtcacccgggctacccacggctgatgctgcttctcttccggccgcagacggtgctcataaacatgctggaccgctttttcacaggcggcgaggatcacccccagcaggtgcagatcgcgggccagcgcctcgggatgcgcgggaagcagccggcgcccggccggattggtcgtttcgaaatagtggaggatcagcgtggagtccatcagctgcgtcccgttatcgagcaccaccgtcggcgccttga

SEQ ID NO: 5930 - DNA, 516 bp, Klebsiella pneumoniae
agccaacctgatccagttgctgatggagggcaaacagcgcggcatcgccgggatggtgatcctcaccggcgaggcctatatccacgccattcccgccacgctgatcgcccttgccgacgagctgggcatgccgctgatcgagcagccctacctgctgaagatggtgattgtcaccgagcgcatcggcaccgcgctggtccgcagcgaaaacgtcctgcagtcgcagcgcgacattctgatgcagctggtcaccggcgactatccggacctgcagatgctccatcagcgcgccctccaccagcagctcgattttacccgtccgctgcggctggcggcgctgcgtctggaggggctgtcccgcctgtttcgccagttcccgcccgagcaggccgaagcctggctgctgcaggcccaccgcagcgtacgtcagcagctgcagcagcagctcaaccagcagggcaatcccttcccgctgctggagcgcagcaatatgtttcttttcctgctgccggatga

SEQ ID NO: 5931 - DNA, 765 bp, Klebsiella pneumoniae
gccatgcctgagtctattgccgtaagcgtcaaaaacgtctccaaacagttcgataatgtggaagtcctgcgggatattaacctgacggtggagaaggggaccgtggtgagtattctcggctcgtccgggtcgggaaaatccaccctgttgcgctgtatgaactggctggaacagccggaccgcggtgaaattcatatcggcggtcagcggctggggattgatgaacagcgcggccgggcgatgtcgcaccgccagctggccaaaatccgcgagcgggtggggatggtctttcagagttttaacctgtggccgcacctgaccgtgcagcagaacgtcagcgaggcgctgctgcgcgttaagggcatgaaacgagacgaggcgaaggccatggccatgcagcagctggagaaagtgggcatggcgcacaaagccgatgtttacccgatcactctctccggcgggcagaagcagcgggtggcgatcgcccgttcgctggcgatgtcgccggaagttattctcttcgatgaaccgacgtcggcgctggatccggagctggttaatgaggtgttgggggtaatgaaagcccttgccgccgagggctacaccatggtggtggtgacccacgagatggattttgcccgccaggtgtccaatgaggtggtgtttctggagaagggactgctgatagagaaggcgccgccggagaagttcttcactcagcctgactccgaacgcgtcaggcagtttctgcaaagcagccgttag

SEQ ID NO: 5932 - DNA, 948 bp, Klebsiella pneumoniae
cagcggcctgaatattattgcagcgaaaagtctgacggacgcagcacagcaggttgttgccgcagtggaggggaaataatgtcagttttaattaataaagataccaaggttatctgccagggcttcaccggtagccaggggaccttccactctgaacaagcgatcgcttacggtacgcaaatggttggcggcgtgacgccaggcaaaggcggcaccactcacctgggcctgccggtgttcaacaccgtgcgcgaagccgttgaagcgaccggcgcgaccgcgaccgtgatctacgttccggcgccgttctgcaaagattccatcctggaagcgatcgacgcgggcattaagcttatcatcaccatcaccgaaggtatcccaacgctggatatgctgaccgtgaaggtgaagctggacgaagcgggcgtgcgtatgatcggcccgaactgcccgggcgttatcactccgggcgagtgcaaaatcggcatcatgccgggtcacattcacaagccgggtaaagtgggcatcgtttcccgttccggcaccctgacctatgaagcggttaagcagaccaccgactacggcttcggccagtctacctgcgtcggtatcggcggcgacccgatcccgggctccaacttcatcgatatcctgaagatgttcgaggaagatccgcagaccgaagcgatcgtcatgatcggtgagattggcggcagcgcggaagaagaagcggctgcttatattaaagatcatgtcactaagccggttgtcggctacatcgcgggtgttaccgcgccgaaaggcaagcgtatgggccacgcgggcgctatcatcgccggcggtaaaggtacagcggatgagaaattcgcagcgctggaagcggcgggtgtgaaaactgttcgcagcctggccgacatcggcgaagcgctgaaagctattatcaagtaa

SEQ ID NO: 5933 - DNA, 1065 bp, Klebsiella pneumoniae
aggcggcctgatcctggtggtgctggcggcctcggcggtcagacacaaaggaggcgaggcatgagtcaaatcaccctgaaaacctctgcgtcggcggaacagacggccagcagcccgctggcctggctgtcgcgggccggatttggcgtcatcatcctgctggccatcgccctgtttggctgggcgaatccggtatttttaaccgtggataactgggccaacctgctgcagggcagcgcgatcctgctgattgtggcgatggcgatgaccctgatcgtcagcgccggggcgattgatctgtcggtgggcgtcgcgctcgatttcggcgccgccttcgccctcgtcgccctgaaaacctggcatctgccgtggcaggccgcggtgggctgcgctctgctcggcggggtgctgattggcctgctcaatgcctttctgatcctcatctgccggatccgccccttcctcgccacgctcggcacctggtttatcgccagcagcgccgagcgcatctataccgacggcggcggcgcgatagcctatcggcggatggctccggagtatcacgacctggcggtgggcaaccttggtgggatccccacgccggtagcgatcgtgctggcgctgtggctggcggcctggctggttaccgagcgcaccctgtggggcaaatatgtccgcgccatcggtcagaacagcgaatcggcgcgtatcgccgggatccgcgatcgcctgaccatgctcggcgtgctggtggccgcctcggcgctctgcgccgtcggcggggtgatcctctccgccaacctgcggcagtttaccccgctggccgggcagtcttacctgatggacgccattgcggcagtatttatcggcactgcctttacccgtctgggccgggtcagcatcctcggcaccctcggcggcgtgctgttccttgccattattgataacggcctgaacctgatggggctcaattatctggtgaacgacgcgctggtcggcgtgattctggtggtggccctcgccctatccttctggcaggcgcgcctgcgccaaacgcatcgctaa

SEQ ID NO: 5934 - DNA, 579 bp, Klebsiella pneumoniae
cttgtcactgatgcgctcaattttacaaggaataaaccgatgccattacccgaacgtctgcaaccagccaaagtaaaccgccagaaactgaaacagctagcggacatggccgaagagatactggcgcaaattgataacggggctaaggaagaggataccgggttgaaaatgttgataaatgactggaatagcctggttattaacccgtatgcattctctgatttccgggatttctcttcatggaccagtgcaaaagacttcacccggatggcgtttaatcaggaaaaatacgtggcggatttatcctgggatgagctgattcagatcatccagtttgtgtgtcaggccgaaggtaaggaatctgaacaaagctacgcgctgggactgcttgagaaaaactttgatgccaatccatccgacctcatctactggcctaatgaatggtttcaggataaagacatgcttcatgtcgatttaacgcctgaagaaatcgccggatacctgatggcaaaatctggccggcggctaagcgatgcgccgcacatcgagctgaagtatcctatcccttcaaatatttaa

SEQ ID NO: 5935 - DNA, 696 bp, Klebsiella pneumoniae
gcagtgactgacatgaatatccttgatttgttcctgaaggcgagccttctggtaaaacttatcatgttgattttgattggtttttctatcgcttcctgggctatcattattcagagaacgcgtatccttaactcggccgcgcgtgaagctgaagcgttcgaggacaaattctggtccgggatcgagctctctcgtctgtaccaggagagccaggggcgtcgcgataacctgaccggttcggaacaaatcttctacagcggtttcaaagagtttgcacgcctgcatcgggctaacagccatgcgccggaagcgattgtcgaaggggcatcgcgtgcgatgcgtatttcgatgaaccgcgaactggaaacgctggagacccatattccgttcctcggcaccgtaggctcgatcagcccgtatatcggtctgttcggtaccgtctgggggattatgcacgcctttatcgcccttggcgcggtgaagcaggccaccctgcagatggtggcgccaggtatcgccgaagcgctgatcgccaccgcgattggtctgttccccgcgatcccggcggtcatggcgtataaccgcctgaaccagcgcgtgaacaagcttgaactgaattacgacaactttatggaagagttcaccgatattatgcaccgtcaggcctttaccaccagcgaaagcaataaggggtaa

SEQ ID NO: 5936 - DNA, 639 bp, Klebsiella pneumoniae
aaaatggctgagccaacagagggtaggccattccctcccgtcaacttcactggcgaaaactggctgccgtatacccggcttatccccgctaccgaaatcggcgaatgggttaaccagcacatcctctctgaagaaggccgaattcataaccccgaccacatccacctgctcgatgctgacgtagcgtttatgtgggcttccggcgcattcgagaagaaggggcgttatgtcctcggccaatgtgaacaggtaatgctccgcgccggaggatggcagaaagcccgtatggaacagcagatgcatgaatggttcggtcgaataccgaagttcatcatcacgctggctgctgactactgcgggcaatgtagtgacctcgaattctgcgcgctgcttgaacatgagctatatcacatagcccaggctaccgatgactacggcgccccgaagttcaacaaagagtccgggatgccggtgctcacacttcgaggtcacgacgtcgaggagttcgttggagtggtgcgacgttacggcgccagcaaagacgtgcaggaaatggtggatgcagcgaacaggccagcggaggttgctcatatcgatgttgccagggcttgcgggacttgcatgctgaaactggcttaa

SEQ ID NO: 5937 - DNA, 465 bp, Klebsiella pneumoniae
cggggggctgacatgacgcaaacccgtatcgtggtcagcccggcgcgctttagcgtcagtgaggaatatccctggctggcggaacgcgatgaagacggcgcggtggtcaccttcaccggtaaagtgcgtaaccacaacctcggcgacagcgtgaaggcgctgaccctcgagcactatccggggatgactgaaaaatcgctggcggaaattgtcgagctggcgcgcgagcgctggccgctgggccgggtgacggttatccatcgcatcggcgaaatgtggccgggggaagagattgtgtttgtcggcgtcaccagcgctcaccgcggcagcgccttcgcagccggcgagtttattatggattacctgaaaacccgcgcgccgttctggaagcgtgaagcgacgccggatggcgaacgctgggtcgacgcccgcgacagcgatcgtcaggcggcagagcgctggtag

SEQ ID NO: 5938 - DNA, 936 bp, Klebsiella pneumoniae
gcattttatgacaccagttatgtgaacgtaatacaaaacaataagaggatagagatgaacactacactgcgcgccctttcaatcgcgttagccgctgcgctaatcgctccttccgcgtttgcggccaccgccgcgatcccaacgatcgatttccatggctatatgcgcgccggggttggggtctccggcgacggtagcgaagcggaatggcaaaaaaataagctgggccgtttggggaacgagtcggatacctatggcgagctggagctgggctctgaggtctataagaaagatgacgtcagcttctatctcgacagtatggtcagcatggtctccgacggctctaacgataatgaaaccacgctgaacgatgatgcacagttcggcttacgtcagttgaacctgcagataaaggggctgatccctggcgatccgaatgcggtgatctggggcggtaaacgttactaccagcgccatgatctgcatatcatcgataccaaatactggaacatttccggctccggagccggggtggaaaactacaccctcggcccgggcgccgtctcgctggcctggatccgcggcgatgccaacgatgttgactatcgcgtcgatggcgacagcaacgtcaatatcaactatatcgatttacgctacgcgggctggaagccatgggcgggctcgtggaccgaattcggtatcgactacgcgatgccaaacaccaccaaaaaacaggatagctacggcggactgtacgatgctgacaacggcgtcatgctgaccggtgaaatcagtcaggatatgctgggcggctataacaaaaccgtgctgcagtacgccaacaaaggcctggcgcagaacatggtctcccagggcggcggctggtacgatatgtggaactacgtgaacgacgccaccgggttatcgcgtgattaa

SEQ ID NO: 5939 - DNA, 1194 bp, Klebsiella pneumoniae
cctggccatgatggtacaccgccgtggcgtcaggaccaatttttccacatctgccgtgaatgtctgtatgccctttgtgccgccgtccggcggaaattcggcggacgatgcgagtatcatgggcggatgtcttataattttcagggtgctgttatcctgaaaatgaaaattccacgtgcagtgagggaaggagtagtcatgaaacaaaccgtttataccgccagcccggaaagccaacaaatccatgtctggagtcttgaagcggacggcaaactgacgctggtgcaggtggttgatgccccagggcaggtccagccgatggtggtcagccccaacaaggaatttctgtacgttggcgttcgtccggagtttcgcgtgctggcctatcgcatcacgccggataacggagcgttaacctttgcgggcgaagctgcgctgccgggcagcccgacccatatctctacggatcaccatggccgttttgtcttcagcgcctcctacaatcagggctgtgtcagcgtgaccccgctgcacgatggcctgccgggcgaaaccatcaccgtggtggaagggctggaaggctgccactcggccaatatctccccggataatcgcaccctgtgggtgccggcgctgaagcaggatcgcatttgcctgtttaccctcagcgacgatggtttcctctcggcacaggagcccgcggaagtgacgaccgtcgagggcgccggtccgcgtcacatggtattccatcccaaccagcagtatggttactgcgtcaatgagctaaacagctcgattgacgtctgggagctgaaagatcctaagggcaacatcgaatgtgtacagaccctggatatgatgccgcctgattttagcggcgtgcgctgggcggcggatattcatatcaccccggatggccgtcatctttacgcctgcgatcgtaccgccagcatcatcacggtgttcagcgtttcggaagatggtagcgtgctggcggtggaaggctatcagcctaccgagacccagccgcgcggctttaacctcgatcacagcggtaaatatctcattgccgccgggcagaagtcgcaccatatcgcggtgtacgatatcgtcggtgagcagggactgctgcaggagaaaggccgctatgcggttggccaggggccgatgtgggtggtggtcaacgcccactga

SEQ ID NO: 5940 - DNA, 492 bp, Klebsiella pneumoniae
tacgcgcatgatagatatcgatataggccaagtagtccatctgctgcagatgcaggtggctcgggtcatagagcatattgcagcgcggatggttatccaccagcgcaagaaaacgctcaaaggtcacgccatcgtgcaggtcttcgccggggtggatctcatagcagacatcgaccccctgctcgtcgaagaggtccagcagcggccgccagcgccgggccagctcggcaaaggcctcatccagaagcggctgattatgcggcggccacggataaaaaaagggccatgccagcgccccggaaaaggtcgcgtgcgcctgcagccccaggcggccggaggctaccgccgcctggcgcactttctccaccgcccagcgctggcgcgcctgcggatcgccatgcagcgccgccggggcaaaggcgtcgaacgccgcgtcatacgttggatgcaccgccaccagctgtccttcaaggtgagtggacagctcgctga

SEQ ID NO: 5941 - DNA, 1080 bp, Klebsiella pneumoniae
gcacaaaatgacaaacaggaaatcacgatgaatagcgcctgggttaaacatgccattagcgaaatcaacgctgactatcagcgttccgccgacacgcacctgatccgtctgccgctgcccgcttttccgggcatccacctgtatctgaaagatgaaagcacccaccccaccggcagcctgaagcatcgcctggcgcggtcgctgtttctctatggcttgtgcaacggctggatcaaagaaggcacgccaattatagagtcctcctcagggtcaaccgccgtttcggaggcctatttcgcccgcctgctggggctgccgtttatcgctgtgatgccctcctgcaccgccagacgcaaaatcgaacagatcgagttctacggcggacgctgccattttgtgcagagcgccggcgaaatctacgcggcttccgaaacgctggcccgcgagctgaacggccattatatggatcagtttaccttcgccgagcgggccaccgactggcgcggcaacaacaatatcgccgacagtattttccgccagatgagccatgagccgcacccgcagccgtcatggatcgtcatgagcgccggcaccggcggcacctcagcgaccattggccgctatattcgcagccagggctacgagacgcagctgatggtcgttgatccgcagaattcggtgttcctcgattactggcagacccgcgacgccagcctgcgcagcccggtcggcagcaaaattgaaggcatcggacggccgcgcgtcgagccgtcgtttattcccgacgttgtcgatgagatgctgcgcgtgccggatgcggcgagcgtagccaccgccctgtggctggaaacgcagcttgggcgcaaggtcggcgcctcgaccggcaccaatatgtggggcgtattgcagctggccgcgcggatgcgcaaagaaggtcgcaccggctcgatagtgacactcctgtgcgacagcggcgagcgttacctggaaagctattacaacccgcagtgggtggcggacaatatcggcgatattgcgccctggcaggcggagatcgccggtctggtcgaaaggcgataa

SEQ ID NO: 5942 - DNA, 1881 bp, Klebsiella pneumoniae
acaaaaaatgagtctctgatgagttttgatattgccaaatacccgaccctggcgctggtagattccacccaggagttgcgcctgttgccaaaagagagcctgccgaagctatgtgatgagctgcggcgctatctactggacagcgtcagccgttccagcggtcactttgcctctggcctcggcacggtggaactgaccgtggcgctgcactacgtgtataacacgccgttcgatcgcctgatctgggacgtcggccatcaggcctacccgcataaaattctgaccggtcgccgggacaaaatcggcaccattcgtcagaaaggcggcctgcatcccttcccgtggcgcggtgaaagcgagtatgacgtgctgagcgtcggtcactcctccacttccatttccgcgggtatcggggtggctatcgccgccgcgaaagaggataagcagcggcgcgcggtgtgcgtcattggcgacggggcgatcaccgccggcatggcgtttgaggcgatgaaccacgccggggatatcaaacccgacctgctggtggtgctgaatgacaatgaaatgtcgatttccgagaacgtcggcgcgctgaacaatcatctggcgcagctgctctccggtaagctctactccaccctgcgcgaagggggcaaaaaggtcttctccggggtgccgccgattaaagagctgcttaagcgtaccgaagagcatatcaaagggatggtggtgccgggcacgctgtttgaagagctgggctttaactacattggcccggtggatggccatgacgtgctcggtctggtcagcacgctgaagaacatgcgcgacctgaaaggcccgcagttcctgcatattatgaccaaaaaaggccgcggctatgagcccgccgagaaagacccgatcaccttccatgcggtgccaaaattcgaccataccagcggcgtactgcccaaaagcagcggcggcctcccttcctactcgaaaatcttcggcgactggctgtgtgaaacggcggccaaagacaacaagctgatggcgatcacgccggcgatgcgcgaaggttcagggatggtggagttttcgaagaaattccccgatcggtactttgacgtcgccattgccgagcagcatgcggtcaccttcgccgccgggctggcgattggcgactacaagccggtggtggcgatctactccaccttcctgcagcgagcctacgatcaggtgatccacgatgtggctatccagaagctgccggtgctgtttgctatcgaccgcgccgggatcgtcggcgcagacggccagacgcatcagggagcgttcgatctctccttcctgcgctgtattccggatatggtggtaatgaccccgagcgatgaaaatgaatgtcgccagatgctgtacaccggctaccactacagcgacggcccctgcgcggtgcgctatccgcgcggtagcggcaccggcgcgacgctcgagccgctggcatcgctgccgatcggcaaaggggtggtgaaacgtcagggcgagaaaatagcgatcctcaactttggcaccctgctgccggaagccgcggcggtagcggacaaactcaacgccaccctggtggatatgcgctttgtgaagccgctggataccgcgctgatcctccagctggccggcgagcacgactcgctggtgacgctggaagagaacgccatcatgggcggcgccggcagcggcgtgaacgaagtgctgatggcccaccgccgggcggtaccggtgctcaatattggcctgccggattattttattcctcagggcactcaggaagagatccgcgccgacctcggccttgatgccgccggtattgaagccaaaatccgcgactggctggcataa

SEQ ID NO: 5943 - DNA, 273 bp, Klebsiella pneumoniae
cagatgaatgaaatgaaaggagcacatatgcagcagaatggttacattccagatacagcgaacgcaattgcccagtatttcaacaaagcatctttgccttcccagcaggaaaccctgggtcagatcgtgatggatattcttaacgaagggcgtcatctcaaccgcaaagcgctatgcaccaaactgttgagccgcctggaccgcgctcgcgcgccggaggaagagagccactatcagaccttaattggtctgctgtttgctggccaggaataa

SEQ ID NO: 5944 - DNA, 807 bp, Klebsiella pneumoniae
cagaaggatgacagtatgccggaaggtccggagatccgccgtgcggcggataaactggaggcggcaatcaaaggcgaacccttaaccaacgtctggttcgcctttcctcagttgcaaccctatcaaactcagctaattggtcagcgggtgacccatatcgccacccgcggcaaggccctgttaacccacttctccggcggattgaccctgtatagccataaccagctgtacggcgtctggcgtgtggtggatgccggcgttgagccgcaatcgaaccgcgtactgcgcgtcaggctgcagaccgccagcaaggcgattttgctctacagcgcgtcggacattgatatcctcacggcggagcaggttgccaaccatccgttcttgctgcgcgtcggaccggacgtgctggacatgacgttaaccgcggagcaggtgaaagcgcggctgctgtcggccaaattccgcaatcgtcagttttccggcctgctgctggatcaggcttttcttgccgggctcggaaactatctgcgggtggaaattctctggcaggtgggattaagcggtaagcgtaaagccgctgaactgagcgacagtcagctggatgcgctggcgcacgcgctgctcgatatcccgcggctgtcctatcgtactcgcggtctggtggatgacaacaagcatcatggcgcgctgtttcgctttaaggtcttccatcgcgatggggaaaggtgcgaacgctgtgggggaatcattgagaagacgacgctctcctcgcggccattttactggtgtccaggatgccagcattaa

SEQ ID NO: 5945 - DNA, 741 bp, Klebsiella pneumoniae
aagaaggatgaaaatcctgtgattgaatttaaaaacgtctccaagcactttggtccgacccaggtgctacacgatatctctctgaaaattaatcagggtgaagtggtggtcattatcggcccttccggttccggtaaatcaacgatgctgcgctgcatcaataagctggaagagatcaccagcggcgatctgattgtcgatggtctgaaggtcaacgacccgaaggtggacgaacgtctgattcgtcaggaagccgggatggttttccagcagttttatctgttcccgcacctcacggcgctggaaaacgtgatgtttggcccgctgcgggtacgcggcgccagcaagcaggcggcagagaagcaggcgaaagagctgctggcgaaagtcggtctggctgagcgcgcgcatcactatccgtccgaactctccggcggccagcaacagcgtgtggccatcgcccgcgcgctggcggtgaagccgaagatgatgctgtttgatgaaccgacctccgcgctcgacccggagctgcgccatgaagtgctcaaggtgatgcaggacctggcggaagagggcatgacgatggtgattgtgacccacgaaatcggctttgccgaaaaagtggcctcgcgactaatctttatcgacaaaggacgaattgctgaagacggcaatccccaggagctggtgaagaacccgcccagcccgcgcctgcgtgaattcctgcaacacgtcgcctga

SEQ ID NO: 5946 - DNA, 531 bp, Klebsiella pneumoniae
cttctttgtgaagttcatcatgtggggcattctcaccgcgctggcctatcacgtcgttgtcggtattcgccatctgatgatggactttggctacctggacgaaaccctcgaagcagggaaacgttccgccaaaatttcttttgttattactgtcgtgctttcacttctcgcaggagtcctcgtatggtaagcaacgcctcagcactgggacgcaacggcgtacatgactttatcctggtccgtgctaccgccatcgttctgaccctctacatcatctacatggttggcttcttcgccaccaccggtgaaatctcatgggaagtgtggaccggattctttgcctccggcttcactaaggtcttcactctgctggctctcgtttccattctcatccatgcctggatcgggatgtggcaggtgttaacagactacgttaaaccactggctctgcgcctggttctgcaactggctatcgttgtggcgttggtggcttacgttctttatggatttgttgtggtgtggggtgtgtaa

SEQ ID NO: 5947 - DNA, 795 bp, Klebsiella pneumoniae
ccgctttgtgaagtaaaggaggcggcgatgctgcaaatctcgcatctttccgccgactacggcggtaaaccggcgctggcggatatcaacctgacgctggagagtggggagctgttggtggtgctggggccttcgggctgcggtaaaactaccctgctgaacctgattgccggattcgtgccctatcagcacggcagcatcaccctcgaaggtcagcgggtgaccgggccgggcgcagagcgcggggtggtcttccagaatgaaggtctgctgccgtggcgcaatgtgcaggataacgtggcgctgggcctccagctggcgggcgtggataaagcgcagcgccggcaagcggcggcgcagatgctgaagaaggtggggctcgaaggggcggaaaagcgctttatctggcaactgtccggcggtcaacgccagcgggtgggcatcgcccgggcgctggcggcgaatccgcagctgttgctgctggacgagcccttcggcgcgcttgacgcctttacccgcgagcagatgcagacgctgctgctgaaactgtggcatgagaccggcaaacaggtgctgctgatcacccatgatattgaagaggccatcttcatggcgaccgagctggtgctgctgtcgccggggccgggacgggtggtggagaggctgcgacttgatttcagccgtcgctttgtcgcgggcgaatcctgccgcagcatcaaatccgacccgcgctttattgaacagcgggaatacattctgagccgggtgtttgaccaacgggaggctttctcatga

SEQ ID NO: 5948 - DNA, 411 bp, Klebsiella pneumoniae
cgctatcgtgaccttgctgtctacacacaaggagatatcagcatgaaatatggaataaaagcactgatggccgcgggcgttctggtttttgcggtaagggtacagggggcgctggcagcacccgccagcggcaaagcggcggtgaataaagaaaatgtgcaggcgtcctcttcggcgaaggcggaagcggtgcccggcgagtctgacaacggggcgacaaaggtcagcattaaccgcgccagcgccgaacagctggcgcaggcgttaaatggcgtaggattgaaaaaagcccaggctattgtcagctaccgcgaagagtacgggccgttcaaaaccctcgatgatctgaagcaggtcccgggaatggggagcgcgttggtggagcgcaatttagcccatctgacgctgtaa

SEQ ID NO: 5949 - DNA, 411 bp, Klebsiella pneumoniae
cgcggtggtgaagaaggagctttctctatgaccccttcgatgtatatgcgcctcaaagacctgtttgtggctgaggggcttaccgcggggtttaaggtccagtggaggcaatggcgcgataccgggaaagacacggaccagttcatcgtgttcaggccttccggcggcaccgacatcacctttgaccttggcggcgactggtatgtgatggttgatgtgatctcctcgaaggcgaatcctgacgctgcagacgccgtggtaaacgccattgtcgaatatatcagcgcgcaatccggcgccgatgattgcgtaggcgctctgcggcttgtcggtaatgtcccggcgccgatcgccaccgaagagggccgtttagtaaccaggctgctcgtctcctgcacatacggggagtaa

SEQ ID NO: 5950 - DNA, 744 bp, Klebsiella pneumoniae
tgcatattcgacagtgtgacagaggaatgtaacatgcaatctgaagaacaacgccttattgatggactgttttcccggctgaaagaggctgaggcgcacagcgcatcgcgcgatgccagcgccgaggagcggattgcccaacacgtgagcgcgcagccggcggccccctactatatggcgcaaaccattcttatccaggaagccgcgattaaacagcttaacgatcgcatccaggcgctggagagtcaggtcagccaactgcaggcggcaaagcccagcagcggcggcttcctctccggcctgtttggcggtggcggctcgtcacgcggttctgaccctatcccgggcgcggagcaatatggtcgcccgcagaccagcgctcagccgcagtatacgccaccaccgcagcagaactatgccccgcaggctgccgcacgcggcggcggctttatggcgggcgcgctgcaaacggccgctggcgtggcaggcggcgtggtgctgggcaatatgctgaccaatatgttcagcggctcgcacccgcaggagatagtcaatatcatcgaagagaagccgcagcctgatgccgcctccgcgcaggacagcatcgcgcaggacaccaccgcaggtgacgatccgttccgccagggagacgatcagttccttgccgacaatacctggaacgacgacttcgacgccggctttggcgacgatgattttggcagcgatgacgatagctgggtttaa

SEQ ID NO: 5951 - DNA, 1182 bp, Klebsiella pneumoniae
cgtttactcgagaataattctcagaatcattatatttataaattggcaaacggaactcattttatggcaagaaaatcagtaagatcgctgttacttactgcgctgctcgcgacgcccctcctcagctatgcaacccaatatcccctgacggtcacggaccttgacggccggcaggtcaccctcgccaaagagccgcagcgtattattttgcaggatggtcgcgacattatgaccctcgccctgctggatcgggacaatccgtttaaacggctggtggcatggaataatctggcgaaaaagcaggatgttgccacctggcagatgctgaaaacgacgtggccccagtcggccacgatccttgacatgggcttcagcgataaagggaacgtcgatcttgaaagcgtcatcgcccgtcagccggatctgatgatcgcccagctgcgcgccaggccagcgctgatggagagcggcgtcatcgacaagctcagcgccctgcacgttccggtgctgtttgtcgactatgagatcgccccggcgaaagataccgcccccagcatcgacctgctgggcaaagtccttaaccgcgagagccaggccaaagcctttaccgattactatcgtcagcagctgcagacgattcgccagaaaaccgcggccatcacgccgaaggccaacgtcttcgtggaagcgctggccggcaacagcgacgcctgctgctttacccacggccacagcggctggggcgggctggtggaggcggtcggggcgaacaatatcggttcgcagctgctgccgggcgcctccgggttcgtttcgctggagaaaatcatcagcatgaagcccgacgcctggatcatgaccggctcgaagcgcggcaacagccaggtgttgcccctgggttatgcggttaagccagaggcggtgaaggcccaggcgcagacgctgctggcgcggcctggggtcagccagatcccggcggtacaggaaaagcgggcctatggcgtttatcaccacttctataaccacccgtggaatattgtcggcatggaatacctggcgaaagatatctacccgcaggccttcggcgatctcaacccggatgagacgtaccattatatcgtgcgccatttcaccgacctgccggaccagccgttcgtcttctcctggcagcagagcgagtaa

SEQ ID NO: 5952 - DNA, 807 bp, Klebsiella pneumoniae
aacctcatcgatgacgcgtatagtttcgtctttgttaatgattctggacccaccatgaccattcaaaacataatttgtgatattgacggcgtactgatgcacgataacgtcgccgttcccggcgcagccgagtttatcaagcgcatcctcgataaaggcatgccgctggtaatgctgaccaactacccgtcgcaaaccggccaggatctggcgaaccgtttcgccaccgctggaattgatgttccggatagcgccttttacacctcagcgatggccaccgccgattttctgcgtcgccaggaaggcaaaaaagcctacgtggtgggagaaggggcgctgatccacgagctgtacaaagccggctttaccattaccgatgtgaacccggattttgtcatcgtcggagaaactcgctcctttaactgggaaatgatgcataaggccgccttcttcgtcgccaacggcgcccgcttcattgccactaacccggatacgcacggtcgcggcttctaccctgcctgcggcgcgctgtgcgccgggatcgagaagatctccggccgtaagccgttttacgtcggcaaacccagcccgtggatcatccgttcagcactgaataaaatgcaggctcactccgagcagacggtgatcgtcggcgataacctgcgcaccgatatactggccggtttccaggcggggctggagactattctggtgctctccggcgtctccaccctcgacgatatcgacagcatgccgttccgcccgtcgtggatttacccttccgtcgcggaaatcgatattttctga

SEQ ID NO: 5953 - DNA, 750 bp, Klebsiella pneumoniae
caacctgccgaccgaggcgatcaccagcccggaacagtttcacaaactcgccggactgtaatattccgcggcgggcgaccgccgcctgttgttgagaaggagggcctcatggatgcaatttcctggcagttattaatcgaaggcgcatggacgaccctctggatttcggccatcgctatcgccttcggggtggtggctggcctgctgatcgccctggtacggatgctgcgcctgccggtgatcgaccagctgctggtggtctatatcagtctggcccgcgcgacgccgctggtgacgctggtgctatttctgttcctttccctgcccacgatgggcattaacctcgacaagaacgtggccgccatcgtggcgctgacgcttaacacgtcggcgtttaacgctgagatctggcgcaatgccttccgcacctttccgcgcgaacagcgggaggcggcggagtcggtagggatgcgccgctggacctacttccgctacatcatgctgccgcagatgtggatcgagagcctgccggcgctggtcaatgagatgtcctttttgatcaaaggtagcccggcgatcgccgtgattggcgtggtggatctcacccgggtcaccaaccgtatatcctcggtcacctacgagccgctgtcgccgatcctcgccgccggcctgctgtatgtggcgatcatcggctgtttgttgaagctgcagggtatcgcggaacgtaaagccaggcgtctggcgcgctag

SEQ ID NO: 5954 - DNA, 1068 bp, Klebsiella pneumoniae
gaagtgtacgaccttttggagaggaaaatggctcaccaacctcgctggacaatgtcgcaagtaacggaattatttaataaaccgctgatcgatctgctattcgaagcacagcaaatccatcgtcaacactttgatccgcgccaggtgcaggtcagcaccctgctgtcgatcaaaaccggcgcctgcccggaagattgtaaatattgcccgcagagcgcacgctacaaaaccggcctcgaagccgagcgcctgatggaggttgagcaggtgctggaatcagcgcgccaggcgaaaaacgccggctccacccgcttctgtatgggcgcggcgtggaaaaaccccaatgaccgcgatatgccttatctggagcagatggtgagaggggtgaaggatctggggctggagtcctgtatgacgctcggcaccctgaccgacagtcaggcgcagcgcctggccgaagcgggcctcgattactacaaccacaaccttgatacctcgccggaattttacggcaacatcatcaccacccgcacctaccaggagcgcctggatacgctggataaagtgcgtgatgctgggatcaaagtctgctccggcggcatcgtcgggctgggagagagcgtaaaagatcgcgccggactgctgctgcaactggctaacctgccgacgccgccggaaagcgtaccgatcaacatgttggtgaaggtcaagggcacgccgctggcggataacgacgacgtcgacgctttcgatttcatccgcactatcgccatcgcgcgcatcatgatgcccacctcctacgtgcgtctctccgccggccgcgagcagatgaacgagcagacccaggcgatgtgctttatggccggggcgaactcgattttctacggctgcaagctgctgaccacgccgaacccggaagaggacaaagacctgcagctgttccgcaagctggggatcaacccgcagcagacggcggtgctggaaggcgacaatgagcagcagcagcgtctggagcaggccttactcaccccggacactgaggaatattacaacgcggcggcgctatga

SEQ ID NO: 5955 - DNA, 819 bp, Klebsiella pneumoniae
aagtggcacgattttttcattaggctagtcgttctcgcaggggatcgtcccgtggatataaaaggaaatgctatgaagtctgtatttaaagtttcactggctgcactgaccctggcttttgcggtttcttcccatgccgctaataagaccctggttgtcgccaccgatacggcgttcgtcccgttcgaatttaagcaaggcgataagtatgtgggttttgacgttgacctgtgggcggctatcgccaaagagctgaagctcgactacaccctgaagccaatggacttcagcggcattatcccggcgctgcaaaccaaaaatatcgatctggcgctggcggggatcaccattaccgacgagcgtaaaaaagcgatcgacttctccgacggctactacaaaagcggcctgctggtgatggtcaacgccaataataacgacatcaaagatgtcaaagatctgaacggtaaagtggtcgcggtgaagagcggcaccggctccgttgactacgcgaaagccaatatcaaaaccaaagatctgcgtcagttcccgaacatcgataacgcctatatggagctgggaaccggtcgcgcggatgccgtgctgcacgatacgccgaatattctgtacttcatcaaaaccgcgggcaacggtaagttcaaagcggtaggcgaatcactggaagcgcaaaactacggtatcgccttcccgaaaggcagcgacgagctgcgtgagaaagtgaacggtgcgctgaaaacgctgcgcgacaatggtacctataacgaaatttataaaaaatggttcggcactgaacccaaataa

SEQ ID NO: 5956 - DNA, 2688 bp, Klebsiella pneumoniae
atgagtgacgagccgctgcgcccggaccctgaccgcctgctgcagcacaccgccgccccgcatcgcggcaaactgaaagtgttctttggcgcctgcgccggggtggggaaaacctgggcgatgctggcggaagcgcagcggctgcgcgcccaggggctggatattctgattggcgtggcggagacccacggccgtaaagagaccgccgcgatgctgcagggcctgagcactctgccgccgcggcggcttgcccatcgcgggcggtacgtctatgagttcgatctcgacgccgccctcgcccgccgtccggcgttgattctggtggatgagctggcgcacagcaatgcgccaggctcccgccatccaaagcgctggcaggatgtggatgaactgctggaggccgggatagatgttttcactaccgttaacgtccagcatctggaaagcctgaatgacgtcgtcagcgggatcaccggcgtgcaggtgcgggagacggttcccgatcccttctttgacgccgcggacgacgtggtgctggtggacctcccccctgacgatctgcgccagcggctcaatgagggcaaagtctacatcggcggccaggccgagcgcgctatcgaaaactttttccgcaagggcaatctgattgcgctgcgcgagttggccctgcgccgcaccgccgaccgcgtcgatgagcagatgcgcgcctggcgcgaccgccagggccaggagaaagtctggcacacccgcgatgcgatcctgctctgtatcgggcacaacaccggcagcgaaaagctggtgcgcgccgccgcccggctcgccgcccgcctgggcagcgtctggcatgcggtgtatgtcgagaccccttccctgcaccggctgccggaaggccggcggcgggctattctcgccgcgctgcgtctggcccaggagctgggggccgaaaccgccaccctctccgacccgtcggaagagaaagcggtcctccattacgcccgcgaacataacctcggcaaaatcgtcattggccgccaaagcaagcgccgctggtgggatcgcagcggcttcgccgatcgtctggctcgccatgcgccggacctcgatctggtggtgatcgccctcgatgagaaacccttcccccttgccgcacgcgccagcgacagccgtccggcgctggagaaatggcgcctgcagctgcagggctgcgcggtggcggtggcgctatgcgccatcattaccctggtggccatgcagtggttgatggctttcgaagccgccaacctggtgatgctctatctgctgggggtggtgctcatcgccctggtctatggccgctggccatcggtgctggcgacggtgatcaacgtcatcagcttcgatctcttttttgtcgccccgcgcgggacgctggcggtgtcggatgtccagtatctgctcaccttcggcgtgatgctcaccgtgggcctgcttatcggcaacctcaccgccggcgtgcgctaccaggcgcgggtggcgcgctaccgtgaacgccgtacccgccatctgtatgagatgtctaaagcgctggcggtgggtcgtagccagcaggatatcgccaccaccagcgagcggtttatcgcctccacctttcaggcccgcagccagctgctgctcccggacgcccagggaaaactgctgcccttaacccaccagccagggctgaccccgtgggatgatgccatcgcccgctggagctttgataagggccaacctgccggcgccggcaccgataccctgcccggcgtgccgtatcagatcttgcccctgaagagcgccgcccgcacctggggactactggtggtggaaccggagaatctgcgccaattgatgatcccggagcagcagcggctgctggagacctttaccctgctggtggccagcgctctggagcgcctcaccctgaccgccagcgaagagcaggcccggctgaccagcgagcgggaaagcctgcgtaactcgctgctcgccgccctgtcgcacgatctgcgtactccgctgaccgtgctgtttggccaggcggaaattctgaccctcgatctggccagcgaaggttcaaaacatgccccgcaggccaacgaaatccgccagcatgtgctcaacaccacccggctggtgaacaacctgttggatatggcgcggatccagtccggcggctttaatctgcataaggagtggctgacgctggaggaagtggtcggcagcgcgctgcgcatgctcgagccaagcctcggcggccagcatattcagctggatttacccgatcccctccagctggtgcatgtcgacgggccgctgttcgagcgggtgctgatcaacctgctggaaaatgcccataagtatgccggcgcccgggcgagcatcggcatccgcgccgaggcggacgcccggcagctgtcgctggaggtatgggataacggtcctgggatcccggcaggccaggaacagactatctttgataaattcgcccgcggcaacaaagagtcggcgatccctggcgtcgggctgggccttgccatctgtcaggccatcgtcgacgtccacggcgggaccatctccgccagcaaccggcccgagggcggcgcctcattccgtgttacactgccgggagaaacgccccctgaactggaagagctacctgaggaattgtga

SEQ ID NO: 5957 - DNA, 351 bp, Klebsiella pneumoniae
cggtcccgcgatgttgacccagctgaaccgcgagtttcccaccgtcagtctgctggatatcggcgccatcctgcgtcaggtcggccaggtgctctcccaggtcagccgggcgctggaggtgatggtaggcctggtgacggcctgcggcgtgctgctgttgctggcgcaggtgcaggtcggtatgcgtcaacgccatcaggagctggtggtctggcgcacgctgggggcaggaaaatcgctgctgcgcgctacgctgtgggcggagtttgccctgctggggctggtttccggcctggtggcggcgataggcgcggaagtggcgctggcgatgctgcagacgaaagtctttga

SEQ ID NO: 5958 - DNA, 774 bp, Klebsiella pneumoniae
cctcagcgcctcgctgttggtcagctggttgaagaaaaggactgtgtaatgattaccctgaaaaacgtttcaaaatggtatggtcactttcaggtgctgaccgattgctccacggaagtgaaaaaaggcgaagtcgtggtggtctgcgggccgtcaggctccggtaaatccacgctgattaagactgtgaacggccttgagccggtacagcaggggcagattatcgtcgatggcaccgtggttaacgataaaaagaccaacctggctaaactgcgctcgcacgtcggcatggtgtttcagcattttgaactgttcccgcatctgtcaattatcgacaacctgacgctggcgcaggtcaaagtgcttaaccgcgataaagcctcagcgcgcaagaaaggcctcaagttgctggagcgcgttggcctggcggcgcacgcggaaaaatacccggcgcagctctccggcggccagcagcagcgcgtggccattgcccgagccctgtgtatggacccgatcgccatgctgtttgatgagcccacctcagcgcttgacccggagatgattaacgaggtgctggacgttatggtcgaactggctaacgaagggatgaccatgatggtcgtgacccatgagatgggctttgcccgcaaggtggcgaaccgggtgatctttatggatgaagggaagattgtcgaggatgccgataaagaggccttctttgccaatccgcaatccgagcgtgccaaagatttcctcgccaaaatactccattaa

SEQ ID NO: 5959 - DNA, 273 bp, Klebsiella pneumoniae
cagtgcggcgatgaagcgggtactggctgtttacgggagggcgcaggcatgaaatttatcaaattaagccaaaggggaacggtagagcgccagggcaaatatggctgggagcctgaaacagtctacgagcctgtatttgttgccgcaggtcacatcgtcagcatgtttttcgctggcgtgacaattctgaaaatgacctccggagaacgcattgacgtgaaagagaccccggaagaaatcatcgccatgcttaccgaaggagcctccaaatga

SEQ ID NO: 5960 - DNA, 1104 bp, Klebsiella pneumoniae
cactctagcctcttcgcctgtgtcaaaagatatggcgatttggccgcgacgccgccggttgtcgccagggcgtggaaagaaatgaccgcgtctcccgtatttggaaaggtgtatatggcctcacagcttaccgatgcattcgcgcgtaagttttattacctgcgtctgtcgattaccgatgtgtgcaacttccgttgcacctactgcctgccgaacggttacaaacccggcgccgtcaataacaatggctttctcagcgtagacgaagtacgccgggttacgcgcgctttctccgcgctgggcaccgaaaaagttcgcctcaccggtggggaaccctccctgcgccgcgacttcaccgagattattgccgccgtgcgtgaaaacccggcgatccgtcagattgcggtcactaccaacggttaccgcctggcgcgcgatgtcgaacgctggcgcgatgccggcctgacggcgattaacgtcagcgttgatagcctcgacgcccgccagttccatgccatcaccggccaggataagttccaccaggtgatggacggcattgacgccgccttcgccgccggctttgacaaggtgaaggtgaataccgtgctgatgcgtgatgttaaccatcaccagctcgataccttcctcgcctggatccaaccccgtcgtatccagctgcgctttattgagctgatggaaaccggtgaaggcagcgacctgttccgccgtcaccatctctccggcatggtgctgcgcgatgaactgctgcgccgcggctggatccatcagatccgccagcgcagcgatggcccggcgcaggtcttttgtcacccggactacgccggcgagatcggtctcatcatgccgtatgaaaaagacttctgcgccacctgcaatcggctgcgcgtctcgtccgttggcaaactgcacctgtgcctgtttggcgaaggcggcgtcgacctgcgcgacctgatggccgaagaccagcagcaggccgcgcttgaggcgcggatcgccgaagccttaacccataaaaagcagacccatttcctgcatcagggcaacaccggtattacgcagaacctgtcctatattggcggttaa

SEQ ID NO: 5961 - DNA, 1542 bp, Klebsiella pneumoniae
caagtaatagacgcacaccagggaagtggcttgccacttccctttttcacgctgcaaggagaacacatgaaaacaccctcacagccgcgcgcgatttactacatcgttgcgatccagatctgggagtacttcagcttttacggcatgcgcgccttactcatcctttaccttacccaccagcttggcttcgacgacagccacgccatcagcctgttcagcgcttacgcatctctggtttacgttacccctattctcggcggctggcttgccgaccgcctgctcggcaaccgcacggcggtaattgccggggcgctgttgatgaccctcggccatgtggtgctgggcgttgagtcgacctccgcctggagtttgtacgtcgcgctggcgatcatcatctgcggctacggcctgtttaaatccaatatcagctgcctgctcggcgaactgtacgctcacgacgacccgcgtcgcgacggcggtttctcgctgctgtacgccgccggcaacgtcggctcgattgctgcgcccatcgcctgcggactggcggcgcagtggtacggctggcatatcggcttcgcccttgcggggatcggtatgtttatcggcctgatgattttcttaagcggcagccgccacttccggcatacccgcggcgtcgataaaccggcgctgcgggcggtgaagttcgtgctgccgacctggggctggctgctggtgatgctctgcctggcgccggtatttttcacgctgctgctgcaaaacaactggtccggctatctgctggcgatcgtctgcctgttcgccgcccagatggtggcgcggatcatgatcaaagccccggagcatcgacgcgcgctgtggcagatcgtcctgctgatgctcgccggaacgctgttctgggtgctggcgcagcagggcgggagctcgattagcctgtttatcgaccacttcgtcaatcgtcgtctgctgaactgggacgtgccgaccgcgctgttccagtcagttaacgcgatagcggtgatggcggccggcgtggtgctggcgtggctgatgcgcccggaaggcagcgtgcgttctgtgctgcgcgtctggctgaaattttctttcggcctgctgctgatgggcggcggctttatgctgctggcgctcaatgcccgccatggcgcggctgacggtcaggcctcgatgggcatgatggtcgccgggctggcgatgatgggctttgccgaactgtttatcgacccggtggcgatggcgcaaatcacccgtctgaacatgcccggcgtcaccggggtgttgaccgggatctatatgctggccaccggcgcggtggccaactggctggcgggcgtggtcgcccagcaaaccaccgaatcgcaaatcagcgatacggcgattgccgcctatcagcatttcttcgcgcagatgggcgaatggaccctcggctgcgtggcggtgatggtcattatcgcctttgccgcggcctgtagcgttggcaaacgtcgtgcggctgcgggtgaaattaccggcggcggcgcctga

SEQ ID NO: 5962 - DNA, 1635 bp, Klebsiella pneumoniae
  unsure (1556): Identity of nucleotide at the above locations are unknown.
cgcccttcagaattaccccatctaataaaaacggcctataaatacgaattcctcaataaagccgttcaaaagatactcttttttcactgttcaacaatcacggttgcgttttttctttttccggccgcaaaacccttgcgcctgctccccctttacggcattttcttaagcacgcactcaggcttcgccacgagacgaagccagcacaacatcaaacacgacagggtaatggagaaggctatgtgttctatttttggcgtactggatattaaaactgacgcaggcgagctgcgtaaaaaggcgttggagctttcccgcctgatgcgccaccgcggtccggactggtctggcgtatatgccagcgacaaagcgattctggcgcacgagcgcctgtcgattgtcgacgtcaacgccggggcccagccgctgtacaacgccgaaaaaacccatgcgctggccgttaacggcgagatctacaaccaccaggcgctgcgcgcggagtatggcgatcgctaccagttccagaccggttccgactgcgaagtgatcctcgcgctgtatcaggaaaaaggcccggagttcctcgacgacctgcagggaatgttcgccttcgccctgtacgacagcgaaaaagacgcgtacttaattggccgcgaccatatcggcattatcccgctgtatatgggccatgacgaacacggcaacttctatgtcgcctccgaaatgaaagcgctggtgccggtatgccgcaccattaaagagttcccagcgggcagctacctgtggagcaaagacggcgaaattcgccagtactatcagcgcgactggtttgattacgacgcggtgaaagacaacgttaccgataagaacgagctgcgccaggcgctggaagagtcggtgaaaagccacctgatgtccgacgtgccttacggcgtgctgctctccggcggtcttgattcatcggtcatctcggctatcaccaagaaattcgccgcccgtcgcgtcgaagatcaggagcgtagcgaagcctggtggccacagctgcactctttcgcggtcggtctggaaggctctcctgacctgaaagcggcgcaggaggtggccaaccacctcggcaccgtgcaccacgaaattcactttaccgtccaggaagggctggatgccatccgcgacgttatctatcacatcgaaacctacgatgtgaccactattcgcgcctcgacgccgatgtacctgatgtcgcggaaaattaaagccatgggcatcaaaatggtgctttccggcgaaggttcggacgaagtgttcggcggctacctctacttccataaggcgccgaacgccaaagaactgcacgaagagacggtgcgtaagctgcaggcgctgcatatgtttgactgcgcccgcgccaacaaagcgatgtccgcctggggcgtggaggcccgcgtgccgttcctcgacaagaattcctcgacgtcgcgatgcgcattaacccgcaggataagatgtgcggcaacggcaaaatggaaaaacacattctgcgcgaatgctttgaatcntacctgccggccagcgtcgcctggcgccagaaggagcagttctctgacggcgtcggctacagctggatcgataccttga

SEQ ID NO: 5963 - DNA, 213 bp, Klebsiella pneumoniae
aataatggccttattgttcaggtgaccctcggactggagaatactgttgatggcgagcgacatgacggcggactcatcaaccagtttatcaccggcgttacggaaatagtcggagagcgcggtgtcctgcagtcttgcgtaaatatctggttgctgatgcatagtctgtctcatcacattctcactctgtttaattcaccatggttgggataa

SEQ ID NO: 5964 - DNA, 759 bp, Klebsiella pneumoniae
gccgtaccagacactagattctttatcaggaataaccttatttcagcgagccgtcatggggccagattgaccgttgcaggagaactgttactacaacgggcttctgaagtactggcatcctatgataatttccggactgatgtgtccagcattcagcaaggactagtgggtaaactgacggtaggcttcggtatttcatctttccgcgtggcccctgaaaaggttgctattttccgtgctctgtatccagacgtgcaagtgtccctgaatgatatgtcctcggcagtacagttccagaaactcgcagaagggcaacttcagacggggtttgttcggcttcctgcacctgaacgactggagagtaaaattctggcagaagaaaagctagttcttgccgtagcccacgagcatgatactgagttatctagtgcggcagagctgctaggttcgaggaagctcctgcaattatccagggacagaggggagggtctgtcggaacagatattgcgttttctttcacttcgtcaactcactccgcagacagtctttccagcagatgacattcagactcttctggctcttgttgccaccaaaaatggtgtggccttattgcctgcgggagttttccatattcttccttgtggcgtcaggcttatacctcttgagggagaacatacaacctggcagacaggaattgcctggaacccgcaaataaaagaccctgtaagagataattttataaatatagtgacaccataa

SEQ ID NO: 5965 - DNA, 516 bp, Klebsiella pneumoniae
gtgattacagagtcatctacacctttggggatccgccgggcgatacctgctacgtcgtggcggttaaacgccgaaccaccaccacctaccttcatgaggaagataccgaatatgactattcagtacatcaaggatgaagaaggaaaagaccagtatgtcgtcattccttacagcgattactttcgtatgcgcctggctctgctggagtacgacgacgaggatgaaagcgactgggaagatattccttatgaatcagatatctatgatgacgtcatgctgccgggcgaagtatgcgacgtgatgcataaagaaaacgtcagcctgcaggccgcgtggcgcatcctgcgcgggatgtcccagcaggaggtagccgaaaagcttggcatcagccagtccgcggtgtcacagctggaagcgctggactcccgtccgcaaaagcgcacccgcgagaagctggcggcgatttacggctgtactcaggagcagatcagcctctatctgccgaaagagggttaa

SEQ ID NO: 5966 - DNA, 543 bp, Klebsiella pneumoniae
tcattcacagaaaatatgtcagagtttgcattaatcattctctacgctcactataaagaggcttgttatgaggacggaataagtccaggaggaaacatgtttaaagctcttaccgctatcgtcgccttagccgcctccgccagcgttatggcgcaaagcgatgtcacgctgaacagtctggctcacgatgccgccacccgggcgtcgtttaaccagatggtcaaaggccatcagctgcccgcctgggtgaccaccggcggcaccggttcgcccgcgcagacggtgaaactgggtagcgaatcctggcaggtgttaagcgcctgcaaaccccacgactgcggccatgaacgtatcgcggtgatctggtcggaaaaaagcaaacagatgtccggcgtttactcggtggtcgatgaaaaaaccgaccaggagaagctgacctggcttaacgtcagcgatgccctgtccatcgatggcaaaaccgtgctgtttgccgccctcagcggcagcctcgacaaccacccggacgcctttaactaccagtaa

SEQ ID NO: 5967 - DNA, 969 bp, Klebsiella pneumoniae
acccccacagagagacgaaatatcttgaaacggttcggcacttcttttaacgccttcaggctcaatttaaacagtggcattactatgaaaaaaacattactggcagcgggtgcggttgtggcgctctccactacttttgccgcgggcgcggcagaaaacgacaaaccgcagtatctgtctgactggtggcaccagagtgttaacgtggtgggcagctaccacacccgttttggaccgcagatccgtaacgatacctacctggaatacgaagcgttcgccaaaaaagactggtttgatttctacggctatattgatgccccggtattcttcggcggcaacagcacggcaaaaggtatctggaacaaaggttccccgctgtttatggagatcgaaccgcgtttctctatcgataagctgaccaataccgacctgagcttcgggccgttcaaagaatggtatttcgccaacaactatatctacgatatgggccgcaacgactcccaggagcagagcacctggtatatgggtctgggtaccgatatcgataccggcctgccaatgagcctgtcgctgaacgtctacgccaagtaccagtggcagaactacggcgcctccaacgaaaacgaatgggacggctatcgcttcaaagtgaaatactttgtgccgctgaccgacctgtggggcggttcgctgagctacatcggcttcaccaacttcgactggggttctgacctcggcgatgacaacttctacgatctgaacgggaagcacgcgcgcaccagcaactctatcgcctccagccacatcctggcgctgaactacgcgcactggcactactctatcgtcgcccgttacttccataacggcggccagtgggctgatgatgcgaagctgaacttcggcgatggtccgttcagcgttcgctcgaccggctggggtggttacttcgtggtcggctacaacttctga

SEQ ID NO: 5968 - DNA, 213 bp, Klebsiella pneumoniae
tatggacaagaacaccaccacctgacatttttccttcatggcaggacaacaaaaaccctatatcgccgtcattgcctgaaaacgacgacaacgctgaaatgctcgcaaaaaccctatcatttccaggcttatctgacgcagccattactgctaccgggatggctgcggcagctggtattgtcatcttcagaacacttctacgagataccatga

SEQ ID NO: 5969 - DNA, 1425 bp, Klebsiella pneumoniae
aacgtcaaagaggatatgcacatgcgtacgtttagtggcaaacgtagtacgctggcgctggctattgccgccgtcaccgcgatgtcgggctgggttgtggctccacaggccagcgcagcaggctttatcgatgattcaaccttaaccggcggtatctattactggcagcgtgagcgtgaccgtaaagatgtgaccgacggcgacaaatacaaaaccaacctttcccactctacctggaacgccaacctggacttccagtccggctatgccgccgatatgtttggccttgatattgccgcgtttaccgcgattgaaatggcggagaacggcgatagcggtcacccgaacgaaattgccttctcgtcacgtaacaaagcctatgacgaagactattccggcgataagagcggcatcagcctgtataaagccgcagcgaaattcaaatatggtccggcgtgggcacgtgcgggctatatccagccaaccggccagactctgctggccccgcactggagttttatgccaggtacctatcagggggcggaggccggggctaacttcgactatggcacggcgggcgcgttaagtttctcctatatgtggacgaacgagtataaagcgccatggcatatcgagatggacgatttctatcagaacgataagaagaccaaagtcgattatctccactccgtcggcgctaaatatgatttcaaaaatgacctggtgctggaggcggcatttggtcaggctcagggctatatcgatcagtactttgctaaagccagctacaagtttgacgtcgccggcgcgccgctgagcaccagctaccagttctacggcacccgcgataaggtcagcaacggcggggtcaacgacatctatgatggcaccgcatggctgcaggcgttaacctttggttataaggtggcggatgtcctggatctgcgtctcgagggaacctgggtgaaggctgatggccagcagggctacttcctgcagcgtatgaccccgacctacgcctcttccaatggtcgtctcgatatctggtgggataaccgctccgactttaacgccaacggcgaaaaagcggtcttctttggcgcgatgtatgacatgaaaaactgggatatgccgggctgggcgttcggcgcgtcttatgtctacgcctgggatgcgaagccgggaagaatgtcctctccggatgcgtactatgaccctgactatcgcctgaaagagtcggcctatagcctggatgcaatgtataccgtacaggaagggcgggcgaagggcaccctgttcaaactgcactttacccaatacgacaaccattccgatattccgagctggagcggcggctacggcaacatcttccaggatgagcgcgacgtgaagttcatggttatcgccccgttcactattttctga

SEQ ID NO: 5970 - DNA, 282 bp, Klebsiella pneumoniae
cgtaatgaagaggtcagcatgaaagcccatatccatcctccctatcgtacggtggtgtttcacgacaccagcgcgaatgagtattttaaagtcggctcaactatccgcaccgatcgcgtgattgaactcgatggcgaaacttttccgtatgtgacgatcgacgtctcctcgaaatcgcatccgtactacacgggcaaacaaaaaaccttcgccaatgaaggcagtgcagcccgattccgccagcgcttcggcggctttattgatgcgaaaaggaaagcatga

SEQ ID NO: 5971 - DNA, 1251 bp, Klebsiella pneumoniae
aacctcgaagatcctgctgatctacctggcgattttcgcgccggtagccatgtcggcgctggcaggggtaaaaagcgcgcagcaggtgcggattcgcgccgcccgttcgctgggcgccagccgggcgcaggtgctgtggctggtgatcctgcccggcgcgctgccggagatcctcaccgggctgcgcattggtctcggggtgggctggtcaacgctggtggccgcagagctgatcgccgccacccgcggattaggatttatggtgcagtctgccggcgagtttctcgccaccgatgtggtgctggcggggatcgcggtgattgccattatcgcctttttactggaactgggtctgcgcgcgctgcagcggcgcctgacgccctggcatggagaagtacaatgagtgaacgtctgagcattaccccgctggggccgtatattggcgcgcaggtgagcggggcagatttaacccgtccgttgagcgacaaccagtttgaacagctgtatcacgcggtgctgcgtcatcaggtggtattcctgcgcgagcagaatatcaccccggcgcaacagcgcgacctggcgctgcgttttggcgacctgcatatccatccggtctaccctcacgccccaggggtggaggagattatcgtcctcgatacccacaacgataatccgccggataatgacaactggcataccgatgtcacctttatcgacacgccgcccgccggcgccattctggcggcgaaagagctgccgacgaccggcggggacaccctgtggaccagcggcatcgccgcctgggaagcgctgtcagaacccttccggcagctgctgagcggcctgcatgccgaacacgatttccgcaaatcgttccaggagtataagtacaacaagaccgaagcagagcatcggcgctggcaggaagcggtggcgaagcatccgccgctactgcatccggtggtacgtacccacccggtgaccggcaagcaggcgctgttcgttaatgaagggtttaccacgcgaattgtcgaggtgagtgagaaagagagcgcagcgctgctgaacttcctgtttgctcatgtcactaaaccggagtttcaggtgcgctggcgctggcagccgaacgatgtcgctatctgggataaccgggtgacgcagcattacgccaacgccgactatctgccgcaacggcggatcatgcaccgggcgacgatcctcggcgataagccgtattaccgggcggggtaa

SEQ ID NO: 5972 - DNA, 456 bp, Klebsiella pneumoniae
ggccgacgagatacggcaaatcgtccagttcgccgatacgttcgagcgactggcggacgatttcgcactgattacgggagtctgattatgggcgctaaagttcgcggcatccgccaggccaaggccaacctcgatcgcatcatcaaagacgttcaggggcgtaaagtcgtgcgcgcggtgcagtctgcgatgcttatcggcagcgcgcaggccgcgctttacactccgatcgatacgtcgacgctcatcaacagccagttccgcgaaatcatggctaacggcaccagggtaaccgggcgcgttggttactccgtcaactatgcggtatatgttcacgacccggcagtgaaacagaacttcacgcgagcaacggcccgcaaggagttcttaacgaagggcttcgaagatacccgcagccagattgacgcggtggtgaagaaggagctttctctatga

SEQ ID NO: 5973 - DNA, 486 bp, Klebsiella pneumoniae
cgtgaaagagaccccggaagaaatcatcgccatgcttaccgaaggagcctccaaatgacaatcacactacaggcagtaaacgagctcattcagtccctggagagcgcaggcgagctgtcgatcagagagcagaagttcctgaagctggcgaaagcgtaccagcagctggctgcggagaatgtggcactgaaggacatcaacgcatggtgcaaaacggatgcattcaaaaacatgtaccgggagtttaaaacagcagaggcgcttggatgctctgatgcggattgcatgcatgatgcaatgcttgtcgcaattatgcatgcgcctgcaacacccgccaccgatcgcatcgtagccgaagccgaggcgcgcggagttgagaagttcgcggcgcatcttcgcgctaatgataacggggcatcagtttgcaaaatgatcgcgctcggagccgatgacttcgccaagcagctgcgcaagggggccaaatga

SEQ ID NO: 5974 - DNA, 291 bp, Klebsiella pneumoniae
ttccaaggagattgcaggatgaaaaaagtgatagtcgcgttagccctttccgccgttgcatttggcgcctccgccgcgcagttgattaccaaagaagaagtgaaacacttcaaactgaccaaagtcgggccgatctcggtggggccgtccggtggcgaattctcttcgccttccgatctgcacgatcagctctccaagctggccgatgagaaaggcggaaagtactacgtgatcaccgctgcgcgtgagcatggccctaactttgaagccacagcggaagtgtataaataa

SEQ ID NO: 5975 - DNA, 228 bp, Klebsiella pneumoniae
gggagtctggatatctccattatccgtgacaggtgcagcatgtacttttatcaaccttcgcagggccacggcctgccgcatgacccgctgaacgcgataatcgggcctcgcccgataggctggatcgcctcgcaggacgccgagggccagcgtaatctggcgccatacagcttttttaactgctttaactatcggccgccgatcattggtttcgccagcagcggctga

SEQ ID NO: 5976 - DNA, 1299 bp, Klebsiella pneumoniae
cccgtgctggaacggctgtcatggaaaaggctggcgctggagctctttttagcgtgtattccggccctgattctgggggcgtttgtgggtcatctgccgtggtttttactggcggcagtgaccggtttgctgatctggcatttctggaatttgatgcgcctgtcgtggtggctgtgggtggaccggagcatgactcctccgcctggccgcggcagttgggagccgctgctgtatggtctgcaccagatgcagatgcgtaataaaaagcgtcggcgcgagctgggaagcctgattaaacgctttcgcagcggggcggaatcgctgccggatgcggtcgtcctgaccacggaagagggggctattttctggtgtaatggcctggcgcagcagattctaaacctgcgctggccggacgacagtggccaaaacattcttaaccttctgcgctatcctgagttcgccaactatctgaaacagcgcgatttttcaaagccgctcaatctggtgctgaataacgcccgtcatctggaaattcgcgtgatgccctacagcgacaagcagtggctgatggtggcgcgcgacgtgacgcagatgcatcagctggaaggggcgcggcggaactttttcgccaacgtcagccatgagttgcgcaccccactgacggtgctgcagggctatctggagatgatgcaggagcaggtgctggagggggcgacccgagaaaaagccctgcacaccatgcgggagcaaactcaacgtatggaaggtctggtgaagcagctgctgacgctgtcgcgtattgaagccgcgccggcgctggcgatgaatgatcgcatcgacgtgccgatgatgctgcgggtggtggagcgcgaggcgcaaactctcagccaggagaaacagacgctgatcttcaccgtcgatgagcagctcaaggtgctgggtaatgaggagcaactgcgcagcgccatctccaacctggtctataacgcggtgaaccacaccccgccggggaccgaaattcgcgtcagttggcagcgaaccccgcagggagcgctgttcagcgtcgaggataacgggccaggcattgcgccggagcatattccccgtctgaccgagcgtttttatcgggtggataaagcccgttcccggcaaacggggggcagtggcctgggactggcgatcgtcaaacacgcggttaaccatcatgacagccggctggaaatcgacagcacggtgggcaagggaacccgctttagcttcctgctcccggaacgattaattgccaaaaatgacgcctga

SEQ ID NO: 5977 - DNA, 561 bp, Klebsiella pneumoniae
ggtggaccggaaatgagcgaattttcacgagaaacactactcaacattatcgagactgaccatgtgcaatgcggtgaggcttcggcactggcccgcatagcgctggccgcaatggacagcgagacggttgagatgcctctcgactacctacagggacacaaagacggtctggagtgggccgctcgactggcagaagccaatcaccctgacaccggagactggctttacgatgaccctatcgagctggcaaaagctattcgcaaaggcccagatatgccgccagtgcagccggtagcggacagcgagccggatcgcaatcctgtgctggcgtatgccgacagttatcgtgatatggcgaaacaaggcgtcgagtcagtcccaatatggtgcgtcattaccgacctcgagcgaaacattgctccgctctatcgtcacgctcagccggtgacggtagtgccggataaaatgacagcgattgttaaggatgaggccgaatacgtagaaggctggaacgcctgccgcgccgccatgctcgcagccgcccagcaggagggaaaatga

SEQ ID NO: 5978 - DNA, 210 bp, Klebsiella pneumoniae
gccgtcgcggaaactgctgggataatgcagtggcagaatcgttcttcagttcactcaaaaaagagcgcatcaggaagcggatatataaaacccgggacatggcccgggcgggatattttcgattacattgaagtgttctacaaccgtaaccgacgccacagccacctcggtggcgtcagcccggaggccttcgaaaaggcctcgccgtga

SEQ ID NO: 5979 - DNA, 360 bp, Klebsiella pneumoniae
gcatgtcaggacgccaatagcaaaaaagcccaccgaagtgagcttttttgcattgaaatggctggggtacgaggattcgaacctcggaatgccggaatcagaatccggtgccttaccgcttggcgataccccaattgtctgttgcgcttgaccgtaactacgccggttgagggcaacagtgcgttcactgctgaacgacttttaaatttggctggggtacgaggattcgaacctcggaatgccggaattagaatccggtgccttaccgcttggcgataccccaacaaattgtttgcggatttatcgatgcgtatcgatacgtccagaatttggtggctacgacgggattcgaacctgtga

SEQ ID NO: 5980 - DNA, 900 bp, Klebsiella pneumoniae
gccatgcaggacgaaatgtacatggcgcgtgcgctgaagcttgccgcgcgcggtcgctttactacccatcctaaccctaacgtcggctgcgtcattgtgaaagacggcgagatcgtcggcgaggggtttcactatcgcgccggcgagccgcatgctgaagtgcacgccctgcgcatggctggcgaaaaggcgcgcggcgccaccgcctacgtcactcttgagccctgcagccaccatggccgtacgccgccatgctgcgatgcgctgattgccgccggcgtcagccgcgtggtcgccgcgatgcaagatccgaacccgcaggtggcggggcgcggtttgtatcgcctgcagcaggccggcattgaggtcagccatgggctgatgatgaacgaagcggaagcgctgaataagggctttctgaagcggatgcgcaccggttttccctgggtgcagctgaagctgggcgcctcgctggacggccgcacggcgatggccagcggcgaaagccagtggatcacctccccgcaggcgcgacgcgacgtgcagcgtctgcgcgcccagagccatgccatcctgaccagcagcgccaccgtgctggcggacgatccggcgctgaccgtgcgctggcaggagctgagcgccgatacccaggcgctttatcccgaagagaatttgcgccagccgctgcgcgtcgtcatcgacagccagaaccgcgtcacgcctgagcatcgtattgtgcagcatgcgggggaaacgctgtttgcccgcctgcgcgccgatgaacggcagtggccggaaagcgcccgcacgctgctggttccggagcataacggcccatctcgatctggtgctgctgatgatgctgcttggcaaacagcagatcaacagcgtctgggttga

SEQ ID NO: 5981 - DNA, 435 bp, Klebsiella pneumoniae
gcgacgcaggacgcgagaagcctactggaacgaggtgtgctttgtgtagcaagagactgcctgaggttgcggcatcgcgggaggcgccgccgcagcccaggcagttttgaccatgcctatccccccagatacatccgcttaatttccggattagtcagcatctcccgcgccgcgcctgacaaggtgatccggccattctccaggacatacgcccgatcggcgattgccagcgcggccgtcgcattctgctccaccagcagcaccgtcatattctcttcgcgcagttgcttaatgatgccgaacagctcgccgacaattttcggcgccagcccgaggctcggttcatccagcatcaataacaccggctcgctcatcagcgcccgggcgatggccagcatctgctgctcgccgccgctcatggtgcccgccatctga

SEQ ID NO: 5982 - DNA, 735 bp, Klebsiella pneumoniae
atggataaggaccgggaaatgacggcgaagtatctgcaaatcgcgcgggaaataaaaaaacgcatcatcagccagcagtatcctgccagcgcgccgctacccgaccagtttgcgctggcggcggagttcagcaccagccggatgaccatccagcaggcgatgcgccagttaatcgtcgaagggctgatctatacccgaaaagggcagggcacctttgtgcggaaaaatttccttcagctgtcgcagtgggagctgcccggcagcgactatttcggcgccaccaaaacctgggagcatcttggcgaggtgcaaagcgaagtggtgcgctttgcggtgcgctttcccagcgacaaggagcaaagttcgctgcttatcgacgccgatgccccggtgtatgactttgttcgcctgcggctgctcaacggcgagccggtatcgctggatctgacggtcatgccggtggggctggtgccggggttaaccaaaagccatctggaaggttccgtgtttcgctatgtgcaggagacgctggggctgaagctgatgggatcttaccgcgtggtgcgggcgatgaagcccggggaactggataaacagcatcttcactgcgaaccgaccgatccggtgctggaggtggagcaggttatctatctggaggatggcacgccgctggagtacgcccactgccattatcgctacgatcacggcgggattattctggtgaataacggctag

SEQ ID NO: 5983 - DNA, 339 bp, Klebsiella pneumoniae
catccagaggaagggagtctgatgttcagattggttgtgcatgtggacgttaaaaaggaattgcaggcgcttccgcccattgtccaggcgaagatgatccggcaattagacaagttacgccaaaatcccaccgcgctgagagaacctgacagtaaaccgctggggcaggggctatttgaaattcgtgcgttaggttcggtacaggggcgagggatctacgtttttcagcaaggcaagacgctctttctgctacgggtttttgtcaagaaaacgcaaaaaaccccgtcatcggaaattcgcctggcgctgaagcgattagaggagatgcgcaatgagtaa

SEQ ID NO: 5984 - DNA, 1257 bp, Klebsiella pneumoniae
ctagtatgggagatgttggaccaattcaggctagggcagaaaaatcgtctggcaaagcgctatttatgcaagttttttcatgaaatgagcgagatcgcatatttgacagcggaatttgcttgtaacgtgtgctttggcgattatgaaaattctttcatttttcaatcggagctggatcacaaaatggataaaaagctgcgcgtcgccgaaattgccgcccgcaccgggctatcgcccagcaccgtttcacgcgtcctggccgggaaagcgaataccagcgacaaggcgcgccgggcggtgctggagtgcgcccgcgagctgggtgtcatgcaggggttggccgccgggcgtctgctgctcaatcatctgctggtgtttgccccgcagcgcgcattcgatgagcgatcggatatcttctactaccgggtgatccagagtatcaataacgcgctggcggcgcatgaagtgcgcctgcgctactgcgcgctggatgagaacgacagcgacgccaacctgtttcttgcccgcatgaatgaacctgagacccaggccgcggtgctgctggggatcgacgatccgcatattcatggcctggcggcggatctgggcaaaccctgcgtattgatcaactgtcgggatgaagggatgcggctgccgtccatcgctcccgatcatcggctgatcggccagtgcgcggcccgctatctgtttgatatggggcatcgggcggtgatgaacgtgatgtgcctgcgccgctataccatggagctgcggctgggggggattcaggaggcgtggcgcgcgcgtaatctgcgctttaccgccagccgggatcttatcagcgtcgccaactttagcgccagagagacggaagagcaggtgggcgcctggcttgacggcttacagggcaggccgttgcccaccgccttcctggtgggcggcgattttatggccgccggcaccgtcagcgcattgcaaaagcgtggcctgcgggtgccgcaggatgtctcggtgatgagcattgacggatttaatctggcggcgattcaggaggtgccgctgaccgcggtgcatgtgccgcgggatgagctgggcagcgaggcggtgcatctcctgcagcagcgcctgctgcgcccggaggcgccgcacggctcgctactgctgcatggcacgctggtggtacgcgattcggtacggcggatccggccgggcaaaggccataccgccgtcgagccgcaggggctgtatgacgattag

SEQ ID NO: 5985 - DNA, 609 bp, Klebsiella pneumoniae
tctgggcgggatgggcatcgccggcggcgcggatatggcgcattttttcaatgccacccgctcgccgcgctccgcgctgtatgctgcccgccgcctgctgcgccacggctggcagcggctacgcgccggacgggggcagcatctggtcaatggcaatgcgctggtcgcccgtctgctgcgatccgccctcgacgccggcgtgcgttttcagctcaatgccccggtggtccggctgctgcagggtccgccgggcgtgtccggcgcggtgctgcgcagcgacggcggggagattcacgtcgaagctggcgccgtggtgctggcctgcggcggttttccccacgatcgccagcggctggcgcaggtggtgccccacgcggcggagggttacggccatttctccgccgcaccgccggacaatcagggcgaggggatcaggcttggcgaatccgtcggcggccagttcgacacttccctgcgccacccgctggcctgggcgccggtgtcccgcgtcactctggccagcggccagcagctaatgtttcctcatctggtggagcgcgccaaacccggggtgatcgccgtcctgcccaacggcaaacgttttgttaa

SEQ ID NO: 5986 - DNA, 963 bp, Klebsiella pneumoniae
ctattaagggacgacactatggcgcactcgcattcgcactcctctgtccaggctccggataacagcaacgcccgccggctgctatgggcgtttatcgtcaccgccggctttatgctgattgaagccgtcggcggcgcgatctccggctcgctggccctgctggcggatgccggccatatgctcaccgactccgccgctctgctgtttgcgctgctggcggttcgcttcgccagccgcccaccaaatgcccgccatacctttggctggttgcgtttaaccaccctggcggcgtttctcaatgctattgctctggtggtgatcaccatgctgattgtctgggaggcgattcagcgcttccagcatccgcagccggtagccggcgtgacgatgatggtcattgcagtcgccggtctgctggccaacgtgctggcgttttggatcctacatcggggtagcgaggagcggaatcttaacgtacgcgccgccgcgctacacgtgcttggcgacctgctgggctcggtcggcgcgatcgtggcggccgtggtgatcctcaccaccggctggacgcctgtcgacccgattctttccgtgctggtttcctgcctggtattacgtagtgcctggcgattactgaaagagagtctgaatgaattgctggaaggcgcgccgcgttcgctggatgtggcggccctgcagcgggatatccgtcgctctatcccggaggtacgcgatgttcaccacgtccacgtctggctggtgggggaaaaaccggtgatgacgctccatgtacaggtcgttccaccgcacgatcatgacgcgttactcaaccgcatcctgcatttcctggaacataaatatgaaattgcgcatgccacggtgcagatggagtaccagccctgcagcggcccggagtgccatctcaacacgatgcacgccgggcacgatcatcaccaccaccattag

SEQ ID NO: 5987 - DNA, 684 bp, Klebsiella pneumoniae
ccagtaagggaaagtatcatgggcaacacgctgacgatttttgatctcgataacaccctgatacagggcgatagcagtacggtctggagccagtttatggttcgcgaagggctggcgacgcagaaggggtatcttgcccgcgaggcgcggctaatggcggattatgaccggggagagatgaatatcgccgattatgtggccctgatccaggcgccgctggccggaataccgaagtcggacgttgacgcgctggtggcccgctgcgtgcgcgaggcgatcctgccccgggtctatccgcaggcgtgggagctcattcgtcgtctgcgggccgagggagagcagatgctgattatctccgcctcggttagcctgctggtgcaggcggtggccgccgcgctggagatcgatcaggcgctgggtattgacgtggcgatggtcgacggcggctacagcggtgaaatcaccgggatccccagctatcagcaggggaaggtggcgcgtctggcgcagtggcgcgaggcgcatccgcagtatgacggcgaggtgacgttctataccgattccattaacgatctgccgctgtgcctgcatgcggatcgcgtgcggctggtcaatccctgtccgcagctgcaggcggccggtgccggatacggctggccggtgctgagctggcggctggaatag

SEQ ID NO: 5988 - DNA, 1197 bp, Klebsiella pneumoniae
tgcggaagggatggaacatcacgtgagcgaagagacgctggcgatgttcctgaaatttacccaaacacagggatctcaggaagcatgactcttcccttcgtccagtcgctgctgcgcgatcgttttctccatttgctgctgattatcgcctgcgtgctcagcgccatcgtgccgtttgtcccggcaagctggccggcggccattgactggcataccatcgtcacgcttagcggcctgatgttgttgactaaggggatcgaactgagcggctattttgacgtgctgggccgaaaaatggcccgccgctttgtgactgagcgccagctggccatctttatggtgctggcggcggcgctgttgtctacctttcttaccaatgacgttgcgctgtttattgtggtgccgttgacgctgacgctaaaaaaatggtgcgccatcccggtgaaccggctgattattttcgaagcgttggcggtgaacgccggttcgctgctgacgccgatcggcaacccgcagaatattttgctgtggggacgatccggcctctctttcttcgggtttatcggtcagatgctgcctctggcagcggcgatgatgctgaccctgctggcgctgtgctggttctgttttccggcgaagcggctcagttaccagagcagcgacaggacgccgtcatggcaacctaagctcgtctggagctgtctgggactgtatgtggtgtttctgacggcgctggagatgaatcaggccctgtgggggctggcgctggtgctgctgggcttcctggtgctggcccgggcggtgatcgtccatgtcgactggtcgctgttgctggtgtttatggtgatgtttattgacgtccatctgctgacccagcttccggcgctgcaccaggtgctgagcggggtggggaccctctccggcggtggactgtggctgaccgctattggcctgtcgcaggtgatcagtaatgtgccctcgactattctgctgctcaactatgtcccgccgtcgatactgctcgcctgggcggttaacgtgggcggctttggcctgctgccgggctcgctggccaatattatcgccctgcgtatggccagcgatcggcgcatctggtggcgcttccatctctactccattccaatgctgctatgggcggcactcagcggctactggctcttcaaactctgcgcctga

SEQ ID NO: 5989 - DNA, 195 bp, Klebsiella pneumoniae
tacaggagggaaatagcacagcgcccggttaaaccgggcgccgggaaatcagtgattttgctggctgcgatctttgtggcctacgccggagaagaggttgaacacttcgccaagaccgtaaatcagtcccaggatgaccgccatcaccaccggtaccatgatgaccgcaaaaaccagacttttcaaaagctctaa

SEQ ID NO: 5990 - DNA, 1176 bp, Klebsiella pneumoniae
aggagaagttttatgtcaatcaccctcaggggcggcgtgtggcactgtcatttctttacgccgtcaggaaaaagagttaggcgatctcttggcacgggggacaaaaagcaggctcaggagctccacgacaaactgaaggcggaagcgtggcgggttgaccagatcggtgacctgcctgtcagaacctttgaagaatgctgtatccggtggttgcgggagaaagaccataagcgatctctggatgatgacaaaaccaaaattgagttttggctgcagcatttttccggccgtgatgtctcgaagataacggcggaggaagttcacgaagccgttaatgggatgatcaaccgtaagcacctgcaggtgtgggagagtaagcgcgatgccgcggtgaggaagggtaagccggttcctgagtacaaaccacggcaggtttctcaggcgacgaaggcgcagcacctttccttcattcggtcccttctcagggccgccgcgaatgactggggctggataaaaacagcccctgttatcaaaacccgcaagcctatcagtaagcggatacggtggctgaccagagaagaagctgaacggttgatcgagtgcatgccggagagcattaagccagtggtgatatttgcactggcaaccggcctgcgccgctcaaacatcatcgggcttgagtggcagcaggtcgatatgcagagaaaggttgcatgggtaaatccggagaacgcaaaagcgggcaaggcgattggcgtagctctgaatgataccgcatgcagggtattaagggatcagatagggaagcactcccgatgggtgttcgttcacacgacggcaaagcatcgccctgatggaacgctgacgcccgcggttagaaaaatgcgggtggatgacaataacgcctggcgcgccgggttgaaaaaagcggggatcgaggatttccgttttcacgacctccggcacacctgggcgagctggcttattcagtccggcgtcccgctttctgttttacaggaaatgggaggatgggagagcatcgagatggtgcgtcgctatgctcacctggcaccgaaccacctgaccgaacacgcacggaaaattgacgccatttttggcgctagcgacacaaatacgacacaaggaggaaatcaggctggtttgaaacttgcgtaa

SEQ ID NO: 5991 - DNA, 1305 bp, Klebsiella pneumoniae
gattttatactttcgaatgaaagatacagcgaggttattatggctgctctcccgacccacgaaacacttcccgccgatcacaaagcggcgattcgccagatgaaacaggccctgcgggcgcaaattggcgacgtccaggcggtgttcgataagctctcagcgcgcatcagcgagcggctgcaggagattgagacactgaaagccgcaggccaggaggtctggccaaccgttccgttccgcgatatcgccgaaggaacagtgagcgatgagcagcgcgcggccattaagcgccggggctgcgcggtgattaaaggccacttcccacgcgaacaggcgctggcgtgggataccgcgatgctggaatatctggatcgcaaccatttcgacgatgtttacaaagggcctggcgacagcttcttcggttcgctagaggcttcgcgcccggagatctacccgatctactggtcgccctcgcaaatgcaggcgcggcagagcgatgaaatggcggcggtgcaatctttcctcaaccgcctgtggcgttttgaacagaatggcaaacgctggttcgatccggacgtcagcatgatctatcccgaccgcatccgccgccgcccgccgggaaccacttcgaaggggctgggggcgcataccgattccggcgcgctggagcgctggctgcttcccgcctatcagcaggttttcgccaacgtttttaatggcaatatcgacgcctacgacccgtgggacgccgcgcaccgtaccgaagtggaagagtataccgtcgacaacaccaccaaatgctcggtgttccgcaccttccagggctggaccgcgctgtcggacatgatcccgggtcaggggctgctgcacgtggtgccgatcccggaggcgatggcttatgtgctgctgcgccccctgctcgacgatgtgccggaagatgagctgtgcggcgttgcgccgggcagagtgctgccgatctctgagcagtggcacccgctcttaattaaagcgttaagctcgattccagcgctgaatgccggggactccgtctggtggcactgcgacatcattcactcggtggcgccggtggaaaatcagcagggctggggaaatgtgatgtacattccggccgcgccgatgtgcgagaagaacctcgcctacgcgcagaaagtaaaaatcgccctggaaaaaggcgcctcgccgggggatttcccgcgcgaggactatgaagccagctggcaggggcgcttcaccgtggaggatctgaatatccacggcaaacgggcgctgggtatgccggtctaa

SEQ ID NO: 5992 - DNA, 1488 bp, Klebsiella pneumoniae
accattggtttggttatggatcaccgcatgacggtggaagaaggtgccgcggccggagtcttcgccggacagacgaaccggaataccttcgtcaaccagcgtggcgtaggccaggttttcagcgccgccccagtcaaacagcttctcgcctgccgccatcgcctggcggtcggcgtaaattttcgccacgcgggactgcatttcgataccttccggtaccgtgctgatgcgtttggccaactcctgcagacgtttcggctcaactttatccggatagctctcgtcccactcgtggttgaggtacggcgaccaggtaaaggaatgcatattcatcggacgccattcctgcaccacgcattcgccggcatccagcgcatcgcggtagaggttaacctgctcggtcgcatcttccagagtcgccaccttctcctgctccagcttgtcagcatagattttgcgcggagtcggatgctttttgatcttctgatacatcagcggctgggttgcgctcggctcatcggcttcgttgtggccgtgacggcggtagcacaccagatcaatgaagacatcgcgtttaaaggtattgcggaaatcaagcgccagacgggtgacgaaggcgaccgcttccggatcgtccgcgttcacgtggaaaatcggcgcctgcaccattttaccgatgtcggtgcagtacggcgtcgagcgcgcatccagcgggttagaggtcgtgaagcccacctggttgttgataacgatgcgcacggtaccgcccacttcgtaaccgcgggctttggacatgttcagagtttcctgaaccacgccctggccggtgacggcggcgtcgccgtggatggtaataggcagaactttgttgctgcttggctcgtccagacgatccagacgggcgcgtacggaaccgataaccaccgggctgacgatctcgaggtgcgacgggttaaacgccagcgccaggtgcaccagaccgccttcggtttccatatcggaagagaagcccatgtggtacttcacgtcgccggtgccgaggtgttctttatgtttgcccgcgaactcgtcgaacaggtcctgcggttttttacccagcacgttgaccagcacgttgagacggccgcggtgcgccatgcccagcaccacttcgcgggtgccgcttttgcctgcatggcggatcatctctttgagcatcgggatcagggcgtcgccaccctccagcgagaagcgcttcgcccccgggaatttggcgccgaggtagcgctccagaccttccgcggcggtcagttcgctgaggaagcgttttttctcttccgcggtaaagctcgctttgccagctaccgattcaatgcgctgctggatccagcgtttttcttcggtagaggtgatatgcatgtattccgcgccgatggagccgcagtaggtttgcttgagggcggcaatcagctcgcccagcttcatcgtgtctttaccgatggcaaatga

SEQ ID NO: 5993 - DNA, 1467 bp, Klebsiella pneumoniae
cgagctggtttttttcagccccgggctaatcacgcccagcagatcctgcagcataaagcgcgccgcgcgggtgccggcgtcaaccgccgtcaggataaacagcgcctcaaacagaatggcgaagtggtaccagaaagagacatccatcagcccgcccagcgagccgtgcaggatgtaggccatccccaccgccagcgttggcgcgccgccggcgcgggagataatcgactgttcgccgacctcgctggcgatttgatgcagcgtatcaggcgtaatgctaaagccccagccgctcaccacctgcgctgccgaggcgacgacatcggtggtacccgccggcgccagcaccgccatcgggctgttcatcgcgaagtagacgcccggatcgataatacaggccgccaccagcgccataatagcgacgaaggattccatcaacatgccgccgtagccgataaagcaggcctggctttcgttggccaacattttcggcgtggtgccggaggagatcagcgcatggaagccggagaccgcgccgcaggcgatggtgataaacaggaacgggaacaggttgccggtccataccgggccggtaccatcgacgaacttggtcagcgccggcatcgtcagggtcgggcgcataatcaggatgccaatcgccagccccacgatggtgccgattttcaggaaggtggagagataatcgcgcggggccagcagcagccagaccggcagtaccgcagccacaaatccgtagcccaccaggatccaggtcagctgtacgccggtgtaatcaaaccacggcgcccaggtcgggctttccgccacccagccgccggagatgatggcgaacaccagcatcaccaggcctatcaccgacacctcgccgatgcgtcccggacgcagatagcggatgtagatgcccataaagatcgccagcggaatggtaaaggcgacggtgtatgtcccccacggactgtgggtcagcgctttcaccacaatcatcgccaggaccgcgaggatgatcaccatgatcataaagcaggccaccagcgccaggacgccagcggtcggtcccatctcctctttaaccagttcgccaagcgaacggccatcgcggcgggtcgaaacaaacagcaccataaagtcctgtaccgccccagccagcaccacgccggcgaggatccagatcatccccggcaggtagcccatctgcgcggcgagcaccgggcccaccagcggccccgcgccggcaatggcggcaaaatggtgaccgaacagcacttttttgtcggttggaacgtagtcgaggccatcgttatgccgcaccgcgggcgtcatccgcgtcgggtcaacgccgagcacggttttagcgatatacaggccgtagaaacgatacgcgatcaaataaacgcagaccgcggcgacgacaatccacagcgcgtttatctgctcaccccggtttaa

SEQ ID NO: 5994 - DNA, 1371 bp, Klebsiella pneumoniae
agccaaccactacgacatgagagagggcagggtatgaagctggcaattcacaacgaggtcgcggtaagcaatgacgaagttcggcaattagatcgcgcctatgtgtttcattcatggtcgatgcagggcaatctcaacccgctggtcatcgccggggcgcaaggctgcgagctatgggattatgaggggaacacctggctcgatttcagcagccagctggtgaacgtcaacattggctatcagcacccccgggtattggcggccatgaagtcgcagctggagaccctggtcaccatcgcgcccgccaccgccaaccttgcccgcggcgaagcggcgaagcgcatcgtcgatctggcgccggcgggcttcagtaaggtgttcttcactaacgccggggcggatgccaatgagaacgcgattcgcatggcgcggctctataccgggcgcgacaaggtgctgtcggcctatcgttcctatcatggcaacaccggcagcgcgatcgccgctaccggcgactggcgccgggtgccgaatgagttctcccgcggccacgttcacttcttcaacccctacctttaccgcagcgagttcaacgccgcgactgaggaagaggagtgccagcgcgcgctggcgcatctgcggcggatcattgaatgcgaggggccgacggccatcgcggcgatcctgctggagtccatccccggcaccgccgggatcctcgtgccgccggcaggctatatgcagggcgtgcgcgccctggccgacgagtttggcatcgtgctgatcctcgatgaggtgatggccggctttggccgcaccggcagctggttcgccttcgagcaggatggcgtggtgccggatctggtgacctttgccaagggggttaacgccggctacgtgccggcgggcggggtgctgattagcgagccgattgcccgctactttgacgaccacttctttgccggggggctgacctactccggccatccgctggcgatggcggcgattgtcgccaccatcgacgcgatgaaagaggagaatgtggttgagaacgcggcctctatcggcaacgaggtgctgcgccccggtctcgaggcgctggcggagaagcacgccattatcggcgaggtgcgcggtcgcggcctgttccaggcgctggagctggtgagcagccgtgaacaaaaaacgccgctgaccgccgccgacatggctgcgatcaaaggggccctgaccgaagccgggctgctggcctttgtggtggagaaccgcattcacgtggtgccgccgtgcaccattactgctgagcaggtggcgcaagggctggcgatttttgatgcggtcttcgctcgctttgccagtctggcgaagtag

SEQ ID NO: 5995 - DNA, 768 bp, Klebsiella pneumoniae
ttaacaacactcacaatactcacaactgaacaggacgttattatgcaagaggcgatatccctctggccgctaatcggcattgccgtgattgtggtcggttttgtattacgctttaacccggtgctggtggtgattatctccgggatcgtcaccggcgtggcggcgcatatgccaatagccactattctggagaaactgggcgagggcttcctgaatacccgtaatctgccgtttattctgctgctgccgctggcggtgatcgggctgctggagcgccatggtctgaaagagcgagcgcaggcgtggatcgcgaagatccatagcgcgaccgccggacgtctgctgatcgtctatctgtttgtgcgcgaagccaccgccgctctggggttgaccagcctcggcggacatccgcaaatggtgcgcccgctgctggcgccgatggcggagggggcggcggaaaagcgctttggcccgctgccgggcaatgtacgctaccgcctgcgcgcgatgtcggcggcgaccgataacgtcgggctgttcttcggcgaagatatttttgtcgccttcggcgcgatcatcttcatgcacaactttatgctggagtcgggtgggatccagacagaaccgttgcatattgccctgtgggggatcccgacggcgatctgcgcctttctgatccacgccgcgcgcctgtggcgactcgatcgccatctccagcgcgagctggaccggataaacgccggacaggcgaaaggcggtgcggcatga

SEQ ID NO: 5996 - DNA, 414 bp, Klebsiella pneumoniae
tcgccgggtttggctggcagatgggctacctgtccaccgccgcgctcggcgccgccggcgtggtgctgctggtgctgttcatgcacgattcgccgcagagcagcggcttcccgtccatcaacgtcatccgcgatgaaccgcaggaggaggtcgaagcccgcggctcggtgtttaaaaaccagctgctggcgctgcgcaacccggcgctgtggaccctcgccctcgcctccgcctttatgtacatcgaccgctacgccgtcaactcatgggggatcttctttctggagcaggataaagcttattccacgctggaggcgtccgggattatcggcgtcaacgctatcgccggcatcgccgggaccatcatcgccggcatgctctccgaccgctttttcccgcgcaaccgcagcgtga

SEQ ID NO: 5997 - DNA, 1050 bp, Klebsiella pneumoniae
cgatcgttttggcgaaacatcccgctgccatttcagttacactatcgtctttcatttcacaaaatcaggcaaaccatgacagatttaatcactcgcccccgccgcctgcgtcaatccgctgcgctgcgcgccctgtttgaagagacaacactgagtttgaacgacctggtgttgccgatctttgttgaagaagaaattgatgattacaaagcgatagaggccatgcccggcgtgatgcgcattccggaaaaatatctggcgcgcgagatcgaacgcatcgccaacgccgggatccgctcggtgatgacctttggtatttctcatcacaccgatgccaccggcagcgatacctggaatgaaaatggtctggtggcgcgtatgtcgcggatttgtaagtccacggtgccggagatgatcgtcatgtccgatacctgcttctgcgaatatacctcccacggccactgcggcgtgctgtgcgaccacggggtggataacgacgcgaccctggaaaacctcggcaaacaggccgttgtcgccgccgccgcgggggcggatttcatcgctccttccgccgcgatggacggacaggtacaggcgattcgccgctcgctggatgctgccggcttcaccaatacggcgatcatgtcctactcgaccaagttcgcttcttccttctacggcccgttccgcgaagcggccggtaccgcgctgaagggcgatcggaaaacctatcagatgagcccgatgaatcgccgggaggccattcgcgagtcgctgctcgatgaagcccagggcgccgactgcctgatggtgaaaccggctggcgcctacctggatattctgcgcgatatccgcgaacgcagcgatctgccgctcggcgcctatcaggtcagcggtgagtacgcgatgatcaaatttgctgcccaggcgggcgctatcgatgaagagaaagtggttctggaaagcctcggcgctatcaaacgcgcaggcgccgacctgatcttcagctatttcgccctcgatctggccgagaaaaagatcctccgttaa

SEQ ID NO: 5998 - DNA, 627 bp, Klebsiella pneumoniae
gattatctttgctattttaggtggcttttaaatcaaagtggtaatagaaaagtgttgatgttacgtcgtttttcattgttttctcttggttttttaggatggttattggtgtccggaaacgccagcgcgtcgttttcatcgacccttagcgaaggttaccataccttaagtaataacgtagcgcagacctggaatgagccggagcactatgatttgtacgttccagccatcacctggcatgcgcgttttgcctatgacaaggaaaaaaccgataagtataacgaacgtccgtggggggcaggtttcggcgtctcgcgctgggatgagaaagggaactggcatggcctgtacctgatggcgtttaaagactcttttaataagtgggagcccatcggcggctacggctgggagaaaacctggcgcccgctgacggaccagaatttccacctcggccttggctataccctcggcgtcacggcgcgcgataactggaactacatcccgatcccggtgatcttgccattggcgtcaataggttacggtccggcaactttccagatgacctatattcccggcacctacaataacggtaacgtttacttcgcctgggcgcgcatccagttttaa

SEQ ID NO: 5999 - DNA, 480 bp, Klebsiella pneumoniae
agcatgaaactgatcagtcacgatctccaggacggcggtaagctgcctaatcgtcacgtcttcaacggcatgggctacgatggcgacaatatttcgccgcatctgatgtgggatgatgtgcccgcgggaaccaaaagctttgtggtgacctgctacgatccggatgcgccgaccggctccggctggtggcactgggtggtcgctaacctgccggccgatacccgcgtcctgccgcaaggggccggttccggtcaggcggagctgccggaagaggccgttcagacccgcaccgattttggtaaggcaggctacggcggcgcggcgccgccgaagggcgaaacccaccgctatatcttcaccgtccacgccctggacgtcgagaaaattgaggtggatgctgaggccagcggcgcgatggtcggctttaacgtccatttccattccctcgccagcgcctccatcaccgccctgttcagttaa

SEQ ID NO: 6000 - DNA, 993 bp, Klebsiella pneumoniae
ggcggcatttggctccttttcagcctgtttgcagcggctttaaaagccgctaacccggtagtaacgttaacgtatcgactcactgacagagaaaccaccatggcagattttccccctgtcgccagcctgcgcagctttgaagcggtggcgcgcctcggcagcgtgacgcaggccgcccacgagttgagcgtgacccattcggcggtcagccagcacatcaaacagctggaagccctggtcggcgtcacgctctttatccgccacggccgcggagtgcgcatcacggaagaaggacggctctatgccctgcaaatccgcgaagcgttacagcacatcgccgacgccacgcgcatggtgcagatcaaaccccgcaccctggaagtgtccctggcgacgctcccctcctttggctgccactggctgctgccgcggctggcgcgctttcaggcgcggcatccgcagatcgcggtgcgcctgctgaccagcctggcggtggttaacctgcaacaggagggtatcgatctggccattcgcatggggcaaggcgattgggagggaatggaaagccggcatctgtttgccgatgaacagctggtggtcgccgcccccggctatcgcggcggtaacctgccgaccaccccgcaggcgatcgccgccagcgatattattttttccatggagtcctggaacgcctggtgcagccaggcggggctggaaaagccgctcgtcccctcaggcctgcgcctgaacgactctaatctggtgctggaggcggtccgcctgggggccggcgtggcgctggagcggcgctccctggtggcgggggcgatagcccgcggcgagctggtgcagctcaccgccgtcaccgtcccctacccctggcactactggctaaccgtctccccgcaggcggagaaccggccggaagtcgcccggttcatcgcctggctggaggaggagatcgccctctggcgccagcagatcagcgcttag

SEQ ID NO: 6001 - DNA, 828 bp, Klebsiella pneumoniae
catatgtattggatcataaacaaaaatatagaattttggcctgaaaataagcggttaatctcgttgaaaaacccggctcaaagcgtcacattgacggccccggcaagccactgtcttgttcttttactggaagccactccggaactggtcagtcagcaagttttctttaaaaaagtgtgggaagatgaagggattctggtcccggcaaataccctgtatcaaaacatatcgatagtcaggcgcggactgcgcgatgtcggggaaacggataattcgatagtcgtgacggttccgcgaaaaggctttcatatcaatcctaacgttaacgttgagaggatggatgaaaaacctttaaattcagaaacttataataacatcaccatcataagccaggatgacgtcgctgaaaaaaatccgaccacagagtctggtgatatcgtgcaaacggccaccagaaaaaacatcggtgcaaaggctacaacgttcttgatcatgctgttaagtttactggcgggttgtttgtcttttcattacatttggcattttcatgatgaaaaacctttttttagcagctatacattggttgaaaacgatcgcgggtgtcatttttataccaaagatgataaccatgctaaagttgataaatttaactattataaatctttgatattcaaatccggacttgattgtaagaagtatcccttcgtttatttttcgatgtcgcaaatgtctcccggatttatagtctttatttgcagaaaaagttacagcgagaaggtttctgccggatgtgttactctctcttttcgtggaatagtatatgaatag

SEQ ID NO: 6002 - DNA, 201 bp, Klebsiella pneumoniae
cgcaatcattgcttttttcataatatcctctctcacgtgtcgtgttatgagtcgcattcaggatggcacaacgaatcggggatgacattaggaattagcctgaaaaacgtcttcgacctccagccatggcagaaaatgctgccgccgcgcgcgccctgtcggcgttggcataatttccaacatgtttgttacattttatga

SEQ ID NO: 6003 - DNA, 2637 bp, Klebsiella pneumoniae
cacatccattggctacactttgtagctgtattgaaaacaggaccactggctgccatgcaagagcaataccgcccggaagagatagaatcgaaagtccagcttcactgggacgaaaatcgtacatttgaagtaactgaagacgagagcaaagagaagtattactgcctgtcgatgcttccttatccttctggtcgactacacatgggtcacgtgcgtaactacaccatcggcgacgtgattgcccgctaccagcgcatgctgggcaaaaacgtcctgcagccgatcggctgggatgcgttcggtctgccggcagaaggggcggcggtgaaaaacaacaccgcgccagcgccgtggacctacgacaacatcgcctacatgaaaaaccagctaaaaatgctgggcttcggctatgactggagccgcgagctggcgacctgcaccccggaatactaccgctgggagcagaagttcttcaccgagctgtacaaaaaaggcctggtgtacaaaaaaacctccgcagtgaactggtgcccgaatgaccagaccgtgcttgccaacgaacaggttatcgacggctgctgctggcgctgcgataccaaggtcgagcgtaaagagatcccgcagtggtttattaaaatcaccgcctacgccgatgaactgctgaacgatctggataagctggaccactggccggacaccgtgaagaccatgcagcgcaactggatcggccgttcggaaggggtagaaatctcctttgacgtcaacgactacgctgacaaactgactgtctacaccacccgtccggacacctttatgggttgtacctacctggccgtcgcggcgggtcacccgctggcgcagcaggctgcggcgaacaatccggcgctggccacctttatcgacgagtgccgcaataccaaagtggccgaagccgacatggcgacgatggagaaaaaaggcgtcgataccggctttaaagccattcatccgctgaccggtgaagaaattccggtctgggcggcaaactttgtgctgatggaatacggcaccggcgcggtaatggccgttccgggtcacgaccagcgcgactacgagttcgccagcaagtacggtctgaacattaagccggttatcctcgctgccgacggctccgagccggatctctccgagcaggcgctgaccgagaaaggcgtcctgtttaactccggcgagttcagcggtcttgattatgaagcgggcttcaacgccattgccgacaaactggctgccatgggcgtgggcgagcgtaaagttaactaccgtctgcgcgactggggcgtatcccgtcagcgctactggggcgcgccgatcccgatggtgaccctggaagatggcaccgtgctgccgaccccggaagatcagctgccggtgatcctgccggaagacgtggtcatggacggcatcaccagcccgatcaaagccgatcctgaatgggccaagaccaccgtcaacggccagccggcgctgcgcgaaaccgacacctttgacacctttatggaatcctcctggtactatgcgcgctacacctgcccgcagtatcaggaaggaatgctggattcgaaagcggccaactactggctgccggtagatatctacatcggcggtatcgaacacgccatcatgcacctgctctacttccgcttcttccataagctgatgcgcgacgcgggcatggtgaactccgatgagccggcgaaacagctgctgtgccagggcatggtgctggctgacgcgttctactatgtgggcgaaaacggcgaacgtaactgggtttccccggttgacgccatcgttgagcgcgacgaaaaaggccgcatcgtgaaggccaaagacgcggcgggccacgagctggtgtacaccggcatgagcaagatgtccaagtcgaaaaacaacggcatcgacccgcaggtgatggttgagcgctacggcgcggataccgtgcgtctgttcatgatgtttgcgtccccggcggatatgaccctcgagtggcaggaatctggcgttgaaggggcgaaccgcttcctgaaacgcgtctggaaactggtctacgagcacaccactaaaggagaggttgcggcactgaacgtggcggctctgagcgaagatcagaaagcgctgcgtcgcgatatccacaaaaccatcgccaaagtgaccgatgacatcggccgtcgtcagaccttcaacaccgccatcgcggcaatcatggagctgatgaacaagctggcgaaagcgccgcaggaagatgagcaggatcgtgcgctgatgcaggaagctctgctggcggtggtgcgtatgctcaacccgttcactccgcacgccagcttcaccctgtggcgtgagctgaacggcgaaggcgatatcgacaacgcgccgtggccggtagcggatgagagcgcgatggtggaagacagcaccctcgtcgtcgtccaggtcaatggcaaagttcgtggtaaaattaccgttgcggtagatgcaactgaagagcaggttcgcgagcgcgccggccaggaacatctggtggcgaaatatctcgacggtaaaaccgtgcgtaaagtgatttacgttccgggtaaactgctcaatctggtcgttggctaa

SEQ ID NO: 6004 - DNA, 627 bp, Klebsiella pneumoniae
aattgccattggctccggcggtcttcgcggcaaaggctggctgcacggcacccagtcgcagctggagtttctgccggaacgccacaccgactttatcttcgccgtcctcgccgaagagctgggcctgattggcgtactgatcctgctagcgctttatattctgctgattatgcgcggactgtggatcgccgcccaggcgcaaaccacctttggccgggtcatggccggtggtttaatgttgattttattcgtttatgtcttcgtaaatattggtatggtgagtggtattttaccggtggtgggcgtaccgttgccgctggtgagctacgggggctccgccctgatcgtactgatggccgggtttggtatcgtaatgtcgatccatacccacagaaaaatgttgtcgaaaagcgtttaaaggggttagcaatgcgtaagcaatggctggggatctgcatagcagcggggctgctggcggcatgttcgagtgatgacgtgcaacaaaaaacggtcagtactccacagccggccgtctgtaatggcccgacggttgagatcagcggcgccgatccgcaatatgaaacgccgaacgccacggcgaatcaggattatgagcgcgacgtgtaa

SEQ ID NO: 6005 - DNA, 561 bp, Klebsiella pneumoniae
agcaaggaactcatcatggcgcagcaaaaatcggtgaccctggttatcagccatctgctcgatccgcaacacagccagcgctacgaagagtggctcggtaaaattatgcccattgcggcagaatttcccggccatcttggggcgaatgtgatccggcccgccgcagggcagaatctgtggagcgtcataatccgcttcgataccctggagcacctctacgcctggacgcagtcggaaacccgtcggcaactggtggctgagattgccccactgctgacggaaggcgatcggactgaggtgcggactgaaccggccttctggtttaccccgccgacggtgaacgtacgccagccgcggcgctggaaacagtttctgatcaccctgctggtgattttccccagcaccaacctggtgcctgcggtgaccggcatgctgctgccgtcgcttaaggggagcctgctgctgcacctcatcaatgatgcctgcgtggttgcgctggtggtctggttctggatgcccatcgtgacccgcctgtttgctggctggttgaagaaaaactga

SEQ ID NO: 6006 - DNA, 729 bp, Klebsiella pneumoniae
gcagaggaactccggcgtcagccaccagacgttgcccggcagaatggaccaggcgtgttcgtcgttcaccacctccttcaccgccagcggcagcaggttccaggcggcaaagtaccagaacagcagttggaccagcagcggagtgttgcgaaacaacgagacccacgcggccaccagtccgcgccccgcgcgtccgccgccgaggcgcagggccagcagcaggaccgccagcagggtggcgagcaggatcccggcgacgctgacccagacggtggtgagaaaaccagagataatccattgcaacggctgcccgctcaggacgccgtgccagtcaagcatcggcgtcactcgaggctctcctggtgcagcggatccagcaccttctgcagaaaacgccgtgcgcgggcatgctgcggatgggcgaaaaactcagccggcggggcgacttcgaggatgtcgccgccgtcgataaacaccacccggtcggcaatttcgcgggcaaactgcatctcgtgggtcaccaccagcatggtgatcccgctgtgggcgagggttttcatcacctgcagcacttcgccgatcatctccgggtcgagcgccgaggtgggctcatcgaacaggataatctgcggcgaggaggccagggcgcgggcgatggccacccgctgctgctggccgccggagagttgcgccggcatctgctgcgctttttcttccagtccgacctga

SEQ ID NO: 6007 - DNA, 708 bp, Klebsiella pneumoniae
agcagtggttgtgaaaaggtacatgatatgagtagtgcaacgatggcaattttgaccatcggcgttgtgccgctggcgggagtattgccgctcctgaccgaacatatcagggaagaacagatcgcccacatcagcctgctgggcgagatgacgcctgacgaggtaatggccgagtacgccgtaggtgacggcgagaaaggactcctgaccttgctcagtaataaccagttggtgatggtgtcgcgacagaaaattgaacgcgatgtccgcagcgcgatcgcgatgctggatcgacaacattatgatgtgatcctgctgctcagttccgaacagctgaccggttttaccacccaccacgcgatcctcctcgagccgcagcggatcatcccgccgctggtggcatcgatcgtcgatgggcaccaggtaggggtgatcgtgccggtggaagagatcatgcccatgcagcggcaaaagtggctctcgctggaaaagtcgccatactacgcgctggccaatccgtttaccggcagcgacagcgagctattaaccgccggcaaaacgctgctggagcagggcgccgacgtgctggtcctcgactgtctcggttactatcagcatcatcgcgatgtgttacaaaaagccctcgatgttccggttttgctgtcgaatgtgctggtttcccgactggcggcagaactattggtctaa

SEQ ID NO: 6008 - DNA, 192 bp, Klebsiella pneumoniae
atcgccttctgctcggcgtcgcaggatattgtgttcgacgcctggaaaaacgacgtgttgcaagcagaagagcgtggcgcccggcgccgcgatcagcgtgctgggctatcgcctggggatgctggtctccggtggaactggccctgtggcttgccgaccgctatctcggctggcaggggatgtactggctga

SEQ ID NO: 6009 - DNA, 450 bp, Klebsiella pneumoniae
acgccactctgccgccgggacgcgccacccggtacagctcgccaattgccgcccgtagatcgtcgcaccactgcaccgccagattgctccacgccagatcgacgcaggcgtccggcagcggcagcgcctcaatatcccccaacagataatgctgcgcggcgtcgttacgctgcgcctgggcgagcatcccggcggagagatccagcgcggtcaccacgctgcccgcctcacgccaatagcgactcatactgccggggccgcagccggcatccagcacctgcgcaaaatcgcggcgcgccagctggcgcagcagtagatcggcgcagcgccgctgcagttcatcatgttgcgtatagccgctggccgcccggccaaacgccgcggccaccgcctgcttattcactgtggccatgcagcacctccagtaaacggttaatgtcttcagcatga

SEQ ID NO: 6010 - DNA, 1632 bp, Klebsiella pneumoniae
tgttatgtctggacatccagatggctaatattatttcgttgtatcttatgctttttacgcagttgtcagccagcggcggctatgaaaaattcgttaaatcagaagattaattgccgcacgggagcagtgatgagcgcgaatcgccttgagatgcataacattagcctggccttctccggctttcaggcgctgaacaaggtggactttaccctccatggcgggtcggtgcatgccctgaccggggccaacggcgcgggtaagtcgacgctgatggccgtgctgtgcggcacccacgcccactatgagggcgaagtgacgatcaacaaccagccggtcatcattcgttcgccgcgggatgctaaacagctggggatccacctggtgcagcaggaggtggacgtggcgctggtgccgggcctgagcattgcggaaaacattatgctggacaggctggcggagtcgggcatgaccttccgctggtcgcgggttcggcagctggcgcgcgaggcgctggcgcagctggatgtggcgctggacgtccggcgctccattgacagctgcacgctcgccgaaaaacagcaaatcctgttggcccgcgccctgtcgcaccattgccgctttttgatcctcgatgaacccaccgcgccgttggatcagcatgaaagtgagcgtctgtttgcggtagtacgccgtctgcagcatcaggggatcggggtggtgtttatttcgcatcgtatccatgagctgaaggcgatctgcgacaccctgacggtgctgcgcgacgggcggctgattgagagcggcccgatggcgccgctgagcggcgaacagatcgtcgaaaagatgctgggccacgagctgagcgatatcttcccgccgccgcgcccgccgcacggcgaagaggtgctgctgcaggttgacggtctgcatgatgaggcgctgctgcaggatatttcgctgcgcctgcggaagggggaaattcttggtatcgccgggctggccggcgcgggcaaaaccgagctgtgcaaagcgctgttcggcgccagcaaaagccgggtgcagcggggcgagctgaacggccagccgtggcgaccgcgcgatccagccgactcggtggggcgcggcctggcgctggtcccggaggagcgacgcaaagagggcattttcattgaagagccgatcgcgatgaacctggcggtcagcgccgataacagcttttcgcgctggagcctgtttggccatcggcaggcctggcgctgggcggaggaggtgattgcccgcctcggcgtgcgcgctaccggtcccggtcagacgctgcgccgtctttctggcggcaaccagcagaaggtggccattggcaaatggctgcgcggtgatgccaacgttttgatttttgacgaaccgaccaaaggggtcgatgtgaaagcgaaaaccgatctgttcatgctgatcgatggtctggcacgggaaggcaaaggggtgatttatgcctcgggtgaattcgccgagctggtcggtttatgcgaccgcatctgcgtactgtgggacggacggatcgtagcggagatccccggcgcggaagcccgggaagagacactgctttattattcaaccggaggagcggcagcgtga

SEQ ID NO: 6011 - DNA, 1764 bp, Klebsiella pneumoniae
caatcaccctgttttcttgtcaaaatacgtcctcacgcgcggcggccatcacgtgctatgctgcgcgagctaaagtcatctacagcggagcgttgttacaccatgatggacaacctacgcacggccgccaacagcgtcgtgctcaagattattttcggtatcattatcgtctcgttcattttgaccggggtgagtggttacctgattggcggtggcaaaaactatgccgcaaaagtgaatggccaggagattggccgtgggcagtttgaaaacgccgtcgccagcgaacgtaaccgtatgcagcagcagcttggcgatcaattctccgagctggcggcgaacgaaaactacatgaaaaccatgcgccagcaggtgctgaaccgcctgatcgatgagtcgcttctggatcagtatgcccgcgagctgggcctcagcatcagcgatgagcaggtgaagcaggcgatcttccagacccaggcgttccagacgaacggtaagttcgacaaccagcgtttcagcggtattgtcgcccagatggggatgaccaccgaacagtacgcccaggcgctgcgtaaccagctgaccacgcagcagctgattaacgccattgcgggtaccgacttcatgctgccgggcgagtccgatcagctggcggcgctggtatctcaacagcgggtggtccgcgcagcgaccatcaacgtaaatgccctggcggcaaaacagaccgccagcgatgaggaaatcaacgccttctggcagcagaatcaggcccgttttatggcgccggagcagttccgcgtcagctacatcaaaatggatgccgccagcatgcaggagagcgcctctgacgaagagattcagtcatggtacgaccagcacaaggatcagttcactcagccgcagcgcaaccgctacagcgtgattcagaccaaaactgaagccgatgcgaaagcggtactggccgagctgcaaaaaggagcggacttcgccacgctggcgaaagaaaaatcgaccgatattatctctgcccgcaacggcggcgatatggggtggatggaagatgcctctaccgtgcctgagctgaaagatgccgggctgaaagagaaaggccagctgtctggcgtgatcaaatcctcggttggcttcctggtggcccgtctggacgacgtccagccggcgcaggtgaagccgctggctgacgtgcgtaatgacattgcggcgaaagtgaagcaggaaaaagcgttggatgcttactacgcgctgcagcagaaggtgagcgatgcggccagcaacgataatgaatcgctggcgagcgcagcgcaggtcgccgggctgaaggtcgtagaaaccggctggtttggccgcgataacctgccggaggagctgaactttaaaccggtcgctgacgctattttcaacggcggtctggtgggtgagaacggcgcgccgggcagcaactccgatatcattaccgttgacggcgatcgcgcttttgttctgcgcattagcgaacacaaagccgaggcggtgaagccgcttgccgaagtgaaggcacaggttagcgatatcgttaagcacaataaagcggaacagcaggcgaaactggaggccgacaagctgctggcggcgctgaaagacggcaaaggcgatgaagacgatgaaggcggctggcctgagctttggcgcgccgcagacgctttctcgtaccggccaggatccgctgagccagctggcatttaccctgccgctgccgcagcagggtaa

SEQ ID NO: 6012 - DNA, 936 bp, Klebsiella pneumoniae
  unsure (189): Identity of nucleotide at the above locations are unknown.
tcggcgccctggtgctctcctggcctccatcgcctcgaaaaacctgatccccggggccattattccggtggggatcgtcacttccctggtcggggtcccgttctttttgagcatcattttacgtcatcgggggcaggtatgagcgaccagacattatccgggctgtcgctgtctcacttcagcgccggntaccccagacgcaaggtgatcgagaacctgacggttccccatctgccgcgagggaaaatcaccgcgctgctggggccaaacggcagcggtaaatcaacgttaatgcgggcgatggcgggtctgggcccctgccgcggcgagctgctgctggagggggaaaatctgctgacgcagccgttctcacgtcgcgcagagcaggtggtctatcttccgcagacgctgcccgccggcgtgcatctgcatgtgctggagtcgataatcgttgcccagcgcgccgccggaggacgccacagtccgaagcgccaggaggaagtgatggcgctgctgcgacagctggggattgcccatctggcgatgagctacctcgatcagctctccggcgggcaaaagcagctggtgggtctcgcccagtcgctgatccgccagccgcgcctgctgctgctcgacgaaccgctcagcgcccttgacctcaactaccagtttcacgtgatggatctggtgcgccgggagacccggcggcgcaacatcgtgaccctggtggtggtgcacgacatcaatattgccctgcgtcacgccgaccacgtgctgatgctcaaggcgggtcagctgctcggcgacggcaccccggccgcggtcatcacccccgagactctggcggccgtctatggggtgcgcgggcgtattgaaccctgttcgcagggggtgcggcaggtgattattgacggcctggtggacagcgaggcctga

SEQ ID NO: 6013 - DNA, 1356 bp, Klebsiella pneumoniae
ccggcgccctgccgaccctccacgatcgctacggcatctccaccgcgaagattgtcgaaaaaattaagtatcgtctgcgttaaccgcgctgctatgacccactggccgctgagcgcgctcagcggccttctcatgcccgccagccaggcgcggcattcttttgcagattttatgcggcctgtcacaaaatctgctagactgcgccccttcatggcattgtggtttttgccatctcttatcgcaataatctccctgaaaactacgccctttaccgggccggggcggttcggagttgttatgtcttttgattcccttggcctgaatcccgatatcctgcgcgctgtcgctgagcagggctacgttgagccgacccctatccagcagcaggcgatcccggcggtactgcagggccgtgacctgatggccagcgcccagaccggcaccggtaaaacggcgggctttaccctgccgctgctgcagcgcctgatccagaatgagccgcacgcaaagggccgtcgtccggtgcgcgcgctgatcctgaccccgacccgtgagctggcggcgcaggtgggcgagaacgtccgcgattacagtaaatacctgaatattcgctcgctggtggtcttcggcggcgtgagtatcaacccgcagatgatgaagctgcgcggcggcgtcgacatcctcgtcgccaccccgggccgtctgctggatcttgaacatcagaacgccgtcagtcttgataaagttgaaatcctcgtgctggacgaagcggaccgtatgctggatatgggctttatccatgacatccgtcgcgtactggctaaactgccggcgcgtcgacagaatctgctgttctcggcgaccttctccgacgagatcaagggcctggccgagaaactgctgcacaacccgctggaagtggaagtggcgcgtcgtaacaccgcgtccgagcagatcacccagcacgtccattttgttgacaagaaccgcaagcgtgaactgctgtcgcagcttatcggcgaaggcaactggcagcaggtgctggtgtttacccgtaccaagcatggcgccaaccacctcgcggaacagctcaacaaagacggcatccgcagcgcggcgatccatggcaacaagagccagggagcgcgtacccgcgcgctggccgactttaaatccggcggcattcgcgtgctggtggcgaccgatatcgccgcccgcggtctggatatcgaagagctgccgcacgtggtgaactacgagctgccgaacgtaccggaagattacgtccaccgcatcggccgataccggtcgcgcggcggccaccggcgaagccttatcgctggtgtgcgtggatga

SEQ ID NO: 6014 - DNA, 1509 bp, Klebsiella pneumoniae
tgtcggccctgccggcgacgctgccggtctctctcgaagtgccgcttgacggcgagcaaggcgccctgccgcctcttcagcgggcgcagttactgttcgatgccgcgcagccctacctgcgcgcctgcgcataaggaatacgctatgacacagactcaacgcctggatgtcagagagttaataaatcgtaacccgctgagccgatttcagaagctgattatatttctcggcttttgcgtcatcgctctcgatggttttgatatcgcgatcatgggctttatcgccccgacgctaaagctggaatggggggtaagcaaccaccagctgggtctggtgatcagcgccgcgctgatcggcctcgcgctgggggcgattttctccggcccgctcgccgactggctgggacgtaagaaaatcatcatcaacagcgttttcttcttcggtttctggaccatcgccaccgccttctcgcacaacgtagaacagatgatgttctttcgctttatgactggcctcgggctgggcgccgcgatgccgaatatcgggacgctggtgtcggaatacgccccggaacgccagcgttcatttattatcaccgtcatcttttgcggcttcaccttcggcgcggcggcgggaggattttcggcatcgtggctgatcccccagtttggctggcactcgctgatggcgctcggcggtattctgccgctgctgtttgcccccctgctcatctggctgctgccggaatcggttcgttttctggtgatcaaacaagcgcccgcggcgcgcatacgcgccattcttaaccgtctctatcccggacaaatcagcgacaacgtgaggtttatcctgccggcgcagccggcggccggcaacgcgatgcgcattgtcctctcccgccagtacggtttcggctcgctgatgctatggctggtctactttatggggctgttcctggtctatatcctcggcagctggctgccaacgctggttaaagcggtaggaatgaccgttagccaggcggccatcatgacggcgatctaccaggcgggcggcaccctcggctcgttgtttgccggctggctgatggacaggatcaacccccatcgcgcgctggggataatctacgccgttggcggcctgttcaccatggcgatgggctacgccgcgggcagctttgccttgctctgtatgctggcgtttatcagcggcgcctgcctgaacggcgcgaataccggcatgaacgccctctccgcccgctactaccctacacaggcgcgggcgacgggctccagctggatgcacggcgtcgggcgcatcggcgccattctcagcgcctttgccggcgccgagatgatggcgctcaacctgccctttgaaagcgtctttttgatcctcggcatcccggcagccctcaccgtcgcaggcctggcggcgaagggcatctttgcggccggtcatcctgccgtcgcttcaacttcccccgcgtctgtgcgcggagcgtcatag

SEQ ID NO: 6015 - DNA, 219 bp, Klebsiella pneumoniae
atcaatgcctgctgggcatcatgctccatatggcgcaataatgcggtgaccacgatctccagcgcttcaacctgcaccgtcagttcctttgcttcttcttccttttgcgccagtttaaccagtaactcagcaatgagattcttcatagcaccagttccttatgcgaggcctgttttgattgggatgtcatacgcgatgacggacctcagaattacttaa

SEQ ID NO: 6016 - DNA, 228 bp, Klebsiella pneumoniae
ttgtcttactgcttcttcgatggctggggtacctggattcgaaccagggaatgccggtatcaaaaaccggtgccttaccgcttggcgataccccaataccgtcgcggtgaaccgcaaatatcgaagaaatatggctggggtacctggattcgaaccagggaatgccggtatcaaaaaccggtgccttaccgcttggcgataccccatccgtacaacgctaactggtga

SEQ ID NO: 6017 - DNA, 1260 bp, Klebsiella pneumoniae
cctgataactgctactgtgaatgcttatccctcccatctggaatcactatgctaaccaccatcatttatcgcagccatatctgcgacaatgtctcattcaaatcgatcgaggccatggtcgccagggcaaacgaaagaaatgggcaggcggacgtcaccggtattttactttttaacgggacgcatttttttcaactcattgaggggcctgaagaaaaggttcaggatatttatcagcatatctgccaggatcctcgccactataatctggtggagttgctttgcgattatgcgccgtcccgtcgttttggtaaggtcgggatggaactgtttgatttacgcgaacacgatcgcgaggaagttctgcaggcggtgatggaccgggggacgtcaaaatatcagctcacctatgatgaccgggcgctgcaatttttccgtacttttgtcgaagccacagaaaaagcgaactattttgagattccttccgcagatagttgggtttttattcctgataaggagacgttctatcctgataccccgattatcgataatacggaaggttgttcctttgccttccagccgattgtcgaccctttcgcctgcgaaattatttcgtgggaagcgctgttgcgtacaccggacgggcaatcccccggcgcctattttgccgggctgatcggggacgatatttatctcgctgacctgcacagtaaacgggtggcgttgtcgctggcgggaaaattaggtttacgtaataaggcgttaagcattaatttactgccgatgaccatggtcaaagcgccgaatgcggtgtctttcctgctcgacgaaattagtcgcaatgaccttattccggagcagattattgtcgagttcactgagcgggaagtgatttcgcggatggacgattttaccgatgcggtgcgcaaactgaagggcgcgggaattaatcttgccatcgatcacttcggcgccgggtttgccgggctatcgctgctggcgcaataccaacccgacagaattaaaatcgaccatgagctgatccgcaatatccaccaggacggaccgcgccagtcgattgtacaggcgattatcaaatgctgtacttctctggagattgcggtctcagccgtcggcgttgagcgtgctgaagagtggatgtggctggaatcagccggtatttcacagttccagggtaatttgttcgccagcgcgcgcctggggggcctacccgccgtcgcatggccggagaaaaaatga

SEQ ID NO: 6018 - DNA, 567 bp, Klebsiella pneumoniae
cccagatgctggcgcgccttgccagagctgaccttgagatccattcccagcaccagcgctttgccggaggtgggcaccagcaggccgcacatcattttgaaggtggtggatttcccggcgccgttggggccaagcaggccgaaaatttcaccgcgcttaacctggaaatcgacatggtcggtagcggcgaaatcaccaaactttttcgttaacgactgggcttcaatgaccgtttcctctttgctgccgtcaacgcgatggataatcgcccccaacggcgattcagcggtcccggcgccgccgagcaggtcgataaacgcatcttcaaagcgcggcgcggtgtcggccacctgcaggggcggcatgtcgccatgctgctggacttcctcaatgcgcgcgtcctttttcaggatcagacgcaccgatttgccctggatcaccccgtcgctaacctgcggcagcttcagcgcccgctgcagcaggcggcggttgttctcctgctggctggaaaccagaaagctgcgcccggccatggtttgcgtcagcgccgtcggctcaccctggtag

SEQ ID NO: 6019 - DNA, 399 bp, Klebsiella pneumoniae
cccggcagctgcagctcatcgccggttgagaagaccgcgacgcgtaccttgcgcaccacctcgacctcggcaatgcccagcgaggccagcaccggcagctcggccaccgtcaggggtgtccccgccgggaagaccaccgcgccgtgggcaatatcttctccgcggcggcgaatatgctgcccggcttttaccggcgcgataaagcgcacgccggcctcggtctgttcagtctcttcctgcatcaccaccgcatcgcagccttccggcaccggcgcgccggtcatgatgcggatacaggtccccgacggccaggcgtcgttgaacggctggccggcgaaggccttaccggcgaccggcagcgccgcgccgtcgcgaaggtcgttcagccggacggcatag

SEQ ID NO: 6020 - DNA, 705 bp, Klebsiella pneumoniae
catagaagctgtagccctgctaagcgcagcgcgggcaggggcattaccggttgcgccgttattttgccgggtggcggctggcgccttacccggcctaccggggcctctcacaggatcacacctcgcaggcccggtaagcgcagcgccaccgggcgatgccatcaggcacggagccgctttattgccgggtggaggctacgccttacccggcctaccggggcctctcacaggctcacacctcgtaggcccggtaagcgcagcgccaccgggcgatgccatcaggcacggagccgctttattgccgggtggcggctacgccttacccggcctaccggggcctctcacaggctcacacctcgtaggcccggtaagcgcagcgccaccgggcgatgccatcaggcacggagccgcttttatgccgggtggcggctacgccttacccggcctacggtccgcgtcatgtttagccttccccctctccccgccgggaagagggattgcctcaggcgctggcgccgtccagccgcgccacttgctccgcgctcaggctcagcgccgccgcgcgggcaaaactctccacctgagccacgctggtggcgctggcgatcggcgcggtcaccccttcgcggccgatcagccacgccagggcaacctcagccggcttcgcgccctgctcgtccgcgaccgccgccagggtatcgataa

SEQ ID NO: 6021 - DNA, 402 bp, Klebsiella pneumoniae
actacgagctgccgaacgtaccggaagattacgtccaccgcatcggccgataccggtcgcgcggcggccaccggcgaagccttatcgctggtgtgcgtggatgagcataagctgctgcgcgatatcgagcgcctgctgaaaaaagagatcccgcgcatcgcgattgccggctatgagccggatccgtccattatagccgaatctatccagaacggtcgccagcagcgcggcggcggtcgtgggcaaggtcagggacgcggcggccagggtcagggacgcagcggacagccgcgcagccagaataatgccccgcgccgtcaggacggcgaggcgccgaaagcgcgcactcaggacggcaaaccgccgcgccgccgtcgcccgcgtaaaccggctggcgaataa

SEQ ID NO: 6022 - DNA, 1119 bp, Klebsiella pneumoniae
cagcggggctgctggcggcatgttcgagtgatgacgtgcaacaaaaaacggtcagtactccacagccggccgtctgtaatggcccgacggttgagatcagcggcgccgatccgcaatatgaaacgccgaacgccacggcgaatcaggattatgagcgcgacgtgtaaaagctacaaaatcgttcaggatccggccaactttactcaggccggtttcgcggcgatctatgacgcagaacccaacagcaacctgaccgccagcggcgaagccttcgatccgactcagttgaccgcagcgcacccgacgctgccgatcccgagctacgcgcggatcactaaccttgccaacggacggatgatcgtcgtgcggattaacgatcgcggtccctatggcaacgatcgggtcatctcgctttcccgcgcatccgctgaccgcctgaacacctccaacaacaccaaagtgcgcatcgaccccatcatcgtcgcgcctgacggttcgctttccggcccggggatggcctgtaccaccgtcgccaaacagacttacgcactgcccgcccgtccgaatctggacggtggggacgccgctggcatgagccagcccgcacccactgacgttcgcccgatcagcaacagcacgctgacgccggcagacagcgtgggcgcgccggtgaacagcggcggtttcctcggcgcgccgacgcccctgaacaacggcgtgctggagagtagcgaaccagcggcagccgccgcgacggctcctgccgccggcgccacgccaacagcgccagtgaccgcgcctggctccattcagggtaatgtggcgcccgctgcggccaccgccgcagccgctggcgccgtggcggcctcgtcctccgcgacctccagcgccagcggtaattttgttgtccaggtgggcgcagtaagcgaccagacgcgggcgcagcagtatcagcagcgcctgagccagcagttttctgtgccaggccgggtcatgcaaaacggcgcggtctggcgtattcagctgggtccctttgctgataaagcacaggccagcgccgtgcagcagcgcctgcaaagcgaagcgcagctgcagtcctttattactcgcgccaactaa

SEQ ID NO: 6023 - DNA, 804 bp, Klebsiella pneumoniae
agaatgagactgattcccctggtaaccgctgagcaggtcggtaaatgggctgcccgccatatcgttaaccgcattaatgcatttaaaccaaccgcggaccgtccgttcgtcctgggtctgccaaccggtggtaccccgctgaccgcctacaaggcgttggttgaaatgcataaagcaggccaggttagcttcaagcacgtcgtcacctttaacatggatgaatacgttggcctgccgaaagagcatccggaaagctatcatagctttatgcaccgtaatttctttgaccacgttgatattccggcagaaaatatcaacctgctgaatggtaacgcgccggacatcgatgcggaatgccgtcgctatgaagaaaaaattcgttcctacggtaaaatccacctgttcatgggcggcgtgggcaacgatggtcatatcgcgtttaacgaaccggcctcttctctggcgtcccgcacccgtattaagaccctgacccatgaaacccgcgtagcgaactcccgcttcttcgacggcgatgtggatctggtgccgaaatatgcgctgaccgtcggtgtgggcaccctgctggacgcagaagaagtgatgattctggtgctgggtcatcagaaagcgctggcgctgcaggcggcggtagaaggtaacgtcaaccacatgtggactattacctgtctgcagctgcatccgaaggcggtgatcgtctgcgacgaaccgtccaccatggagctgaaagtgaagacgctgaaatatttcaacgaattagaagctgaaaatattaaaggtctgtaa

SEQ ID NO: 6024 - DNA, 1092 bp, Klebsiella pneumoniae
cttgtgctatgtcacacttttcacttctttgatatgctatcttcctcacaaacgataagccgaatggagcgaatcatgaaagttctggttacaggtggtagcggttacattggaagtcatacctgcgttcaactgctgcagcagggacacgaggtggtgatcctcgacaatctctgcaacagcaagcgcagcgtgctgccggtgattgaacgtctcggcggcaaagaagccacctttattgaaggcgatattcgtaacgaagcgctgatgacggagatcctccacgatcacgccattgaggcagtgatccacttcgccgggctgaaagccgtcggggagtccgtcgccaagccgctggaatattacgacaataacgtcaccggcacactgaaattagtctctgccatgcgcgccgctggcgtgaagaactttatctttagctcctccgctaccgtctacggcgatcagccgaaaatcccgtatgtcgaaagcttcccgaccggcaccccgcaaagcccctacggcaaaagcaagctgatggtggagcagatcctgaccgacctgcagaaagcccagccggagtggagcattgccctgctgcgctacttcaacccggtcggcgcccacccgtcgggcgacatgggggaagacccgcaggggatcccgaacaacctgatgccctacatcgcccaggtcgccgttggccgtcgcgaatcgctggccatttttggtaacgactatccgaccgaagatggtaccggcgtgcgcgattacatccatgtgatggacctcgccgatggtcacgtcgcggccatggaaaaactggctgacaaagccggggtgcatatctacaaccttggcgccggcgtcggcagcagcgtgctcgacgtagtcaatgctttcagcaaggcctgcggcaaacccattaactaccatttcgcgccgcgccgcgatggcgacctcccggcctactgggcggatgctgccaaggccgaccgcgagctgaactggcgcgtaacgcgcaacctggacgaaatggcgcaggacacctggcactggcagtcccgtcatccgcagggttatccagactaa

SEQ ID NO: 6025 - DNA, 690 bp, Klebsiella pneumoniae
tcagggagactcatgaaggaaaataacgcgcttttgcgtctcgacggtgtggggtttaagaccgacgacgccgttattttacacaatatcaattttcagcttcgcgccggagaattcaagttgattaccggcccttccggctgcgggaaaagtaccttgctgaagattatcgcctcgctgctcagcccaacctccgggcgcctgttcttcgacgatgcggatgtcgcgacgctgtcgccggaaaggtatcgccaacaggtctcttactgcgcgcagacgccggccctgttcggtgattcggtttacgataatctgatttttccgtggcagatccgcaataaacaaccggatccgcaggcgctgctggccgacctgcagcgctttggccttgacgaaaatatgctggaaaaatccattaatgaactctccggcggggaaaagcagcgcgtatcgctgatccgcaatctacaatttctgccgcgcgtgctgctgctggacgaaattaccagcgcgctggatgaaagtaataaacagaatgtgaatgaaattattcatggctacgcaacggaaaaacaggtcgctgttctgtgggtcacccacgatcgcaatgaaatttcgcatgccgatgaagtgattacgctgcaacctgccggcggaaatatgcaggaggtacagcatgaacgggcataa

SEQ ID NO: 6026 - DNA, 549 bp, Klebsiella pneumoniae
ggcttaggacttattagaaacacatttgaggtggttatgaataaaattgcacgtctttcagcactggccgttgttctggctgcatccgtaggtaccactgcatttgctgcaacttctaccgtaaccggcggttacgcgcagagcgacatgcagggtaaagcgaacaaagctggcggtttcaacctgaaataccgttacgagcaagataacaacccgctgggcgttatcggttccttcacctacaccgagaaggataacaacagcaacggtacttacaacaaaggtcagtactacggcatcaccgctggtccggcttaccgtctgaacgactgggcaagcatctacggcgtagtgggtgttggttacggtaaattccagaacaacaactaccctcataaatccgatatgagcgactacggtttctcctacggtgctggtctgcagttcaacccgatcgaaaacgttgctctggacttctcctacgagcagtctcgtattcgtaacgttgacgtcggcacctggattgctggcgtgggttaccgcttctaa

SEQ ID NO: 6027 - DNA, 204 bp, Klebsiella pneumoniae
gttcgtcaatggtgtgaatcagcaggcgttgtatttctgtcatcttggtcctcgaattctgcaatgagcctgccgcgcccggcggaccaggcgcggcaggctcagcctgaaggctattttatgttgcaatattctgcggagaaagtaacagatcagttacagaaaagcataacagttacggatttgtcggcggaaggcgcttaa

SEQ ID NO: 6028 - DNA, 228 bp, Klebsiella pneumoniae
ataactgaatggtatatctctgcaaaatcactgatgaggcatcgagagttaccggcaggcaatcgcgtcaagctgaaagagcatacccgcagctcctccatcatgggcaaactcggtttggatagattttctggctggataattgccgttaaatctttggcgcatgatcttttccattattgggatattccacacgtccctaaacaaagcatcaattttaacaactga

SEQ ID NO: 6029 - DNA, 438 bp, Klebsiella pneumoniae
atttaccgatgcgcggatcgccctggggcgcagcggcgccagtctgccgacccgcgaagtcctcaactttggtctggcccatgccagagcgcgggatgccattcatcagccgttcgccagccaacaattggtggcgccgctggcggcgctcggcctcgatgccctgacggtgcacagcgccgcgccggaccgtcatacctatctgcggcgcccggatctcgggcggcagctcgccgacgagagtcgcgccgacctcgccgccagcggcgtccgccccgccgacctgctgctggtgatcggcgacggcctctcttcctgggcggtagagcgccaggcggtgccgttgatccgcgccctgctgccctatctgcagacgctgggtatcggcctggcgccggtggtgctggcgcatcagtcgcgggtggcgctgggagatga

SEQ ID NO: 6030 - DNA, 375 bp, Klebsiella pneumoniae
tccagccgatggtgccgaacacgcggaccaccgggaaggttttatcgacattggccaggctgtggaaggcgatattgttggtcagcgccagggtcggcatatagcacagcgtatagccgaacagcaggccaatcagcagggcgccgttctgcgccaccagcgcctgcgggacaaaccacaggatcgccgccccggccaggtgcatcaccgccatcaccttctgcgaggcgaaaaagcgatccaccagcatccccagcacaaagggagacaagatggaggcgatcggcccggcggagaacgcatcgccgatcagcaatgacatctcatagcgggtcatcaccagccccagggtcaccgaccagctgccccagataa

SEQ ID NO: 6031 - DNA, 729 bp, Klebsiella pneumoniae
tcatccatgtgtcatgtaccatcatctcgacggggaggccctatcatgtctgctttgttaaaagccagccgtaatgatgcgataatagcccgttgtttacagactatttcccagttaattccactaacttcagcggtgttttatcgagtaaataatcgtttaaaacccgaaaactatatattgcataatatttccgataatacgcaccaacaatatctggaaaacttccagccgctggatccgcttctgccgtcgcactttagccaccagaacaccaccgtggcggcgatgacgccgcggctctgcgaccgcaaccggcattactatcatgaatttatgttgccgaataacgtgcgcgacatgaccgagatctttatccgccgcgagcggcggatcgtcgccggtatctcgctgatgcgcgacgtgcctttctccagcgaagagcgccagcgggcccaggcggtgctgccgctggtagagctggccattcgcgactgcctgcaggaagaagatgatctgcccgccatcctgacggcgaaagagcgggaaatcgtcggcatggtgcgcgaaggcgccagcaataagctgattgcccgccagctggatatctcgctctcgacggtaaaaacgcacctgcgcaatattttcgccaagaccgaagtggtcaatcgtaccgaactggtttcccgaacctggatgccggccgctcagcgtacgctgcatctgtaa

SEQ ID NO: 6032 - DNA, 1014 bp, Klebsiella pneumoniae
  unsure (17),(306): Identity of nucleotide at the above locations are unknown.
cgcaggatgtgctgcancggctgtacggcgatgaagttagccaattgcattaatttcactcacacgggcaacataatgaaaaaatatatgactggcgcagttcgtttatccgcaatggtcgcgggcatgatgatggcatggcaggcagcggcggcgcagccgaaagagctcaatctgggcattctcggcggccagaacgccacccagcaaatcggcgataaccagtgcgtgaaggccttcctcgataaagagctgaacgtggataccaaactgcgcaactcttccgactattccggggtgatccanggcctgctggggggcaaagtcgacgtggtgctgagcatgtccccctcctcctacgcctcggtttatctcaataatccgaaagcggtggatatcgtcggcatcgccgtggacgacaaagatcagtctcgcggctatcactcggtggtgatcgtcaaagccgactccccatacaaaacgctggacgatttaaaaggcaaagccttcggcttcgccgatccggactccacttccgggtatctgatccctaaccatgcgtttaaagaaaaatttggcggtaacgccgacaacaaatacaacaacaccttctccagcgtcaccttctccggcggccatgagcaggacatcctcggcgtgctgaatggccagttcgcgggcgcggtcacgtgggcctcgatggttggcgattacaacaccggctacactaccggcgcgttcaaccgcctgattcgcatggatcatccggatctgatgaagcagatccgcattatctggcaatcgccgctgatcccgaacggtccgatcctggtgagcaatgcgctgccggcggactttaaggcgaaggtcgtggcggcagtgaaaaagctggacaccgaggatcacgcctgctttatcaaagcgatgggcggtactcagcacatcggcccgggcagcgtggctgacttccagcagattattgatatgaaacgcgagctggtgagcgcgcgttaa

SEQ ID NO: 6033 - DNA, 1827 bp, Klebsiella pneumoniae
ccaaattcgtgcagacgccggttaagtacacgccgggccagtcgaagaattacaccgtggaaagtcagcgcgaaaacctgctcaacattatccagaacggccagcagacgggacgataagatgccaatttatacagatgatccggggcagggtataaaccagccgttgtcgaatgccccatcaggacttggtgaatcgctgctttcctccctgaaagaggggttcaaagaggggcctgttgtgtctggttatcggttttctcaagccgaccaactggcaaatgacccaaattcgaccatcgtcagcaaatctgacgcagaaacacgccttaaagagtacggcgtgaaaagtatcaatgtgcctgacagcggcgttacgcaaacattcctcgatcatgtgatcagcgagcgcagggaaactctggcgaagcagcagatcgccatgtctgccccgtctggatgggttgccactccgcttaactttgccgcaaaccttgctggctcaatggcggatccaggcaacgtggcgctggctctggtcccgttcggtggtgaagcgaaggcggcaaccatgctagggcgcttcggtgagcgtcttgctaccggcgcgcggcttggtgctgggcaggccattgccacagtacctctgacggcgcaggcagcagcggcagaaggcgatgacttcacctacggcaatgctctggagagcacattctttaacaccattgccggtgggcttatgcacgctggtggtggtctgatcgctgatgtggtgcgctcccgcagggttggcgctgctgaaaatcccgcgacctatccagacgctcagcccgtcgctgatgcgcaaccaacgccagtcgtgacgcctgacaacatcccggctggcgttaacattcctgagtccgacaccaatgccgatctgtcagcggcaatcgcacgggatgcagaatcttatgcctatagccgcgcctatgatgatgtcgttcctgaatatctggccaggcagcaggaactacagaccggacgcatcgacaacgttgctgatcttcgcactgagctggcggccaataaccgacaaagtgaagcgcttgacgctacgctggcgcagcgcacgacggagtatcaggcgcaacgcatgaatttcaaagcggctcaggccaaggcacagcgtgatattcagggtgagaaagacaccattaccgcgcgtaatcaggaaattaaccagacgcttgaacgtaacgccatcgcagagcaggcgcgcggcagagagtcgcaactgtcacgcaaagagatcccggaagacctagcaccattaatcgaccagcgcgcacagcagatccgcgaaagcatgcagatgtcacctgtcgccggtgcagtgcgtacagcgtctgccgcggtgcgggaggcagactggagcgtaaaccagcaggcttaccgcggcgcactggcgcacatgatggaaggccgctctccggacattgagcctttctatgatctgcacaaaccagcgctacgcgagcgtgctatccaacgcatccagaatccagtgcggcaggctgatgaaggttcccgcgccgtcagtgaaactgcagatcgtgtgtggcaggatacgcagaaggctgaccatgaaatcacagcggccactgccgatctggaaaatgaattcaatatcagtgatgcgctgctgaacgacattgccacagacaacccagatctggctgcgtctatgcgcgagaacattgcttcgatccgtgcagaggccagtgacgactctatcggcaaagcgtatcgcgctttcgccgcctgtatgattaaccgggggttgtaa

SEQ ID NO: 6034 - DNA, 876 bp, Klebsiella pneumoniae
gcattgccgtgcgccaaatcacggcaatataatgagaatagttatcaatcaataacacatacaccatcacattcagcgcaccgttcgcggcgcgagggatggcgtgtagagaggagtgagagaatggctgtaactaagctggtactggttcgtcatggcgaaagccagtggaacaacgaaaaccgcttcaccggttggtacgacgtggatctgtccgagaaaggcgttagcgaagcgaaagcagcgggtaaactgctgaaggctgaaggcttcagctttgattttgcttatacctccgtgctgaaacgtgccatccacaccctgtggaacgtgctggacgaactggatcaggcctggctgccggttgagaaatcctggaagctgaacgaacgtcattacggcgcgctgcagggcctgaacaaagcggaaaccgctgagaaatatggtgacgagcaggttaaacagtggcgtcgcggcttcgctgtcactccgccggagctgaccaaagacgacgagcgctacccgggccacgatccgcgctatgcaaaactgaccgacgcggaactgccgaccactgaaagcctggcgctgaccatcgaccgcgtcgtgccttactggaacgaaaccattctgccgcgcctgaaaagcggtgagcgcgtgatcatcgccgctcacggtaactccctgcgcgcgctggtgaaatacctcgacaacatgggcgaagacgagatcctcgaactgaacatcccgaccggcgtaccgctggtatatgagttcgatgaaaacttcaagccgatcaaacattactatctgggtaacgcggaagagatcgcggcgaaagctgctgccgtcgccaaccagggtaaagcgaagtaa

SEQ ID NO: 6035 - DNA, 300 bp, Klebsiella pneumoniae
tgcgcgccgtgggcgaccgggtgtttattaccggacggcgcgaagcgccgctgcaggctgtcgccaatgagaccggcgccacggcgctggtgggcgatgccgccgacggcgaggtgtggcgccagcggctgctaccggcgatcctcgaccagaccggcgggattgatgtcctcatctgcagcgccggcgggatgggcaacagccccgccgccgagaccagcgaccgccaatggcgcgaggcgctggacggcaatctcaccagcgccttcgccagcgttcgcgcctgcctgccttcgctga

SEQ ID NO: 6036 - DNA, 315 bp, Klebsiella pneumoniae
ttggcccagtgcgcctgctggcgaaaagcggcggcaagtccggcgattttaaggtgggtgaatgccatgattaaggttctgttttttgcccaggtgcgcgagctggtcggtaccgattcgctgacccttgatgccagcgaactggcgactgtcgaagcggttcgtcagcagcttgccgcccgcggcgatcgctgggcgctggccctggaggagggcaagctgctggcggcggttaaccagacgctaacctctttcgaacatccagtggccagcggcgacgaagtggcgttcttcccaccggtaacggggggctga

SEQ ID NO: 6037 - DNA, 600 bp, Klebsiella pneumoniae
gcggtctggtgtgaggaacaaactatgtcattgattcgtccggcacttgtgctatttattctgttaacgctgctcaccggcggcgtctatcctctgcttaccaccagcctgggacaatggtggtttaactcacaggccaacggctcgctgatccgcctgaacggtgaagtgcgcggctcggcgctgattggccagaacttcaccgccgcaggctatttccagggccgcccgtcggccaccgcggagacggcggataatcccatggcctctggcggcagcaacctcgccgccagcaacccggcgctggataaagcggtgagcgagcgcgtgcaggccctgcgcgccgccaacccggacgccgacccgcgggtgccggtcgaactggtcaccacctcggcgagcggtctcgataacaacctgactccggccgccgcgctgtggcaggtgccccgggtggctcaagcgcgccagctgagcgttgagcaggtaacccagttggtgaatcaggccacacaaaccccgctgctgagcttccttggccagccggtgatcaatatactgcaactcaatatggcgctggatgccctgaaggataagtaa

SEQ ID NO: 6038 - DNA, 969 bp, Klebsiella pneumoniae
tttaaacggtgtaagagtcgcatgggggccgtcgtccaccgggccgctgtaaacccggaacaattaataatatctattcactattacttccgtatatcccaggtgatactgcaacacaagcgaagcccatcacacatcggggaatataccatggcaaaactggcggcatttgatatggacggcaccctgctgatgccggaccatcgtcttggagaaaagacgctttccgcgctgaaacggctgcgtgagcgcgatatcaccttgaccttcgccaccggccgccatgtgctggagatgcaccatgtgattggcgaattttcccttgatgcatttctgatcaccggcaacgggacgcgcatccattcgctggaaggggaggagctttatcgccaggatctcgctcccgaggcggcagaagcggtgctgcacggcaaatgggatacccaggccagcatgcacgtctttaacgatggcggctggttcaccggccaggcaaggcctgaattgttgcaagcgcatgtattcagcggctttcactatcaactgtgcgatctgaagcgtatgtcggcgcagcatgtcaccaagatctgtttctgcggcgatcatgacgatttgcgccgtctgcggatccagctgaatgagacgctgggcgatcgcgcatttctctgcttctcggcaatggactgtctggaggtgctgccggttggctgcaataaaggcgcggcgctggcggtgctcagccagcatttaggcttcaccctgcaggagtgcatggccttcggcgatgcgatgaacgaccgcgagatgctgggcagcgttgggcgggggttcatcatgggcaacgcgatgccgcagctgaaagccgagctgccgcatctgccggtaattggcgactgccggaatcaggcagtctcccattttttaactcattggctggataatcctgatcttccttattcccccgaatag

SEQ ID NO: 6039 - DNA, 840 bp, Klebsiella pneumoniae
cctatcaggtgcggcagattgagagctataacgcgcacgccctggaggcgtttgccgtcggcaccgcgctgtacctggcgctgggggtggcgatgggcgtggcgttcacgcgtctcggcccgggaagaaaactgcaacggagcgcccgacatgaacgctaatctggcggtgatcgccgataacctcgattacctgctgtggggccgactggcggagggccagcccggcggcgtggcgctgaccctgctgatggccatcggcgccaccctgctggcgctgccgggaggcattgcgctggcgggcctggcctggcgctacggcgggctggtgcggcgtctgctgtttctgtgggcggaaattatccgcggcatcccgctgatatttgtcatcttctggctgtggtatctgctgccgatgctgaccggcggcgatctgcccggcgcggtgaccgtgaccctggcgctggcgtggtttaccgccgcctcggtgatgcactcggtgctggccgggctgcagtcgctgccgaaaggacagtatgaggcggcgctgacccaggggttcgctcccgggcaaacgctgcgcctggtgctgctcccgcaggcgctgcgcaacgttcagccgtcgctggtggggatctttatcggcctgctgaaggacacttcgctggcgtttatcgtcaacgtcccggagctgaccaccgtggccggccaggtcaacaaccgggtgcagatctatcccctggcgatcttcgtcttcaccggcgcggtgtactacctgctgtgctgcggtctgagcctgctggccagccggcgctttacccgccgcgcgaccaccagataa

SEQ ID NO: 6040 - DNA, 612 bp, Klebsiella pneumoniae
aataacaggtggcataatgcgaatcgttatcaaacagatgaggctactgtagcacagttggctgacggaaaatggagggggttggtgaaaactgctcaacttttacaaacgctgaacgaccagctgagtgagctggccgcgctggtggcgccgctggcggagcacgcgaccctcagcccgcgctttgaccgccagctcttccacacccgcagcacgctgatgcaggcctatctggcggaagcccaacacaactttaaccagctccgccaggccgtcgagcgccagcagctgccgcaggtggtctggattgccgagcgtctggcggcacaaatcgccgcgctgcgccgtgaaaccgccacctggtccttgcgcagttgggaccacgcgtcgccaacgttgagccgctggcagcgccgtcgcctgcagcatcaggagtatgagcgccgcctgctggcgatgcgcgaccaacgccagcgtcagctggcgcaggcgaccagccttgacgagcagcagcggctggggaaagaagttgaagcctatagcggccggttggcgcgctgccgacaggcgctggacaagattgaaaacgtactggcgcggctgacgcgctaa

SEQ ID NO: 6041 - DNA, 846 bp, Klebsiella pneumoniae
attcagaggtgtgaaatgaatccctacagatatgatattcagacgctggagcgtaaagcccgcgcggtgcggcgccatattgtgcgcttaaacgccaatagtccggccggcggccacaccggggctgacctttcgcaggtcgaactgttaaccgcgctctatttccgcgtccttaacgtcgcgccggaccggctcgacgacccgcagcgcgatatctacatccagtcgaaaggccacgccgtgggctgctactactgcgtcctggcggaagccggcttcttcccggtcgagtggctggagacctaccagcatgccaattcccatctccccggccacccggtgcggcaaaaaacgccgggcatcgagctcaacaccggcgcgctgggccacggtttgcctgttgcggtggggctggcgctggccgcgaagaaaagcaacagcacccgccgcatttttttgatcaccggcgacggcgaactggcggaaggcagtaactgggaagccgccctggcggctgcacattacggcctggataatctggtcattattaatgataagaacaacctccagctggccgggccgacgcgcgaaatcatgaataccgatccgctggccgataaatggcgcgccttcggtatggaagtcagcgaatgccagggtaacgacatggcctcggtggtctcggtcatcgaggggttgaagcaggaaggtaaacccaacgttattattgccaacaccacgaaaggtgccggtatttcctttatccaggggcgcccggagtggcaccaccgggtgccgaaaggcgaagaaattgcactggcactggaggaactgaaagatgagtaa

SEQ ID NO: 6042 - DNA, 471 bp, Klebsiella pneumoniae
atcaggaggtgtaccatgaaaaagatgatttctctggcagtaattttatcctgtgtgttgagcgtcccggcctttgccgatggcccgaacgacggccatcgtccggggcaacccacggtgtggcagaacggtccggaccatgacgggcatgcaccgcagggcggacctgacgcgcatcatcagggcgaccatgaccagcgtggcccggatcgcgacggccatgacaaacgcgatctggcacgtcatgagcaggaccatttcgcctggcgcgggaacgatttccgcaaaggccacccggctccggcgccgttccgtggcgatgaatatcgcgtccgcgactggagcgaccgcggcctgccgcccccgccggaaggccatcactggtcctatatcgacggtaactatgtgctgatcgccgcggcgaccgggatcatcacctcgattctggtgagcggcgccctcggccactaa

SEQ ID NO: 6043 - DNA, 1290 bp, Klebsiella pneumoniae
tctgactttcgcatcccgcgcgcgccgtggcagcacggcgttttcctgatgcctgtgggtatcactccctggaggatcctccggggggaggcttttttgaccggagcacgccctacgatgtcgagtacacctctcactgataatgcgctttcccggcccgccgggctgatggtgtccctgcgtttgctggcggcgatcgtgatttttgccgctattgcgccgggtattctgatgaccgcgccggcggtggcggcgcagctggccagcgaatggcagctaaaacccgggcagatcggctggctgttctcagcggagctgggggcgatgagcctggcgacgctcccggcgtggtggtggatgagccgcctcgactggcggcgggttgccctgacggccggggtggtgtttctggccgccaacctcgtctcggcggtggtcacccagtacgagacgctactggcggcgcgctttatcgcctcgctggcgggcggcacgttgatgattttgtgcatcagctgcgcggccggaacgccgaacccgtcgcgggtctacgccttctgggtgctcgggcaactgctgttagggatgcttggcctgctggcgctgcccggcctgttcgcgacctttggcctgaaggtggtgtatctgatcctcgccgccatcatgctctgctgtttgccgctggtatccgctttccctccgcgctttcaaccgctttcagtctcccgccagcagccgtcgacggcgctgtggcgtcaagcgctggcggtgctggcggtgctcactttctatatcagcctcagcgccgtgtggacctttatcggcaccatcggcagcgcggcggggctgagcccgacgcaggtcggtctggtgctggcggcggcgacggtttgcggcattatcggcgccggcggcgcggccctgcgcggcacccggcgggccgatcgtttaccggtgtggctgggctacggcctgttgatcgtcagcgttgggctgctgatcggccagccgctgctggtgcgttacgccatcgcggcgctgctgtttaagttcacctggaccttcgtgctgccctttattctcgcccgcgtggccgggctcgataacagcggtcggctaatgaacagcatcaatctggtgatcggcggcggcatggcggctggcccggcgcttgcgggggccttactgcaacacttcgccagcgccgacccgctgctggcggcggcaggcgtctgcgcgctgctgtcactgattttaattgtggcggcatccgccgccgggaaggcttag

SEQ ID NO: 6044 - DNA, 1143 bp, Klebsiella pneumoniae
agacgctttcgccttcctgttcttgattctggtcctcttgttccgcccggtcggcattatgggcgacgaacgtctggaaaggagccgtttctgatgctcaacgcgacgacgaccgccggggcgcagctgcgcaacctggtcattattgtcatctgtatcgcgctgctggccggaatcaacgtggttttcaatgactacattgttcgtgtcatcagcaccatttttatctttatgatcctcgcggtcagctacaacctgatcaacggcgtgaccggccagctgtcgctggagccgaacggcttcgtggcggtgggcgcctacgtgaccgccctgctgatcctctccagcgacagcaaggtagacatgtttgaaatggccgcccccagcccgtggatcctcagcctgcacgcgggcttcctccctgccctgctgataagcggcctgtgcgcggcggcgctggcggtgtgcctcgccgtgccggtcttccgggtacgtggcgactacctggccattgtcaccctcggctttgggtttatcatcaagatcctcgccattaacaacccgcaaatcaccaacggcgccatcgggctgaacgatattccgcagcagccgcatctcctgttctggtgcgggctgttcgccctgctggccaccggcatgatcctccagctggtgtggtcgaagtatggccggatgatgaaagctattcgcgacgatgaagatgcggcgatcgccatgggggtcaacaccttccgcattaaaacctgcgccttcgccaccagcgccttcttcgaagggatcggcggcggtctgctggcttccctgctgaccaccatttccccggggctgttcgactttatgctcaccttccagctgctgattattatcgtcctcggcgggctcggcagcaccaccggcgccctgctcggcaccgtgctggtggtcggcagcggcgagtggctgcgcttcctcgatcagccgctgcagttcttcggtcacgatctcggcgcgtacccgggcctgcgaatggtggtcttctccctgctgttgctgattatcatgctcttcgcccgcgaggggctgctggggaaaaaagagatttggcagatgggaagaaggaacagcagctatggcggaaaataa

SEQ ID NO: 6045 - DNA, 987 bp, Klebsiella pneumoniae
cgatgtcttcgtcgcagtacgccatcgcggcgaccatcacgatcctgctgtcgatctttgtcgtcggcctggcgctgtggcagttccgcgccaccaaatccttcaaaaatgacgacatggcgtaagggaagcaacatggctcaatcacccagtattaaacgcgaaaagtggatccggctctctctcacctggctggtggttattctggtctcggtggtgattatctatccgctggtctggacggtcggggcgtcgctgaacgccggcaatagcctgctcagtacctcaatcattccggaaaatgtgtcgttccagcactatgccgatctgttcaatggcaatgtgaattacctcacctggtactggaactcgatgaaaatcagcttcctgaccatggtgctgaccctgattagcgttagctttaccgcttacgccttctcccgcttccgctttaaagggcggcagaacgggctgatgttgttcctgctgctgcagatgatcccgcagttttccgcgctgattgccatctttgtgctgtcgcaactgcttggcttgataaacagccacctggcgctggtgctgatctacgtcgggggaatgatcccgatgaatacctggctgatgaaagggtatctcgacgcgatccctaaagacctggatgagtccgctcgcatggacggcgccagcagctttcgcatctttatcgagatcatcatgccgttgtcgaggcccatcctcgcggtggtggcgctgttctcgttcactgggccgctgggggatttcatcctctccagcaccatcctgcgcaccccggataaatacacgctgcctatcggtctgtataacctggtggcgcaaaaaatgggtgccagctacaccacctacgcggcgggggcggtgctgatcgccgtaccggtggcgatcctctacctggcgctacaaaaatacttcgtctccggcctgacctcgggcagtactaaaggataa

SEQ ID NO: 6046 - DNA, 354 bp, Klebsiella pneumoniae
atgcccgttcgcctattcaggaaaagggtggcatgcatagagacggttatgaataacagtgaaactgaggaaataaccgatgaaatcatcggcgaggcggttctagcgcttctgaaaacgaatcgcccgattaccaccccgaccctgctggttcgacttcggttaatgcaggcgacagaaccagatcgccagcgtagaaagatcatcgctgccgtgatcgaagaaatttgcgcgaagcttatccgtcagcggaagtacgcgcctttacaggtaaagaaaatcaatggccgttgggaaaccagaggttcgctggcgccagacagcatgccgtcggaagctaaaaagatccactga

SEQ ID NO: 6047 - DNA, 1467 bp, Klebsiella pneumoniae
agtctccctcgttttgtttttttaagtattttttacatggagatgacaaaagtgaaattaagcgccctatttattgccctgattcctctactgggctcgccggttattcatgcagaaactactgctgcgccggttctggaaaatcgcgctgcgcagggagatatcaccactcctggcggcgcgcgtcgtttaacaggcgatcaaaccgaagcgctgcgcgcctcgttaatcaataagccagctaaaaacgttattttgctgattggcgatggcatgggtgattcggaaattaccgctgcgcgaaactatgccgagggggcgggcggtttctttaaaggaattgatgctctgccgttaaccgggcagtacacgcattattcgctggataaaaaaaccgggaaaccggactacgtgaccgactcggcggcctccgccaccgcctggaccaccggcgtgaagacttataacggcgcgctgggcgtcgatattcatgagaatgcgcatcagaccatcctcgagctggcgaaagcggcggggctggccaccggcaacgtttccaccgccgagctgcaggacgccacccccgcggcgttggtagcgcatgtgacatcgcgtaaatgctacggcccgacggttaccagcgaaaaatgccccagcaatgcgctggaaaaagggggcaaaggctccattaccgaacagctgctgaacgcccgaccggatgtcaccctgggcggcggcgcgaagacctttgccgaaacggcgacggcgggcgagtggcagggcaaaaccctgcgcgagcaggcgcaagcgcgcggctaccagattgtgaccgacgcggcttctcttgccgccgcgacggaagccagtcaggataaaccgctgctgggactctttgccgatggcaatatgccggtacgctgggaagggccgaaggcgtcttatcacggcaatatcgataagccgccggtgacctgtacgccaaacccgaagcgtgacgcctcggtgccgacgctggcgcagatgaccgagaaagcgattgacctgctgagtcgcaacgagaaaggtttcttcctgcaagtcgaaggcgcgtccatcgataagcaggaccatgcggccaatccgtgcggccagatcggcgaaacggttgatcttgacgaagcggtgcagaaggcgctggaattcgcgcgaaaagacggtaataccctggtgatcgtcaccgccgaccatgcgcatgccagccagatcatcccggcggatagcaaagccccggggctgacccaggctctgaacacgcacgatggcgcggtgatggtgatgagctacggcaactctgaggaagagtcgatggagcacaccggcacccaactgcgcattgcggcctacggtccgcatgcggctaacgtcgtcggcctgaccgatcagaccgacctgttcacgaccatgaaagctgccctgagtctcaaataa

SEQ ID NO: 6048 - DNA, 648 bp, Klebsiella pneumoniae
aggcggcctcggcttattcagccgtggtttttaatcggctataaaacaaagcagtctgcttgctacttcgaaaataacgatatgaagccaaaactgacgcatgctctctttttaattccttttttgttgttggcaggatgctcctcctcaccgaaacaggcaaagaacacaaaatctcatgcggatatgaccattgatagcgggtcggacgatctgatcccggtggtggcggccctgcatgatcagatgcacacctggcagggaaccccctatgaatggggcggtactgaacaaagcggcgtcgactgctcgggtttcgtctggcgcacgctgaaggatcgctttaacctgccgatggagcggatcaccacccgcgagctgctgcacatgggcgtgcgggtcaataagcgggatttacgtcccggcgatctggtgttcttccgcacccgggccgggatgcacgttggcttttacgataccgatcataatttccttcacgcctcgagcagccagggcgtgatgcgctcttcgctggacaacccttactgggaatcggcgttctatcaggcgcgtcgtctgccgaaggagtataacgcgcagatcaccatgaacagcgacaccctgcatctggcgaagaatcgccgctaa

SEQ ID NO: 6049 - DNA, 267 bp, Klebsiella pneumoniae
aattctgctcgtcgcccatgtgcaccagcagatcgaggtggccaaggttctcgccctcttccggcggcaggctcttcagttccaccgccgcgccgcgcagccgcagctcctgggccacctcctccatcgccgggtagcacaccgtctccatcatcagtttggtatagcgcgtgcccgggtaattcatcagccgcgacaggcgcttcttccagctcagacgatcctggaggcccatcgggcgcggggcggtgtcgcggctggcgctga

SEQ ID NO: 6050 - DNA, 1842 bp, Klebsiella pneumoniae
ttgcactatcgtgctggacgcgcgcctgccgcgcactctggccggtctgctggccggcgtcgccctcggcctcgccggcgcgctgatgcagacgctcacccgcaacccgctggccgaccccggcctgctgggggtcaactccggcgccagcttcgccatcgtcctcggcgcggcgctgtttgggatcacttccccgcaggagcagctgctgctggcattctgcggcgcgctctgcgcctcgctgctggtagcctttaccggcagccagggcggcggtcagctgagcccggtgcgcctcactctcgccggggtcgcccttgcggcggtactcgaggggctgtccaacggcatcgccctgctcaacccggacgtctacgatcagctacgcttctggcaggccggttcgctggatatccgcaccctgcaaacgctgaaaattgtcctgctgccggtagtggtggcggggatcgccgctctgctgctgagccgggcgctgaacagcctgagcctgggcaacgataccgccaccgccctcggcagccgcgtcgcccgcacccagctgatcggcctgatcgtcatcaccgtcctgtgcggcagcgccaccgccgtcgtcggccccatcgcctttatcggcctgatgatgccgcatatggcgcgctggctggtgggggccgatcatcgctggtcgctgccggtcaccctgctcgccaccccggccctgctgctgtttgccgacgtgattggccgcctgctggtgcccggcgaactgcgggtatcggtggtgagcgcctttctcggcgcgccggtgctgatctggctggtgcgccgccagccgcggggaggtggcctgtgattgccccgtcccgccgcctgatagccagctgtctgctgctaacggccgccagcctgctgatttccctgctcgggctggcgcaaggcccggtgcccctgacgattgaccaggtgttctcggcgctgttcggcgatgcgccgcgcaacgtcgcgatggtggtgaacgaatggcggctgccgcgggtgttaatggcgctgctcatcggcgccgcgctcggcgtcagcggcgccattttccagtcgctgacccgtaacccgctcggcagcccggacgtgatgggctttaacaccggcgcctggagcggcgtgctggtggcgatggtcctcttcggccagaacctgacggcgattgccctggcggcgatggccggcggggtgctgacctcgctggtggtctggctgctggcctggcgcaacgggatcgagaccttccgcctgatcattatcggcatcggcgtgcgcgccatgctggtggcattcaacacctggctgctgctgcgcgcctcgctggagaccgccctttctgcgggcctgtggaacgccggatcgcttaatggcctgacgtggggtaaaacctggccgtcggcgccgctgatcctgctgatgctggtgggcagcgccctgctggttcgccggatgcggctgctggagatgggcgacgataccgcctgcgcgctgggggtgcaggtcgagcgttcgcgcctgctgctgatgctggtggcggtggtgctcaccgccgcctcgacggcgctggccgggccgatctcatttatcgcgctggtggcgccgcatatcgcccgccgcctgagcggcacggcccgctggggactaacccagtcggccctgtgcggcgcgctgctgctggcgctggccgattacggcgcccaacggctgtttatgccgtggcagctgccggttggcgtgttaaccgtcagcctcggcggtatttaccttattgcattgttgattcaggagtcccgcaaaaaatga

SEQ ID NO: 6051 - DNA, 240 bp, Klebsiella pneumoniae
tgcggccatcggccatcaccaggatgcggtcggccagggccatcacctcatccagttccgaagatgagaacatcaccgccagcccctgctgagccattttgccgatcaggtgatagacgtcggttttcgcgccgacgtcgatgccgcgcgtcggttcgtcgaggaacaccacctgcggctgggtcatcagcgctttacccagcaccactttttgttgattgccgccgctcagcgaggtga

SEQ ID NO: 6052 - DNA, 906 bp, Klebsiella pneumoniae
aaacctaatcgactacggtctggattcggtgcggatgatggccctggccgcccgctggcgcaaagtgcacggcgatatcgacttcgtgatgctggcgaaaaacccgaccatcgacgcctggtgggcgctgctctcccgcgaggtgcactaatggcggcgctggattttcgcggtcagaccgtgtgggtgaccggcgcaggtaaagggattggctatgccaccgcgctggctttcgtcgaggccggggccaacgtcaccggtttcgacctcgcctttgacggcgaaagctacccgtttgccaccgaaacgctggacgtcgccgatgccgaccaggtacgcgaggcatgcagccggctgttggcgaacaccgagcgtttagatgtgctggtgaacgccgccgggatcctgcgcatgggcgctaccgaccagctgagcgcggaagactggcagcagaccttcgcggtcaacgtcggcggggcgttcaacctgtttcagcagacgatggcccagttccgtcgccagcggggcggggcgatcgtcaccgtcgcctccgatgctgcgcacacgccgcgcatcggcatgagcgcctatggcgcctcgaaggcggcgctgaaaagcctggcgctgaccgtaggccttgagctggcgggcagcggggtgcgctgtaatctggtgtcgccgggctccaccgataccgatatgcagcgcaccctgtgggtcagcgacgatgcagagcagcagcggatccgcggcttcggcgagcagtttaagctcggcatcccgctgggtaaaatcgcccgcccgcaggagatcgccaataccattctgttcctcgcctcttctcacgccagccatatcaccctgcaggatatcgtggttgatggcggctcgacgctgggggcgtaa

SEQ ID NO: 6053 - DNA, 1542 bp, Klebsiella pneumoniae
ctgataaatcgctattcatgcagaacgatcgactttcgctttacgccaggaaacacacttcatatgcagacaacatcatcgcagccgcgggcgatctactacgtcgtggcgctgcaaatctgggagtactttagcttttacggcatgcgcgccctgctgatcctctatctcaccaatcagctcaaatatgacgataaccatgcctacgccctgttcagcgcctactgttcgctggtctatgtgacgccgatcctcggcggctatctggccgataagctgttaggcaaccggatggcggtcatgctcggcgcgctgctgatggccattggccatctggtgctcggggccagcgaaaccgctccggttttcctgtacctgtcgctggcgatcatcgtctgcggctacgggttgtttaaatccaacgtcagctgtctgctgggcgagctgtacgaacccgccgatccgcgtcgcgatggcggcttttcgctgatgtatgccgccggcaatatcggctcgattatcgcgccgatcgcctgcggctacgtacaggaggagtatagctgggcgatgggctttgccctggcggccatcggcatggtcgcggggctggtgattttcctctgcggcaaccgtcatttccagcataccgctggcgtcaaccgccaggcgctgtgcgcgcgccgcttcctgctgccgaactggggctggctgctggtattgctggttaccgccccgctgctgattgcggtactgttctggcaggagtggtcggtgtatgccctgatcgtggccacggccattggcctcgcggtactggcgcggatctacctgcgcgccgaaaccgataaacagcgcaaggatctgcgcctgatcgtcgtcctgaccgccttcagcctgctgttctgggccttcgcccagcagggcgggagctccatcagcctgtatattgaccgcttcgttaaccgccatatcatgagctacgaagtccctaccgctatgttccagtcaatcaacgccttcgcggtgatgctctgcggcatggtgctggcgtggctggtgaaagagagcgtgaacggcaatcgtaccgtgcgcatctgggggaaatttgccctcggtctgggcctgatgagcgccgggttctgcattttgaccctcagcgcccgctggtcggcggcctatggtcagtcgtccatgccgctgatggtgctgggtctggcggtgatgggctttgccgaactgtttatcgacccggtcgccatgtcgcagatcacccgcattgagatcccgggtgtcactggggtgctgaccggtatctatatgctgctctcaggggccatcgccaactatctggccggcgttatcgccgaccagacctcgcaggcgtcattcgacgccgccggagcggtgaactactccattgacgcctacattaccgtcttcagccagatcacctggggcgcgctggcctgcgtcggcgtggtgctggtcatctggctgtatcattcgctgaaagtcaagacccgccgtctggcggtggagtaa

SEQ ID NO: 6054 - DNA, 339 bp, Klebsiella pneumoniae
gccattgatcgtcggcggcctgcttatcttcgtgctcggcagcgtcatcgccgcgctcaccgactccatctggggcatcattcttggccgcgccctgcagggctccggcgccatcgccgccgcggttatggccctgctgtccgatctcacccgcgaacagaaccgcaccaaagcgatggcctttatcggcgtcagcttcggcgtcaccttcgccatcgccatggtgctggggccgattgtcacccaccagctgggtctgcacgcgctgttctggatgatcgccatcctggcgaccgtcggcatcctgctcaccctgtgggtggtgcccaacagccataa

SEQ ID NO: 6055 - DNA, 1473 bp, Klebsiella pneumoniae
agcgaagatcgccgaggatattaccgacgcgctgatgaaaattgctgcgactcactcttaatcagcatagagggaacgaccatgcaggctattcttagtttcttaacggaaatattcagtcaacccgcctttttaatggggcttatcgccttcgttggtttagtggcgctgcgctcccccggtaacaaactgcttaccggcacattgaagccgattttaggctatttgatgttgagcgctggggcaggcgttatcgttgccaatctcaatccgctgggcggtattatcgaggccggatttaatatccgcggcgttattccgaacaatgaagccattgtctccgtcgcccagaagatgctgggcgtggaaaccatgagtattttgctgttaggctttattttcaacctgattatcgcccgttgtaccaagtataaatatatctttctgaccggccatcattcgttctttctcgcctgcctgttctccgccgttctgcaggcggcggagttccagggctggatgttgatcctgatcggtggattcctgttgggctcatggtcggccatctccccggccatcggtcagcgttacaccaggcaggtaaccgaagacggcgggatcgccatgggccatttcggctctctcggctactacctctcggcatggatcgccagccggaccggcaatccggcaaattccttcgccgataccgaaatttcagaaaagtggggctttctgcgcgataccacggtcaccaccggtatcgtgatgtttgttatctactttgtctgcagcgctgtcgccgggtcggcgtacctgagcaccatcaccgaccaaaacatgctgatcttctcggtgctgaccggtctgcagttcgccgttggcgtagccattgtctataacggcgtgcggctgatcctcggcgatctggtgccggcgttccagggcatcagccagaagctgatcccggactccatcccggccgttgactgcgcggtgttctttacctttagccccaccgcggtggtagtgggattcatcagctcctttgtgggcgggcttgtcgggatgctcttgctcggcgggctgggcatggcgctgattattcccggcatggtgccgcacttcttctgcggcggcacgtccggcgtcttcgccgacaaactgggcggtaagcgcggatgtatcatcgcctcctttatcggcgggatcttcctcgccttcctgccggcgatgctgctgccggcgctcggcaacctcgggtttgaaaacagcaccttcgccgatttcgacttcgcggtatggggcatcattatcgggaatgcgttcacccagtttggtcagatcactatctatctgatttgtctggcgctgctcgtcgcgctgctggcgcctttctgcttccgtcacgtccaggtggtgggcaacacgctcagctatgaggagcttacggcgaagcagaaaaatgaataa

SEQ ID NO: 6056 - DNA, 552 bp, Klebsiella pneumoniae
cgactggatcgtagaggcccagcctggctatggatactggctggattacctgatcaccgaagtgatgccgagggccgactgatgccaacattacgagaatggaaagagcgacggccggcaagcgacatcaaacagacggtggagttttatcaccctgcgtttggttattaccgggtggtcaataacctgtttcgcccggcgacgtttggcggaaactcgttcgagcctgcgcggttcagcgtgaccgagccggcgcaggacggaacggcggtcatctcaatgatgataacctttgtcgccgcgacggagcatgtccggcagacactgaaaagctggcgcggggcggcgcgcatgacgccgataaagtgcctgtatcagcagtggaacgcgatcggtgacacggcgtcattgaaagactggacgctttacgtgaacgacatttcagccgatgccagcaacgtcaccgtgaccgcaggcaagaccaatccgctgacgctggccaactccatcatttacaccacgaaagactatcccgggctaatcaccgtatga

SEQ ID NO: 6057 - DNA, 1170 bp, Klebsiella pneumoniae
tacttttgtcgctattgttttgcagtgagaggtggcggtgagcgttttttcaaatggcccctgttacaatcatgggataacaacataaggaaccggaccatgaagtctaaaagcgctactctggaagacgtcgcacgccatgcgggcgtctcttaccagaccgtgtccagggtactcaacaaatcagctaatgtatccgaagcgacgcgtcgcaaggtggagaaatcgatagaggccttacgctatgtgccaaaccggctggcgcagcagctggtggggaaggagagccagacggtcgggctggtgactatttctctggcctggcatgcgccttcccaggtggcggcggcggtaaaacgctatgccaacctggaaggttaccaggttctgatttcgatgatcgatgagagcgtcaaccaaagcatccaggattccatcaatgaactgaaatctcagcgggtggataaagtcattatcaacgtgccgctggagaccgaacaggcgcagaaaatcgctgctgacaacgatgatatcgtctgcctgtttctcgatgttgatccctacagttccgtgtttaacgtttcgtttaacccggcggacggcacccgggccagcgtcaaatatctctatgagatggggcatcgggagatcgcgctgctggcggggccggacagctcagtctcggccaaactccggttaaaaagctggctggagaccctggatggttacggtctgaagccggtgaccgtcctgcacggcaactgggatgcgcagagcggctacgcctgcgcgctgcagatgctgcgcgaaacgcctaatttcagcgctgtgctggtgggtaatgatcagatggcgctgggggtgctcagcgccttccatcagcatcaggtggcggtgccgggtgagaagtcggttattggctatgacgatacttacgaaagctcctttttctatccggcgctgagtaccgtgtcgctcgacctcgacctgcaggggaaagaggcggtgcggcggatcctcgccagcaccagcggggcgcctcatacctcatccattctgccggcgcgcctggtgatacgccattccagcggcgcccgaatcgagcagggaaaagatctgcaggccattgcggaacagctccgcgccatcgcccaccgtctggcaccctga

SEQ ID NO: 6058 - DNA, 1155 bp, Klebsiella pneumoniae
gacaggagtcgtcaaatgatcgattatgaagtattgcgttttatctggtggctgctgattggcattctgctgattggttttgccgtcgccgacgggttcgacatgggggtgggcatgctcacccgcttcctcggccgcaacgacaccgagcgtcggattatgatcaacgccatcgccccgcactgggacggtaaccaggtgtggctgatcaccgccggcggcgcgctgttcgctgcctggccgatggtttacgccgcggcgttctctggcttctatgtggcgatgattctggtgctggcctcgctgttcttccgtccggtcggttttgactaccgttccaagatcgaggacacccgctggcgcaacatgtgggactggggcatcttcatcggtagctttgtgccgccgctggtgattggcgtggcctttggcaacctgctgcagggcgtgccgttccacgtcgatgaatacctgcgtctgttctataccggtaacttcttccaattgctgaacccgtttggtctgctggccggtatcgtcagcgtggcgatgatcctgactcagggcgccacctacctgcagatgcgtaccgtaggcgaactgcacctgcgtactcgcaccgtttccatggtggcggcgctggtgacgctggtctgcttcgcgctggcgggcgtgtgggtctactacggcatcgacggctatgtggtgaaatcggtgattgaccataccggcccgtctaacccgctgaccaaggaagtggtgcgggaagctggcgcgtggatggtgaactttaacaatatgccagcgctgtgggcggtgcctgccctgggcgtggtgttgccgctgctgaccgtcgtttcgaccaaagcggataaaggtgcctgggcattcctgttctcctcgctgaccctggcctgcatcattctgactgccggtatcgcgatgttcccgttcatcatgccgtccagcaccatgctgaacgccagcctgacaatgtgggacgcgacctccagtcagcggacgctgaacctgatgacctacgtggcgattgttttcgtgccgatcattctggcctacaccagctggtgttactggaagatgtttggccgcatcacgcgcgaagacatcgaaaagaatacccactcgctgtactaa

SEQ ID NO: 6059 - DNA, 222 bp, Klebsiella pneumoniae
tcaattggtcgcaggttcgaatcctgcacgacccaccaatttcagcatttaactcagatgctgaacgtgaaggataacgttgcgtcagcaacggcccgaagggcgaggcaaagccgagtcatcctgcacgacctaccaatttctgaattggtctcgagtgaaattattcaggtagtaccagatcgggtcgttagctcagttggtagagcagttgacttttaa

SEQ ID NO: 6060 - DNA, 231 bp, Klebsiella pneumoniae
tggttgatgctcgctactgataatcgggtaatcatcattcaatggcacaagctcgaaatgctggcagcccaggtgatccgtgtaagtaggccgatattttttaaaggtcgcttgagccccaccgtttttggccacaacaaactctccgggggttggctcaacttcggggtctacaatgatcacatctccagccttgaagtctggctccatcgaatcgccttcgatgcgtaa

SEQ ID NO: 6061 - DNA, 210 bp, Klebsiella pneumoniae
gccgccacccggcaatatgaaggcatgatgactgataaattacccggcggcgctgcgcttgcgcggacctggggggagcctacgggaggaccccgtaggctggggaatgcgctaagccgctatccgggaagctggactagacccgggttccccagaggtcgtattcgtcggcgtgctcgactttcacccgcaccacgtcgcccggcttaa

SEQ ID NO: 6062 - DNA, 699 bp, Klebsiella pneumoniae
gacatgacccgacgcgccgaccgtttatttcagattgtgcagatcctgcgcggcaggcggctcactaccgctgcgctgctggcggagcggttgggcgtgtcggagcgtaccgtctatcgcgatattcgcgatctctccctctccggcgtaccggtggagggcgaagcgggcagcggctaccggctgctggcgggctacgatctgccgccgctgatgctgaccaccaaagaatccgaggcgctgatcgctgcgattcggctgctaaaaacctggggcggtgaggcgctgtcgcagtcgctggagtccgcccaggaaaaaatgctggcgatcctgccggaggcgcgtcggcgccaggcggagcagactcgcctgtttgcccccgatttcggcgcccatcgctatgctaaaaaccattttgacgtcattcatcaggcggtctccggccagcaggtgctgcagctgcgctatcaggatgagacaggccgggtgaccgagcgcgacgtgctgcccctggggctgtttttctggggcgaacgctggctgctggtggcctggtgcgaactgcgcaatgattaccgcaattttcgcctcgatcgttgcctggaggtcagaaggaccgaacgtcgattcagcgagtgcgccgaccgctcgttaagcgattttttgcgcaaggtccggtgcgaggtgcgggagaaataa

SEQ ID NO: 6063 - DNA, 708 bp, Klebsiella pneumoniae
tctgctgcccgcaggggctggcccgcgaagcgcagcgctttctcaatacctatccggcggtgtggatggcaggccgcttcgacgccgaacgcgggagtcttcgaccacggcccgctgcacgagctggacagcggatttgagttctacgcgccgcagaccatgcaggccgacgatggccgccgcctgctggtcggctggatgggcgtccccgacggggacgagatgcatcagcccacccgcgcgcagggctggatccatcagatgacctgcgtgcgtgagctggagtggcaggctggcactctgtatcagcgtccgctgcgcgagctggtcgccctgcgcggggaagcccagggctggtgcggacagaccctgcccctcgccccgatggagctggcctttgacatcgcccccaacagcacgctggggctggactttgccggcgccctgcagctcaccgtcaatcgcgacggcctacgtctgtcgcgccgcggcctgcagacggcagagatgcatcaccgctactggcgcggcgaggcgcgacgcctgcggatctttatcgaccgctccagcgtggagattttcatcaacgatggcgagggggtgatgagcagccgcttctttccgggctatccggggcagctcatcttcagcggtgcgacgccggtggcattctgccgctggctgctgcggccatgcatggtagaataa

SEQ ID NO: 6064 - DNA, 834 bp, Klebsiella pneumoniae
tgtcattaccgtcacgtctgcctgcgatcctgcaggccgttatgcagggccagccgcaggcgctggccgacagccattatccgcaatggcatctggcgcccggtcaacggactgctgaacgatcctaacggcttttgccaggtcgccgggcgttaccacctgttttatcagtggaacccgctcgcctgcgaccatacctataagtgctggggacactggagctctgccgatctgctgcactggcggcacgaacctatcgccctgatgccggatgaagagtatgaccgcaacggctgctactctggcagcgcggtcgagttcgagggcgccctgactctgtgctacaccggcaacgtgaaattccccgacggcgggcgcaccgcctggcaatgtctggcgaccgagaatgccgatggcaccttccgcaagctggggccggtgctgccgctgccagaaggctataccggccatgtgcgcgaccctaaagtgtggcggcaggacgggcgctggtacatggttcttggggcgcaggatgtgcaacagcgtggcaaagtgctgctgtttaccgccagcgacctgcgggagtggcgcctggtgggcgagatcgccgggcacgacgtgaacggcctggcgaacgccggctacatgtgggagtgcccggatctctttccgctggcggacacccacctgctgatctgctgcccgcaggggctggcccgcgaagcgcagcgctttctcaatacctatccggcggtgtggatggcaggccgcttcgacgccgaacgcgggagtcttcgaccacggcccgctgcacgagctggacagcggatttga

SEQ ID NO: 6065 - DNA, 2130 bp, Klebsiella pneumoniae
ttaccctaccggtggaccacaacaatgaataattcagggaaataccttatctgggcgctgctctccgtcatcggagccttcgccctcggctatatcgctttaaaccggggtgagcagataaacgcgctgtggattgtcgtcgccgcggtctgcgtttatttgatcgcgtatcgtttctacggcctgtatatcgctaaaaccgtgctcggcgttgacccgacgcggatgacgcccgcggtgcggcataacgatggcctcgactacgttccaaccgacaaaaaagtgctgttcggtcaccattttgccgccattgccggcgcggggccgctggtgggcccggtgctcgccgcgcagatgggctacctgccggggatgatctggatcctcgccggcgtggtgctggctggggcggtacaggactttatggtgctgtttgtttcgacccgccgcgatggccgttcgcttggcgaactggttaaagaggagatgggaccgaccgctggcgtcctggcgctggtggcctgctttatgatcatggtgatcatcctcgcggtcctggcgatgattgtggtgaaagcgctgacccacagtccgtgggggacatacaccgtcgcctttaccattccgctggcgatctttatgggcatctacatccgctatctgcgtccgggacgcatcggcgaggtgtcggtgataggcctggtgatgctggtgttcgccatcatctccggcggctgggtggcggaaagcccgacctgggcgccgtggtttgattacaccggcgtacagctgacctggatcctggtgggctacggatttgtggctgcggtactgccggtctggctgctgctggccccgcgcgattatctctccaccttcctgaaaatcggcaccatcgtggggctggcgattggcatcctgattatgcgcccgaccctgacgatgccggcgctgaccaagttcgtcgatggtaccggcccggtatggaccggcaacctgttcccgttcctgtttatcaccatcgcctgcggcgcggtctccggcttccatgcgctgatctcctccggcaccacgccgaaaatgttggccaacgaaagccaggcctgctttatcggctacggcggcatgttgatggaatccttcgtcgctattatggcgctggtggcggcctgtattatcgatccgggcgtctacttcgcgatgaacagcccgatggcggtgctggcgccggcgggtaccaccgatgtcgtcgcctcggcagcgcaggtggtgagcggctggggctttagcattacgcctgatacgctgcatcaaatcgccagcgaggtcggcgaacagtcgattatctcccgcgccggcggcgcgccaacgctggcggtggggatggcctacatcctgcacggctcgctgggcgggctgatggatgtctctttctggtaccacttcgccattctgtttgaggcgctgtttatcctgacggcggttgacgccggcacccgcgcggcgcgctttatgctgcaggatctgctgggcgtgattagcccggggctgaaaaaaaccagctcgctaccggccaacctgctggcgaccgcgctgtgcgtcctggcttggggctacttcctgcatcagggggtggtcgatccgctgggcgggattaacaccctatggccgctgtttggtattgccaaccagatgctggcggggatggcgctgatgctctgcgcggtggtcctgttcaagatgaaacgccagcgctacgcgtgggtggcgctgctgccgaccagctggttgctgatctgtacgttgaccgccggctggcagaagtcgtttagcccggacaccaaagttggtttcctggcgatcgctaataaattccaggcgatgatcgacagcggcaacattccgccgcaatataccgaatcacagctggcgcagctggtgtttaacaaccgtctcgatgccgggctgaccatcttctttatgattgtggtggtggtgctggcgctgttctcgattaaaaccgcgctggcggcgctgaaagaggataaaccgacggcgaaagagacgccgtatgagccaatgcctgaaaacctggacgcgattgagacccaggcgaaaggggcgcattaa

SEQ ID NO: 6066 - DNA, 1206 bp, Klebsiella pneumoniae
caaatccaccgcgtggtgggccagcagggcggtattctgctgaacggtggtgagctgatagggctgccagtccgcctgcgggatatcgtcaaagccgacgatggccggcagcggggcggcggcgtcccgcaggccgtcctgggcgcccagcgccagcatatcggtggcgcaaaacagcgcctgcatcccggggttttcagcaaccaattctctggcagcctggttgccggcctgatagccgccgccgtcgcagaagcggctgctcaccgccatatccgacgtccgggcgataaaagcctcatagcgctggcgggtgctgaagttctcgcgattttcgccaataaagccaacctgccgccagcctcggcggctgaacagatccgccaccagcttcgctccctgggcgttatcgctgcacacccggtcgcagccggcgaggtccgcatggcggttgatcagggtgacggggatcttgcgcgccagatactcctccgccagcgacagcggcggcgcgccggaggtgatgatcaccccggcgacgtgatagctcagcagttgtttaagcgagggggcgagctgctgcggatcgtcagcgttcatcagcagcggcataaagccattgagcgccagctgatggaccagcggcgccagcagtttgctgcgaaacgggttgtcgaaaccggcggtgacgatgccgataaaattactgctgccggtgatcatcgtccgggcgatgatattcacctgatagcccagggcttccgcggcgctcagcaccttctgccgggtcttctccgacaccgaggcgccgggggtgaaggtgcgggagaccgccgagcgcgagaccccggccagtctggccacgtcctcggccttaatccattttttatcgctcatcgtcgtttcgcgccgtctgttttccaggaggccgacgcccgggcgggcgtcggtcacgcacactgcctgaaaaggtatcacagaaaggcgtcgtcgcgcagcgccttgcgccctatgccgggtagcggatgtgctccacctcacgctgcaaaatcaccctgccgtggcgaatggaggtcagcacccgtgcctgacgacggacggcctcgtagtcgttttccgcatcgaggatcagcaggttcgccgggcggccttcggcgaggccgtagttatcgcccagacagagcgcccgggcgctgttgtcggtga

SEQ ID NO: 6067 - DNA, 360 bp, Klebsiella pneumoniae
agcctaaaccgaagtggaacgctgtatgccccccatccttcgcaagcactacgagaaggtaaagccgatgggtgtcagcctggtgaaatttgtcagtgttattggccgcatgaatgggcggtatggagtggagtcatgaagctgaaaatgtataccccatccgggtctgtgatcgtcgaaaccaacgacgtcgcgcagttttacccagacgctgaaagcggcggagagctgaccacaatcgaactggtttcgccaaccggcgaccacgggaaggtggcagtaaaacatagcttccaccaggtgactagcgctcttgccacggcctggaaaatggatgaagacaaggcaggtgcagcatga

SEQ ID NO: 6068 - DNA, 1341 bp, Klebsiella pneumoniae
aaaactgaccggctacccggtcagccaccctcagtttcatctcaacgcctcggtcgcgctggtgatctggcgtttatcgcaaaaccatttacaggacccaccatgaaaattattaacgctcgcctgcgccgccaggaggcgctgtttacccttgacctgcatgacgggatgattcaccgcatcaccgcccaggccgcgatgcagactgccgacgcaggggatatcgacgcccagggccggctggcgatcccgcccttcgtcgagccgcatatccatcttgacgccaccctcaccgcgggcgagccggagtggaaccgcagcggcaccctgtttgaaggcatcacccgctggagccagcgcaaagcgagtattaccccggaggacacccgtcagcgagcgctgaaaaccatcggcatgctgcgcgatttcggcgtccagcacgtccgcacccatgtggatgtcaccgacccgtcgctggcggccctgcaggcgctgctggcggtgaaacaagaggccgccgatctcatcgatctgcagattgtcgcctttccgcaggagggaatagaatcgtatcccaacggccgggagctgatgacgcgcgccatcgagatgggcgccgacgtggtgggcggcattccgcactatgagaacacccgcgacaaaggggtcagctcggtgatgtttttgatggacctcgcccagcgctacggccgcctggtggatgtccactgcgatgaaatcgacgatccgcagtcgcgtttcctcgaagtgctggcggaagaggcgcgggtgcgcggcatgggggcgcaggtcaccgccagccacacctgcgcgatgggctcttacgataacgcctactgctcgaagctgtttcgcctgctgaaagcctcggggatcaacttcatctcctgcccgaccgaaagcattcatctgcagggccggtttgacagctggccgaaacggcgcggcgtcacccgggtggcggagctggatcgcgccggcatcaatgtctgctttgctcaggactcgattcaggatccgtggtatccgttgggaaacggcaatatcctgcgcattctggatgccggactgcacatctgccatatgctcggctatgacgatctgcagcgctgtctcgactttgtcaccgacaacagcgcccgggcgctctgtctgggcgataactacggcctcgccgaaggccgcccggcgaacctgctgatcctcgatgcggaaaacgactacgaggccgtccgtcgtcaggcacgggtgctgacctccattcgccacggcagggtgattttgcagcgtgaggtggagcacatccgctacccggcatag

SEQ ID NO: 6069 - DNA, 276 bp, Klebsiella pneumoniae
acaccttgccgggcggcgcggcgcttgcccggcctacaatgccagcgtcccccagtccagaccgtaggcccggtaaggcgcagccgccaccgggcatcaggacgggaacgcggcctgaacaccttgccgggcggcgcggcgcttgcccggcctactgagcttgcaccggcctgccataccccaggcccggtaaggcgcagccgccaccgggcaagcgcaccctacttaactttcgttgacaatttccgggcgctggaaacggcgcagctcgcgtag

SEQ ID NO: 6070 - DNA, 1206 bp, Klebsiella pneumoniae
cgccttcgccgtcgaccgccgttcctgcgccgccggcccgccggtgcgccatccgacgtctctgtccctctccctgatgccgccgcgccgccaccggctcctaccgtggccagcgcgccgtcaggccgcaagcgcctcactaccgccctggtgtgggggctgttcctgttggcgctgggcacctgcgtggcgctggtggcgctgtcgagcatggaatcgcggccgccggtcaacaaggcgcgtctgctgctcaatccgcgcgatatcgatatccacctggtgaatggcaactcctgcgctaactggtcgtcgcagcactcctacgccgtaggactggccagcctgatcaccacctcgctgaacaccttctcgacctttatggtgcatgataaaacggactacaacatcaatgaaccaagcagttccggcaaaacgctgaccattgagttcgttaatcagcgccattatcgggcgcagcagtgctttatgtcggtccagctggtggacaacgccgacagctcgacgatgctggacaagcgctactttgtgaccaacgataaccagctgaccatccagaacgatctgatgaacagcctgtcggatgccctggcgcagccgtggccggcgcgaatgcaggcgatgctcaggcaatatcagccctcgcaaagcgtggcgttaacctatttctaccagtcgcatcagctgttaatgaagggcgacgtcgattcattaagtaaggccagtagcctgctggatgatgtgattaagcgggcgccggattttatttacgcctatgccgaaaaaacgctggtggatgtattgcgccattcgcaacagcctctggacgataaacaactggccgccctctacagtgaagtcgagcgggtaggggcgatgccgggtataaaagacatggcgatttattatcaaataaaagcggtggattcattggggaagggcaaagtcgacgaagcaaataccgcaattaatagtgcgattgatttagagatgtcatggctaaattatgtgctgttaggcaaagtctatgagatgaaaggtgagaaccgtctggctgccgattcttacatcacggcgtttaatttacgtcctggcgaagataccctgtactggattgaaaatggggttttccagacatcggttaaccgagtagttccatatctcgacaactttctctcttcagaataa

SEQ ID NO: 6071 - DNA, 198 bp, Klebsiella pneumoniae
gcgcgacgccgggaaagccgcaccctgcaggcaaccgtaatgctgcaggcgcaggcaatcgccgctcagggcgtcaccgatttggataaatacctgcaaaaaggcgagaagccggcgaagcagcgcgtgatgttccgcggcattctgattacccaggataacgccgataaagtccaggatttcaacattaagtcctga

SEQ ID NO: 6072 - DNA, 465 bp, Klebsiella pneumoniae
ggtagacgccgaggctgtccggcgaggagagacccggtcgttcgccaatcaggatcgccaccgcgcgggctttcagggtttcgccaatatcatctcccagcgccacccgcgactgatgcgccagcaccaccggcgccaggccgatacccagcgtctgcagatagggcagcagggcgcggatcaacggcaccgcctggcgctctaccgcccaggaagagaggccgtcgccgatcaccagcagcaggtcggcggggcggacgccgctggcggcgaggtcggcgcgactctcgtcggcgagctgccgcccgagatccgggcgccgcagataggtatgacggtccggcgcggcgctgtgcaccgtcagggcatcgaggccgagcgccgccagcggcgccaccaattgttggctggcgaacggctgatgaatggcatcccgcgctctggcatgggccagaccaaagttga

SEQ ID NO: 6073 - DNA, 912 bp, Klebsiella pneumoniae
aacgggcgccgacgttgttcggcgcccgtttttttgccgggacaagaaaagcccgccggaagggtgacgtgtatcaccatatgcgctagcatgaagtcctcacacttcggagcgcgtatgggcctgttaaaccggataaaaatgctgtggcgagccgccgtcggctcgtcttattcctggcctgcgatggatatcgtcctgcccggcgaacgctatttgcacctcgtcggcagtatccatatgggcacccgcgacatggcgccgccgccggcgaagcttctgaaaaaaatacgccaggccgatgcgttaatcgtcgaggccgatatcagcggcaatgaaaccccgtttagcaatctccccacttacccaccgctggcggaacgcctgagcgatgcgcagctgagcgagctagaggcgcgagccggcgagctgggcctgtcggtcgggctgttcgacagccagccgctgtggcaggtggcgatggtcctgcaggccacccaggcgcagaagctggggctgcgaccagattacggcatcgattatcagttgctgatggccgcccgcgagagcaacatagcggtgatggagctggaaggcgccgacagccaaatcgcgctgctgcgcgatctgcccgacggggggatggcgctgctggaggatacgctgacccactggcgcaccaacgcccgtttactgcaggtcatgatcggctggtggctggagcaaccgccgtcgcgcggcgcggtatcgctgccgacgacctttagccagtctttatatgatgtgctgatgcaccagcgcaacctcgcctggcgcgagacgctgctggccttgccgccggggcgctacgtggttgccgtcggcgcgctgcacctgtatggcgaagggaatctgccggatatgctgacataa

SEQ ID NO: 6074 - DNA, 738 bp, Klebsiella pneumoniae
cgcgctggccgactgctggactttttcaccggtggccaccgagccggtgaagctcaccttggcgcaggccggatgcgtaatcagccgctgggcaatctcgccgccggcgccgttgaccacgttaatcaccccatccgggatacccaccgcttttgccagctccgccacgcgcagcagcgtcagcggcgtatattcgctcggcttgaggacgatggtgcagccgcagaccagggccgccgccagcttccagatggcaatcatgatggagaagttccacggcacgatgccaaccaccaccccaagcggctggcggcgggtaaaggcggtatatttctccccggccatcgatggcagcgagacatccagcgtttcaccggtgactttccccgcccagccggcgaagtagcgcaggaacgccaccgactggtccagctcgagcatccgcgccagcgtgatagttttgccggaacagagactttccagctgcgccagcgcttcgcgatgctctgccagcgtgtccgccagcttcagcagcagcgcgccgcgcgccagcgtcggcatctcgcgccactgactaaacgcctggcgggcgctctccatagcgcgatccgcctggtcactatccgccgcggtgacctcggcaatcgcctgcccggtcgccgggttgatcaccgcgaacggcgcgccgcggcccgcctcacgttgaccggcaataaactgcccgtgcggctggcgtaa

SEQ ID NO: 6075 - DNA, 1044 bp, Klebsiella pneumoniae
actgcaggccgggttttgcgagggtcgcctcgcagcccggccttatttattattttgctgaggcataacgtatggcatgcggcgaattctcccctgattgcccgttattttgatcgcgttaaaagcgcccgccttgatgttgaaaccggcatcggcgatgactgcgcgctcctgcatattcccgagaaaaaaacgctggcaatcagcaccgacaccctggtggcgggcaatcacttcttacccgatatcgaccctgccgacctcgcttataaagcgctggcggtgaacctgagcgacctcgcggcgatgggcgcggagccggcgtggctcacgctggcgctgaccttgccggaggtggatgaagtctggctggaagccttcagcgacagcctgtttgtccagctggactattacgatatgcaactgattggcggcgacactacccgtggcccgctctccatgacgctgggtatccacggctttgtgccgccgggacgcgccatgaaacgcgctggcgcgaagccgggggactggatctatgttaccggcactccgggagatagcgccgccggtctggctgtactgcagaatcgtctaacggtggatgaaccgtctgacgccgactacctgctggcccgtcatctgcggccgatgccgcgcgtgctgcagggccaggcgctgcgtgacctggcgacatcggctatcgatctctccgacggcctgatctccgatctgggccatattctcaaagccagcggctgcggcgcgcgcatcgatctcgatgccatgccgtactccgatgcgatgctgcgccaggttgattctgagcaggcgctgcgctgggcgctcgccggcggggaagattacgagctgtgctttaccgtaccggagctgaaccgcggggcgctggacgtggctcttggccatcttggcgcgcgttttacctgtatcggacagattgcgccggagagcgaagggctgcagtttatccgcgacggtaagccggtcgcgcttgatttaaagggatacgatcactttgcgtag

SEQ ID NO: 6076 - DNA, 1101 bp, Klebsiella pneumoniae
cggatcatacggggctcctctggcaataacgcattgcgaccacccgttacgctcagcaaattccataccaccctgccgccatctgacacagcgatgcggcccatctggctctatacggaattgaaaaacgctcccacattaaaaacgtattcagccgccgtggactggaacgtccccggccactattttgcagaaaccttttcgcgttctggaatgaacccgtctggccaatccatcaggggtgaaataatgaaaaaatcattggcatcaatgtgtctgagcgctgtattaacggtcgctttttcttatcacgccgtcgcggccgatcttccggaaatagaaaaatccggcacccttaaagtggcgacggaagatgattatgcgccatttaactttatgaataatggccaggctgatggctttaacaaagatatgcttgaggaattacgtaagtacgccaaattccatgtcgaccagagcatattaccgtggaccggattattagcggctgtctccaccgggcaatacgatatggccttaaccggggcggttattaccgatgagcggctgaaggtctttgatttcaccccaccgtgggcctccgcgcagcactatttcgtcaaacgcgctggcgatacctcgctaaataccattgccgatctcagcggcaaaaaagtggggttacaggccgggagcgcgctgctggcgcgtttgccggagctgaaggcgatgctggagaagaccggcggcaagctggggccggtggtggagtatccctcctatccggaagcctacgccgacctggcgaacaagcgactggattacgtgattaacgtggtgatctcggtaaacgacctggcgaaagccaaaccgaaggtcttcgccaaagggctggccgtctccggaccggggtatatggcgtggccgatcccgaaaaactcgccgcagctgctggcctatatgaccaagtttatgaaccacatgaaggagaccggcaagctcgccgagctgcagaaaaaatggttcggcgaaacctatgacaacctgccgaccgaggcgatcaccagcccggaacagtttcacaaactcgccggactgtaa

SEQ ID NO: 6077 - DNA, 375 bp, Klebsiella pneumoniae
ggccgaatacgtagaaggctggaacgcctgccgcgccgccatgctcgcagccgcccagcaggagggaaaatgactatagccatcgatcgacttaaagaggtgacaagggactttggtcgcaggcatatcgcctaccagatggccagagaactgctggagatttatagcggtaacggcccggttgtctggaatgtgttgagcgatttccctcctgaggtgaatggcaaatatcttgtcattaccagctacggggatattcggaccgcctgctatgactgcgaatcaggggaatggagggcttcagatggcaccattaccggagttatcaaatggatggagttgccagccgcccagcaggaggtgaagggtgagtaa

SEQ ID NO: 6078 - DNA, 930 bp, Klebsiella pneumoniae
cgcgctgtacgcccgtcgtctgctgggcttaaagcatgccccggagttcgccgactggctggcgaaaatgcagattatcgatccgcacggcgcgctgcggctcaccgacgcccgtcatccactgctgtccgtcctgccgcaaggagcctccgtatgaaccgtcccgatgcctggaacccgctgcgtgaatttaccgatgcgcggatcgccctggggcgcagcggcgccagtctgccgacccgcgaagtcctcaactttggtctggcccatgccagagcgcgggatgccattcatcagccgttcgccagccaacaattggtggcgccgctggcggcgctcggcctcgatgccctgacggtgcacagcgccgcgccggaccgtcatacctatctgcggcgcccggatctcgggcggcagctcgccgacgagagtcgcgccgacctcgccgccagcggcgtccgccccgccgacctgctgctggtgatcggcgacggcctctcttcctgggcggtagagcgccaggcggtgccgttgatccgcgccctgctgccctatctgcagacgctgggtatcggcctggcgccggtggtgctggcgcatcagtcgcgggtggcgctgggagatgatattggcgaaaccctgaaagcccgcgcggtggcgatcctgattggcgaacgaccgggtctctcctcgccggacagcctcggcgtctacctcacctggcagcctcatcgtcagcgcctggagtctgagcgcaactgtatctccaatattcggccggagggattaagccatgacgccgccgcctttaaactggcctggctgctggagcaggcttttttgcgccggcttaccggggtgggcctgaaagatgaaagcgataatccggcgctgcatggtaaaataaaaccgttgccccctttaaaataa

SEQ ID NO: 6079 - DNA, 321 bp, Klebsiella pneumoniae
ccggctgtacggttcagctataatttatcaataaccttttacaggaggcagacgatggcatcaggttgggcaggcgacggcgccgtacaggatcagatcgacagcactattgacgatgcggttgctcgcgcccgccgcgagcttccacgtggcgaaagcaacaaattttgtgatgaatgcggagagccgattccggaggcccggcgacaggccatcccaggggtcagatactgcgtgaagtgccagcaggagaaagatttacataacaatacattttcaggatataatcgtcgcggttccaaggatagccagctacgctga

SEQ ID NO: 6080 - DNA, 1497 bp, Klebsiella pneumoniae
tgcacatcgctgcaaaaaatgggatacatcatgtcatcattgcaaatttcgcaaggcacgtttcgcctgagcgatacaaagaccttaaaaatagaccacctgagcgtggcggcgggtgaaagctgggcgttcgtcggcagcaacggcagcggcaaatccgccctcgcgcgggccctggcaggcgacctgaccctgctcagcggccagcgcgaaagccacttctcccgcgtgacccgcctctccttcgaacagttgcagaagctggtcagcgacgagtggcagcgcaataacaccgacctgctcagcccaggcgaagaagacaccggccgcaccaccgcggagattatccaggatgaggtgaaagatcctgcccgctgcgcgcgcctggccgaacagtttggcatcagcgccctgctggaccgccggtttaaatacctgtcgaccggggaaacgcgtaagaccctgctgtgtcaggccctgatgaccgatccgcaactgctgatcctcgatgaacctttcgacggtctcgacgtcaactcccgccagcagctggctgccctgctggccgacctgcacagcgccggcatcaccctggtgctcaaccgtttcgatgagatcccggagtttgtgcaattcgccggcgtgctggctgactgcaccctcagcgagaccggcgagaagtcttccctgctgcagcaggcgctggtcgcccagctggcgcacagtgaaaaactggacggcatcaccctgccggagccggatgtcccaccggcccgtcatgcgctggcagactcggcgccgcgtatcgtgctcaacgacggcgtggtctcctataacgatcgcccggtcatcaatcacctctcatggaccgtgaatccaggcgaacactggcagatcgtcggtcccaacggcgccggtaaatctacgctgctgagcctggtcaccggggatcatccgcagggctacagcaacgatctcacgctctttggccgccggcgcggcagcggtgagaccatctgggatattaaaaagcatatcggctacgtcagcagcagcctgcatctggactaccgggtcagcaccaacgtccgcaacgtcatcctgtcgggctattttgactcgatcggcatttatcaggcggtctccgacaagcagcataagctggtgcagcaatggctggatattctcggcatcgataagcgcaccgccgacgcgccgtttcacagtctgtcgtggggccagcagcggctggcgcttatcgtccgcgcgctggtgaagcatccaaccctgctgatcctcgatgaaccgctgcaggggctggaccccctcaaccgccagctggtgcgccgctttgtcgacgtgttgattggcgaaggggccacacagctgctgtttgtctcgcaccatgcggaagatgccccggactgtattacccatcgcctggcgttcgttcccagtggagacggttacacttatcagctcggccccgtggcctga

SEQ ID NO: 6081 - DNA, 2520 bp, Klebsiella pneumoniae
tcgcgaacacggcaccaccctgatcctcgtcactcacgatccgctgctggcggcgcgctgcgatcgccgtctgcgcctggcggatggccagctgcgggaggaagcatgatcgcccgctggttctggcgcgaatggcgctcgccgtcgctgctgatcgtctggctggcgttaagcctcgccgtggcctgcgtgctggccctggggtcgataagcgatcggatggagaaaggccttagccagcaaagccgtgagtttatggccggcgaccgtacgctgcgtagttcgcgcgaggtgcccgccgagtggatcgcacaggcgcggaagtcagggctgaccgtcggcgagcagctgagctttgccaccatgacgttcgccggggatacgccgcagctggcggacgttaaggcggtggacgaccgctatccgctgtatggcaccctcgagacgcagccgccggggctgaagccgcaggcggggagcgtgctgctggcgccaaggctgatggcgctcctgaacctgaaaaccggcgatacgattgacgttggcgatgccacgctgcgcattgccggggaggtgattcaggagccggatgcagggtttaaccccttccagatggcgccgcggctgatgatgaatatggccgacgtggcaaaaaccggggccgtgcagcccggcagtcgcgtcgcatggcgctataagttcgccggcgacgctgaacagctggccaattatgagcagtggctgctgccgaagctcggcccggagcatcgctggattggtcttgaccaggacgacagcgcgctgggcaaatccctcgaacgctcgcagcaattcctgttgttatccgcgctgttgacgctgctgctggccgtcgccgcagtggcggtagcgatgagccactactgccgcagccgctatgatctggtcgccatactcaagacgctgggcgccggacggtcgcagctgcgcaagcttatcgtcggccaatggctgctgctgttgacgctgtcggtgataaccggcggggtggcgggcctggcgctggagcgtctgctgctgctggtgctcaaaccggtgctgcccgccgcgttacccgctgccagcggttggccgtggctgtgggctatcggggcgacaggcgtcatttccctgctggtgggcctgcgaccctatcgactgctgctggcgaccctgccgctgcgagtgctgcgtcaggatgtggtggctaacgtctggccgttgaaaatctggatcccggcggttagcgtcgtggtggtgggcctgttggcctggctgctgggcggcagcccgctgctgtggtcggtgctggccggggcggtggtgctggcgctgctgtgcggcctggtgggctggggattgctgtggctgctcaaacgcctgacgctcaaagccttgccgctgcgtctggcggtgaaccgcctgctgcgccagccgtggtcgaccctcagccagctggcggcgttttccctgtcgtttatgctgctggcgctcctgttggtgctgcgcggcgatctgcttgaccgctggcagcagcagttgcccccgcagagcccgaactactttctgatcaatatcgcccctgagcagatagtgccggtgaagaccttcctcgccgaacaccagacgcgggcggcggaattctatccgatcgtccgggcccgtctgacgcagatcaacggtcagtctacggacggaaacaaagacgaagcgctgaatcgcgagcttaatctcacctggagcgaacagcgtccggatcataatccgctggtggccggcagctggccgccgaagccgggcgaggtatcgattgaggaggggctggcgcagcggctggggataaagatcggcgatacagtgacctttaccggcgatacccaggagttcagcgcgaaggtcagcagcgcgcgcaaagtagactgggagagcttgcggccaaacttcttctttattttcccctccggggcgctggacgggcagccgcagagctggctcaccagcttccgctgggataacggtcccgcgatgttgacccagctgaaccgcgagtttcccaccgtcagtctgctggatatcggcgccatcctgcgtcaggtcggccaggtgctctcccaggtcagccgggcgctggaggtgatggtaggcctggtgacggcctgcggcgtgctgctgttgctggcgcaggtgcaggtcggtatgcgtcaacgccatcaggagctggtggtctggcgcacgctgggggcaggaaaatcgctgctgcgcgctacgctgtgggcggagtttgccctgctggggctggtttccggcctggtggcggcgataggcgcggaagtggcgctggcgatgctgcagacgaaagtctttgattttccctgggcgccggactggcgcctgtgggtgttgctgccgctgacgggagcggtgttgttatccctgtgcggcggcgggctggggctgcgtctgttaaaaggaaaagcgctattccgccagtttagccagtaa

SEQ ID NO: 6082 - DNA, 267 bp, Klebsiella pneumoniae
ttcagaacacgctgcaggcgtgcgaagagtatcacgacgttgaggaggcctgagatggcgacattttccttaggtaaacacccgcacgttgagctgtgcgatctgctgaagctggaaggctggagcgaaagcggcgcccaggcgaagatcgccatcgccgacgggctggtaaaagtcgacggcgcggtggaaacccgcaaacgctgcaaaatcgtcgctggtcagacggtgagctttgaaggccagagcgtgaccgtcacggcctga

SEQ ID NO: 6083 - DNA, 654 bp, Klebsiella pneumoniae
cctatggcacgaaaaaccaaacaacaggcacgtgaaacccggcaactgattctggatgttgctctgcgtctgttttcgcagcaaggcgtatcatctacctcgttggcaacaattgcaaaagctgcgggtgtaacgaggggggctatctactggcatttcaagaataaatcagatttattcaacgaaatttgggagctgtcagacgccagtattagcgatctcgaaattgagtatcgggcaaaattccccaacgatccactctcagttatcagggagattctagtctatgttcttgaagcgacagtgacagaagaacgtcgacgattaatgatggagattatctatcataagtgtgagttcgtcggtgaaatgaccgtggtgcagcaggcccagcggcagctctccctggcgagttatgagcgtatcgagcagaccttgaaagagtgcatcgcggcgaagctgctgcccgccaatttactcacccggcgggcggccgtgttaatgcgcagctacctttccgggctgatggaaaactggctgtttgcccccgattcgttcgacctgcatgcggaagcgcgggactacgtcgctattctgctggagatgtatcaattctgcccgacgctacgcggcccggagagcttgtcagcttaa

SEQ ID NO: 6084 - DNA, 402 bp, Klebsiella pneumoniae
gtaaggcaacgtgatgcagttggcacattgcttacgcaaatcctctgcaccgggcgatacgttagcgaggagctctcgccggcggatataacgcagaaggtagtagccagtttgatgccggccaccctggacaccataaagtcggaagagaagcagacctatcactcccctctgaagacgaactaccgcgagcacatccacagtcctgagggagttaacggtctggttgagcactccatgctgatggatatgctgaacaagatagatgctgacgggcatgatgtgtccggcgccgccgcagaggtcacagctatgctcagctacattgttggtatcggcgccgtactgcgcgacatagagacgcatgctcagtacgtgatggctaaggccaagggttactga

SEQ ID NO: 6085 - DNA, 189 bp, Klebsiella pneumoniae
  unsure (102): Identity of nucleotide at the above locations are unknown.
caccataaacggcacctgaaagttctgctggaacttatcatcatgcgccagatactgcaactctttgacccgctccttgaacgccaaaccatgatcggaaanataggtcaaggaaaaattgtcaccggaatgttgcaactgaatgatcaagctaagcccgcagcgaaatccgtctgccttctgccgtag

SEQ ID NO: 6086 - DNA, 957 bp, Klebsiella pneumoniae
aacagcaaacgaggactgacagcgaggcccgcttctgacaaaatatccttatccccctttcgtaaagatacagatggaatcctctctctgatggcagcaaaaattattgacggtaaaacgattgcgcagcaggtacgctctgaggttgcggaaaaagtgaaggctcgcgttgcggccggaaaacgcgcccctgggctggccgtcgtgctggtcggcagcaacccggcctcgcagatttatgtcggcagcaagcgcaaagcatgtgaagaagtgggcttcgtctcccgctcttacgatctcccggaaaccaccagcgaagccgagctgctggagcttatcgacactctgaatgccgataagaccatcgacggtattctggttcagctgcccctgccggcagggatcgataacgtcaaagttctcgagcgcatcgcgccggataaagacgtcgacggcttccatccttacaacgttggccgcctgtgccagcgcgcgccgcgcctgcgtccgtgcactccacgcggtatcgtgaccttgctggaacgctacaatatcgacacctacggcctcaatgcggtggtcattggcgcctccaatatcgtcggtcgcccgatgagcatggagctgctgctggccggctgcaccaccaccgtcacccaccgctttacaaaaaacctgcgccatcatgtcgaaaacgccgacctgctgatcgtcgcggtgggcaaaccgggctttattcctggcgagtggattaaagaaggggcgattgtggtcgatgtcggcatcaaccgtctggaaagcggcaaagtggtcggcgacgtggtgtatgaagatgccgccgaacgcgcgtcctacatcaccccggttcccggcggcgttggcccgatgaccgtcgctaccctgattcagaacacgctgcaggcgtgcgaagagtatcacgacgttgaggaggcctga

SEQ ID NO: 6087 - DNA, 1353 bp, Klebsiella pneumoniae
ggtataaaacgaggaaaccctatgtcacgtatagatacgctggtctgtactgacgccaggaaaacgaaatatcgtttcgtggttttgacgatgatttttctggtgtatgccatcaattacgccgaccgaacgaatattggcgcggtactgcctttcatcattgatgagtttcatatcaataattttgaagccggggccatcgccagtatgtttttcctcggctatgcggtaagccagatcccggccggctttttcatcgccaaacgcggtacccgggggctggtatcgctctccattttcggcttctccgcctttacctggctgatgggcacggtgagctccgtgtttggcctgaagctggtgcggctgggactggggctgagcgaagggccttgcccggtggggctggcttccaccataaataactggtttccaccaaaagagaaagccacggcaaccggcgtttacatcgcggcgaccatgtttgcgccgattattgtgccgccgctggcggtgtggattgcggtgacctgggggtggcggtgggtctttttctcttttgctatacccggaattgtggcggccatcgcgtggtatctgctggtcaaatccaagcctgctgagagcggatttgtttcccaaagcgaactggcagagattaatgccgggcgtgaaagtcataataatagcgtacgcgaaaatatcttaattgccgaaagattcacctggctggataaaatcattcgggtaaagaaaatggcgccaattgatacggcgaaaggcttattcacctcaaaaaatattctcggtgactgcctggcgtattttatgatggttagcgtgctgtacggattattaacctggatccccctgtatttagtcaaagagcgcggtttcgatgtaatgagtatgggcttcgtggccagtatgccgtgcatcggcggctttattggcgcgatcggcggcggatgggtttcggataagctattaggccgccggcgtaaacccaccatgatgttcactgcggtgtcaacggtggtcatgatgctaattatgctgaatatcccggccagcaccctggcagtttgtattggattattctttgtcggcttttgtttaaatatcggctggccagcctttaccgcgtacggtatggccgtttcggatagcaaaacctatccaatcgcctcttccataattaatagcggcggcaacctcggtggatttgtcgcgccgatggcggctggtttcttgcttgataaaaccgggagttttaattctgtatttacctattttggtatctgcgccgccattggtttggtggtgattcttttcctcgatgaaccacaataa

SEQ ID NO: 6088 - DNA, 1239 bp, Klebsiella pneumoniae
acgtctgaacggcttaatcagaattcgaggatcgaggcaatgtcgcaataccataccttcaccgcccacgatgccgtggcttacgcgcagcagttcgccggcatcgacaacccatctgagctggtcagcgcgcaggaagtgggcgatggcaacctcaatctggtgtttaaagtgttcgatcgccagggcgtcagccgggcgatcgtcaaacaggctctgccctacgtgcgctgcgtcggcgaatcctggccgctgaccctcgaccgcgcccgtctggaggcgcaaactcttatcgcccactatcagcacagcccgcagcacacggtaaaaatccatcactttgatcccgagctggcggtgatggtgatggaagatctttccgaccaccgcatctggcgcggagagcttatcgctaacgtctactatccccaggcggcccgccagcttggcgactatctggcgcaggtgttgttccacaccagcgatttctacctccatccccacgagaaaaaggcgcaggtggcgcagtttattaacccggcgatgtgcgagatcaccgaggatctgttctttaacgacccgtatcagatccacgagcgcaataactacccggcggagctggaggccgatgtcgccgccctgcgcgacgacgctcagcttaagctggcggtggcggcgctgaagcaccgtttctttgcccatgcggaagcgctgctgcacggcgatatccacagcgggtcgatcttcgttgccgaaggcagcctgaaggccatcgacgccgagttcggctacttcggccccatcggcttcgatatcggcaccgccatcggcaacctgctgctgaactactgcggcctgccgggccagctcggcattcgcgatgccgccgccgcgcgcgagcagaggctgaacgacatccaccagctgtggaccacctttgccgagcgcttccaggcgctggcggcggagaaaacccgcgacgcggcgctggcttaccccggctacgcctccgcctttctgaaaaaggtgtgggccgacgcggtcggcttctgcggcagcgaactgatccgccgcagcgtcggactgtcgcacgtcgcggatatcgacactatccaggacgacgccatgcgtcatgagtgcctgcgccacgccattaccctgggcagagcgctgatcgtgctggccgagcgtatcgacagcgtcgacgagctgctggcgcgggtacgccagtacagctga

SEQ ID NO: 6089 - DNA, 1260 bp, Klebsiella pneumoniae
cgcgctgaacgtcgattaattaaaggatacacaatgagtagcgtagatattctggttcccgacctgcctgagtccgtagctgacgcaaccgtcgccacctggcacaaaaaaccgggcgacgcggtcgtccgtgacgaagttctggtcgaaatcgaaactgacaaagtggtactggaagtaccggcatcagcggacggcattctggatgcagtgctggaagacgagggcgccaccgtcctgtctcgccagatccttggccgcctgcgcgaaggcaacagcgcaggtaaagaaagcagcgagaaagccgatgcgaaagcgtccactccggcgcagcgtcagcaggcctctctggaagagcagaacaacgacgcgctgagcccggcgatccgtcgtctgctggctgaacacaaccttgacccagcggccatcaaaggcactggcgtcggcggccgtctgacccgcgaagacgttgagaaacatctggcgaaagccccggcgccggcagaagccaaagcgccagccgccgccccggcagccgcgccggcgccgcagctgggccaccgttcggaaaaacgcgtcccgatgacccgcctgcgtaaacgcgtagccgaacgtctgctggaagcgaaaaactctaccgccatgctgacgacctttaacgaagtcaacatgaagcccatcatggatctgcgtaagcagtacggtgaggcgttcgaaaaacgtcatggcatccgcctgggctttatgtccttctacgtgaaagcggtagtggaagcgctgaaacgctatccggaagtgaatgcttccatcgatggcgacgacgtggtgtaccacaactacttcgacgtcaacatgggcgtttccactccgcgcggtctggtcaacccggttctgcgtgacgtcgacctgctgggcatggcggatatccaaaagaatatcaaagagctggcagtgaaaggccgcgacggcaagctgaccgtatacgacctgagcggaggtaacttcactattaccaacggcggcgtcttcggctccctgatgtccacgccgatcatcaacccaccgcagagcgctattctgggtatgcatgccattaaagaccgtccgatggcggtcaatggcaaggtagagatcctgccgatgatgtacctggcgctctcctatgaccaccgtctgatcgacggacgtgaatcggtaggcttcctggtggcgattaaagagctgctggaagatccgacccgtctgctgctggacgtgtag

SEQ ID NO: 6090 - DNA, 1407 bp, Klebsiella pneumoniae
aacgccgaacgagatcgccctgacgatcctgctgatcgccctgacgctagtgttcctgctggccaccgccacatctggcccttctcggcgtggagcggcaatgcggtcagcgttaccgtactggtcgccctgctggtgtgcctgatcccgaccaccatcggcgggctgctgtcggccatcggcgtcgccgggatgagccgtatgctcggcgccaacgtgatcgccaccagcggccgcgcggtggaagccgctggcgacgtcgatgtcctgctgctggataaaaccgggaccattaccctcggcaaccgccaggcctccgccttcctgccggctcgcggcgtggaagagcgaaccctcgccgacgccgcccagctctcctcgctggcggatgaaacccctgaggggcgcagcatcgtggtgctggcgaaacagcgctttaacctgcgcgaacgcgatctgcagtcgctgcacgccacctttgtcccctttaccgcgcaaacgaggatgagcggcatcaatatcgatcagcgcatgatccgcaaagggtcggtggacgccattcgccgccacgtggaggccaacggcggcctcttccctgccgatgtcgataaacaggtggaagaggtcgctcgccagggggccacgccgctggtggtcgccgaaggcgaaaaggtgctggggattattgcgctcaaagatatcgtcaaaggcggcatcaaagaacgtttcgcccagctgcgcaaaatgggcattaaaacggtgatgatcaccggcgataaccgcctgaccgccgcggcgatcgccgccgaggccggcgtcgatgatttcctcgccgaagcgacgccggaagccaagctggcgctgatccgccagtatcaatcggaaggtcggctggtggcgatgaccggcgacggcaccaacgacgcgcccgcgctggctcaggccgacgtggcggtagccatgaactccggtacccaggcggcgaaggaagcgggcaacatggtcgacctggattccaaccccaccaagctgattgaggtggtccatatcggcaaacagatgttaatgacgcgcggttcgctgaccaccttcagtattgccaacgacgtggcgaaatatttcgccattattccggcggcgtttgccgcggtctatcctcagctggccatgctgaacgtgatgggtctgcattcgccctcatcggcgatcctcagcgccgttatcttcaacgcgctgatcatcgtcttcctgatcccgctggccctgaaaggcgtcagctatcgcccgctctccgcctcggcgatgctgcgccgcaacctgtggatctacggcctcggcggtctgctggtgccctttatcggtattaaagccatcgacctgctgctgaccctgagcggtctggtgtga

SEQ ID NO: 6091 - DNA, 210 bp, Klebsiella pneumoniae
cttaaaccgctcggcctgggcaagcgtgaatatccactgcagcgtccatgtcgccttaaggtctgtggtgatcggcgtgattatcaatgggccgactgccgtctgcgtcgtctgccaggctgtatcctgcgtcatgttctgatcggcacgctggggcagtggcaggaacggagggtattgaactgttgccacgtttcctccgggcattga

SEQ ID NO: 6092 - DNA, 261 bp, Klebsiella pneumoniae
tcaccgctgcgcgtgagcatggccctaactttgaagccacagcggaagtgtataaataacctttttttaaagcgtgccgtatcggcgcgcaacgcattgagcctggagcgcgttaagcctccgggcttatttttttctgctatcggaattgccttaggcaatagcggcagcggaaatgcgtttttatcgctatatatagatttcatgatcacgatgttaatgaattattgctttttattgttaataaagagccaattctga

SEQ ID NO: 6093 - DNA, 861 bp, Klebsiella pneumoniae
cttcatatgcgcgtaaactttgatgttttgatgatccttgatgctcttgaccgccacggatccttcgccaccgccgcggagtcgctgtataaaacccccgcagctctgagctatatgatccagaagctggagagcgatctgaacatcgtgctgttggatcgttccggccatcgggcaaaatttaccgataccggccggctgatgctggagaaggggcgacagcttttaagtgccgccagagatctggaaaagcaggcccagcagctgagcgcgggctgggagcgagagctagccatcgcccttgacgcctcatttcccttttcggctctgctgccgctgatcgccgagttttacgcgcaaaacccacagacgcgactgaacttcagccatcacaccctcgccggttcgtgggaagagctgacccatcatggggcggatattatcctcggcgccatcaatgagccgcccacctccgcggagtggtcatggcaaaccctcggcgcgttggataacatcttcgtcgtcgccccccatcacccgctggctcaggcgaaggagccactggccaataaacagctcagccagcatcgggccatcgtgatccgcgacagcgcccgctattgccatccgctcaacagcaatctcctcgacgagcagccgcaaatcggcgtcgatgatttcgccagtaaagtcgaactattgtgcgccgggctgggctgcggctttctgccgcgccatatcgctcgcccgtggctggtaaaaggcagtctggtggagaaaagcgtcgcctgctggcgggataaggatattacctatatggcctggcgcagcgggaatgatgggctggctcagcgggaatga

SEQ ID NO: 6094 - DNA, 183 bp, Klebsiella pneumoniae
tcgccaatgcgggttctctcctggttaacccacactgaactgaatcccccgggcaacgtggcgctgatgctgccgacgctgctccacgagctgtcgctggccagcatgttttgcaggttaacgttgatcgactcgcccagcggtagcgtcaggcgggtttcccccaccgcctggttgtcgtag

SEQ ID NO: 6095 - DNA, 510 bp, Klebsiella pneumoniae
  unsure (162): Identity of nucleotide at the above locations are unknown.
ctgcgcccgcgccaacaaagcgatgtccgcctggggcgtggaggcccgcgtgccgttcctcgacaagaattcctcgacgtcgcgatgcgcattaacccgcaggataagatgtgcggcaacggcaaaatggaaaaacacattctgcgcgaatgctttgaatcntacctgccggccagcgtcgcctggcgccagaaggagcagttctctgacggcgtcggctacagctggatcgataccttgaaagaagtggccgccaaacagatcagcgaccagcaactggaaaccgcaagcttccgcttcccgtacaacacgccgacctccaaagaaggctatctgtaccgcgagatcttcgaagagctgttcccgctgccgagcgcggcggagtgcgtccctggcggtccgtcggtggcctgctcttcagcgaaagccattgagtgggatgaagcgttcaaaaccatgaacgatccatcaggccgcgcggtcggtgtccaccagtcggcctacaaataa

SEQ ID NO: 6096 - DNA, 1005 bp, Klebsiella pneumoniae
ccggcgccgcgccgcggtacgacagggcaggggcgatccacttcatcgttaaggactggcgaaatgggcaaggcggttatagcaattcacggcggtgcaggggcgatttctcgcgcgcaaatgacgccggagcgggagcgagagtatgtggcggcgctgtcgactatcgtcgaaagcgggcagaaaatgttggccgcgggcgccagcgcgctggatgccgtgaccgaggctgttcggctgctggaggagtgtccgttgttcaacgccggaatgggcgcggtatttacccgcgatcaaacccacgagctggacgcctgcgtaatggacggctacagcctgcaggctggcgcggtagccggggtcaaacatttgcgtaatccggtgctggcggcgcgtctggtgctggagaagagtccgcacgtattactgatcggcgagggggcggaaaattttgccatctcccacgggatggcgcgcgtggataacgatctcttttccactcctgaaaggctgctgcagctgcaggaggcgaaagcgggcggggagattatcctcgaccaccacgccgctcccctcgacgaacgccagaaaatgggcaccgtcggcgcggtggcgctcgatctggccggcaatctggcggcggcgacctccaccggcggcatgaccaacaaactgcccggacgcgtcggcgacagcccgctgccgggcgcggggtgttatgccaataatgccagcgtggcggtctcctgtaccggcaccggcgaagtctttatgcgcaccctggcggcctacgatatcgccgccctgatggagtatgggcagctcagtctctattccgcctgcgagcgggtggtgatggagaaactgccggctctcggcggcagcggcgggctgatagccgtcgatcgcgaaggcaacgtcgttttaccgtttaacagtgaaggcatgtaccgcgcctggtgctatgccggcgatacgccgaccattggcatttatcgcgaatag

SEQ ID NO: 6097 - DNA, 1914 bp, Klebsiella pneumoniae
actaagcagcgaatgaaattacagaattctttccgcgactatacggctgaatcctcgctgttcgtgcgccgggcgctggtcgcttttttggggattttgctgcttaccggcgttctgatcgccaacctgtacaatgtgcaaatcgttcgcttcgacgactatcagacgcgctcgaacgaaaaccgcatcaagctggtgccgatcccgccgagccgcggcattatttacgatcgcaacggcaccccgctggcgcttaaccgcaccatttaccagctggagatgatgccggagaaagtcgataacgtacagcagacgctggatgcgctacgcgacgtcgtcgatttaaccgacgatgacatcgccggtttcaaaaaggagcgcgcccgctcccatcgttttacctcgattccggtaaaggtcaacctcagcgaagtgcaggtggcccgctttgccgtcaaccagtaccgctttcccggcgtggaagtcaaaggctacaagcgtcgttattacccctataattcagcgctgactcacgtcattggctatgtctcaaaaattaacgataaagacgtcgaccgcctggataaagagggcaagctggccaactacgcctcgacgcacgacattgggaagctgggtatagagcgttattacgaggacgttctgcacggtcagaccggctacgaagaggttgaagtgaacaaccgcggccgcgtcattcgtcagctgaaagaggtgcctccgcaggccggacgcgacatctacctcaccctcgacctcaagctgcagcagtatattgaaacgctgctggccggcagccgcgccgccgtggtggtgaccgacccgcgtaccggcgctattctggcgctggtttcaaccccgagctatgacccgaacctgttcgtcgacggcatctccagcaaagattactccgcgctgctcaacgacccgaacacaccgctggtcaaccgagcaacgcagggggtctatccgccggcgtcgacggtcaaaccgtacgtcgccgtctcggcgctgagcgccggggtgatcactcgcaacaccagcctcttcgaccccggctggtggcagttgcccggctcagagaaacgctatcgtgactggaaaaagtggggccacggccatctgaacgtcaccaaagcgctcgaggagtctgcagatacttatttctaccaggtcgcctatgacatgggcatcgaccgtctctcagagtggatgagcaagtttggctacggccactacaccggtatcgacctctccgaggagcgctctggcaacatgccgacccgcgaatggaagctcaagcgctttaagaaaccctggtaccagggggacaccattccggtgggcatcggccagggttactggaccgccacgccgatccagatgaacaaagcgctgatgatcctgattaacgacggcgtggtgaaggtgccgcatctgctgcagagcaccgtggaagacggcaagcccgtaccctgggtccagccccatgagccgccggtaggcgatatccattccggctattgggaaatcgccaaagacggcatgtacggcgtggccaaccgcggcaacggcaccgcgcacaaatacttcgccagcgcgccgtataaaatcgcggccaagtcaggtaccgctcaggtgttcggcctgaaggccaacgaaacctataacgcgcaccggatctccgagcgcttgcgcgaccataaactgatgacggcgtttgcgccttataacaacccgcaggttgccgtggcgatgattctggaaaacggcggcgccggcccggcggtcggtaccattatgcgccagatcctcgatcacatcatgctgggcgataacaacactacgctgccaagcgaaaacccggcggtaaccgcaggggaggatcaataa

SEQ ID NO: 6098 - DNA, 939 bp, Klebsiella pneumoniae
tgggcggcgctgctggtaccctgcattatcgccacgctgctggcgcccgaaccgagcgacgttatcccggtccccagatcgctcgagcaggcggtagccgaaccgctgcgcgattttttcggccgcaacaacgcctggctgattctgctgctcatcgtcctttataagcttggcgatgcgtttgccatgagcctgaccaccaccttcctgatccgcggcgtgggatttgacgctggcgaagtgggaatggtgaacaaaaccttaggcctgttcgccaccattctcggcgccctgtacggaggcgtcctgatgcagcggctgacgctgtttcgggcactgctcattttcggtttgctgcagggggtctctaacgccggctactggctgctgtcgattaccgataagcacctctattccatggcgaccgcggtattctttgaaaacctgtgcgggggaatggggacggcggcatttgtcgcgctgctgatgacgttatgtaataagtcgttctccgccacccagttcgcgctgctctcggcgctctctgcggtcggtcgcgtatacgttgggccgattgccggctggtttgtcgaggctcacggctggtcgaccttctatctcttctctgtcgttgcggcggtgccggggattgccctattgctgctgtgccggcaaacgcttgagcatacccaacgcaccgcaagctttatgccgcgtagtgagttcccgcaggcctatgcgctggcgctggggatcctgactctgggctgcctgctgctcgcggtgtggctggcgctgctgatcctcaacgcgctggattatacgtcgttctccttcctgtccggcctgctggaggttgccgcgctcaccgccgtcggcgggattttgttcggcggcctgcttgactatctggcgctgcgtaaaacccgcctgatttaa

SEQ ID NO: 6099 - DNA, 1242 bp, Klebsiella pneumoniae
acgtctaagcgtcttgattgccaaatattaacatcgtgttatagtggcttcaacaacagcattacaatcggtataaaaagaatgaacaataaccccttgattccagagagtaaacttcctgcactcggcaccacgatttttacccagatgagcgccctggcccagcagcatcaggccataaacctgtcccagggctttcccgattttgacggcccgcgctatctgcaggagcgtctggcgtaccacgtggcgcagggggcgaatcagtacgccccgatgaccggcgtgccggcgctgcgcgaggcgatcgccgggaagacggcggagctgtatggttaccagcccgacgttaacagcgagatcacggtcaccgccggcgcgacggaggccctgtatgcggcgatcaccgccctggtgcgccgcggcgacgaggtgatctgtttcgatcccagctatgacagctacgcccctgcggtggcgctggccggcggcgagttacgtcgtattgcgctgcagccgccgcattttcgcgtcgactggcggcaatttgccgccgccctgagcgagaaaacccggctggtgatcctcaacaccccgcacaacccttcggccaccgtctggcagcgcgaggattttgccgccctgtggcaggcgatcgccgaacgcgagatctatgtcctgagcgatgaagtctatgagcatatctgctttgctgagggcggccacgccagcgtactggcgcatccacagctgcgcgagcgggcggtggcggtctcttcgtttggcaaaacctttcatatgaccggctggaaggtcggctactgcgtggccccggcggccatcagcgccgaactgcgcaaggtgcaccagtatctgaccttctcggtgaataccccggcgcagctggcgatcgccgacatgctgcgcgaagcgccggagcattatcgtgagctgccggcgttttatcgggaacgtcgcgatctgtttattgaagcgctgcgtcccagccggctggaaatcctgccctgtgaagggacctatttcctgctggcggactacagcgccatctccgatcttgacgatgtcagcttctgccgctggttgaccactgagatcggcgtggcggcgatcccgctctccgtcttctgcgccgatccgttcccgcacaagctgatccgcttgtgcttcgccaaacagccggcgactctgctggctgcggcgacgcgtttgtgccagctgtag

SEQ ID NO: 6100 - DNA, 867 bp, Klebsiella pneumoniae
ttcactaagcgaggcaaacagatgaagatgaccgaatcacaaaaagtcgccgcggcggcgtggcgtattcgccgttacgccctgcaaatgggggaagtgcaggggcagggctatatcggccaggcgctgggctatgccgatgtgctcgccaccgccttcagccatgccatgacctatcgcccggaagatcccgagtgggaggggcgcgatcgcttcctgctctctcatggccattacgctatcgcttattatgccgcgctgctggaggcgggcattatcccggaagccgaactggaaacctacggctccgacgacagccgcctgccgatgtccggcatggcgacctacaccccggggatggagatgtccggcggctcgctggggcagggactgtccattgccgtcggcatggcgcttgggctgcggcagaaacagagcaaggcctgggtctacaactccatgtccgatggggagctggacgaagggtcgacctgggaggcggcgatgtcggcggctcactatggcctgagcaacctgattaaccttgtcgatgtcaacaaacagcaggctgacggcgattcacgcaaaatcctcggctttgagccgctgcaggataaatgggccgccttcggctggtacgtacagcgcgtggacggtaacgatctgccggcggtgatggccgcctttgacaacgcgaaaagttattccggcaatcagccgcgggtcattttatgcgacacgctgatgggcaaaggggtgccgttcctcgaaacccgcgataaaaaccattttattcgcgtcgatgccgacgaatggcaaaaagcgatcgcggtgctggacgctaacaaaccggaaggagtgctgtaa

SEQ ID NO: 6101 - DNA, 420 bp, Klebsiella pneumoniae
ccaggaaagcgcgttgacgtgctgggggttagaccagtgaaaacatcttctgtcgtcattctggtgctgggcgagattctcctttcggcgctgattatctttgttctccttcatcaggtggggaaagagaaaaaacgtgctgatgatgcagaagggcaggtgaccagcgcacaggccatcaccgcaaacgtcctgactaccatgaccatcttcaactccatctcagaggctaaccagcatgcaaaagagcagatcgcactggacgcatcgggagcctcggctgatatccgggttgctgttgcgaatgatgattgcgctaatcgccctgtgcctgctggcgcagttaagcggctgcagcaatatgcgaacggtttacgtcaaggtgccggtagtggcgttaccggtcagcctgacagctga

SEQ ID NO: 6102 - DNA, 1743 bp, Klebsiella pneumoniae
ccgtttgagcgcgggtttccggctcatctgacaaagaccttagcacaagcgccgcggtggaatttaccgcaggccgtgaaaagtgtgtcatttgctggcataatgtctgctgtatcacaccccctcatactcttttttcaggatatccccgtgctagtatccagcaacgttaccatgcagtttggcagtaagccgctgttcgaaaatatctccgttaaatttggcggcggcaaccgttatggtctgatcggcgccaacggcagcggtaaatcgacctttatgaagatcctcggcggcgatctcgaaccgacgctgggcaacgtttctctcgacccgaacgagcgcatcggtaagctgcgtcaggatcagttcgcctttgaagcgttcaccgtgctggatacggtcatcatgggccacggcgagctgtgggaagtgaagcaggagcgcgatcgtatctacgccctcgctgagatgagtgaagaagatggctacaaagtggccgacctggaagtcaaatatggcgaaatggacggctactcggcggaagcgcgcgccggcgaactgctgctcggcgtcggcattccggttgaacagcattatggcccgatgagcgaagtcgcgccgggctggaagctgcgcgtcctgctggcgcaggcgctgttttccaatccggatatcctgctgctcgatgaaccgaccaacaacctggacatcgacaccattcgctggctggagcagacgctgaacgatcgcgacagcaccatgattatcatttcgcacgaccgtcacttcctgaacatggtctgcacccacatggcggatctcgactacggcgagctgcgcgtgtatccgggcaactacgacgaatacatgaccgcggccacccaggcgcgtgagcgtctgctggcggacaacgccaagaaaaaagcgcagattgcggacctgcagtccttcgttagccgcttcagcgccaacgcctctaaatcgcgtcaggccacctcgcgcgcgcgccagattgacaaaatcaagctggaagaggttaaagcctccagccgtcagaacccatttatccgcttcgagcaggataagaaactgttccgtaacgcgctggaagtggaagcccttaccaaaggctttgatgaaggtccgctgttcaaaaacgtcaacctgctgctggaagtgggcgaaaagatcgccattctgggcgccaacggcgtgggtaaatccaccatgctgaaaaccctggtaggcgaactgcagccggacaacggcagcgtgaaatggtctgaaaacgcgcaaatcggctactacgcgcaggaccatgagtacgagttcgaaaacgacctgacggtcttcgaatggatgagccagtggaagcaggaaggcgacgacgagcaggcagtacgcagcatcctcggccgtctgctgtttagccaggacgatatcaaaaagccggcgaaggtgctttccggtggcgagaaagggcgcatgctgttcggtaagctgatgatgcagaagccaaacatcctggtgatggacgaaccgaccaaccacctggatatggagtcgattgaatcgctgaacatggcgctggagatgtatcagggcaccctgatctttgtctcccacgaccgtgagtttgtcagctcgctggcgacccgcgtcctggagatcactccggaccgcgtgatcgacttcagcggcaactacgaagactacctgcgcagcaaaggtatcgagtaa

SEQ ID NO: 6103 - DNA, 186 bp, Klebsiella pneumoniae
ctggcagagcgccggctggaaatgaccatccagaacatgcgcatcaaccacaacgcagtttcagctactcactgctgcgactgcggggaagagatacccgaacggcgccgggaactggtggctggctgtcagcgctgcgctgactgtcaggaagagtttgaagaacgtggtaagcatctgaggtga

SEQ ID NO: 6104 - DNA, 1527 bp, Klebsiella pneumoniae
gatcgccggcgagccgacgccagccacctacgacttcaaggcggcagcgattccccaggcgctgctggcggcccagccgggagcggtaaacgtggcgtcgctggggaaaattatccctggctggggccagaccgaagactttatcgcgccgtggttcgcgacgctggaagcgaaaaacaaataaaatcaagccgggtggcggtgggcggcggcctggtgccctcgccccggccctctccgcagggagagggggaaaaccatgccaccgggcgagagggatcccctatgtcagcattaccttcccccgaatacagccgcaatatgcggctgattggccatagcgatcagggcggtcgtccggacggcgtgcagctgatggtgcatcgcggattcgcctatatcggccatatggtgtcgcagggtttttccgtggtcgatgttcgcgatccgacccggcccaccaccgtcaactatattgccgcgccgccgggcacctggaacgtgcatctgcaggcgcatgacgatctgctgctggtgatcaacgcccgggatctgtttgccgacgcccgttttgctgatgagaaggtctactacacccgctcggtgggcgacacggtcagcgatgtgcaggacaagggctggagcgccgggctgcgcatctttgatatttccactcccgcgcagccgcgggaaatcagtttcctgtcgcttaacggcatcggtattcaccgcatctggtacgtcggcgggcgctgggcgtatgtgtccgcgctgatcgacggttttaccgactacatcttcctgaccatcgatctggccgatccgcgtaagcccgaagtagccgggcgctggtggttgccggggatgcaccaggcgggcggtgaaacaccggactggccgcagggcaaacgctatgcgctgcatcacgccattattgccggggataccgcctacggcagctggcgcgacggcggcctgacgctgctggatgtcaaagaccgtacccagccgaggctgattagccatcgcaactggagcccgccgttcggcggcggaacgcataccgcgctgccgctgccggatcgtgacctgctggtggtgctcgacgaagcggtgctcgacaatcaggaggacggtgagaagctgatctggctgtttgatatccgcgagccaaccaacccggtgagcatcgccaccttcccgccgccggacgaagcggattatgtggcgaaaggggcgcatttcggcccgcacaacctgcatgagaaccggccggggagctttgtcagctcaacgctgatttttgccacgtatcagaatgccggcgtgcgggcttacgacatttccaacccgtaccgtccgctggagaccggggcgctggcgccggctgcgcctgagagaatgatggatacccgtcccggccgcccgcgggtgatccagtcctgtgacgtgtttgtcgatgcgcaaggcattatctacagcaccgattacaacggcgggctatcggtgattgagtatctggggtga

SEQ ID NO: 6105 - DNA, 189 bp, Klebsiella pneumoniae
atgtcgcggcggataaacaatatgaccccgaaaaccggggccatccgtcttgccacgttgcgcctgtttctgccggatggcggctgcgccttatccggcctacggtccgtgcggcctgcctttaatttggcctcaaccccccggtggcgctgccgcttaccggggctacagcgctgtgcgatttggtag

SEQ ID NO: 6106 - DNA, 216 bp, Klebsiella pneumoniae
ttgcggcggcgaaaagcctgccccagccgccagctgatcgtggccaccgatcgcggtattttctataaaatgcagcaggcggtgccggagaaaacgctgctggaagcgccccaccgccggcgaaagggcgacctgccgcagctgcgcgcattgtccgtggatggcgatgaatggcctgaaagccattgccgagggtctcgagcagggcggcgctga

SEQ ID NO: 6107 - DNA, 1251 bp, Klebsiella pneumoniae
aggcccaggcgcagacgctgctggcgcggcctggggtcagccagatcccggcggtacaggaaaagcgggcctatggcgtttatcaccacttctataaccacccgtggaatattgtcggcatggaatacctggcgaaagatatctacccgcaggccttcggcgatctcaacccggatgagacgtaccattatatcgtgcgccatttcaccgacctgccggaccagccgttcgtcttctcctggcagcagagcgagtaaatacagcatgcgtttaacctccgactccgtgctcgacgggctgcccgccgggacctctggcgtgatggatgactatcgccgtatcgtgcgtcgccgtctgctgctgatcctcctgctggcgctgttgattgtcgcgtcgctgctgctcgattttatgctcggcccctccggtctgccgctgcagagcctgtggcagacgttaaccgatccggccagcgccgatccgggcacgcgcgctatcgtctgggatatccgtctgccctatgcggtgatggcgattatcgtcggtctggcgctgggactggccggcgccgaaatgcagaccatcctcaataacccgctggccagcccgtttaccctcggcgtctcctcggctgcggcgtttggcgccgcgctggcgattgtgctgggtattggtctgcccggtattcccggccagtggtttatctcggccaacgcctttatcttcgccctgctggcggccctgctgctggacggcatcacccgctggacccaggtggccacctccggcgtcattctgttcggcatcgcgctggtctttacctttaacgctctggtctcgatgctgcagttcatcgccaacgaagacacgctgcaggggctggtgttctggaccatgggcagcatcgatcgcgcctcctggagcaaagtcgccatcctgctggtcgccctggcgctggtgatgcccctgtcgctgcgcagcgcgtggaagctgaccgccctgcggttgggcgaggaccgggccatcagctttggcattaacgttcgccgtctgcgcctgaccacgctgctgcggatcagcatcctgtcagcgctttcggtggcctttgtcgggccaatcggctttatcggcctggtggcgccgcatattgcgcggatgctcttcggcgaagaccatcgcttttatctgcccgccagcgcgctgatcggcgccctggtgctctcctggcctccatcgcctcgaaaaacctga

SEQ ID NO: 6108 - DNA, 222 bp, Klebsiella pneumoniae
cgtgccaggcgacgattcttacccagaccctcgcccagcggcctgaattgcgacgcctggctgctgccgtcacagagcatcgaaggatccatgcaggagcgcaaccggctgctggccagcaaagacgtcgctgacgtggtgtcgcgctttgatgaagtggatatcgccatcgtcggcatcggcattctcgaaccctctcaactgctgaaaaccctccggtaa

SEQ ID NO: 6109 - DNA, 753 bp, Klebsiella pneumoniae
tggccgaggcgatccagcatccggacgtcatttccgcttatctgggagaagccaattatgcttaacgcccgggaactgaaggtcttttacggcgtgatccagggtctgaagggcgtcgatatcgacgtctatgaccgggaaatcgtcaccctgatcggcagcaatggcgccggtaaaacctccaccctgaacgggatcgtcaacctggtgcgctccagtgggcgcgtcagcttcctcaacgacgatatctcacgcagccagacccaccagatcgtgcgtcgcgggctggcgctggtgccggagggacggcgcgtctttaccaacctgaccatcgaagagaacctgcgcatgggcgcttacaataatctcgccggctacgcccgcctgcgcgatcgcatgtacgccctctttccgcggctcaaggagcggcgccatcagatggcgggcaccatgagcggcggcgagcagcagatgctggccatcgcccgggcgctgatgagcgagccggtgttattgatgctggatgaaccgagcctcgggctggcgccgaaaattgtcggcgagctgttcggcatcattaagcaactgcgcgaagagaatatgacggtgctgctggtggagcagaatgcgacggccgcgctggcaatcgccgatcgggcgtatgtcctggagaatggccggatcaccttgtcaggcgcggcgcgggagatgctgactaatccggaaattaagcggatgtatctggggggatag

SEQ ID NO: 6110 - DNA, 402 bp, Klebsiella pneumoniae
gctgcagggcgccggcaaagtccagccccagcgtgctgttgggggcgatgtcaaaggccagctccatcggggcgaggggcagggtctgtccgcaccagccctgggcttccccgcgcagggcgaccagctcgcgcagcggacgctgatacagagtgccagcctgccactccagctcacgcacgcaggtcatctgatggatccagccctgcgcgcgggtgggctgatgcatctcgtccccgtcggggacgcccatccagccgaccagcaggcggcggccatcgtcggcctgcatggtctgcggcgcgtagaactcaaatccgctgtccagctcgtgcagcgggccgtggtcgaagactcccgcgttcggcgtcgaagcggcctgccatccacaccgccggatag

SEQ ID NO: 6111 - DNA, 1425 bp, Klebsiella pneumoniae
accgaccagctcggcgaattcacccgaggcataaatcacccctttgccttcccgtgccagaccatcgatcagcatgaacagatcggttttcgctttcacatcgacccctttggtcggttcgtcaaaaatcaaaacgttggcatcaccgcgcagccatttgccaatggccaccttctgctggttgccgccagaaagacggcgcagcgtctgaccgggaccggtagcgcgcacgccgaggcgggcaatcacctcctccgcccagcgccaggcctgccgatggccaaacaggctccagcgcgaaaagctgttatcggcgctgaccgccaggttcatcgcgatcggctcttcaatgaaaatgccctctttgcgtcgctcctccgggaccagcgccaggccgcgccccaccgagtcggctggatcgcgcggtcgccacggctggccgttcagctcgccccgctgcacccggcttttgctggcgccgaacagcgctttgcacagctcggttttgcccgcgccggccagcccggcgataccaagaatttcccccttccgcaggcgcagcgaaatatcctgcagcagcgcctcatcatgcagaccgtcaacctgcagcagcacctcttcgccgtgcggcgggcgcggcggcgggaagatatcgctcagctcgtggcccagcatcttttcgacgatctgttcgccgctcagcggcgccatcgggccgctctcaatcagccgcccgtcgcgcagcaccgtcagggtgtcgcagatcgccttcagctcatggatacgatgcgaaataaacaccaccccgatcccctgatgctgcagacggcgtactaccgcaaacagacgctcactttcatgctgatccaacggcgcggtgggttcatcgaggatcaaaaagcggcaatggtgcgacagggcgcgggccaacaggatttgctgtttttcggcgagcgtgcagctgtcaatggagcgccggacgtccagcgccacatccagctgcgccagcgcctcgcgcgccagctgccgaacccgcgaccagcggaaggtcatgcccgactccgccagcctgtccagcataatgttttccgcaatgctcaggcccggcaccagcgccacgtccacctcctgctgcaccaggtggatccccagctgtttagcatcccgcggcgaacgaatgatgaccggctggttgttgatcgtcacttcgccctcatagtgggcgtgggtgccgcacagcacggccatcagcgtcgacttacccgcgccgttggccccggtcagggcatgcaccgacccgccatggagggtaaagtccaccttgttcagcgcctgaaagccggagaaggccaggctaatgttatgcatctcaaggcgattcgcgctcatcactgctcccgtgcggcaattaatcttctgatttaa

SEQ ID NO: 6112 - DNA, 2556 bp, Klebsiella pneumoniae
aatagacagctgtgcagatggataacgacgatgcctcaacgatggattaccccaggactgaaaacacggcttgccttcggcatgatctttttgttcgttcagcccgacgtcagcgctgctgccgcaggcgcgcagcagattggcggggtgattattccgcaggccttcagccaggcgctgcaggacggcatgagcgtcccgctctatattcatctcgccggcagccagagcacccgggacgatcagcggatcggcagcgcctttatctggctggacggcggccagctgcgcgttcggcagatccagctggaggagagcgaaggtaacgccagcgtcagcgaacagacccgccagcagctgattggcctggccaacgccccgttcagcgaggcgctcaccattcccctgaccgacagcgcacagctggatctcagcctgcgccagctgctgctgcagctggtggtcaagcgcgaggcgctgggcaccgtcctgcgctcgcgcagcgaagatatcggtcagtccagcgtcaacgctctcagcagcaacctgagctataacctcggcgtctataacaaccagatgcgtaacggcgggagcaacacctccagctacctgtcgctgaacaacgtcacggcgctgcgtgagcatcacgtggtgctcgacggctcgctatacggcatcggcagcggtcagcaggacagtgaattatataaggccatgtatgagcgcgatttcgccggccaccgctttgccggcgggatgcttgacacctggaacctgcagtccctgggaccgatgaccgctatttcggccggtaagatttacggcctttcctgggggaaccaggccagctccaccgtcttcgacaacagccagtccgccacgccggtgatcgcctttctgccggcggcgggcgaggtgcatctcacccgtgacggtcggttgctgagcgtccagaacttcgccatgggcaaccatgaagtggatacccgcggcctgccgtacggtatttacgacgtggaagtggaggtgatcgtcaatggtcgggtggtcagcaaacgcacccagcgggtcaataagctgttcagccggggacgcggcgccggcgcgccgctggcgtggcaggtatggggcggcagttttcatatggatcgctggtcagagagcgggaaaaagacccggccggcgaaagagagctggctggcaggcctttcggcctccgggtcgctcagcaccctgagctgggcggctacgggctatggctacgacaaccaggcggtgggggaaacccgcctgacgctaccgctgggcgagtcgatcaacgttaacctgcaaaacatgctggccagcgacagctcgtggagcagcgtcggcagcatcagcgccacgttgcccgggggattcagttcagtgtgggttaaccaggagagaacccgcattggcgatcaattgcggcgcagcgatgccgacaaccgggcgatcggcggcaccctcaacctgaacgcgctgtggtcgaagctggggacgttcagcgtcagctacaacgatgaccgtcgctacaacagccattactacaccgcggattactatcagacggtctacagcggcgcctttggctcgctcggcctgcgggcgggaatccagcgctataacaatggcgacagcagcgccaacaccgggaaatatatcgccctcgatctgtcgctgccgctgggcaactggttcagcgccgggatgacccatcagaacggctacaccatggctaacctctcagcgcgcaagcagtttgatgaaggcactattcgcaccatcggcaccaatctgtcgcgggcaatctccggcgataccggggatgacaaaaccctcagcggcggcgcgtatgcccagttcgacgcccgctacgccagcggcacgctgaacgtcaacagcgcggcggacggctacgtcaacaccaacctcaccgccagcggcagcgtcggctggcagggcaaaaatatcgccgccagcggacgaaccgacggcaacgccggggtgatcttcaacaccgggctggaggacgatggtcagattagcgccagggttaacgggcggatcttcccgctcagcggcaagcgtaactacctgccgctctctccctatggtcgctatgaggtggagctgcagaacagcaaaaactcgctcgacagctacgacatcgtcagcgggcgcaagagtcatctgaccctttatccgggcaacgtcgcggtgattgagccagaggtgaagcagatggtcaccgtctccggccgtattcgtgcagaagacggcacgctgctggcgaatgcgcggattaacaaccatatcggccgtacccgcaccgatgaaaacggcgagtttgtcatggacgtggataagaaataccccactatcgatttcagctacggcggcaataaaacctgcgaagtggcgctggagctcagccaggcgcgcggcgccgtctgggtcggggatgtggtctgcagcggcctctcgtcgtgggcggcggtgcagcagtcaggagaagagaataaaagttaa

SEQ ID NO: 6113 - DNA, 1125 bp, Klebsiella pneumoniae
catcaggttagcccaacacccataaggacagcttccatgagcaacagcgatatccgcgtcgtgcccggcccggccaactatttctcccatcctggcagccttgagcggctgagcgatttttttaacgccgaccagctctcgcgagcggtgtgggtctatggcgagcgcgctctggccggcgccgaaccttttctgccggcggccttccacctgccggaggcgaaaaagatccgctttaccggccactgcagcgaacgcgacgtggcggggctggtgcaggcctccggtgacgatcgggcggtagtgattggcgtcggcggcggcgcgctgctcgacagcgcgaaagtgctggcccgccgcctgggggtaccgctggtggccatcccgactatcgccgccacctgcgcggcgtggacgccgctgtcggtgtggtatagcgacgccggacaggccctgaattttgagctcttcgatgacgccaactttctggtgctggtcgaaccgcgcattattctcaacgccccggcggagtacctgctagcgggcattggcgacaccttagccaaatggtatgaggccgtggtgctggcgccgcagccggaggcgctgccgctcaccgtgcggctggggattaacggcgcgcaggcgatccgcgatgtgctgctggccagcagcgaaacggcgctggcggaccagcgccgcggcgatctgacccaggcgtttcgcgatgtggtggaggcgattatcgccggcggcgggatggttggcgggctgggggaacgttacacccgggtcgccgccgcccatgcggtgcacaacggactgacggtgctgccgcagacggataaattcctccacggtaccaaagtggcctacggcattctggtacagagcgccctgcttggtcaggacgatgtgctggcgcagttagtgcaggcgtatcagcactttaacctgccgaccaccctggcggcgctggaggtcgatatcaataaccgcgcagagctggaccgggtcattgcccataccctgcgcccgggcgagtcgattcactatttaccggtgacgttaacccctgaggttctgcgcgcggcgtttgagaaggtggaatacttcagccgttaa

SEQ ID NO: 6114 - DNA, 333 bp, Klebsiella pneumoniae
acggggcatagccgtggaccagcggcaggagctcctcctgcaccgccagccagaaatcgcggtgacagggcagctcaaccccgcggcgctggttgtcgatcgcgtcgatcagcaggtagaccgccggcggcagtctcccctcgcgggtcagggcggccagcggcgaccacaccggcatgctctcggcccagaactggccgtccagcaggatcgccagcggccgcgtttgcgggtcgacggcctcgccaggggtgtagatccagacccggcgatggttgcccagacgcgcgctgcgccactcaagacaacgggcgggaggatgcgcctcattaa

SEQ ID NO: 6115 - DNA, 477 bp, Klebsiella pneumoniae
tatatgaatagaataaaatttgcttttggcttttttatttctggcgctatgctgggccttttttataatttgctgaacgataaaatacatcataaggaagagtgcacggcatcgctcgtcgtgttcaagggtaatacacaaactaacttgacgttaaatttcatgtattcgcttgatgaaagcaagggcactgttgcggtcagcggtagttatctggatggagggaaactgcagggccacatcagaagagacgtcatttatgatatggtcaaaaatcatgaatctcatcatttccactcccgagaaataaaccgatacggtaacattgattctgtatcggatacgttcctggccaccatcctgccagatttttacgtttatccggatgaaaaaataagctatatcatctcaaaacaaaatgaacatagcttcctgataaaagttggttcaaggccactactgtattgcgctaactaa

SEQ ID NO: 6116 - DNA, 1344 bp, Klebsiella pneumoniae
gttcagtgtagacttgtaaacctaaatgttttcaaaatggtttacaagtcgcttatgacactggacgatctcgctttcgatcggcgccacatctggcacccctacacctctatgacttcccccctgccggtctatccggtggtgtccgcccacggttgcgagctgtccctcgccggcggcgaacagttggttgacggtatgtcttcctggtgggcggcgatccacggctacaatcacccacgcctcaatgcggcgctgaaggggcaaattgaccaaatgtcgcacgtgatgttcggcgggatcacccatccgccggcagttgcgctatgccgtcagctggtggcgatgaccccggcctcgctggagtgcgttttcctcgccgactccggttcggtggcggtagaggtggcgatgaaaatggcgctgcagtactggcaggctaaaggcgaaccacgtcgtcgttttctgaccttccgcaacggctatcacggggataccttcggagcgatgtcggtctgcgatccgcagaactcgatgcacagcctgtggcagggctacctgccggataacctgttcgcccccgcgccgcaaagccgctttgacggcgagtgggacgagatggatatggtaccgtttgcccgcctgatggccgcgcatcgtcacgaaatcgccgcggtgatcctcgaacctatcgtccagggggtaggcggcatgcggatgtaccatccggagtggctgaagcgggtgcgtaaaatgtgcgaccgggaagggatactgctgatcgccgatgagattgccaccggctttggccgcaccggcaagctgttcgcttgtgaacacgccgggattaccgccgacattctgtgtctgggcaaagcgctgaccggcggcaccatgaccctttccgccgccatcactacccgaacggttgctgaaaccattagcaatggcgaagccggttgctttatgcacggccccacctttatgggcaatccgctggcctgcgcggtggccggcgaaagcctgcgcctgctggagagcggcgaatggcagctgcaggtagcggcgattgaagcccagctgcaggccgagctggccccggcgcggggatctgcgctggtcgcggacgtccgcgtgctgggcgctattggcgtggttgaaacccgtcgcccggtcaacatggccgccctgcagcgctttttcgtcgagcagggagtctggatccgtccgtttggccggctgatttatctgatgccgccgtacatcatcacgcccgagcagctgacccgcctgacccgtgcggtcaaccaggcagtgcaggacgaaacattttttagcgaataa

SEQ ID NO: 6117 - DNA, 474 bp, Klebsiella pneumoniae
tggagtattttggcgaggaaatctttggcacgctcggattgcggattggcaaagaaggcctctttatcggcatcctcgacaatcttcccttcatccataaagatcacccggttcgccaccttgcgggcaaagcccatctcatgggtcacgaccatcatggtcatcccttcgttagccagttcgaccataacgtccagcacctcgttaatcatctccgggtcaagcgctgaggtgggctcatcaaacagcatggcgatcgggtccatacacagggctcgggcaatggccacgcgctgctgctggccgccggagagctgcgccgggtatttttccgcgtgcgccgccaggccaacgcgctccagcaacttgaggcctttcttgcgcgctgaggctttatcgcggttaagcactttgacctgcgccagcgtcaggttgtcgataattgacagatgcgggaacagttcaaaatgctga

SEQ ID NO: 6118 - DNA, 192 bp, Klebsiella pneumoniae
attttcttcagccgggtcagtaacatctttttgtgtcgaactgtatgtgacattgcacgatccaccgtttcattctgtccgggattaccgacctgcgtggtcagcaacgcctgccagcataccatgatcctttttattagccgctttatctactggggggtagtattttactactgggggggagtaggataa

SEQ ID NO: 6119 - DNA, 246 bp, Klebsiella pneumoniae
agttacttcagcgttacagtactgtctacagcgttgctcaatcatacattccggattatccatgcggtgttttggatgctttatgttttatccaaagaaacaaaccataaggagatctcgttatgccaacagtgccaactgtacaaggagtgccaactgtacaaggccgccaggttgaaagccgcggcgtttcatctccgggattccagaccttcgaccagcccaatgttagcgatgcgctggtaa

SEQ ID NO: 6120 - DNA, 420 bp, Klebsiella pneumoniae
acttcgttcagaaaagcaaacatggcgcacttttgtcgttacctcctatccctgctaatctgtccaaaactaactagtggggatagggatatgaaaaaggctttatttgcgttcttggcactgatgtcatttagtgcagtttccgcgacaacaataagcattccaactgattcgaaagccaaatacaccatcattgataaaagcttaaatggtaccatggcgaccatcacgaccatgagagaggggccgtcagggacatcttactcacagcgcctgtatgactgcacatcgtggacagttaagtatcttggtgatggtgatacgctggagcagatgaaagcatccaagcctgacgaaggaatgtcaccaatagttgataattcaatagcgtattatataggccaacgggcctgtaaataa

SEQ ID NO: 6121 - DNA, 1722 bp, Klebsiella pneumoniae
agtccatccaggttgagatgggtaaattccagtccatattttaaccgggaggtttttttgcaatttgactacatcattattggtgccggctccgccggcaacgttctggcaacacgactgactgaagatccaaacaccaccgtcctgctgctggaagccggcggccctgactaccggttcgatttccgcacccagatgcccgccgcgctggcttatccgctgcagggcaagcgctacaactgggcctacgaaaccgaaccggagccgtacatgaacaatcgccgcatggagtgcggacgcggcaaagggctcggcggctcctcgctgatcaacggcatgtgctacattcgcggtaacgcgatggatctggacaactgggccaaagagccgggtctggaacactggagctatctcgactgcctgccctactaccggaaagcggaaacccgcgatatcgggcctaacgactaccacggcggcgatggcccggtgagcgtgacgacgccgaagccgggcaataatccgctcttcgaggcgatggttgaagccggggtgcaggcgggctatccgcgtaccgacgatctcaacggctaccagcaggaaggctttggcccgatggaccgcaccgtgacgccgcagggccgtcgcgccagcaccgcccgcggctatctcgaccaggcgcgcggtcgcccgaacctgaccatccgcacccatgcgctgaccgatcacattatttttgccggcaagcgcgcggtgggcgtcgagtggctggagggagagagcacgatcccgtcaaaagcgacggccaacaaagaggtgctgctgtgcgccggggcgattgcctcgccgcagatcctgcagcgctccggcgtgggtaacccggagctgctcaggcagttcgatatcccggtggtgcacgatctccccggcgtgggtgagaacctgcaggaccatctggagatgtatctgcagtacgagtgcaaagagccggtatcgctctacccggcgctacagtggtggaaccagccgaagatcggcgccgagtggctgttcggcggcaccggcatcggcgccagcaaccagttcgaagcgggcggttttatccgcagccgcgcagagttcgcctggccgaacattcagtaccacttcctgccggtggcgattaactacaatggctccaacgcggtgaaagagcacggcttccagtgccacgtcggctcgatgcgttcgcccagccgcggccacgtgcgcctgaagtcgcgcgacccgcacgcccatccggcgatcctgtttaactatatgtcccatgagcaggactggcaggagttccgcgacgccatccgcattacccgggagatcatgaaccagccggcgctggataagtatcgcggccgcgaaatcagtccgggaatagaatgccagagcgatgccgaactggatgagtttgtgcgcaaccacgccgagaccgcgttccacccgtgcgggacctgtaagatgggttacgacgagatggcggtggtcgatggcgagggccgcgtccacggtctggaaggattgcgggtggtcgacgcctcgatcatgccgcagatcatcaccggcaacctcaacgccaccaccattatgatcggcgagaagatggccgacgccattcgcggccgccagccgctgccgcgcagcaccgcgacgtattatgtcgctggcgacgcgccggttcgccgttaa

SEQ ID NO: 6122 - DNA, 384 bp, Klebsiella pneumoniae
aggagtaccaggcgcgggcgcggggatactcctgcagcagggccgccagggcctggatctcagcgaatgacggcagggtttcacaggccagcaggtcggcgccggcatccagcagcgcttcgacgcgcgggcggtggaaggcctggaactctgccgcgctgcgctgataatcgccgcgatactccgagccgtcggcgagaaacgcgccatacggccccaccgaaccggccaccagcagcgtaccggcctgcgggttctcggcgaggtacgcctcgcgcgctttgcgcgccagctcgacgcttttgccgattagcgcccgggactgcgcctcatccagcccgcgcgcggcaaagcccgccggagtggcctgatagctggcggtga

SEQ ID NO: 6123 - DNA, 921 bp, Klebsiella pneumoniae
acgggtaccagttcctgtctatactggtattggcactactatgctggaggggtgatgaccacgatgccgcaacgggagtcgacgatcgccgtgccggacgatcgacgcaaacagctgggggcctttctgcgcgcccgccgtgaaagcctcgatccgcagcgcctggggttgccccgggtgggccgccggcgcacgccgggtctgcgccgggaagaggtggcgatgctcgccgacgtcggcgttacctggtacacctggctggagcaggggcgggaggtgaatccgtcggaggcggtgctggtgggggtggcgaatgccctgcagtgcagtccgctggagacccggcatctgttcgtgctcgccgggctgaccccgccggaagccacccaggtgacggtgtgcgaaggcatcagccctggcacccgccggatgctggacagcctgatgccgcagccggccagcattcagaaaccgaactttgatattgtggcgtggaacgacagcttctgccgcctgatgggcatcgatttcgccaccctcccggaagaagatcgcaactgcatttatctctatctgacccatgagacctggcgcagccggatcgaaaatcgcgatgtgctgccgaccttcgtctcctatttccgcgccgcgatggccgagcaccgcggcgatccggcgtgggaaaacaaactggcgcgctttttcgccgcctcgtcggagtttgaagcgctgtggcatcagcgctacgaggtgcgcggcgtggaaaaccagattaaacattttaaccacccgcagctcgggcgattcagcctgcagcagatgtactggtattcagcgccgcgcaacggctcgcgcctgctggtctacctgccgatggacgaggcgggcgagcaggcgctggcgtggctggaccaacattaa

SEQ ID NO: 6124 - DNA, 885 bp, Klebsiella pneumoniae
cgtcaaaccaggatggcggtaaaactcagaaaacttctgggtcttgcagccggatggcagaatgtccaacataataccctaacccgacggagcgaaaaaaagaactttgccatgaaattaaatagccgagcgcaatctgcacagaatccgcacaaccactccccgatcgtgctggtccacggtctgtttggcagcctggacaacctgggcatcctcgcccgcgacctgatcgccgaccacgatattgtgcaggtcgatatgcgcaaccacggtttgtcgccgcggtcgccagagatgacctaccccgccatggcgcaggatctgcttgatacgctcgacgcgcaccagatcgagcgcgccacctttatcggccattcgatgggcgggaaagcggtaatggcgcttaccgccctggcgcctgaacgcatcagcggtctggtagcgatcgatatcgcgccggtggattatcacgttcgccgccatgatgagattttcgccgctatccgcgccgtcagcgaatccgccgccagcacccgccagcaggcggcgcatgtgatgcgcgagcacctgcaggaagaaggcgtgattcagttcctgctgaaatcattcgtcgacggcgactggcgcttcaacgtgccggtgctgtgggaccagtatccgcatatcgtcggctgggaaaccatcccggcctggccgcacccgacgcagtttattcccggcggcaactcgccctatgtgaccgacgcctaccgcgacgcgctgctggcccagttcccgcaggcccgggcccacgtcatcgccggcgccggacactgggtccatgccgagaaacccgaggcggtgttacgcgccatccgccgctatctgacgagcatcgccgcctga

SEQ ID NO: 6125 - DNA, 951 bp, Klebsiella pneumoniae
cgccccgccaggcaacaagacaggaggtttttgatgctgatttttattcctatccttattttcgtcgcgctggttattgtggccgcggcggtgaaaattgtcccgcagggctaccagtggacggtggagcgcttcgggcgttttacccagacgctgcagccgggattaagcttagtcgtgccgtttatggaccgtatcggccgcaaagtgaacatgatggagcaggtgctcgatatcccctcgcaggaggttatctcccgggataacgccaacgtcaccatcgacgcggtctgctttattcaggtgatcgacgcgccaaaggccgcctacgaggtcagcaatcttgagcaggcgatcgtcaacctgacgatgaccaacatccgtaccgtgctcggctcaatggagctggacgaaatgctctcccagcgcgacagcattaacacccgcctgctgcatatcgttgacgacgccaccaacccgtggggggtgaaaatcacccgcgtcgaaattcgcgacgttcgcccgccggcggagcttatcgcctcgatgaacgcccagatgaaagccgaacgtaccaaacgcgcgtacatccttgaggccgaaggggtgcgacaggcggaaattctgaaagcggaaggggaaaagcagtcgcagatcctcaaggccgagggcgaacggcagtccgcgttcctgcaggcggaggctcgcgaacggtccgccgaagcggaagcccgcgccacccaaatggtctcctcggcgatcgcctcgggcgatattcaggcgatcaactacttcgtggcgcagaaatacaccgatgcgctgcagcagattggcgccgctaacaacagcaaagtggtattgatgccgctggatgccagcagcctgatgggatcgatcgccgggatcagcgagctgatcaaagaaggcgctggcgatcggaaaaaatcatga

SEQ ID NO: 6126 - DNA, 324 bp, Klebsiella pneumoniae
gagagcgccaggtacatcatcggcaggatctctaccttgccattgaccgccatcggacggtctttaatggcatgcatacccagaatagcgctctgcggtgggttgatgatcggcgtggacatcagggagccgaagacgccgccgttggtaatagtgaagttacctccgctcaggtcgtatacggtcagcttgccgtcgcggcctttcactgccagctctttgatattcttttggatatccgccatgcccagcaggtcgacgtcacgcagaaccgggttgaccagaccgcgcggagtggaaacgcccatgttgacgtcgaagtag

SEQ ID NO: 6127 - DNA, 432 bp, Klebsiella pneumoniae
gccatggccagagcacgtggacgcggacgtcgcgaactgaagtccgagatcaacatcgttccgctgctggatgtcctgctggtgctgctgctgatctttatggcaacggcgccaatcattacgcagagcgtggaagtcgatctgccggacgccacggaatcgcaagcggtgaaaagcaatgacgatccgccggtgattgtggaagtctccggggtagggcagtacagcgtgaaggtggggcaggagacgctgtcccagctgccgccggagcaggtaattgccgaagcgaagcgtcgtcttgaagccaatgaaaaaacggtattcctgatcggcggtgcgaaagacgtcccttacgatgaaattattaaagcgctgaacctgttgcatagtgcaggggttaaatcggtcggcttgatgaccaaacctatttaa

SEQ ID NO: 6128 - DNA, 480 bp, Klebsiella pneumoniae
atcaggtacagggcatcagaagagaggatcacagcgatgacagctcaaatttcagcgtatggccgactggtggccgacccgcagaccagaagaacgggaaaaggtacgaacatggctatggcccgcctggcggtagctcttccctgtaatgcggcagataacggagaggttactttctggctgggtgtcattgcctttggtaagcaggccgatgcgctggccaaacaccataaaggagaccttgtcagcgtggcgggtaatatgcagatcaatcagtggactggtcaggatggcggtacacagcaaggctatcaggtcattgcggacagtgtactcagcgccagaacggtacgaccaggaggtaaagcagggcaacagggtcaagctacggatgctctgcgccgtgcccatgagcaacaaccgcccgcgaccgggtatgaaggattcgaccagactccgccgtatgaagatgatttttga

SEQ ID NO: 6129 - DNA, 321 bp, Klebsiella pneumoniae
ctgcgccacaggagcacaaaagggagagcggcgtcgcaatccagcaacattctccatatcgctacagaccgccgcgggcggctatgcgaagatgcgttttttgctgttggaggccgcatgaagctcactgataaaattcgccgcgattggcactactacgccgtggcgctggggttgatttttattcttaatggcgtggtggggctgctggggtttgaaacacaggggtggcaatcctacgccgtcggtctgatcacctgggtcattagcttctggattgcgggctttgtgatccgccgccgcccggcagaagaggcctga

SEQ ID NO: 6130 - DNA, 360 bp, Klebsiella pneumoniae
gggcatgacagtcctgatataactgctgcgcggtcgcactatgaaggactcaggtgcgatataaattataaagagaggaagagaacagtgaataaatctcaactgattgacaaaattgctgcgggtgcggacatttctaaagctgcagctggacgtgcgttagatgctttaatcgcttctgttactgaatctctgcaggctggggatgacgttgcgctggtaggttttggtacctttgctgttaaagaacgtgccgcccgtactggtcgcaacccgcaaacaggtaaagaaattactatcgctgccgcaaaagtgccgggcttccgtgctggtaaagcgctgaaagacgcggtgaactga

SEQ ID NO: 6131 - DNA, 732 bp, Klebsiella pneumoniae
tgcggagacaggaaaatgaaactcgagttttcaatttatcgctataacccggatgttgacgacgctccgcacatgcaggattacacccttgaagcggaagaaggtcgcgacatgatgctgctggatgcgctgatccagctgaaagaaaaagatccgtcgctgtcgttccgccgctcctgccgtgaaggggtctgcgggtccgatggtctaaacatgaacgggaaaaacggtttggcgtgcatcacgccaatctccgcgctgaatcagccgggcaagaagattgttatccgtccgctgccaggattaccggttatccgtgatttggtggtggacatggggcaattctatgcacaatatgagaagattaagccttacttgttgaataatgggcaaaatcctccggctcgcgagcatctgcagatgcctgagcagcgtgagaaactcgacgggctgtacgagtgtattctgtgcgcctgctgttcgacctcgtgcccgtcgttctggtggaacccggacaagttcatcggcccggctggcctgctggccgcgtatcgcttcctgatcgacagtcgcgataccgaaaccagcgagcgcctggacggcctgagcgatgctttcagcgtattccgctgtcacagcattatgaactgcgtcagtgtgtgtccgaaggggctgaacccgacgcgcgccatcggccatattaagtcgatgctgctgcagcgcagcgcgtaa

SEQ ID NO: 6132 - DNA, 471 bp, Klebsiella pneumoniae
caacaggacagattccgcatgactgacaacaataccgcattaaagaaggctggcctgaaagtcacacttcctcgactaaaaatccttgaagtgctgcaggaaccggataaccatcatgtcagtgcggaagacttatataaacgcctgatcgacatgggcgaagagatcggtctggcgaccgtttaccgcgtcctcaaccagtttgatgacgccggcatcgtgactcgtcataatttcgaaggcggaaaatccgttttcgaactgacccagcagcatcaccacgatcacctgatctgcctcgactgcggcaaagtgatcgaattcagcgacgactcgatcgaattacgccagcgtgaaattgcctcccgccacggcatccgcctgaccaaccacagtctgtatctgtacggtcactgtgcggaaggggattgccgcgaggacgaacacgcccacgacgcggtggaaaaataa

SEQ ID NO: 6133 - DNA, 243 bp, Klebsiella pneumoniae
gaaattcgcagcgctggaagcggcgggtgtgaaaactgttcgcagcctggccgacatcggcgaagcgctgaaagctattatcaagtaaaccctctctgcttgtccgcaagcagaaatctgtccgatttcgacatggttggccaccgtcaggtggccttttttgtgaccgttatcccgtctcgtcagaaccgcagcgccaacaacgaattgattttctgcgaaaagccctatctatcatattga

SEQ ID NO: 6134 - DNA, 210 bp, Klebsiella pneumoniae
ttgtgccgcagatcctcgcgaccctgcacgtcaccctcaaaggccccgcccacgcccgggccatcagcctgtatggcgggatcggcgggatcgcctttatcgtcggtcagatgggcggcggctggctggtgtcggcggacatcgccgggctgggctggcgcaacgccttttttatcaatgtgccgatctgcctgctggtgctggctctga

SEQ ID NO: 6135 - DNA, 255 bp, Klebsiella pneumoniae
ccatcacgcagccatttcatatttaaagatttcaaaaatgtcttccaggtcttgttgttgaaatctatcagtggcatcgacatagaagtctggtttcagctgctcaatatcaaattgaacacgatagcctgttttctctgcgatatagtcactgagttcatctgtatctacaggattggggcatgtgacaccatcatgctgaagcaagacaacattatcaccaagaaagctaatcatgtactgaagtatcagtga

SEQ ID NO: 6136 - DNA, 456 bp, Klebsiella pneumoniae
tcgtggcgcagatgctgtttctggaagcggaaaacccggcaaaaagacatttacctgtacattaactctccgggcggggtaatcaccgccgggatgtcgatttatgacaccatgcagttcatcaagccggatgtcagcaccatctgtatggggcaggccgcttctatgggcgcgttcctgctgaccgccggggcgaaaggcaagcgcttctgcctgccgaactcccgcgtgatgatccaccagccgctgggcggctatcagggacaggcgacggatattgagatccacgctcgtgaaatcctgaaggtgaaaggacgcatgaatgagctgatggcgcatcataccggccagtctcttgagcagattgagcgtgacaccgagcgtgaccgcttcctgtctgctgcggaagccgtggagtacgggctggtcgactctattttgacccatcgtaattga

SEQ ID NO: 6137 - DNA, 192 bp, Klebsiella pneumoniae
ttaaggcgcagcgttcggcgaatgatttcctcagtgtctttctcccagtggaccgggatccaggcggcggaaatcaccccacgctatcggtttatctctgagcaaaaggccggtccggtgtacatcaccaacttccagttgcagaaggtggataacgctcacctcggtaccgatgagttcacagtcaattaa

SEQ ID NO: 6138 - DNA, 369 bp, Klebsiella pneumoniae
ataaagcggctaataaaaaggatcatggtatgctggcaggcgttgctgaccacgcaggtcggtaatcccggacagaatgaaacggtggatcgtgcaatgtcacatacagttcgacacaaaaagatgttactgacccggctgaagaaaattcaggggcagagtaccgcgttagagaaaatgcttaatcgcgagcatgagtgcgctgaaatattacagcagctggcggcgatccgcggcgcggtcaacggcatgatgctgcaggttattcaggggcatcttaccgaccatgtggtgaaagagcctgacgagacgcagcgcgaagcggatctggagacggtgatgcaggtgattaaatcctatctgaagtag

SEQ ID NO: 6139 - DNA, 384 bp, Klebsiella pneumoniae
tgctgcagcagttgggctacgaggtcattaacctcggcattattcctgacgacccggcgaagctgcgtgacgcttttatcgacgccgaccagcaggccgatgtggtcattagctcaggcggcgtctcggtgggcgaagccgattacaccaaaactatcctcgaagagctgggggagatcggcttctggaagctggcgattaagccggggaaacccttcgccttcggcaagctcagcagcagctggttctgcggcctgccgggtaacccggtgtctgccaccgtcaccttctgtcagctggtgcaacccctgctggcgaaactctcgggcaagcacggcccgcttcaggcgccccgcctgcgggtccgcgccgccacgcgcctga

SEQ ID NO: 6140 - DNA, 444 bp, Klebsiella pneumoniae
cccgcaagcagaccggaggaaggaaacaataagaacagcatgtgggcgttattcatggtaagaaatgtgaaaaaacaaagacctgtcaatctggatctacaaacgatacggttcccaatcacggcgatagcgtccattctccatcgcgtttccggtgtcatcaccttcgtggcggtcggaattctgctttggctgctgggcaccagcctttcctccccagaaggttttctgacggcggcctccatcatggatagcttctttgtgaagttcatcatgtggggcattctcaccgcgctggcctatcacgtcgttgtcggtattcgccatctgatgatggactttggctacctggacgaaaccctcgaagcagggaaacgttccgccaaaatttcttttgttattactgtcgtgctttcacttctcgcaggagtcctcgtatggtaa

SEQ ID NO: 6141 - DNA, 825 bp, Klebsiella pneumoniae
cgcaaaagcagctgtttgacaagcttggcctcgccaccgccccgtggcagctgctggcggataaaagcgagtggccggcggtgtttgcccgccttggcgaactggcgatcgttaagcgtcgcgttggcggttacgacggccgcggccagtggcgtctgccgggaaaacgagatcgatcagctaccggccgataactacggcgagtgcatcgtcgagcaggggattaacttctccggcgaggtatcgctggtgggcgcccgcgctcatgacggtagcaccgtcttctacccgctgacccgtaacctgcatcaggacggtattctgcgcgccagcgtcgccttcccgcaggccaacgctcgccagcaggaacaggcggaaagcatgctgacggcgatcatgaacgagctgaactatgtcggcgtgatggcgatggagtgcttcgttaccgccgaggggctgctgattaacgagctggcgccgcgggtgcacaacagcggccactggacgcagaacggcgcgtctatcagccagttcgagctgcatctgcgggcgattaccggcctgccgctgccgccgccggtggtcaacagcccgtcggtgatgatcaacctgatcggcaccgatcttaactacgactggctgaagctgccgctggtgcacctgcactggtatgacaaagaggtacgcccgggtcgtaaagtcggccacctgaacctcaccgacagcgataccgatcgactgagcgcgacgctggaagcgatcaagccgctgctgccgccggagtacaccagcggcctgttctgggcgcaatcgcagctcagctaa

SEQ ID NO: 6142 - DNA, 465 bp, Klebsiella pneumoniae
aagttgagcagttttcaccaaccccctccattttccgtcagccaactgtgctacagtagcctcatctgtttgataacgattcgcattatgccacctgttattttaaccattatcggctggctggcggtagcgctgggtacgctgggcgtcttcttaccgttgctgccgacgacgccgtttattctgctcgccgcctggtgctttgcccgctcatcgccgcgctttcaccagtggctgctgtatcgctcctggtttggcggctatcttcgccactggcaacagtaccgcgccatgcctcgcggcgctaaaccgcgcgccattgcgatgatcgtggtgacttttgctatttcgctatggctggttaagcttacgtgggtgcgcatcatgctgttggtcattctggcctgtctgctgatctttatgtggcgcattccggtggttgacgcaaagcaacaaaagcactga

SEQ ID NO: 6143 - DNA, 504 bp, Klebsiella pneumoniae
agacaaggcaggtgcagcatgaaattctccaaattcactgagttggtagcccgcatctggtcaaacacaactacgcagcgtcgcgacccggagattaccatcgtcgtccactcacctggcagcatcgggccgtcgccatccgtcgaggtcgaggctattcacgcaggcttcgactgggatgcgggacaggtgatgatctacccggctcaacctctgacggtgctaactcctgagcaggtagcggaaatcagcgagagcgttcgaaaaggccagagctggcacgcatacgaggcttacaagaagcacaaatcgcagctggaaaacgctgcgcttgagcatgcgaaagtcgccgggcagcgcgacgagctgctggcagcactcgaagaaatgaccgatatcgttagcaaacatacctacccacaaccagataaacctaactctacgtggggtcgattagaggctgccaaagaagttatttcccggacaaaaggcggtgaagtatga

SEQ ID NO: 6144 - DNA, 1248 bp, Klebsiella pneumoniae
cggataataaggagtgatatggccacccatctggtctggttacgcacggatttacgcattcacgataacctggcgctggctgccgcctgccgggatccgcaggcgcaggtgctggcgctgtatatcgccaccccggggcagtggcgtgaacatcacctggcgccacggcaggccgcttttatcgccagccatttacagagtctgcatgccgcgctggcggaacggggcataccgctgtgggtagaagaggcggacgattttaccgccagcgtcgaacggctggccgatttttgccagcagcatcaggtcagtcacctgttctacaactatcagtacgaattcaatgaacgccagcgcgatgccgccgttgagaacaccttgcgcgacgtgatttgccagggctttgacgacagcgtcctgttgcctcccggcagcgtactgaccggtggcggcgaaatgtataaagtcttcaccccgtttaaaaatgcgtttattcgccgtctgcgggacggactgccggcgtgcgtggcggccccgaagccgcgccaggcgcctgcctgccaggcgccgccgctgcctgagcttaactacccgcaaacgccgttcgacgggctgctgtttgccgcggatgaaaaaacggcgctggcgcgtctgcgcgcgttttgtcagcaagcggcggcggattacgaggggcagcgcgacttcccggccgtggaagggaccagtcgactgtcgccctgcctggccatcggcgtgctgtccccccgccagtgcctgcatcgtcttctgacggaacatcccgccgcgctggacggcggagccggcgccacctggcttaacgagctgatctggcgcgagttttaccgccatctgatggtctactatccgaagctctgtaaagggcggccatttactgcctggacagataaggtcgcctggcgcgcagaggaggccgccctacaggcctggcagcgcggggagaccggttttccgattgttgatgccgccatgcgccagcttaacgccaccggctggatgcataaccggttacgcatgattgtcgccagcttcctgaccaaagatttgcgcctcgactggcgggcgggcgagcgctatttcatgagccagctgattgatggcgacctggcggcgaataacggcggctggcagtgggcggcttcaacgggcaccgacgccgcgccctatttccgcatatttaaccccacccacccagggcgaaaagtttga

SEQ ID NO: 6145 - DNA, 876 bp, Klebsiella pneumoniae
ttgaggataagtatgagtcaggcactctctaacctgctggcattattagatctggaaaaaattgaggaagggttgtttcgcggacagagcgaagacctggggttacgtcaggtttttggcggccaggtagtgggtcaggcgctatatgcggcaaaagagaccgtgcccgttgagcgtctggttcattcgtttcacagctactttcttcgccccggcgatagccagaagccgatcgtttacgatgtggaggtgctgcgcgacggcaacagcttcagcgcccgtcgggtcgccgccatccagaacgggaagccgattttctatatgaccgcctccttccaggcgccagagaatggctatgagcatcagaaagcaatgccggccgccccctcccctgacggcctgccttcggaaaccgatatcgctcgcaagctggcgcatctcctgccgccgcaggtgaaagacaaattcctctgcgataaaccgctggagatccgtccggtggagtttcataacccaatgaaaggccatatcgccgaaccggtgcgccaggtctggctgcgcgccaacggcgccgtccctgacgatctgcgtattcatcagtatctgctgggctatgcttcagactttaacttcctgccggtggcgctgcagccgcacggcgttggtttccttgagcccggcatgcaggtcgccaccatcgaccactctatgtggttccaccggccgtttaatattaatgaatggctgctttatagcgtcgaaagcacctcggcctccagcgcccgcggcttcgttcgcggcgaattctacacccaggatggcacgctggttgcctcaacggttcaggaaggggtgatgcgcaaccgcaacgcataa

SEQ ID NO: 6146 - DNA, 615 bp, Klebsiella pneumoniae
tcaagcgtaaggagaatgaatatgagcgcgtcggcactgatttgcctcgcccctggtagcgaagagaccgaagcggtcaccactatcgacctgctggtccgcggcggagtaaaggtgaccaccgccagcgtcgccagcgacggcagcctgaccatcgtctgttcgcgcggcgtcaaactgctggcggatgcgccgctggtcgaggtggccgatggtgatttcgatatcatcgtcctcccgggcggtatcaagggcgcagagtgcttccgcgacagcacgctactggtggaaaccgtccgccagtttcatctctctgggcgcattgtggccgccatctgcgccgccccggcgaccgtgctggtaccccataatctgttcccgatcggcaacatgaccggttttccggcgctgaaggaacatatccccgccgagcagtggcaggataaaagagtggtctgggatccgcgggtgaatctgttaaccagccagggtccggggacttcgattgatttcgccctgaaaatgatcgatctgctggtggggcgcgagaaagcgtatgaggtcgcctcacagctggtgatggccgctggcatctataattactacgaagcctga

SEQ ID NO: 6147 - DNA, 456 bp, Klebsiella pneumoniae
aagccatcaaggcctgatttttgtaaggggaattccgtgaaacctgctgctcgtcgccgcgcccgtgagtgtgccgttcaggcgctctactcctggcagttgtcccacaacgacatcgctgatgtcgaataccagttcctggcggaacaggacgtaaaagatgttgatgttctgtatttccgcgaactgctgtccggagtggcgactaacagcgcgtacctcgacggcctgatgaagccctacctgtcccgccagctggaagagctgggccaggttgaaaaagcggtgctgcgtatcgcgctgtttgagctgtccaaacgtgatgacgtaccgtataaagtggccatcaatgaagctatcgaactggcgaaaaccttcggcgctgaagatagccacaagttcgttaacggcgtgctggacaaagcggctccggtaattcgtccccacaagaagtaa

SEQ ID NO: 6148 - DNA, 957 bp, Klebsiella pneumoniae
cgccagacaagaccacagggtggaaaggagaacaagatggcgacagagcaactgcggtggggcgtgagccccctgtgctggaccaacgatgtactcgaggatttaggcggtgatattcccctggatacctgcctgcgcgaggcgcgggaggcgggctatcagggcattgagttaggacggaaatttccccgtcaggcatcaaccctgggcccgctgctggcggcggctgacctgcgcctggcgtccggctggtacagcggcatgctggccgaccgcagcgtggaagcggagctggaggcggtgcgggagcacgcccagctcctccggcagctcggcgcgaaggtgatggtttacggcgaatgcgggcaactgccaggtgaaaccccgcttgatgagcctatttcgctctcgccgccgttaagccgcgtcagccttgcggcgtattgccacaagctgaatacctttgccgacctgctgctgcgcgactatgacctccagctggcctatcaccatcatctgatgatgctggtggagcacgatgacgagctggagcggtttctgtctcacacccatgacaacgtcgggctggcgtttgataccgggcacgcctttgtcgccggggtcgagatcccgcgcgtactgcacaaatatggccaccgtatccgccatctgcatctgaaagacgtgcgtccgcaggtgctggggcgtctgtatcgtgaaaacctgagctttaacgaggcggtgcgcgccgggctgtttaccatcccaggcgacggctgcatcgactatgcgccgatcctcgactttgtccgggacagcgactaccgcggctggctgattatcgaagccgagcaggacccggcgatggcgccgccgctggccaccgccagccgcgcctatgcctggctggcgcaccatttatcttccccttcatcgtcagaggagtacgcatcatga

SEQ ID NO: 6149 - DNA, 1245 bp, Klebsiella pneumoniae
gcccgtgcaagcgcgccgccgggcaacagtatccggccccctcccctacttcgccagactggcaaagcgagcgaagaccgcatcaaaaatcgccagcccttgcgccacctgctcagcagtaatggtgcacggcggcaccacgtgaatgcggttctccaccacaaaggccagcagcccggcttcggtcagggcccctttgatcgcagccatgtcggcggcggtcagcggcgttttttgttcacggctgctcaccagctccagcgcctggaacaggccgcgaccgcgcacctcgccgataatggcgtgcttctccgccagcgcctcgagaccggggcgcagcacctcgttgccgatagaggccgcgttctcaaccacattctcctctttcatcgcgtcgatggtggcgacaatcgccgccatcgccagcggatggccggagtaggtcagccccccggcaaagaagtggtcgtcaaagtagcgggcaatcggctcgctaatcagcaccccgcccgccggcacgtagccggcgttaacccccttggcaaaggtcaccagatccggcaccacgccatcctgctcgaaggcgaaccagctgccggtgcggccaaagccggccatcacctcatcgaggatcagcacgatgccaaactcgtcggccagggcgcgcacgccctgcatatagcctgccggcggcacgaggatcccggcggtgccggggatggactccagcaggatcgccgcgatggccgtcggcccctcgcattcaatgatccgccgcagatgcgccagcgcgcgctggcactcctcttcctcagtcgcggcgttgaactcgctgcggtaaaggtaggggttgaagaagtgaacgtggccgcgggagaactcattcggcacccggcgccagtcgccggtagcggcgatcgcgctgccggtgttgccatgataggaacgataggccgacagcaccttgtcgcgcccggtatagagccgcgccatgcgaatcgcgttctcattggcatccgccccggcgttagtgaagaacaccttactgaagcccgccggcgccagatcgacgatgcgcttcgccgcttcgccgcgggcaaggttggcggtggcgggcgcgatggtgaccagggtctccagctgcgacttcatggccgccaatacccgggggtgctgatagccaatgttgacgttcaccagctggctgctgaaatcgagccaggtgttcccctcataatcccatag

SEQ ID NO: 6150 - DNA, 255 bp, Klebsiella pneumoniae
agaaatcaaagcattaagaaaacttctgaagaagaaaaaatgaaacaacaattctctacagccagcaactatagcgaagcttgcgatatgttgcgctcaggatacgtaaaacacgtccgcctgaactggaatatcggtagtgatgagttctttcgcattgcttccgactggtgtgacaccggcgctaaaatcaaaaaagatgaagatggctttattatttccctgaaagggtttcctattccgcgccagcattaa

SEQ ID NO: 6151 - DNA, 1395 bp, Klebsiella pneumoniae
aatcgccaaagagcggcgtcatcctcatcaggatgcgattcattatgccggttgggtcagcttatttaccctccacgcgctgtggcccttgttatggatctgggcgacgctgtggcgcgaagaccgcggatgggggatgcgccacattgccgacgatcagcaggcgctgcatcagcgtctggaaacggtggtccagcagctggaacaggtccagcgcgaggtggacgttctgaaagcgaaggaggcaaaataatggaaacgttaatgttgctgacctacgccgcgctatgcatcgtggtgtttaaagtttttcgcatcccgctcaataagtggaccgtgccgacggcggtgctcggcggtatcgccctgattggcgcggtgatcttcgggatgaactacaacttcccttataccgacgtcggtaaccaggtgtttcgcaccgtgccgattgtgtcgcaggtgcgcggccgggtgcagagcgtaccggtgaagcctaaccagatgctgcataagggcgatgtgctgtttaccctcgacccgacgccgttccaggcgaaagtggacgatctgcaggcgcagataaaagctgccagtcaggatgcgctctccttaaacgcggcgttaagccaggcgcaggccgagctgagcagagcggtggcccagcgtgaccagtcgcggcgagagtatgcccgctatcgggagggccatgcccagggcgccttctccgatcaaatggttgatacccgtctgcagacgtggaaagccgatgaagccagcgtcagcgcggctcaggcaaaggtggttcaggcgcgtaatgcgctggactcggtggtgaagggcaaaaacaccaccgtggcctccctgctggcgcagctgcaaaaggcgcagtttcagctggagaacaccgtcgtccgcgccccggaggatggctatgtcagtaccgtcggcttacggccgggcaccatgtccactgcgctggggatgatcccgctgatgacctttgtgccggtggagggcgccgcctcgcgggagtacgtcgcggcatttcgccagaacgccctgcagcgtctgcacaaaggcgagcccgcggagctgatgtttccggctatcccgggcaccgtctttcgcggagaagtggccgacgtgctgccggcgattggcgagagccagttccaggggcagggcaaactgctgaccacagacgcgctcaatacccatggccgggcgctggtggtgctgaaggtgaccgatccgcgttttgccgaatacgctctgccgcagggggccaccctcgaggcggcggtctactcggatcacctgaaagagctgtcgctgatcaggaagatcctgatccgcatgaaaagctgggaaaactatatctatctcgatcactaa

SEQ ID NO: 6152 - DNA, 753 bp, Klebsiella pneumoniae
atagtacaaagggcgttctgcgcccttgatactgtttatggagcgactatgaccccgattaaagaattaggcgaatgcgttatcggtacagatgaccgggagtattttttccggccgtcattccgcaacatggcgcgcatcggcgagcctgctgaaatcgtccagacgttctatgacctttgcaatgacgaggccactccgttgattcagcgcgctgctcaggcctatatccgcgacgagtacagccgcctccccgattgtgtgctgcgatatgtccagggcgggatgcttacccgcaaagccatcatggcggcgcatacggtgctcacagcctgctgcgacgacgatataggcaatctggtcggctggatgaagccgggcaaatcacgcaagcgtggctttgtatggcgcccgggcagcatgccgccggaaagcatggtcatcgtcgcgcaaaacctgatgatgcacggcatcatcggcaaagcgaaggtgcgcaagctgcagcgttacgaaacgaacgagacaacctcagaattccgcgctgccgactacatcatggcggcgcgtaaccatttcggcataagccgagaagaggccgagaacctcacgatgacagagttcagcttacttctgaatgctaaatacccaaatcagaacggcttcacgcgcgaagagtacgacacggtcatggacgaagacgatcgccgctggcagtcgatgatggagcaggaacaagcccgtaaaaccaaataa

SEQ ID NO: 6153 - DNA, 564 bp, Klebsiella pneumoniae
caacagcaaagtggtattgatgccgctggatgccagcagcctgatgggatcgatcgccgggatcagcgagctgatcaaagaaggcgctggcgatcggaaaaaatcatgatcggcatgatcctcgcacaccctcatctgttctggctaagcctcggcgggctgctgctggcggccgagatgctgggcggcagcggatacctgctgtggagcggcgtcgccggcgtggtgaccggcgccctgacctggctcctgccgctgagctgggaatggcaaggcacgctgtttgccgttctcaccctgctggcggcgtggctgtggtcgaaatggctgcgcaagcgcgtcaaaacgcagcgcccggccgatgcccagctcaaccagcgcgggcagcaactagtgggccgccgcctgacgctggatgccccgctggtgaacggccgcggccacgtccgcgtgggcgatagctcctggccggtgattgccgatgaagacttcgcggcgggcagcaaggttgaagtgattgccgtagaagggattacgctacgaatcagacccgccgtccgttaa

SEQ ID NO: 6154 - DNA, 585 bp, Klebsiella pneumoniae
tattttaaaagacgctggcttgccgaagtttttttaataaaattctcatggattaatcatatgaacaatgatgaagaatttagttttgtttccgaaatatctaattccaaaagaactattgaatcaataataaaatcagaattattagaaaactttaaaactgatacattgattttcaattcaatcctcatcaacttacttattttaacaagagatataacatataaatcatttaagttagggaatgaaatttcgtttactgatgacgtcatcattaccaataaaataacaaatgtttccatgctaataaaatatgctagagatgcagcatgtcatatcgactccgacaatcatatatcaatagaaaccggggcaaaattcagttttaacatttgttttggaaaaggaaatttagcaaatataaatggcgttgagtttcgctcagattatgatgatgatgtttgcatatttataggtgatcaaaagatatatttaaaacgacatatatatagagcagcaactgaagcaattcagtttttcaaagagcactacaaagatactgaatttagtttccatcttcggtaa

SEQ ID NO: 6155 - DNA, 1233 bp, Klebsiella pneumoniae
gtaagtaaaagtatgacagcaggcggacaagctcaaattggtaacgttgacctcgtaaaacaactgaacagcgcggccgtgtaccgcctgattgaccagcatgggcccatctcgcgcattcagatagccgaacaaagccagcttgcccctgccagcgtgaccaaaatcacgcgtcagcttattgagcgcggcctgatcaaagaagtcgatcagcaggcctccaccggtggccgccgcgctatctctatcattgcagaaacccgcaacttcaacgccatcggcgtgcggcttggccgctatgacgccactctgaccctgtatgatttaagcagcaagaccctggaagagaagcacttcccgctgcccgagcgcacccaggaaacgctggaacacgccctgctgaatatcatcgccacctttatcgaaaactgtcagcgcaaaattcgcgagctgatcgctatctcagtgatcctgccgggcctcgtcgacccggaaagcggcgtgatccgctatatgccgcacattgcggtggaaaactggggcctggtcggggcgctggagaaacgcttcaacgttacctgctttgttggccacgatatccgcagcctggcgctggccgagcactattttggcgcaagccaggattgcgaagactccattctggtgcgcgtgcaccgcggtaccggggcggggattatctccaacgggcgcatttttatcggccgcaacggcaacgtcggcgaaattggccatattcaggtcgacccgctgggcgaacgctgccactgcggcaacttcggctgtctggagaccgtcgcggccaatgccgccattgaacagcgggttcgccacctgctggagcagggctaccagagccgtctgacgccggatgactgcacgatcaaaactatctgcaaagcggccaacaagggcgatgccctggcctgcgaggtgattgagtacgtggggcgccacctcgggaaaacgatcgccatcgccattaacctgttcaacccacaaaaaatcgtcgtcgccggcgaaatagtggaagctgaaaaggtccttcttccggccatcgaaggctgcattaacgcccaggcgcttaaggcgtttcgtaagaacctgccggtggtgcgctccaccctcgatcaccgctctgcaatcggcgccttcgcgctggtcaaacgcgccatgcttaatggcacgctgctgcagcgtttgcttgagagctaa

SEQ ID NO: 6156 - DNA, 564 bp, Klebsiella pneumoniae
cgacacgaaagttcctgccggcgaagcggcggaacatcctcctgggtattaagggatgataaggagaacatcatgaaatttgcctatatgtttagtgccttagccgtcgccgcgacgctgaccgcctgtgctaatcaccactcgaacaattcttcgacgcaggcggccgcgcccgacccttacggtatcgcgacgctgagcgtggcgcagcagcagccgagcgtcacggggacgattaatatccgccagagaatcgctttaccgccggatgcggtactgacggtgaccctgtcggatgcttctctggcagatgcgccagcccgcgtattgtcgcaaaaagcggtgcgtaccgaaggcaaacaggcgccatttaactttgcgctgccttacaacccggcagatattcaaccgaacgctcgcattctgctaagcgcggcgatcacggttaacggccagttgatgtttattaccgataccgtgcagacggtcataaaccagggcggcactcatgccgacctgacgctggttccggtccagcagaccgccgttcctgtcgcccagtaa

SEQ ID NO: 6157 - DNA, 543 bp, Klebsiella pneumoniae
ttactacgaagcctgatagccggtccgcgccgcgggctggctccccttttcctgaggagtcgcagcatgtcccggagcgcaaccgattctcgcgatcttgtaatcagccgcctgctcagcgcgcccgccccagccctgtggcgcgcgtgggccgacccggcattactccgaacctggtggtgcccgaagccctggcaaaccgaggttctggcctttgattttcgcgccggcggggcctttcacaccgtgatgcacgggcctgacggtgaacgcaacgataaccccggctgttttcttgaggttatcccgcaacaaaaaatcgtcatgacctcgatgctgacggcggattatcgccccgccgtttcccccttcgcgatgacggccatcatcacctttgccgatgaacaggtcgggtgtcgctatacggctacggtgctgcatgccgatgatgaaacccgcgagcagcatgagcagatgggatttttcgagggctggaatattgtcatcgatcagctcaatgacctggcgctgaccctgcgctaa

SEQ ID NO: 6158 - DNA, 333 bp, Klebsiella pneumoniae
gcacgtggaagccaccaaagccgggaagaaagaagaaatctgatgaaatttatcgctactctgtacgcgataatggacaagcgcccgctccgggcgctttccttattgatggcgctgctgctggctggctgcattttctgggatccgtcgcgctttgcggcgaagaccagcgagctggaaatctggcatggtttcttgctgatgtgggcggtttgcagcggcgttattcacggcgtgggctttcgcccgcgtgccgttcactggcaggggattttttgtccgcttatcgctgatatcgtgctcgctttaggtctcttctttttcttcttttga

SEQ ID NO: 6159 - DNA, 1014 bp, Klebsiella pneumoniae
caaaccggaaggagtgctgtaatgagccagagtcaaccccgtttaaaaacgtcggcgatgatcgcctcgattgctgatgaaggccaggcgaccgtccctgcgcccttcggcgtcgcgctgtcaaaactggcggcgcagcgcccggacatcgtcggcatgactgcggatctgtcaaaatataccgacctgcatattttcgcccaggccttcccggatcgctttttccagatgggcatggccgaacagctgctgatggcggcggcaggggggatggcgaaggagggatttattcctttcgccaccacctatgccgcctttgcaacccgtcgcgcctatgattttattcaccaggtcatcgccgaagagcatctgaacgtgaagatctgcgcggcgctgccgggcctgacgaccggctatggccccagccatcaggccaccgaagatctggcgatcatgcgtggtatccccgggatggttatcgtcgatccttgcgatgcactggagatagagcaggcggtaccggccattgccgatcaccaggggccggtgtatatgcgtctgctgcgcggtaaggtgccgctggtgctggataaatatgactatcagttcgaactgggtaaggcgaagctgctggaggacggcaacgatgtgctgattatctcctccgggctgatgaccatgcgcgcgctggaggcggctgaaaagctgcgggccgataatatcggcgtggcggttctgcacgtgccgaccatcaaaccgctggatgagaaagcgattattgaacaggcgtcgaagccgggccgcctggtggtaactgcggagaaccacaccgcggtcggcggcctgggggaagcggtggccgcgctgctgatgcgtaagggcgtacgctgtgagctggatagcgtggggctgcccgacgcgttcctgttagccggcgccctgccgaccctccacgatcgctacggcatctccaccgcgaagattgtcgaaaaaattaagtatcgtctgcgttaa

SEQ ID NO: 6160 - DNA, 975 bp, Klebsiella pneumoniae
tttttcattttgtttcattcaccggcgtacctacaaaatcaaggatcaactatgaatattaagaaaacgattgttgcctctttgttagcctgcattctgcctgcggtggttatggcaaaagatgtctccattggcgtctcgatggcgctgtttgacgataacttcctgacgatcctccgtacctcgatgcaaaaagagatgaaaaaagatggcgttaaatcgcagatcgaagacgcgaaaggggatgtctcccagcagctgcagcaggtgcagaactttatcggccagggggtggacgccattatcgtcaacccggtggataccaacgcggtgaaaccgatcatggatcaggccaccaaagccgggatcccgctggtgtttgtgaaccgccgtccgcaggcggagctgaccgacaagatggcctatgtgggatctgactctattctcgccggccgtctgcagatggaagcgctggcgaaagcgatgaacggtaagggcaatgtggcgatcctgctcggcgacctggcgaatgaatccactcgcgaccgcaccaaaggggtggaagaggtggtagcgaaatacccgaacatcaaaatcgtccagaagcagaccgcgaaatttacccgcaatgacgcagtggatgtggtcagcaactggatgaccagcggtgaggatatccaggccatcgcctccaacaacgatgaaatggcgatcggcgccctgcaggcgctgggcaaaaacccgaaccatattctcatcgccggcgtggatggcaccccggacgcgctgcagatgctgaagagcggcaagatgatcgccaccatcttccaggatgcgaaaggccagggtgaaggcgcagtcgacgcggccatcaagctggcgaacggcgagaaagtggaaaaaatcatcgacgtgccgtatcagctgatcaccaaagagaacatggctgaatttaccaaccgtaatcagaaatag

SEQ ID NO: 6161 - DNA, 183 bp, Klebsiella pneumoniae
ataacactgagctgcacgccccgctgcagaaaaaaccaggttgtcggcaccattaacttacaattggatggtaaaaccatcgaccagcgaccgctggtggtcctgcaggaaattccggaaggtaatttcttcggcaaaattattgattacattaaattaatgttccaccactggtttggttaa

SEQ ID NO: 6162 - DNA, 972 bp, Klebsiella pneumoniae
tccactatgagcaaatcacatccccgctggcggatggcgaaaagagtgctgaccgtgctcttttttatcgccgtcatcgtcctgctggtgatctacgcgcaaaaagtcgactggcaggacgtgtcgaaggtgatccgcggctacgatcggctggccttgtttagcgccattgcgctggttatcgtcagctacctcatttacggctgctacgatctgctcggtcgggcctattgcgggcacaagctggcgaaacgccaggtcatgctggtgtcgtttatctgctacgccttcaacctgacactcagcacctgggtcggcgggatcggtatgcgctaccggctgtactcgcggctggggctgaacggcagcaccatcacccgtattttttccttaagcattaccaccaactggttgggctatattctgctgggcggggtgatattcacggcagatctggtgaagctgccgccgcactggtacatcagccagaccactctgcgcattatcggcggggtgatgctgatccttacgctttgctatctgttcggctgcgcgttcgccaaacgccgtcacctgacgattaaaggccagcggctggtgctgccctcctggcgcttcgcgctgctgcagatggggctctcggcggcgaactggatggcgatgggggcgataatctggctgctgttgggcagcgagattaactattttctggtattaggggtgctgctggtgagcagtatcgccggggtgattatccatattccggctgggatcggcgtgctggaggcggtgtttatcgccatgctctccggggaagatatttcgaagggcgcgatcattgccgccctgctcgcctggcgcgcgctctattatttcctgccattgctgctggcgacggtggcctatctgctgctggagagccgggcgaaaaagctgcggcaaaagaaccagcgcaagctggcccgcgaatga

SEQ ID NO: 6163 - DNA, 603 bp, Klebsiella pneumoniae
acctgcgtgaggaaaaaagtagtggctcgtccaaagagtgaagataaaaagcaagcgttactggaagctgccaccgcggctttcgcccagtccggcatagccgcctcgacgtcggccatcgcccgcagcgccggtgtggccgagggaacgctgtttcgctatttcgccaccaaggatgagttgctcaacgagctgtacctcgcgattaagctgcgcctggtgcgcacaatgatcgccgggctggatccggacgagaagcgcccgaaagagaacgcgcgcaatatctggaacagctatatcgactggggcgtgcgcaacccgatggagcacaaagcgatccgccggatggcgctcagcgagcgcatcaccgacgaaacccgccgccaggtaaaagagagctttccggagctcaacgaaatgtgccagctgtcggtgaaagagatattcctcagcgaggcgtaccgcgcctttggcgacgccctgtttctgtcgctggcggaaaccaccatcgaattcgccagccacgatccgcagcgcgcccgggagattatcgccctcggctttgaagccatgtggcacgccctgcatgaggcggacgcataa

SEQ ID NO: 6164 - DNA, 1260 bp, Klebsiella pneumoniae
aggatagtgagaccggcgcgcgcgagggcagcgagtttatccgccgccatatcattcccgttgcaggacgggccttcgatgactttgccgccggcgggagggaataacatgattcaggtcgcgattatcggggcagggtttattggcccggcgcatctggaggcgctgcggcggctgggagatgtcgaggtggtggcgctgtgcgacagccgccttgaggcggcgcagcgcaaggcgcaggcgttgaacattgcccatgcctacgacagcgtggaggcgctgctggcccatccggggctgcaggtggtgcataactgtacgccgaaccatttgcatgcccagattaaccggcagatcctcgccgccgggctgcacgtcttctcggaaaagccgctgtgtatgacggcggaggaggcgcgggagctggtggcgcttgccgcccgggccggcgtggtgcatggcgtcagcttcgtctatcgccagttcgctatggtccagcaggcggcggcgatgatccgccatggcgaggtcggcagaatcttcgcggcccacggcagctatctgcaggactggatgctgctggagaccgactacaactggcgggtcgattcggcgcagggcggcgcgtcgcggacggtggccgacatcggctcccactggtgcgataccgtgcagtttatgaccggtcggcggattgtcgaggtgatggcggatctgtctatcgtctggccaacgcgtaaagcgccggtcaatggcaaagcgaccttcagcgccgttcacgaggcgcaggcatatgaaacgcggcctgtcgataccgaggactttggctcggtgctgttgcgttttgacgatggcagcaagggcagctttatggtctctcaggtgagcgccgggcggaaaaaccgtctggcggtggagattaacggcagcctctgttctctggcctgggatcaggaagtgccccagcggctgtggatcggccaccgcgagcagccggatcgcctgctcagcgatgacccgagcctgctgcggccggaaatcgctgacagcgcccattaccccggcggccatattgagggctggccggacgcttttaagaatatgatggggcatttttatcaggcggtgcgcgccgggaagatgccggcggccggggcccggcgcttcgccgctttcgacgacggcgccgatgtgatgtacatcatcgaggcgatcgtcaaaagccatcagcagcagcgctgggtcagcgtcgaacgctga

SEQ ID NO: 6165 - DNA, 1320 bp, Klebsiella pneumoniae
aaggagtcgagtgtgagcatccattccagcgaaaattttagcgacgcacgcgggcccgggcgccatgcatggtgcggcctgctgctggcaatcgtgccgggtttcggtcagttttatcatcgccagtggctgaaagggctggtcttcctggtgctgctgagcagctttctggggattttttatgatttcctgcgtgaggggttgtgggggttatataccctgggtgaagaggtaccgcgggataactctatcttcctgttagccgaggggattatcagcgtgctgatcgtcgctttcggcgtgctgatctattttctctcgctgcgggatgcgtggctcaacggcaaaaaacgcgatgaggggatcgccctcaacagcgtgcgtaagcagtaccagatgctgctgagcgacggctttccgtacctgatgatcaccccgggctttattctgctggtgtttgtggtgatctttccgattctgttcggtttcgccatcgccttcaccaactacaacctgtaccacaccccgccggcgaagctggtggactgggtggggctgaaaaactttattaatattttcaccctctccatctggcgctccactttcctggatgtgctgcagtggaccgtggtgtggacgctgctggcgaccaccctgcagtgtacggtgggcgtactgctggcgattctggtgaaccaaaaagatctgcgctttaagccgctgatccgcaccatctttattttgccgtgggcggtgccggggtttgtcaccattctcgtttttgccggcatgttcaacgactccttcggggtcatcaacaacgcgatcctgtccttttttggcatcagtccgaaagcatggctcaccgatccgttctggactaaaacggcgctgatcatgatgcagacctggcttggcttcccgtttgtctttgccatgaccaccggcgtgttgcaggcgatcccggacgatctgtatgaagcggcgacgatggacggcgccagcgcctttacccgtctgcgcaccatcaccctgccgctggtgctgtatgcgatcgcgccgatcatcatcacccagtacaccttcaactttaataacttcaatatcatttacctgttcaacaatggcggccctgcggtggcaggctctaacgccggcgggacggatattctggtgtcgtggatctataagctgacgatgtcttcgtcgcagtacgccatcgcggcgaccatcacgatcctgctgtcgatctttgtcgtcggcctggcgctgtggcagttccgcgccaccaaatccttcaaaaatgacgacatggcgtaa

SEQ ID NO: 6166 - DNA, 675 bp, Klebsiella pneumoniae
cttttaccgagcgcgatgaccagtaaaggcgaacaggcaaaaaatcagcttatcgcggccgctatcgcccagtttggcgagtacggccagcacgccaccacccgcgatatcgccgcccaggccgggcagaatatcgccgctatcacctattattttggctcgaaagacgatctgtatcttgcctgcgcccagtggatcgccgattttatcggcgacaattttcgcccgcaggccgaagcggcggagcacctgcttgccggggaagcgccggatcgccaggcgatccgcgacctcatccttagcgcctgccacaacatgatcctgctgctcacccaggacgatacggttaacttaagcaaattcatttcccgtgagcagctggcgccgaccgccgcctaccatctgatccaccagcaggtgattgcccccctgcaccattatctcacccggctgattgccgcctggaccggctgcgaagccagtgatacgcaaatgatcctccatacccacgccctgctgggtgaggtgctcgctttccgtctcgggcgtgaaactatcctgctgcgcaccggctggacgcagtttgacgcgcaaaaaacggaacagattttcgaagtcattacctgtcatatcgatttcatcctgcatgggttatcgcaaaggagtttgggctga

SEQ ID NO: 6167 - DNA, 981 bp, Klebsiella pneumoniae
acgccagcgaggatttcgcttttatgctgcgcgaacgcccgggcagctacttcctgctcggcaatggcgagaaaggggagaagggcggttgcatggtgcacaaccccggctacgactttaacgatgacattatcaccatcggcgcgacgctattcgcccgtctggtggaaaaacactgtcgctaatctctggagaagaacgcgaatgaaaaaatcactgttgctatggctggcattaatggcgtcgacgtcggcgctggccgaagggggaaaggagatccgcttcggcgtcgacccgactttcgcgccgtttgaatggaaagatccgcagggcaagctggcggggtttgatatcgatttaggcaacgccatttgtcagcagctgcaggcgaaatgcgtgtgggtggaaagcaatttcgacggcattatcccggcgctgaaggcgcgtaaattcgacgcgatcctttccgggatgtacatgaccgagaagcgcaaagcgcagattgcctttagcgacaagttgtataacgggccggtgttcctcgtggcgcgtaaaaataccctgcaaggcaatacgccggaacagctgaagggcaaaaccatcggcgtggagcagggctcggcgcaggagacgtatgttaaccagcactggcggccgcagggtataaacattgtggcctaccagggggccgatagcgtggtgcgtgacctggagtcggggcgcatcgacggcgcggtgctctccgggatgatggccgactacagcttcctgcagcagccgcagggtaaggaattcgcctttgtcggcggccatctgcaggacgatacgctgtttggcgccggggcggcgataggtttgcgtaaagacgatgaggcgctgcgtcaggaaattaacggcgcgattgcgaagattcttgccgacggcacctataaaaaattagctggcaaatattttagctttgatgtttattccgggacataa

SEQ ID NO: 6168 - DNA, 693 bp, Klebsiella pneumoniae
ataatggcgagaagaattctggtcgttgaagatgaagctccaatccgcgaaatggtctgctttgttctggagcaaaatggctttcagcctgtcgaagcggaagattatgacagcgcggtgaatcaactcaatgaaccctggcctgatttgattctcctggactggatgctgccgggcggttcggggctgcagtttattaaactgctcaagcgcgaggcgatgacgcgggatattccggtagtgatgctgaccgcgcgtggagaagaagaggatcgcgttcgcggcctggagaccggcgcggatgactacatcaccaagcctttctctccgaaagagctggtggcgcgaatcaaagcggtgatgcgccgtatttcaccgatggcggtggaagaggtgatcgaaatgcaggggctgagcctcgacccttcatcgcaccgggtaatgaccggcgacagtccgctggatatgggaccgacggaatttaaattattgcacttctttatgacccatccggagcgggtgtacagccgcgaacagctgctgaaccacgtctgggggaccaacgtttatgtggaagaccgcacggtggacgtccatattcgccgcctgcgcaaagcgctggaacacagtggccatgatcgtatggtgcaaacggttcgcggcacggggtatcgtttctccgcccgtttctga

SEQ ID NO: 6169 - DNA, 1218 bp, Klebsiella pneumoniae
gcgcctcagagtgcaaatgatttcaaaaaggagagcaccatgttaaacggcctgaaacccttatcccgttccctgcgctggggcatggtcggcggcgggggaaccagtcagatcggctacagccaccgctgtgcggcgctgcgtgacaatgtttataccctgctggccggcgcgcttgacgtcgatgccgagcgcgggcgcgcgttcggtgagcaactgggcatcgcgccggatcgctgctacgccgactaccagaccctgtttcgcgaagaggcgcagcgccctgacgggatcgaggtcgtctcggtcaccaccccgaacaatacccatttcgccatcaccaaagcggcgctggaggcgggactccacgttatctgcgaaaagcccctctgctttaccgccgaagaggcgcgcgagctggtggatctgagcaaaaaacagaacaaaatcgtcggcgtcacctacggctatgccggctatcagatgatccagcaggcgcggcagatgattgccgatggactgctcggcgagatccgcatcgttaacatgcaattcgcccacggcttccataaccaggccgtcgagctgcaggcagaatccacccgctggcgagtaacgccaaagtttgccgggcccagctatgtgcttggggatctggccacccatccgctgtttgtcgccgagaccatggcgccgcagctcaatatcaaacggctgatgtgctcccgtcagagctttgttccctcccgcgcgccgctggaagataacgcctttgtcctgatggaatatgacaacggcgcggttggctcgatgtggaccagcgcggtcaacagcggcgccatgcactcgcaaaaagtgcgcatcgtcggcgaaaaagcaagcatcgaatggtgggatgagcatcctaaccagctcagctatgaggtgcagggcgagccggcgcgcattctggaacgtggaatgccctacctgtcgccgaacgcgctggcggatgaccgcattggcggcggccatccggaagggctattcgaagcctgggccaacctctatcgccgctatgcgcaggcgattgacgccacggatcgcgacgatcgcgccttcctgcaagacttctggtatccggacgtcgaagccgggctgcacggcgtctattgggtagagcagtgcgtcaaatcggctgacgctggcagccagtgggttgactttactttaccttaa

SEQ ID NO: 6170 - DNA, 300 bp, Klebsiella pneumoniae
attaaacagagtgagaatgtgatgagacagactatgcatcagcaaccagatatttacgcaagactgcaggacaccgcgctctccgactatttccgtaacgccggtgataaactggttgatgagtccgccgtcatgtcgctcgccatcaacagtattctccagtccgagggtcacctgaacaataaggccattattttatggctgattcaggcgctggaaaccaccgatgacgtggtgaccgcggacgtgatccgaaaaacactggagattgtcgttggctacaccatggacgatatctaa

SEQ ID NO: 6171 - DNA, 222 bp, Klebsiella pneumoniae
cgcaggtggaggcttggatgttggagctgctcggcaacgacctcactgcccagggggcgccaaagcctggcggatattttgacggtaaaagagtcctatctcgccgccgcgctgtcggctattcaccagcgctatggcaccgtcgacgcctggctggcggcagagtaccagcttaccgcgccggttcgcgccgcgctgcaggcccggctgctggaagagtaa

SEQ ID NO: 6172 - DNA, 759 bp, Klebsiella pneumoniae
cccgcgcggagctcacctttaaacaggattacgggcacgacgtctggcccgaactggaaagtctttcgttgttgctctgccacaaagccctggcggacgtttttattgatggttgatatgactcagttacaggcaatctatggcggcaccttcgatccggtgcattacggtcacctcaagccggttgagatcctggcgaatcagattggcctgagcaaggtcatcatcatgcctaacaacgtcccgccgcaccggccgcagccggaagccaccagcgcccagcgcgtgcacatgctgaagctggcgattgccgataaaccgctgttcacgctcgatgaacgcgaactacggcgcgataccccctcctggacggcgcaaacgctgcaggagtggcgccaggagcaggggccgcgcaaaccgctggcgtttatcattggccaggattcgctactgacctttcccacctggcacaactatgaaaccattctcgacaatgtccacctgattgtttgccgccgcccgggttacccgctgaccatggcgcaggaagcggatcagcgctggctggatcgccatttaacccacgacgtggagtctctgcataaccgcccttccggcgtgatctacctggctgagacgccgtggttcgatatttccgcgacgatcatccgccagcgccttgagcgcggcgagtcctgcgccgagatgctgcccgccgccgtgctggattacatccgcgagcagggactctattgctga

SEQ ID NO: 6173 - DNA, 528 bp, Klebsiella pneumoniae
agccgtaggagagaaatagcggtttcacctgcggccacagggcgaagcggattttctgcagcggcgacgcgccgcaggccgccaggccgcgtaccggtttgttttgcgcgctttccaccgcctcgtagaacagtttggttaggctgccgacggtatgcagcatcagcgccagaaagcccgggatcgcgccgatgccgaacgccatcacaaagatcaccgcccacgccagctcgggcatggtgcgtaaaaacgccaccagcacgcgaatggcaaagcgcaccggcgccggggaccaggcgttattggcggcaagaaacgcgaaaaccgtggcgatggcgactgccaccagggtcgaggccagcgccagctgcagagtttcccagatcagcggcagctggatcggcaggcgatagccccaccaggccagcgaccctttggtctgcacatcggcgaacaggttgccagcgctcaggggcggaatggtctctgccatatagtcaaagaaatggggcagcgagtgccagatag

SEQ ID NO: 6174 - DNA, 567 bp, Klebsiella pneumoniae
aacggaaggaggaaggccgtgagtagcctcgcaaaagtaatacctttcagaccgtctgtaacggtcgtggagcgtcaggtggcagatatcgatgatgggtatacccgcatcgctaacgagctgctggaagcggttatggctgctgatttaacggctcgccagctgaaggtcgttctggcggtgatccgcaaaacttacgggttcgggaaaaagtttgaccgcattaccaatacccagattgcagaaatgaccggcattcaccatacgcatgtctgcaaggccaagaacgagatgattgcaatgaacatcatcgttaccaatggcctggcgatcggggtgaacaaggtgatttctgactggaatttcagcattagccaaaatggcaaatcattagccgaaacagctaatgaaacattagccaagtcagctaatacccataagccaactcagctaaacacaaaagaaactattcaaaagaaagaaagaaaagatccccctaaatcccccaaggggggaaaactcactcgctcaggaagtgatggattacttcaacgagctaacgggtag

SEQ ID NO: 6175 - DNA, 1560 bp, Klebsiella pneumoniae
ctatccgggagtggcgctggctattccctgccctaccccattattgtgcagaggttgactatgtttagtaacagactcgccagccatcttgagcgcggcgtcgtcggcttcccgaccaccctcgccagctccgtcgggctgatcatggccagcccggtgatcctgacggtcaccagcggcttcggcatgggcggcgataccttcgcgctggcggtgctgctggcctttattatgatgcaggcgcaggtcaccacctttgccgaggcggcgacgctcattcccaccaccggttcggtgtacgactatatctcctgcggcatgggccgcttcttcgctatcaccggcgcgctgtgcgcctatttgatcgtccatatcttcgccgggacggcggagacgatcctggcgggcattatggcgctggtgaacttcgagtcgattaacgcccagatggccgctcaccagaatacctggatggtgggcgtcggcatggtggtgattttcggcttgctcaacgccatcggcgtggaaatcttcggcaaggtcgaagtggtgctgaccttcggcatgtggaccacgctgaccattttcggcctgtgcggcatttttatggcgccggtcacccatctgtccggctggttcggcacaccgctgaacgttagcgatatcaacggcctgttcggctatatcggcatggcgatgtttatgttcgtcggttgcgaactggtgacgccgatggcgccggagatcaaacaggcccaccgcaccataccgcgggcgatggcgctgggcctgctgggggtcgccagctgcatgtttatctacggcgcggcgatcaaccgccaggtggagaataccgtgctcgacgcggccaacaacgtccatctgctggatacaccgatggcgatcccggccttcgccgaacgggtgatgggccacgccggccagtactggctgggggtcgggctgctgttggccggctgcgccaccatcaatacgctgatggccgccgtgccgcgtattatctacggcatggcgctggacggcgcgctgccccatttcctgacctggctgcatccgcgctttaagacgccggtgatcgccattgccatcggggtggcgatcccctgcctgcacgcctggtatctgaacggcgatctggaccgcatcgtgccgctgatcctcgccgcggtctgcgcctggggcgtcgcctatctgctggttactctgtcggtggtgatgctgcgcattcgccgcccggacctgccgcgcgcctaccgctcgccgtggttcccgctgccgcagattatctccagcgtcgggatcatcatcgctatcgtcaatatcacgccgcccgggatggacagccgccaggtgctggtgccgttcggcataatgctcggcctgaccgccgcttacgccctgttctggacggtgtgcgtgcagcgcgtcaatccgttcaagccgctggtagtggaagaggtggtggagcgcgccatcaacaattatgaaaaacagacccgcggggagatgacgccagatgtcctccgtcccctggtttga

SEQ ID NO: 6176 - DNA, 672 bp, Klebsiella pneumoniae
attcgcgggagattttcaatgacggataaaaaagtatacgcggctatcagcgctgtggccggagagctggcagagaaaggcatcagcaaggccagaaaacagggcagccaggtcaactacgcattccgtgggatcgatgacgtttacaacgctctggcccccgccctggtgaagcacaagttgctgatcctcccgcggtgtactgagcggtcatgctgtgaacgaaccagcaaaaatggtggcgcgttgttttatgtaaccgtccgggctgagttcgattttgtcagcacggaggacggcagcactcataccgtcgtcacctacggcgaggcgatggacagcggcgataaagcaacgaacaaagccatgtcgattgcgtacaaatatgcagcctttcaggcgttctgtatccctacagaagaaacgactgtggaccctgactatgaggctcaccaggtaaggccagcagacgcagatcagattctcgctgatttcactgcttacgcaggctcagagaacgatcctaaggccctccatgataactacggaaaagcatggaacagccttcatggcttccctgagcatcagacgaagtgcagagacgttaccggcatccgcctgagagaactgaaacaagccgcaagtggtggcagccatgaaagtaacagctga

SEQ ID NO: 6177 - DNA, 321 bp, Klebsiella pneumoniae
caaaatcctggagtgctttaccctgcaagtgttccccctgggtgcgtgaagattgataatcataaagagcctgacagtatacctgaactgatgaaaaagtcgggtgaaatgtctgtcggcaggcgttcgtggcgggctatcatcccatccctcgccgcggattgcatcgccatttttgtaaaacaatttctgcaaaccggctttggcggatgctgcctggcagcggagaataacagcctgctctggcctgtcaatggtctggcgggaattcttcttgcggctgccagacggcctggctatttaatacccgcagggtggtga

SEQ ID NO: 6178 - DNA, 1707 bp, Klebsiella pneumoniae
ccttaccctggcatggttttaccttcgattgaaacctgctgtggacgggcgacaaataaatttgtattggggcatgcgtatgagccagagcttctcggttcattttcggagtcttcatgcgatgagcaaggagtcatgatgttagatatagtcgaactgtcgcgcttacagtttgccttgaccgcgatgtaccacttcctgtttgtgccgctaacgctcggtatggcgttcctgctggccatcatggaaacggtctacgtcctttccggcaaacagatttataaagatatgaccaaattctggggcaagttgtttggtatcaacttcgcgctgggtgtggcgaccggtctgaccatggagttccagttcgggactaactggtcgtattactcacactacgtgggcgatatctttggtgcgccgctggccattgaaggtctgatggccttcttcctcgaatccacctttgtaggtctgttcttcttcggttgggatcgtctgggcaaagttcagcacatggccgtcacctggctggttgcgctgggttccaacctctccgcgctgtggatccttgtcgccaacggctggatgcagaaccctatcgcatcggacttcaacttcgaaaccatgcgtatggagatggtcagcttctctgaactggtgctcaacccggtcgcccaggtgaaattcgttcacactgtggcgtcgggctatgtcaccggcgcgatgttcatcctggcgattagctcctggtacatgctgaaaggtcgcgacttcgcctttgccaagcgctcgtttgccatcgcagccagcttcggtatggcggcgatcctctccgttattgtgctgggtgacgaatccggttacgaaatgggtgacgtgcagaaaaccaaactggcggctatcgaagcagagtgggaaacccagcctgcgccggcggccttcaccctgtttggtattcccgatcagaatgcgcagaccaaccactttgcgatccagatcccctacgccctgggcatcattgctacccgctcggtggacaagccggttatcggcctcaaggatctgatggttcagcacgaagagcgtatccgtaacggcatgaaagcctacgcgctgctggaacagctgcgcgccggttcaaccgatcaggccgtgcgtgaccagttcaataacgtgaagaaggacctcggttatggcctgctgttgaagcgctataccccgaacgtcgctgacgccacggaagagcagatcgccaaagcgaccaaagattccattccaagcgtcgcaccgctgtacttcgccttccgtatcatggtggcgtgcggcatcctgatgctgctgattataggcgcctccttctggagcgtgatccgtaaccgcatcggcgagaaaaaatggctgctgcgcgccgcattctacggcctgccgctgccgtggattgccgtggagtcgggctggtttgttgccgaatacggccgtcagccgtgggcgattggtgaggtcctgccgacggcggtggctaactcatcattaaccgcgggcgatctgatcttctcaatgttgctgatctgcggtctgtacacgctgttcctggtggctgaactgttcctgatgttcaagtttgcccgcaaaggacctagcagcctgaaaaccggccgctatcactttgaacagtcctctgcggctattcagtcggcacgctaa

SEQ ID NO: 6179 - DNA, 1224 bp, Klebsiella pneumoniae
acccaccctgggggtcgatatcggcgcccgccgggatatttatcaacgtacgcgccagctggccgatcaaggacgggcggtgctggtctcctccagcgacgcccccgaactgctcggactatgcgaccggatcctggtcctctggcgcggcgcgctggcggccaatctgcccacccgcgggctaacgctggacgccctactggtggcgatcaacggcggacaggagccttcaccatgagtactgctatccagcgtcgcggccgtccgggcctggcgacgctgattgaaaaatttcccctgatcctgtttctggcgctgctggtatggctgagcgtacagtcgccctactttctcagctggcaaaatatcagcctgatgctggtccagagcgttccgctggcaatcctctgtttcggcctggtctgcgttatcgccgtgggcggggatgatgtggtctccggcggcatcgacctctccctgccggcgacggcggtgctcggcgtcgcgctgctcagcctcgggctggccgaatggcacacgccatatctcctgctgctggcgctgctggcggcggtttgcctgctgtgcggggcgatcaacggcttgctggtgctggcggccggcctgccgccgctgctggccaccctctcgacctcggtggcgtttaccggtctgacagatctgttgaccggccagcggcgcatcgcggtcagcgatccgctgatggtcgcctttcgcgataacagcgtgctggacctgccctggccgctggtctacctgctgggggtgtttatcctgttccagttcctgctccaccactcccgcttcggccagcatgtgcaggcggtgggcggcaaccgcgatatggcgcagatgagcggcctgaacgtgcgccgcttgaccctgctggtctggctgttagcgggcattgccgccgggctggctattctgccgctgctcagccagggctccggcagctccagcgggacggccacgccgctgctgctggagaccgtgctggcgacctttatcggcgccgccttctcgcgccgtcgggtggtcaccatctggggcgcgctgctgggggcaatcctggtcaacgccctctctaacgggctcggcctgctgggggtcaatatcttctggatgggcgccattaaaggcggcctgatcctggtggtgctggcggcctcggcggtcagacacaaaggaggcgaggcatga

SEQ ID NO: 6180 - DNA, 762 bp, Klebsiella pneumoniae
ttatctgctggagtggcgatgaaaaatagcgaactggaacaactgattaacgacaagctcaatagtgcggccatcagtgacttcgcccctaacggtctgcaggtggaaggacgcgaaacggtgcacaagatcgtcaccggagtgacggcctgccaggcgctgctggatgaggccgtccgtctgcaggcggatgcggtgattgttcatcacggctatttctggaaaaacgaatcgccagtgatccgcggcatgaagcgccgtcgcctgaaaaccctgctggccaacgatatcaatctctacggttggcacctgccgctggatgcccatccggagctgggcaataacgcgcagctggcgcatctgctggggattaacgtgctcggcgaaatcgaaccgctggtgccgtggggcgagctgtcgatgccggtttccggcctcgaactggcctcgtggatcgaagcgcgactggggcgcaagccgctgtggtgcggcgataccgggccggacaccgtcagccgcgtcgcctggtgtaccggcggcggccagagctttatcgacgccgcggcgcgctttggcgtggacgcctttatcaccggcgaagtgtcggaacaaactattcactctgcccgcgagcagggcctgcatttttatgccgccggccaccacgccaccgagcggggcggcattcgcgccctcagcgaatggctgacggaaacgaccgatctggatgttacctttattgatattcctaaccctgcctga

SEQ ID NO: 6181 - DNA, 1161 bp, Klebsiella pneumoniae
ttaaccgctgggacaaggagaatagccatgggcaatagctttctctcctggcggcgggtccgcgccctgtgcgtcaaagagacccggcagattgtgcgcgatcccagcagttggctgatcgcggtggtgatccccctgctgctgctgtttatcttcggctacggcattaacctcgactccagcaggctgcgggtcggcgtattgcttgagcagcagagcgaagaggcgctggatttcgtccataccatgaccggctcgccctatatcgatgccaccgtcagcgacagccgcaggcagctgattgagatgatgcaggccggacgcatccgcgccatggtggtcattccggtggatttcgaccgccagatggcccgccccggcgccgacgcaccgctgcagctcatcaccgacggcagcgagcccaataccgccaacttcgctcagggctatgtggaaggtatttggcaaatctggcagcaccagcgggcggaagaccgcggcgaaacctttgaaccgctgatcgacgtgcagatgcgctactggtttaacccggcggctattagccagcactttattatccccggggcgatcaccatcatcatgaccgtggtcggcgccatactgacctcgctggtggtggcccgcgaatgggagcgcggcaccatggaggcgctgctgtcgacggagatcacccgcgccgaactgctgctgtgcaagctcattccctactatttcctcggcatgctggcgatgctgctgtgtatgttggtgtcggtatttattctcggcgtgccctatcgcggctcgctgccgatcctgtttgtcatcaccagtctgtttttgctcagcaccctggggatggggctgctgatctcaaccattacccgcaaccagtttaacgccgcgcaggtggcgctgaacgccgcctttttaccgtcgattatgctgtccgggtttattttccagatagacagtatgccggcggtgatccgcgcggtgacctatgtgatcccggcgcgctatttcgttagtactctgcaaagcctgtttctggcgggcaatattccggtggtgctgctggtcaacgtgctgtttttgattgcgtcggcggtgatgtttatcggtctgacgtggctgaaaaccaaacggcgtctggattag

SEQ ID NO: 6182 - DNA, 705 bp, Klebsiella pneumoniae
tcgccagctggcctggcactgctacgatctgctcagccagctgatcgacggtcaggccccggagccgcttcagcgctacctgcccgccaccctgcagattcgccatccctgacggcgcggttggcaattagcgttttcgcctggcgcgcgccgcctgcctcagcgccagcagcgcgctggcgagcaccgcgccaaggccgatcgttaccggccagcggtaagccaccagcaacgagggcaatccaccatccggcgccagcatcaccagattccagcccgccagccccgcgttgccgttcagcgcccggcttaacatcctttgatgcggggcgaatggctgaatggtctggtagtggctgccgaacagcgggggctgcatctctcgcgggaactgcgcctgcacctgggccagcacgctggccggcagcgcgtgcgatgccgccagcagatgcccgtcgccattcaccagcagcagctgataatgccgctcccgggcgagggtctggagagcggcgcgcatcgccgccagcggccaggtcgcttcccgctgcggcgccggaatgttcatccgccgctcaaggcgttccgccacccactgcgcatcctcctccagctggcggatctgcctctcacggtaaacctctctggccggcaaattcatgccccgaccgagcgccaggatcgccagccccgcaagcagcgtga

SEQ ID NO: 6183 - DNA, 348 bp, Klebsiella pneumoniae
catagagctggagaaaaaaccagcagcgcagatgtgggagggcctatggctgaattcagtttttcaaaatcgcttttgggaaataaaaaaaggggcgcgctgaccggcagccatgtcgcctacgggctgttcgtgttgatctgctgctgggccggcgcgcagatgctcagcatgctgatccacgccccgggggtatttgaacgcctgatgcaagcccaggacgccagccgtccgcaagtcgacatcagcctcgccgtgggtaccctctttggtctgatccctttcctgatcggctgcacgttcatcggggtactggcgcttatcgtgcgctggcgtcagcgccgttaa

SEQ ID NO: 6184 - DNA, 525 bp, Klebsiella pneumoniae
agcagagctggccgccgagcgcaaacgcgaagcccaggaacaggagcaaaaatgagtcaggtgatcctcgatttacagctggcctgcgaagagaccagcggcctgccggacgaagcccttttccaacgctgggtcgacgccgtcattccgccgtttcaggaggagtcagagttaacgattcgtctggtcgacgttgcagaaagccatgagctgaacctgacctatcgcggcaaggataagccgaccaacgtcctctccttcccgtttgaagcgccgccgggaattgaaatgccgctgctcggcgatctgatcatctgccgtcaggtggtagagcaggaagccagcgagcaaggtaagccgctggaggcgcactgggcgcatatggtggtgcacggtagcctgcatctgctgggctacgatcatatcgaagacgacgaagcggaagagatggaaggccttgaaacagagataatgcttgctctgggctatgaggacccgtacatttccgagaagattgcggaatag

SEQ ID NO: 6185 - DNA, 207 bp, Klebsiella pneumoniae
caaccgcatggtcatcgagaatttcatgaccggtataaacccggccctgggttaatgcatacattacgacccccggtatatacgcctcatcaggtcagcgttcgttcgtttgccgccggcatgatggtgcgtacaaagaaaaagatgatcccgcgccagggcgcgggaaggactacattacagacctttaatattttcagcttctaa

SEQ ID NO: 6186 - DNA, 366 bp, Klebsiella pneumoniae
catttaaatggagtggcggcatctcagcgttgtcggaggagaaaattcatgatgatacgtgaacagatcgaagcaaaacttagagcagcgttcgacccgatgtatctcgaagtcgtggatgaaagttatcgtcacaacgtccctgcgggctctgaaagtcattttaaagtggtgttagtgagcgatcgcttcactggcgagcgtttcctcaatcgccaccgtatgatctacggcacgctaaccgaggagctgtcgaatacggtgcatgccctggcgctgcacacctacacgattaaagaatgggaagcattacaggatacggtatttgcttcgccgccgtgccgcggcgcagggagtatcgcttag

SEQ ID NO: 6187 - DNA, 234 bp, Klebsiella pneumoniae
agtgatggtggcgcagcatctctgtgcgtgctctttcataaaaagcgacgtaactggcgtggtaaaccacaccaccggcatcggtatcttcgtagtagacccgaaccggccatcgaaacagcgttgtattcactttacatcccggtaatgcaaaaaaaggttagagctttcaaacttcgctactatacgcgcgggaaaggtggtttggaatgggggaaagtaaacggggcgtaa

SEQ ID NO: 6188 - DNA, 336 bp, Klebsiella pneumoniae
  unsure (223),(238): Identity of nucleotide at the above locations are unknown.
attggaggtggtataatgtcattagtatgcactagtgtttctggcgttgcagagggccattttgtagtgggccgcacctacaaaccggacagcaatggacgccttacgacccaagccacagatgataccggatgccaggcattgtggaccgtggagaacgacaatatttacgctttagttggagatttagattctgaagtaatagtcacttttgaaccagatnaccaccccaaccccngccattattggcggggcccaaggattccccaccaaacaaagccctgcatcacatcactccccagcagcgttcatgcttgggtaatctattcgaattaa

SEQ ID NO: 6189 - DNA, 1974 bp, Klebsiella pneumoniae
atccagggtggtgtagctatccagcttcttggtattggccgcatcggcatactgcgagccgctatgattgacgcgcgcggtggcggtcaggccttccaccggcttgatgtcatattcggcgccgagtaccgcgtagaagttagccaccccgatggcatctttaccgtcggttgcgccttcagcggttttagtctgtttggcatccagccagacggtactggcgttaagacgcagtcccagcatcggctcgccaaagacgttcatctctacgccgcggttacgctgctcgccgtcgaggccgtaattgccagcggtatcggaaatggcgttcggttttttgatttcaaacagcgccagcgatcctccgatcgtaccgtagtcgatcttgacgcccacttcgtcctgcttcgagtgcgcgatcccggtactctgcccagcattggccgccgtcgtcggcgccacagagcccggctgcagcgcttcggtatggttagcatacagcgacagctgctcccacggcttgtacaccaggccaaacgtcggcatccagcggctttgggtataacgcgaagaggtatcttccagcccggtggcgttgctgtagttgcgcacaaccactttctgatgacgagcagcggcggtaaacagcactttatcgttaaagaagccgagggtatcactcagcagccagccctgcgtacggctgcgcgaggtgaccagcggatcgtggtagttgccgccaaaataggcgttatccggcatcgccacatcatggttgtcatagatattagtggtcgggttcctggccgacatccgccaggcggtcgcatcggtatgcacctgcgccgcatagccgaggttcaccttatgcgaaatcgcgccggtattgaaatcgccgcgtaccccgcccatgccgctgatcgcgtcgataatgcggttagtatccaggcggcccaccgtcgcatcgccgtttttattcagaagcttcggcgcgctgtaggtaccaatttcatgcgaatgctggccgccgagggcgctgtataccgtccagctatcggtcaggtcatattctgccttcgccatgccgaactcgctttcaatatcgctatagccccacttctggctgtagtttttgctgttgtccggcagcgccggaacgaaatccacgccgctgatattgacgcccatcgtaccgccgtggaacgttttcttctgatagccgaaatcgagcgaggagcggaaacggtcgccgcggtaatcaagccccagcgaagccagcgtggtacggcgtttatcattatcgatagcgccttcaccctcgcgatgcaccaggttgacccgggcgccgaactggttgttgtcgccgaaacggcgccccaggtcgagggtgccgcccacctgagaatcagaggtatagtcgacgccaacgcgcgcggtcggcagatcttccgcccgcttcggctcgaggttaatcatcccgccgacgccgctgctggccgcgccgttaagcaggctgttagcccctttgaaaatttcaacgcgctccagcatctgggtgtccatcacctgacgcggcaccacgcccgccaggccgcccatcgtcatgtcatcgccatcgagcttaaacccgcggattcgataggtctcggcgaagttgccgtagccctgtacggcctgcacgccagcgtcgttactgacgacatcggcgatagttttcgcctgctgatcctgaatcagcttcgaggtatagccgatgacgttaaacgggacgtccatcgctttttgttcgccaagcatccccagacggccgccgtgggcgatctggccatcgaggaatgccggaaccaccaggtcgccgccggatttaaaatcgctggtttcgttagcctcgacgatgagggtctcttcgccaggctgcttcgcggcggcagcgtccgcggccatcgccgtttgactggcggcgccgatggctaa

SEQ ID NO: 6190 - DNA, 966 bp, Klebsiella pneumoniae
ggagtactcggcatgatgacacgtcctttgggcaaaaccggattttccatcgccccattagtctttggcggcaacgtctttggctggaccatcgatgaaaaaaccagttttgctcttcttgatgctttcgttgaccacggttttgacgctatcgatacggcggatgtttattcccgctgggcggagggcaaccagggcggcgaatctgaaaccataatcggccgctggctacaggcgcgccccggcatgcgtgataaagtcaaaattttcaccaaagtcggctccgatctcggcctccccggccataaagggctcagcaaagcctggatccaacaggcggttgacgactctctgcgtcgcctgaataccgattatatcgacctctatttctcccactggccggatccgcaaaccccggtggcggaaacgctggaggccttccacagcctgcagcaggccggaaaaatccgcgcgatgggggcctctaacctcgatgcgatgcagctggcgggggcgctggaggtggcgcgtaagggcggcttgcctgcgtggcaggtgctgcagccggaatataacctctaccaccgctctgcgtttgaaggcgcgctgtgcgatctctgcgtcagccgcgatatcggggtggtgacctactacagcctggcctcggggttcttaaccggtaagtaccgccagccgtcggatctgacacagagccagcgcggaagcgggattggtaagtacctgaatccgcgcgggatgcggattatcgataccctggcggcggtcgcggacgagcagggcgcgaagccggctgaggttgccctggcgtggctgatcggccgcgaaggggtgaccgcgccgatcgccagcgccaccagcgtggctcaggtggagagttttgcccgcgcggcggcgctgagcctgagcgcggagcaagtggcgcggctggacggcgccagcgcctga

SEQ ID NO: 6191 - DNA, 1914 bp, Klebsiella pneumoniae
caccatgtcggccgcctctttggtgacttcggtgcctttgatacccatggcgatacccacgtcggcctggcgcagcgccggcgcgtcgttgacgccgtcgccggtcatgccgaccacttcgccgttatcctgcagggctttcaccaggcgcagcttatgctccgggctggtacgggcaaagatgtcgtactccaccgccgccttcgccagcgccgcatcgtccatgtgctccagctggtagccggtcatggcctggctactgttggtgatccccagcatctggccgatgctcatcgccgtctgcgggtggtcgccggtgatcattttcacgcggatgccggcggtctggcaggcgtggatggcgtcaatggcttccggacgcgggggatccatcatcccggcgatgccgaggaaaatcagtccctcctgcaggtcctcatggttgagggtggtggcatcaaggctggccggcttacaggccgccgccaccatccgcagtccctgacgggcgaagcgcgccatctcctcttcccagtactgcgcctcgaacggcaccgcgccgtggcggctcatctgctcgcggcacatggcgaagataacgtccggcgcaccggtgatcagcacccgggcattgccatcgatgtgctgcagggtcgacatatatttgtactgcgagtcaaaggggatcttggccaccagacgggcctccaccgccgggagctgcgctttcgccgccagcactttaagcgccccttcggtcggcccgccggtgatcccccacagaccgcgctcatcctgggtaagctggctgtcgttacacaggtcgatggtgcgcagccaggtctccagcacggtgccgggctgaacctgcacgggctcatcgctcccctcgaggaagatccgcccctgcggctcgtagctgtcgccttccacccgatagcagcagtcggcggtgatgatcgctttgacggtcatttcgttcatcgtcagggtgccggttttatccgagcagaccacggtcatggcgccgagggtttccacggtcggcagcttacgaataatcgcccgcttgcgcgccatcgtctgcacgccgagcgacagaataatcgagatgatcgccggcagtccttccggtaccgcggctaccgccaggctaatcagcgacagcagcagctcgcccatcgggatatcccgcagcgcgaggctgaagataaacagcgccaccatcatggcgagaataatggcgaaaatcgctttgccgagcttatccatctgcaccagcagcggggtacggtgcttctcaatacccgccatcatctggttgatatggccgagttcggtctgcgcgccggtggcggtcaccacgccgacgccgccgccggcgctgacggtggtcccggagaagaccatgttcacccggtcgcccagcggcagatcgccctccagcgcgtcggtgattttatccaccaccgtcgactcgccggtgaggatcgcctcttccacccgcaggttgtgggtttcaatcaggcgcatatccgccggcacgcggtcgccggcgcgcaggataacgatatcccccggaaccaggtcgcgcgtcgggatagtctcatgcttgccgttacgctggacgcgggcatcgctggagagcatgttgcggatcccctgcagcgatttttcggcgttgctctcctggatatggccgatcagggcgttaatcaccgtcacgccgaggatcaccagggtatcaacccagtgccccatgatggcagtcagcgccgcggcggccagcagcacgtaaatcagtacgtcgttaaagtgggcgagaaagcgcaaccagcccggtttgcctttcttttccggcagcgcgttcggcccacaggtattcaggcgctcggcggcgtctgcggaacttaa

SEQ ID NO: 6192 - DNA, 1467 bp, Klebsiella pneumoniae
tgctacgtcggtctgctgaatgacgcaatggagaatcccatgaatacgtctgctgtttcacccggccgcgccggtctgttgctgctgctgagcggccagatgctgccgcttattgatacctcgatcaccaatgtggcgctggacgccatcacccacaccctggcggccagcgccacgcagctggagcttatcgtcgctctgtacggcgtcgcctttgccgtctgcctggcgatgggcagtaagcttggcgataactatggccgccggcgcctgtttatgtggggcgtcgccctctttggcatcgcttccctgctgtgcgggatggcgaacagcatcggcgccctgctggcggcccgcaccctgcagggcgccggggcggcgctgattgtgccgcagatcctcgcgaccctgcacgtcaccctcaaaggccccgcccacgcccgggccatcagcctgtatggcgggatcggcgggatcgcctttatcgtcggtcagatgggcggcggctggctggtgtcggcggacatcgccgggctgggctggcgcaacgccttttttatcaatgtgccgatctgcctgctggtgctggctctgagccgccgctatgtgccggaaacccgtcgcgagacgccgtcgcggattgactggcagggtacgctgtacctcgcgctgatcctctgctgcctgctgttcccgatggccctcggtccggagctgcactggccgctgtggctgcagctgatgctggtggcggtcctgccgctgctgttcgccatgcgtcagagcgccctgcgccagcagcagcgtggcgaccatcctctgctgccgccgcgtctgctgcagttgaccagcatccgcttcgggatggccatcgccctgctgtttttcagcgcctggtccggctttatgttctgcatggcgctgaccatgcaggaggggctggggatggcgccgtggcagtccggcaatagctttatcgccctcggcgtggcctattttatttcggcgctgtatgccccgcggcttatcgcccgctacagcatggggcggatcctgctgaccggtctggcggtgcagatcgccggtctcctgctgctgtgcgccaccttctcccgcttcggcgtcgccaccaacgccctgacgctggttcccgccacggcgctgatcggctatggccaggcgctgatcgtcaacagcttttatcggattggtatgcgcgatatcagcgccagcgacgccggggccgggagcgcaatcctcagcaccctgcagcaggcgaccctcggtctcggaccggctatccttggttcgctgttcctggcgctggcccgtcgcggcggcggaaactatccgcaggcgctgattgattttctgctggtcgaggtggccatgatgctgttgctgggggcgatagcgctgtggctacgccatcatctcaaccgacaaccggcgacggtggcctcgtaa

SEQ ID NO: 6193 - DNA, 183 bp, Klebsiella pneumoniae
ttatcttccggtaaactttattgccactgctgtctttgtcttatttttgggataacctgctttcaggttatcccgttttatttatttccgggcggcaaaatgttcatccagaagctgacgcagcgcatcggactgtttaccgaaaatagcatgcacctgctgaccaagaataataacccctag

SEQ ID NO: 6194 - DNA, 291 bp, Klebsiella pneumoniae
aaaccctccggtaactactatcacgaagatatgctgcaggtgctggcggcgcgcggcgcggtgggtgatatctgcctgcactactacgacaaaaacggccatccggtcttacgcgatgatgaagatccggtgatcggtatggcgctggagaaggtcaaaaaatgcccgaacgtggtcgcgctggccggcggtaccgacaaagtcgcggccatcaaaggggccctcaccggcggctacattgatgttttaatcaccgattaccctaccgctcgcatgctggttagcgactaa

SEQ ID NO: 6195 - DNA, 255 bp, Klebsiella pneumoniae
tccgctgccgggtttgcgccaggcctgccgtctgctcctgctggcgctcccacaggggacgcagttgggcggcgggctgggccagctcaagcttcgccagcgccggggcggcgtccgccagcgcctggcgggcctgctgctgccgggtggcggcctgctgctgctgctgcgccagctcgtcgcggcgggtcagccactggagctggtgctgctggctctgctgctgggccagcagggctttttcttcgtcagtaa

SEQ ID NO: 6196 - DNA, 1026 bp, Klebsiella pneumoniae
cgcccagccggatggcggtgcttgcgcctcatccggccgctgtttctgcgttttacctgccagaaagtcaggcaacccatgccgtccggcgctgagtttacgcgcgacgagcgacagttaaatcaacatgagaacccaaacgacgccatgagcgacgacaattcacacagtagtgacacagtaaacagcaaaaagggatttttctccctgttactcagccagctttttcacggggaaccgaaaaaccgcgatgaactgctggcgctgatccgtgattccgggcaaaacgaccttatcgatgaagatacgcgtgacatgctcgaaggggtaatggatatcgccgaccagcgggtccgcgacattatgatcccccgttcacaaatgataaccctgaaacgcaaccagacgctggacgagtgcctggatgtcatcatcgaatccgcccactcgcgtttcccggtcatcagtgaagataaagatcacatcgaagggattctgatggccaaggatctgctgccgtttatgcgcagcgacgccgaagccttcagcatggaaaaagtgttacggccggcggttgtcgtcccggaaagcaagcgggtcgaccgcatgctgaaagagtttcgctcacagcgctatcatatggcgatcgttattgacgaattcggcggcgtctctggcctggtgaccatcgaggatatccttgagctcatcgtcggggaaattgaagacgagtacgacgaagaagaagatatcgatttccgccagctgagccgccacacttggacggtgcgcgccctggcctccatcgaagacttcaacgacgccttcgacacgcactttagcgatgaagaagtggataccattggcgggctggtgatgcaggccttcggccatctgccggcccgcggcgaatctatcgacattgatggttaccaattcaaggtagcaatggcagatagtcgtcgtatcattcaggtgcatgtaaagctgcccgatgacgctccccagccgaagctggaagagtaa

SEQ ID NO: 6197 - DNA, 1344 bp, Klebsiella pneumoniae
ctggcatacggaattcaaataaaaaccattaaattgttataccttcacatgaggttgataatgaaaaagaacacgcttgctgcactgatccttaccaccctggcggcggggcaactcgccagcctgcaggcgcatgccgccgggcagctcaacgtctgggaggacattaaaaaatccgctggcatcaaaaccgcggttagcgattttgaaaagcagtacaacgtgaaggtcaatctccaggagatgccctacgcccagcaactggaaaaactgcgcctcgacggcccggcgggcattgggccggacgtgctggtgatcccgaatgaccagctcggcggcgccgtggtacagggactactctcgccgctcagcgtcgttcaggcgaaacaggatgcctttacgccagcctccatcaatgccttccgcatggacaacgcgctgtatgggatcccgaaggcggtggaaaccctggtgcttatctacaacaaggacctgatcgacaagccgctggacagcctgcaggcctggctggactactcgaaaacccagcgcgagcagaacaaatacggcctgctcgccaagtttgaccagatctattacagctggggggcgattggcccgatgggcggctatatctttgctaaaaacgacagcggcggctttaacccgcagcaggtgggtctcaatacccccggcgccgtcgaagccgtcaccttcctgaaaaaattctatgccgagaaggtctttccggcggggatcctcggcgataatgggctgaatgccatcgattccctgtttaccgagaaaaaagcggcggcggtgatcaacggcccctgggccttccagccgtatgaagccgctggcattaactatggcgtggcgcccctgccgaccctgccggacggcaagccgatgagctccttcctcggcgtcaaaggctatgtagtatcgacctggagtaaagacaaagcgctggcgcaacagtttatcgagttcatcaaccagccgcagtatgtgaaagcccgctatgtcgccactggcgaaattccgccgctgaaggcgatgattgacgatccggtgattaaaaacgaccaaaaggccagcgccgtcgccatccattctgcgcgagcggtggcgatgccgggcattcccaaaatgggggaaatgtgggggccggccaatgccccgcttgaactgaaccccaccggtaaacatgcgccgccaggccgcgctcgaataagcggtgaaacagatgacgatgcagatcgaagcgatgcaggccagcaatcagtaattcaccgtcacgtgaagtcaccgagcgggagggggacctcccgtttgtag

SEQ ID NO: 6198 - DNA, 1164 bp, Klebsiella pneumoniae
atgtgtgacgggtatatacttcagggaacacatcgaccgggagagactatgcctttagccgattttcaccgctccgatccttttaccctcggtatcgaactggagctgcaggtggtgaacccgccgggttacgatctcagccaggatgcctcgacgctgattgccgacgtccagcatcagctgaccgtgggagaagccaaacacgacatcaccgagagcatgctggagatcgccaccggggtgtgccgcgacatcagccatgcgcaaatccagctcagcgccatccagcaggcggtccagcgcgcggcgctgcgccatcatctgcagatctgcggcgggggttcccacccctttcatgcctggcagcgccagcaaatcagcgataacccgcgctatgtcaaaaccgtcgagcattttggctatctggcgcagcaggcgacggtctttggccagcatgtgcacgtcggctgccagagcggcgacgacgccatctatctgctgcatggcctgtcgcgctttgtaccgcacttcatcgcccttaacgccgcctcaccgtggtttgacagcaccgacagccgcttcgcctgttcgcgcctgaaccgcttctcctcctatcccgacaacggtccgatgccgtgggtggccgactggcaggggtttcgtcgcctgttccgccagctgagctacaccagcatgatcgatagcatgaaggatctgcactgggatattcgccccagcccgcagtttggtaccgtcgaggtgcgggtgatggacacccccttgaccctcgcccaggcgatccacatcgccggctttattcagaccctggcctgctggctgttgacggagcgtccttttaagcaccagcctgatgattatctgctgtacccctttaaccgctatcaggcctgccgctacgggctggacgggaccctcaccgacgtgcgcagcggagagcagcgcagcatccgccaggagatcctgcagctcgccgaccggctggcccctttcgcccatcagctgaaggcgacggcagcgctggaggcggtggttcgccaggcgaaatcgccgcacagcgaggcgcagcagatgcgcgactttatcgccaacggcggttcgctttccgggctggtgcaaaaacactgtgagatttgggcggcataa

SEQ ID NO: 6199 - DNA, 1158 bp, Klebsiella pneumoniae
tcgaccgacggagaaataccaatgaaatcgttttccgggaaagcgtctttaatggccacgctggttgccgcgctggtcggcgccagcagcgcgcaggcagcagaaattaaaattggggtggtattacccctgagcggcgccctcagcggctatggccagccgtcgcagaaagggctggacattattcaggccatcaccccgacgttaaaaaatggcgataccatcaagcttatcgttatcgatgataaaagcgataaagtcgaagcggccaacgccatgcagcgcctggtctccagcgataaagtggatgccgtgatcggggaagtcacctcctccaacaccctggcgatgaccaaaatcgccgacgacagcaaaacgccgctggtctcctccaccgccaccaacgaccgcgtcacccgcaaccatccctacgtcagccgggtctgcttctcggacagcttccagggggtggtcggggccaatctggcctcccgcgatctgaaagccaaaaccgccgccatcgtgtttgacagcagcaacgactactccgtcggcctggcgaaagcgttccgcacccagttcctgaaaaacggcggcaccattcccatcgaggtccaggctccgggcggcagcaaggactttaaagcccagttggcgagcgtcaaggcgaagaatgtcgacatgatttacatgccgatctactacaccgaaggggcgctgattgccgtgcagtctaaacaactggggctcaacaaaccggtggtgggcggcgacggtctggccgcggatcaggtcttcttcgatgtcggtaaagacgcggtcaacggctatatgaccaccgattactactcgccgaacgccaaagagcagaccccggcgggggaaaccttcatcaaagcctgggaagccaaataccagcagccgacccatacctggggcgcaatggcggcggacgcctataacgtcatcgtcaacgccatgaaccagtgcagcgatccccacgatcgggtctgcgtgaatgaaaaaatccgcgccaccaaagatttccagggggtgaccggcacgctgacgttacagaacggcgacgccattcgcagcgcggtcatcaacgaagtgaaagatggcaagctggcgtttcgtaccgtggttaacccttaa

SEQ ID NO: 6200 - DNA, 297 bp, Klebsiella pneumoniae
gggtgctgcgggttttcaaacaccgcgcggcgcgggcctatttcgacaatgcgaccgcgatacatcaccgccacgcggtggctgatgcgctccaccaccgccatatcatgggaaataaacagaaacgcgatgcccatctcgcgctgcaggtcgagcatcagattgataatctgcgcccgaatggagacatccagggccgacaccgactcgtcggctatcaccaccttcggattcagcgccagcgcgcgggcaatgcagatccgctgccgctggccgccggaaaaggcatggggatag

SEQ ID NO: 6201 - DNA, 486 bp, Klebsiella pneumoniae
tcgcacattttctgcaagcctctgtcgcccggcagaggcctttccgcgccgcctcgacgggttgcgttttgcctcttacctgcgttttttctccgctctacagtaccccataagaaattcggaatttatctaatagtcttattatttccttatcttttgtgtgggcgtacagtggaggtacggatgaaaattgtctggtcaaaaacggcagataagccattttctaaaatcgatactcggtataagagccgcattaaatccaggctggagaagatggatgataaagcttcacctatctcggatatcaaaaaattgtcctctcccgaaaaccactaccggctgcgattaggtgattacagagtcatctacacctttggggatccgccgggcgatacctgctacgtcgtggcggttaaacgccgaaccaccaccacctaccttcatgaggaagataccgaatatgactattcagtacatcaaggatga

SEQ ID NO: 6202 - DNA, 219 bp, Klebsiella pneumoniae
gccgggtcaggcgcagccgccacccggcacaaaaacgtctccctatccgtcgtctcccccgctgcgaccgaaacttcacccaactgtaatctgaacgacatctccaccttctactgtctgggcaggacggaggaggagccactatgtttagtctcgacaacgtactcgatgacctgtggcctcaggcgaggcccgccccctggcaaaagaaactgttaa

SEQ ID NO: 6203 - DNA, 1386 bp, Klebsiella pneumoniae
cggcctgcaggatcgcaggcagacgtgacggtaatgacattattcagcgtccgttttgtatttcagcgtcagagagagcgcgaaggccacggcgaaggcgatcgccattccgataatgtagttcagcagcgagctggcctgcacgatagccattcccgggatcgccgtcaggcccaccgcggtcatgtagacgtgcatcgacaccacccaggcgccgccggcggcaccgcccaccagcgcggcgatgaacggtttcacaaagcgcaggttaatcccgaagattgccgcctcggtgatccccagcatcgccgaaaacgccgacggcagggtgatagcttttattttggcatctttggttttaaaccacaccgcaaagcaggcgccgccctgggcgacgttggccatcgcccagatcggcagcaggaagttgacgccaatcgatgggttgcccagcagtccggcctcgatggcatggaagctgtgatggataccggtaataacgatcaccgaatagaggccgccgaacagcaggcccgccagccagccggcgtggctgataagcgtgctgaggataaacgaaatgccgtcgccgagcgcgcgaccggccgggccgatcagcagcagggcgataaagccggagataatcaccgtcaggaacggagtgaggatcaggtccagcgcgtcagggatcacgcggcgcagccgcttctcgaccatgctcataaaccacaccgccagcagcaccgggaagacggtgccctggtagccgatcatcgccacttcgatgccgaagaaattcatggtgtggaagccggcggcgacgccccaggcgttggtcagcgccggatgggtgaggatcccgccgagggtcgcgcccagataggggttaccgccaaattcgcgtgcggcggtaaagccgatcaggatcggcagaatgataaacgccgccgaactgcacatatccagcatgatatagagagcgttgctcgggtcgacccaaccgtaagttttcaccatccccagcaggcccatcagcaggccggaggcgacgatggccggaataatcggcacgaagatgttggacagcaggcgggcgatgcgctggaacgggttcagctttttccccgccaggtcggcggcttcggatttgctcgattcgctgatgcctgcggcctggataaaggcggcatagactttattgaccaccccggtgccgaagatgatctgcatctgtccggcattgcgaaagcagcctttcaccccgtcgattttgccaatcgcctgctgatcggcgagcgcgtcgtcgaccagcaccagccgcaggcgggtggcgcagtgcgcggcgctggcgatattttccttgccgcccagcaggggaagcagtga

SEQ ID NO: 6204 - DNA, 1368 bp, Klebsiella pneumoniae
tcgcgcgcagggcggggaatatgctactatttcccgcttgttccctgttatttaagcgccactatgaaatttcccggtaaacgcaaatctaaacactattttcccgttaacgcccgcgatccgctgctgcagcaaattcagccggagaatgaatccagcgtctcctgggtggtcggtatcgaccagacgctggtggatatcgaagcgaaagtggatgaggcgtttatcgtgcgctacggcctgagcgcgggccattcgctggtgattgaagatgacgtcgccgaggcgctgtaccaggagctggtgcgcaacaatctcattacccatcagtttgccggcggcaccatcggcaataccatgcacaactactcggtgctggcggacgatcgctcggtgctgcttggcgtgatgtgcagcaatatcgaaatcggcggctatgcctatcgttacctgtgcaatacctccagccgcaccgatctgaactatctgcagggcgtcgacggcgccattggccgctgctttaccctgatcggtgacagcggcgagcgcaccttcgccatcagcccgggtcacatgaacaagctgcgtccggaaagcattccggaagcggtgatcgccggcgcctcggcgctggtgctgaccttttacctggtccgctgcaagccgggcgagccgatgccggacgcgacgatgaaggctattgagtatgccaaaaagcacgatgtgccggtggtgttaaccctcggaaccaaatacgtgattgccgataacccggcgtggtggcaggagttcctgcaggagcatgtctctattctggcaatgaacgaagaggaaggggaagcgctgaccggctttgccgatccgctgtcagcggcgaataaggcgctggactgggtcgacctggtgctgtgcaccgccggcccggcgggcctgtatatggcgggcttcaccgaagaagaggcgaagcggaaaacccagcatccgctgctgccgggggcgatcccggagtttaaccagtttgaattcagccgcgcgatgcgtcaccaggattgcgttaatccgctgcgcatatattcccatatcgctccctatatgggcggccccgagaagatcatgaacaccaacggcgcaggcgacggcgcgctggcggcgctgctgcatgacatcaccgccaataactaccaccgcaataacgtccccaactccagcaagcacaaatgcaaatggctgacctactcctcgctggcgcaggtgtgtaaatatgccaaccgcgtgagctatcaggtgctgaaccagcactcgccgcgtttaacccgcggcctgccggagcgtgaggacagcctggaagaggcgtactgggatcggtaa

SEQ ID NO: 6205 - DNA, 1509 bp, Klebsiella pneumoniae
gccggagcaggtatggatttttatcttggtatcgatattggcacctcgcgggtgaaagcggtgctgtttgatcagcatttcaccgcctgcgccagcgccgcggaaaatacctcaccccgcctgtcggccaatggctacgcggaacaggatatgacccagctgtggcattcggtgctggctactctgcgccagattgcccgccatccggcgctacaggcggggcggctgcgggctatcggcctcgccgggcaaggggagggggtctggctcagcgatgagcagggcgaaccggtgggcccggggatcctgtggagcgatacccgcagccacgagctaatgagcgacctgctgcgccgacccggcttcgaccgccgctatttcgccgataccggcacccacctgcagccctgcaataccagcctgcagctgtactggctgaaacagtatcagccggcgcggctggcggccgcgcgctatctgtttttcgccaaggactggatccgctttcgcctgaccggcgtggcggcgctggagctgacggacgccagtagctcgttactcaatcagcagaccggcagctggtcctcggtggtgatgaacgagatggggctgaacgaactgctgccgatgtttcccccgctgctggccccggatgccctggccggcacgctgagcgacgcggtggcggcgctgaccgggctgcccgccgcgacgccggtggccgccggggcgctggatgtctgtagcgccgcgctgggctgcggcgcggtcaacgaaggggatatctacacgatcctcggcaccacctgctgcaccgggatcgtctgccgcggcccgcagacggtgaacgaggcgacgcgctttgtcacccataccgaagccggacaggtgatctccctgtttccgatgcaggccggtacgccaaacattgactggctgcagcagcatatttcgctggacgccgatctggggcgcctggagcaggcgatcgcggcggtggagccaggcagcggcggcgtcttctggcagccgtacctcaatggcgaacgtgcgccgttttacagcccggacgcgcgggccggctttttcggcattagcccgcacaccacccgcgccgaactgcagcgcgcggtgtttgaaggcctggccttcgccattgtcgatgcgctgcagggttatccgcagggcggcgagctgtatctgaccggcggcggcgcagcctcggcgacctggctgcagattatcgccgactgtaccggacgcacggtggtctccagcgcctttaacgaactgagcgcgcgcggcgcggcgatcctggcggcccgtagcgtcgcggcgctggccgaaacgcctccgctggcgcagacccgctatcagccgcgccctcaggcgcatgcccgctacgcggcgctgtatcccgtttaccgcctgctgcgcgagcagatgctgccggtatggcaggccagacaggccgcccttcaacctctttctcaggacctacaaccatga

SEQ ID NO: 6206 - DNA, 351 bp, Klebsiella pneumoniae
tcactacaaggaattgcaatgaaagagttaacactgaacgaaatggagtatatctccggtggctttaatctgttcggcgcagccagcggcttcgccagctttgtcgccaactctggcgtcggcttcacctcttttgttctgacctccggcaccgcatttgcctccttcgtcggcgacagcgcgatggcgtttggttccttcctgaccggacagtcaaactgggaaacctttgtgaccgccggaaaggaaaactggggaagctttgttaacaccgccggcaacagctggaatactttcgtgaataacgcggccagcgactggaacacctttctgaccaaagcgtcggcctaa

SEQ ID NO: 6207 - DNA, 1125 bp, Klebsiella pneumoniae
tcaagacaaggaagcataatggccgcacgtttatcgcgcattattcccgtttcattgacgctgctggcggccatggcgctgagcgcctgtaccagccagcaggctccggcgctgaaagagggcgagaagcctgttgacgtggcgtcggtggtgcggcagaaaatgccggccagcgtcaaggatcgggaggcctgggcgcaagccatcgccaccgcgtttgacagccagaagctggcgccgacggaagaaaacgtctgctcggtgctggcggtcgcgcagcaagagtctaactatcagtccgatccggtggtgccggggctgaataaaatcgcctggcaggaaattgaccgccgggcggaaaaaatgcacattccgccgtttctggtccataccgcgctgaagatcacctcgccaaacggtaaaagctatagcgaccgtctggacaatgtgaagacggaaaagcagttgagcgccatttttgatgactttatcgggatggtgccgatggggcagaagctgttcggttcccttaacccggtgcacaccggggggccgatgcaggtcagcattgcttttgccgagcagcacacctccggctacccgtggaaaatgaacggcacggtgcgccaggaggtcttcagtctgcgcggtggcctgtggtttggcacctatcatctgctgaactatccggccagttatagtgcgccattgtaccgctttgccgacttcaacgccggctggtacgccagccgtaacgccgccttccagaacgcggtggtgaaagccagcggggtaaaactggcgctcgacggcgaccttatccgctacgacagcgaggagccgggcagcaccgagctggcggtgcgtcgcctggcgagccagctggggatgagcgacagcgagatccatcgtcagttgaaaaagggcgacagcctggcgtttgagaagaccgatctctatcagcaggttttccgtctcgccgagaaaaaggcgggcaaaaccctgccgcgggagatgttgccagggatccagctggagagtccaaaaatcacccgaaatctgacgacggcgtggtttgcgaaacgggttgatgagcggcgggcaaactgtatggcgcggcgttaa

SEQ ID NO: 6208 - DNA, 1227 bp, Klebsiella pneumoniae
ttttggcaaggttcgagctgcgccagtgagtcgttcactaagagtcgcgaaggcgtagggtggcgtaaagacagcaggctggaaacacacaatatcggccgctgcgcgtccatcgggtcattgattttttatagggttgatccaatgaaatacacacttccggcgttgacgctggccatcagcgcggcgttaagcggctgcgcgacgcctcattcctctgccgtttcccaaccggttgtcgactcgccagtccctaacgtggcgcaaccgctgcagcgccagctagcggaagggctgtacgagatggcgttaagcccgcagggtgatgcgctgtacgtcgccagcgctgaaggctttaaaaatgtacagggcggggcggtttacacactggatccgcacaccctcaataccatcggcctgacgcataccgatctgaaaaacttcgctttacagctctctgcggagggtaaaacgctgtatgtcagcaattcgctggacggcggcatcagcgctatcgacaccgccaccggcaaggtaaaaaaccgcctgctgttcagcgagcgcaatgaaaaaggtcgcccttatggggcccgtcagctgctgttgctgaataatactctctacgttggcgcggtcgccgacccggcgcaaatctgggtggttgacgccactaccctgaagctgaaaacgcggattaaaaataccggtaaatggatgaccggcctgcactactccgcgcaaaccggtcgcgtgtacgccgctaacggcagcggtgaaattctggtgatcaacccgcgtaaccaacgcattgaacagcgctggaagccgctgggcgacaagccggcgctgctgcttaatatggccgaagatagcgacaccggccgtctgttcgtgaccgacaactcgaaagcgaaaaccactctggtgctggatatccacagcggcaagctgcttaaacagctcgacgtcggcgattcgctggcggtgcagttcaataagaaacgccacgaaatttatatttcacagcgtgaatccggcaaggtcatcagccttgacgccagccgctacacgctgaagaaaagctgggcgctgccggccaatcccaacagcttgctgctttccgccgatggtcagacgctgtttgtcaccgtcaaacagcccttcaataaagaccactccactaaaggcccggacagcgtcgtacgtatcgacctgaacgcgcaataa

SEQ ID NO: 6209 - DNA, 261 bp, Klebsiella pneumoniae
gcgcgtcgaggcgctcgaaaacaacaacacccctcatcgatacaccatcgaagaactggaaggcatcagacgccattgcagcgcgttacgccgcgcactcgtcaagcaaagggaggccgcatgaatcaggacgcaattgagcgcatccgggagcgctggtacaagctccgcctgtgccggcaccgaggcaccgtactggttgactaccgcattttaaagaaatttgtccgcatctatcagaccctgggagagacagcatga

SEQ ID NO: 6210 - DNA, 801 bp, Klebsiella pneumoniae
atgggtcgaggtcgaacccttcagtcacctgtttggggggctgtaatgaccgttgagctgagcgatgaagagatgctgcgctataaccggcagatcgtcttgcgcggttttgattttgacggccaggagcggttaaaagccgctcgcgtgctggtggtcggcctcggcgggctcggctgcgccgccgcgcagtatctggccgccgccggggtcgggcagctcaccctgctcgatttcgacactgtctcgctctccaacctgcagcgccagacgctgcacagcgacgccaccctcggccagccgaaggtggattccgcccgcgaggcgctggcgcgcattaacccgcacgtccgtctggtcccgctcaatgccttgctggatgagaccgcgctggcggcgcagattgccgatcacgatctggtgctcgactgcaccgacaacgtcgccattcgcaaccagcttaacgtcggctgctttcagcacaaaaccccactggtctccggagcggcgatccgtatggaggggcaaatcagcgtctttacctatcaggatggcgaaccctgctaccgctgcctgagccgtctgttcggcgaaaatgccctcacctgcgtcgaagccggggtaatggccccgctggtgggcaccattggttcgctgcaggcgatggaggcgattaagctgctgagcggctacggcacccctgccagcggaaaaatcgtcatctacgatgccatgacctgccagtttcgcgaaatgaggctgatgcgtcacccgcagtgcgaggtatgcggctcgcactga

SEQ ID NO: 6211 - DNA, 1668 bp, Klebsiella pneumoniae
gcggggcgaggagatcgccagcgtgccgttgcagcaggtcgggccgggccacttcgtcgcccgcgaatccgccgatgtgctgggcagaacataacaacacataacgcatcttttcaggagaacacgatgacacaacctgtttcacgcaaatggtggctggcgctgagtatcgcggcggccctggcgagcgctcccgcctttgccgccaaagatgtggtggtggcggtcgggtctaacttcacgaccctcgacccctatgatgccaacgataccctgtcgcaggcagtggcgaagtccttttatcaaggcctgttcggccttgataaagagatgaagctgcaaaacgttcttgctgagagctataccgtgtcaccggacggcctggtgtacaccattaagctgcacagcggggtgaaattccaggatggcactgactttaacgccgaggcggtaaaggctaacctcgatcgcgcgagtaacccggataaccatctcaagcgctataacctgtataaaaatatcgccagtaccgaggcggtcgatccgaccacggtcaaaattaccctgaagcagcccttctcggcgtttattaacattctcgcccatccggcgacagcgatgatttcgccggcggcgctgaaaaaatatggtaaggatatcggcttccacccggtgggcaccgggccgtataagctcgacacctggaaccagacggattttgtgaaggtcagcaagttcgatgggtactggcagccggggctgccaaagctggattctatcacctggcgtccggtggtggataacaatacccgggcggcgatgctgcagaccggcgaggcgcagttcgccttcccgatcccttacgaacaggcgccgctgctggcgaaaaacagtaaactggagctggtggccagcccgtcgatcatgcagcgctacatcagcatgaacgtgacgcagaagccgttcgataatccgaaggtacgggaagccatcaactatgcgattaaccgtcaggcgctggtgaaggtagcgttcgccggctacgccaccccggcgaccggagtggtgccgccgtcgatcgcctatgcccagacctacaccgcctggccatacgatccggcgaaagcgcgccagctgctgaaagaggcgggctaccctaacggtttcagcaccacgctgtggtcatcacataatcacagcaccgcgcagaaagtactgcagttcacccagcagcagctggcgcaggtggggattaaggcgcaggtgacggcgatggacgctggtcagcgggcggcggaagtggaaggaaaagggcagaaagagagcggggtacggatgttctataccggctggtccgcctccaccggtgaagccgactgggcgctgtcgccgctgttcgcctcgcaaaactggccgccgacgctgtttaataccgcgttttacagcaacccgcaggtggataacgcgctgagcgaggcgctgaaaaccaccgatccgcaacagaaaaccaaactctataaagaggcgcaggatattatctggaaagagtcgccgtgggtgccgctggtggtcgagaaactggtctccgcccacagcaagaatctcaccggtttctatatccagccggataccggctttagcttcgaacaggcggacctgacgccgtga

SEQ ID NO: 6212 - DNA, 1986 bp, Klebsiella pneumoniae
acaaatggaggcggccttcgccgcctccgcttgaaaaatttccccgctgtccccatctcccactcaacggttttttacccatttaaaatggcattgttgaggttgaatcagatgaaaggacaagaaactcgtggttttcagtcagaagtaaaacagcttctgcacctgatgatccattccctctattccaacaaagaaatctttctgcgtgagctgatttccaacgcctctgatgcggccgataagctgcgtttccgcgcgctgtcgcagccggatttgtatgagggagacggcgagctgcgcgtgcgggtttcgtttgataaagacaaccgcaccctgaccatcgccgataacggtatcggtatgaaccgggaagaggttatcgaccatctcggcaccatcgccaaatccggcaccaaagcgttcctcgaatcgatgggttccgaccaggcgaaggatagccagctgatcggtcagttcggcgtcggcttctattcggccttcatcgtggcggacaaagtgaccgtgcgtacccgtgcggcgggcgacaagccggaaaacggcgtgttctgggagtccgccggcgaaggcgaatataccgtagctgatatcaccaaagccgatcgcggcaccgaaatcaccctgcatctgcgcgaaggcgaagatgatttcctcaacgactggcgcgtgcgctctatcatcagcaagtattccgaccatatcgcgctgccggttgagattgaaaaacgggaagagaaagacggcgaaaccgtgatttcgtgggaaaaaatcaacaaggcgcaggccctgtggacccgcagcaaatccgaagttaacgacgacgaatacaaagagttttataagcatatcgctcacgactacagcgacccgctgacctggagccataaccgcgtggaaggtaagcaggagtacaccagcctgctgtatatcccgtcgcaggcgccgtgggatatgtggaaccgcgatcataaacacggcctgaagctgtacgtccagcgtgtgttcatcatggacgacgccgagcagtttatgccgaactacctgcgcttcgtgcgcggcctgatcgattccaacgatctgccgctgaacgtctcccgtgaaatcctgcaggacagcagcgtgacccgcaacctgcgcaccgcgctgaccaaacgcgcgctgcagatgctggataagctggcgaaagacgacgctgaaaaataccaaaccttctggaaacagttcggcttggtgctgaaagagggcccggcggaagatccgagcaaccaggaagcgatcgccaaactgctgcgtttcgcgaccacccataccgactcctccgcgcagaccgtatcgctggaagagtatgtctcacgcatgaaagaaggtcaggagaagatctactacatcacagccgacagctatgcggcggcgaagagcagcccgcacctcgagctgctgcgtaagaaagggatcgaagtgctgctgctctccgatcgcatcgacgagtggatgatgagctacctgaccgagttcgacggcaaagcgttccagtctgtcgctaaagccgacgagtcgctggacaagctggcggatgaagtagacgagtccaccaaagaagccgaaaaagcgctggagccgttcgttgagcgggtgaaaaacctgcttggcgaccgggtgaaagaggtacgtctgacccatcgtctgaccgacaccccggcgattgtcaccaccgacgccgacgagatgagcactcagatggcgaagctgttcgcggcagcgggccaggcggcgccggaagtgaaatacatcttcgaactgaacccggcgcatcagctggtgaaacgcgcggccgatacccaggacgacgcgcagttcggcgaatgggtggaactgctgctggatcaggcgctgctggccgagcgcggcacgctggaagatccgaaccagtttatccgccgtatgaaccagctgctggcttcctga

SEQ ID NO: 6213 - DNA, 918 bp, Klebsiella pneumoniae
ccgggtggaggtgatgccggtgcgtcaggcgtggcagccgttcgctatcgaccgggattaagcgaaacccgacgcatcccctgtcggcgctgccggcagggaatgcaggccggactaacggctgctttgcagaaactgcctgacgcgttcggagtcaggctgagtgaagaacttctccggcggcgccttctctatcagcagtcccttctccagaaacaccacctcattggacacctggcgggcaaaatccatctcgtgggtcaccaccaccatggtgtagccctcggcggcaagggctttcattacccccaacacctcattaaccagctccggatccagcgccgacgtcggttcatcgaagagaataacttccggcgacatcgccagcgaacgggcgatcgccacccgctgcttctgcccgccggagagagtgatcgggtaaacatcggctttgtgcgccatgcccactttctccagctgctgcatggccatggccttcgcctcgtctcgtttcatgcccttaacgcgcagcagcgcctcgctgacgttctgctgcacggtcaggtgcggccacaggttaaaactctgaaagaccatccccacccgctcgcggattttggccagctggcggtgcgacatcgcccggccgcgctgttcatcaatccccagccgctgaccgccgatatgaatttcaccgcggtccggctgttccagccagttcatacagcgcaacagggtggattttcccgacccggacgagccgagaatactcaccacggtccccttctccaccgtcaggttaatatcccgcaggacttccacattatcgaactgtttggagacgtttttgacgcttacggcaatagactcaggcatggctcattcctcttttggctccccaggcggtcaggcgcttaa

SEQ ID NO: 6214 - DNA, 2115 bp, Klebsiella pneumoniae
gcgggtggaggcctttgtcaaacagcgcattcagagcgcgtttccggaggatggttttctcggcgaagagagcggcgctcgcctgcccgacgcgcgagtgctgtgggtggtcgaccccatcgatggcaccagctgtttcctcaacggcctgcacacctggtgcctgtcgctggcgatcgtcgccgacggcgaaccggtcatcggcgtggtctacgaccccaaccatcgcgagctgtttcacgccctgcggggccatggcgcctggctcaacgacgctccgatccgtccgcaccccgcgacgacggtcaaagagggcgtgatgggcgtcggcacctcgcatcgcgtcaccccggcggactttctgccgtttctgcaggcgctgctcagcgacggcggcatgtttatccgcaacggctccggggcgttgatgagcgcctgggcggcggcgggccggttgattggctactacgagccgcacatgaacccgtgggacgccctaccggggctggtgctgatgcgcgaagcgggcggcgccagcaacgattttctggcgcaggaggggatccagcgcggcaatccgctgctgctggccagccagacgctctacccgcagctgaaaaagatgatcccacaaccattacattaacccttacgggtcaggctatttctgattatgtactctacacagtaacgataacttcattcacggacgaaccacatcaatcagtcaggcctccgacctgcggagaaccacctatgtctggaattatcgcttttttccgggcgtcgccgccgaaagcgggcgccgcgtttgatgaacaccgttttcgccgggtgcgctggcaaacctttatcgccatgaccctggcctacgtcaccttttacgtctgccggttatccttcaccgtcgccaaaagcgcgctggtggagctggggatcaccccgacggagctcggcatgatcggctctaccctgttcttcagctacgccatcggcaaactggtcaatggttttatcgccgatcacgccaacgtggtgcgctatatgagcctcggtttattgctcagcgccgggatgaacctgatgatggggatgaccaccaacgccctgctgctggccatcttctgggggatcaacggctgggcgcagtcgatgggcgtcggcccctgcgcggtctcgctggcgcgctggtacggcgttaaggagcgcggcaccttctatggcatctggtcgacggcgcataatatcggcgaggcggtgacctatatggtgatcgccgcggtgatcgccgggtttggctggcagatgggctacctgtccaccgccgcgctcggcgccgccggcgtggtgctgctggtgctgttcatgcacgattcgccgcagagcagcggcttcccgtccatcaacgtcatccgcgatgaaccgcaggaggaggtcgaagcccgcggctcggtgtttaaaaaccagctgctggcgctgcgcaacccggcgctgtggaccctcgccctcgcctccgcctttatgtacatcgaccgctacgccgtcaactcatgggggatcttctttctggagcaggataaagcttattccacgctggaggcgtccgggattatcggcgtcaacgctatcgccggcatcgccgggaccatcatcgccggcatgctctccgaccgctttttcccgcgcaaccgcagcgtgatggccggattcatcagcctgctgaacaccgccggcttcgccctgatgctctggtcgccgcacaattactacactgatattctggcgatgattatcttcggggccaccattggcgctctgacctgcttccttggcgggctgatcgccgtcgatatctcttcgcgcaaggccgccggggccgcgctcggcaccatcggcatcgccagctacgccggcgccggcctgggcgagtttctcaccgggatcattattgataaaacggctatccttgaaaacggcaaaacgctgtatgatttcagcacgttggcgctgttctgggtgggtaccggtctgggttccgcgctactctgttttaccactgccgccatcgtcgcccggcgccatgccgtcgaacggcagacctcgttctcctcataa

SEQ ID NO: 6215 - DNA, 315 bp, Klebsiella pneumoniae
cgagcaggaggaagtatgaacaacgtgattaactggtttgaaattccggtcgccgatatggatcgcgccgtcgcgttttatgagccggtgatgcaagtgtcgctgcgtcgcgaaaccatggactgcgccgagctggcggtgttcccgcatcaggatccggcccccggcggcgcgctggccaaatttgaaggtatcgcgccctcggcgcagggcgctattatttatctgcatactgatcatcttgccgccacgctggagcgcgttgcctcggccgggtggggcctgtgtcttcggcccgctgacgctgccgaatga

SEQ ID NO: 6216 - DNA, 597 bp, Klebsiella pneumoniae
gagcaaggaggccacatgcttaaacgtgctcagcgccggtgcaaaatatgccggacaaaattcaccccagcattcgaaaaccatcgttggtgctgccctgagcatggcgctgaatttgccatgcaggaactggagaagaagcgcgaaaagcaggcccaggcgaaagagaagaaagagcgcgcagcctggcgcaagcgcaaaaccgcgttgaaacctctccggcactgggaagacatgacccagcgcgtcgttaacgactatatccgcgagcgtgaccacgatctgccgtgcatcagctgcggcacgttcgacacggttcaatgggaagctggccactaccgatcccgcggtaaagcatcgcacctgcgctacaacgaggacaacattcacaagcagtgtcatcactgcaacgtgcagatgtcaggtaaccagcagcagtaccgcattgctcttgtagagaaaatcggcgctgagcgcgtcgaggcgctcgaaaacaacaacacccctcatcgatacaccatcgaagaactggaaggcatcagacgccattgcagcgcgttacgccgcgcactcgtcaagcaaagggaggccgcatga

SEQ ID NO: 6217 - DNA, 846 bp, Klebsiella pneumoniae
ccaacgggaggctttctcatgagcgtggtactgaacgacaaaccgcgtcagtcgacgctgaagtggcgctggccgctctcccgccagctcaccctcagcgtggcgaccctggcggtgctgctggccgtctggtgggcggtcgcggcgctgcagctgattagtccgctgtttctgccgccgccgggccaggtgctgcagaagcttatcaccatcgccgggccgcagggctttatggatgcgacgctctggcagcacctggcggcgagcctgacgcggatcgttatcgccctgctggcggcagtgcttattggcgtaccggtggggatcgccatggggctcaactcgacggtgcgcgggatcctcgacccgctgatcgaactctatcgtccggtaccgccgctggcctacttaccgctgatggtgatctggtttggcatcggtgaaacctcgaagatcctgctgatctacctggcgattttcgcgccggtagccatgtcggcgctggcaggggtaaaaagcgcgcagcaggtgcggattcgcgccgcccgttcgctgggcgccagccgggcgcaggtgctgtggctggtgatcctgcccggcgcgctgccggagatcctcaccgggctgcgcattggtctcggggtgggctggtcaacgctggtggccgcagagctgatcgccgccacccgcggattaggatttatggtgcagtctgccggcgagtttctcgccaccgatgtggtgctggcggggatcgcggtgattgccattatcgcctttttactggaactgggtctgcgcgcgctgcagcggcgcctgacgccctggcatggagaagtacaatga

SEQ ID NO: 6218 - DNA, 630 bp, Klebsiella pneumoniae
gggggactgggtatggctgaagattattttcatattgcacctaaaatagtaccgaaatggagtttatttccggctttaaaagtaggagatacaatcaagacaggcgactttaatccattttttaactttttcctttcttcaaatttgcccacggagaacgtgaatgtcgatggagaggtgagcccatggtcctggatgcagtttctggctgggataagatatggaacaatgaataccagcatgggtgtacaagacattgcgaccagaggtcattaccttgccatgcatttttgtaagtatacccgggagttaatatgggagtctgttcgagccacacactatccagacaagccctctcgtcaaaagtgcatttgggtgtgctgcggtgccgataatctggagtactggaaaccccaccttagcaataaaaaagatgatttacttgtttaccgcgtagaactggatggggttacgcatgaggcgagcgatgaacacttaatgaaggatgatatgccttatgaagaagctctcctgatggcacaccgctactggaaaggtgaaatcgcaaatccgttggcaaaagagaccctttttgaagggaggatgaagattctggagttgatccattaa

SEQ ID NO: 6219 - DNA, 183 bp, Klebsiella pneumoniae
atttggctggggtacgaggattcgaacctcggaatgccggaattagaatccggtgccttaccgcttggcgataccccaacaaattgtttgcggatttatcgatgcgtatcgatacgtccagaatttggtggctacgacgggattcgaacctgtgaccccatcattatgagtgatgtgctctaa

SEQ ID NO: 6220 - DNA, 267 bp, Klebsiella pneumoniae
cggcgtatgggcaaacggcagccagcgcggcacgttgcaaaaagtcctgtaataacatcgctctgccgacaggccggggataatgcagacagaacctcccggcgcaggccgggagggagtgcaacggattacttctgcggacgcatggccgggaagaggatcacgtcgcggatggtatggctgttggtaaacagcatcaccatgcggtcgataccaatacccagacccgcggtcggcggcaggccgtactcgagggcggtcacgtag

SEQ ID NO: 6221 - DNA, 1566 bp, Klebsiella pneumoniae
agccagatgggccgcatcgctgtgtcagatggcggcagggtggtatggaatttgctgagcgtaacgggtggtcgcaatgcgttattgccagaggagccccgtatgatccgtcacctgttacacgttgattttcagcctggccgcggtttgcaggaacaggtgcgagagacgctggtgaatgccattctcagcgggatcttcgccgccgacaccccgctgccctcctgtcgccagctggccagccagcttcgcgtctcgcgtaacaccaccgcgctggtgtttgaaagtctggtcaacgagggctacctgattagccgcccacgcagcggttactacctgcatcccgactatcatgaagcttcgcctgccgccgtcgagagtgcaccgcagcgcgaagcggctgcaccacgctggggcgaccggctgcagatgacccccagccagcaggagtcgatcctcaaaccggcgggctggatgcactaccgctacccgtttatctacggccagcccgatacccggcaattcccgctggccacctggcgctcggcggcgaactggctgcacggcggggtgcgcgacccggcgtgggtcatcgaccatattgaccaggatgtgccgatgctgatcgagcagatccgcacccgggtgctgcccaagcgcggcattgtcgccgcgccggatgaaattctcatcacccttggctcgcaaaatgccctctacctgctgacccgactgctgctctcttccaccacccgcattggcgtcgaaaacccctgcttccgcgaagccatcaacacctttctgctcgccgacgccgaggtggtgccgcacccggtggatgaagaggggatcgtgcttaatgagcgtccctgcgattactactatgtcactccaggtcatcaggtgcccaccggggtgaccatgagcagtgcgcggcgtcgccagctgctggagcatgccgcccgccatgacgcggtcattattgaagatgattatgactcggagagtaactttaccctcaacccgctgccggcgctgaaggccagcgatcgcagcggccgggtggtgtatgtcagcagcctgtcaaaagcgctgtcaccggggctgcggttggggtttatggtcgccgacccggacctgattgacgaggcgcgcgccctgcgccggctggtctatcgccatccgccgaccaacattcagtaccagatggcccacttccttgcccagggccattatgaaacccatctgcggcgctaccactatgactccgcccagcgctgggaacgcctgcatgccgccctgcagcgctatctgccgtcgtgtcgcgcgctggcggggagcgagcatgctaacgccttctggctgcagaccccggcgcagatcaacacccagcagctcacctggcgcgccgcccacgccggcgtgctgattgagcccggggcgcgccattttcttaacgccgcgccgccggataactattttcgcatgggattccacgccattaaccctgacgccatcgcccagggggtggaggtcctgcgcggccagctggagcagatgggttag

SEQ ID NO: 6222 - DNA, 654 bp, Klebsiella pneumoniae
acgtgtgtgggtaatgaagtctctataatacccataattcagaccggacgcagcacacattgcaaggtgcatcgacccccgcggttatgctataacacccccctatatctcacccgacaccgggtgctggcaccacactcatcggaacaggatgcaaaaatggttactttccacaccaatcatggcgatatcgtaatcaaaacgtttgacgacaaagcgccggaaacagttaaaaacttcctggactactgccgcgaaggtttctacgacaacaccattttccaccgtgttatcaacggcttcatgattcagggcggcggttttgaacctggcatgaaacaaaaagcgaccaaatctccgattcagaacgaagcgaacaacggtctgaaaaacacccgcggcacgctggcgatggcccgtactcaggcgccgcactctgccaccgcgcagttctttatcaacgtggttgacaacgacttcctgaacttctccggcgaaagcctgcagggttggggctactgcgtcttcgcggaagtggttgaaggcatggacgtggttgacaaaatcaaagcggttgccaccggccgcagcggcatgcaccaggatgtgccgaaagatgatgtgatcatcaaaagcgtcaccgtcagcgagtaa

SEQ ID NO: 6223 - DNA, 2388 bp, Klebsiella pneumoniae
cgcgccgtgggaagcgcgtctttcatcagaacatgtcaaatcgggcttattcagccagcgacggagtgcctttgcccgcttttggcaacatttatgccgcctcccctcccggtgggaaggggcgtttggggaacgtggcgacaaaaagcaggaataacaatgaataacaggatcaaatccctggccttgctggtcaatctgggaatttacggggttgcttttccgttaagcgcagcggaaaccgccaccgacgataaaaacagcgccgctgaagagaccatggtggtcaccgccgccgagcagaacctgcaggcgccgggcgtctccaccatcaccgccgatgagatccgcaaacgccccccggcgcgcgacgtctcggagatcattcgcaccatgccgggggtcaacctgaccggcaactccaccagcggccagcgcggcaacaaccgccagattgatatccgcggcatgggcccggaaaataccctgatcctgatcgacggcaagccggtcaccagtcgcaactccgtgcgccttggctggcgcggcgagcgcgacacccgcggcgataccagctgggtgccgccggagatgatcgaacgtatcgaagtgattcgcggcccggccgccgcccgctacggcaacggcgccgccggcggcgtggtgaatatcatcaccaaaaaaaccggcgatgagtggcacggctcatggaacacctatatgaacgccccggagcacaaggatgaaggctccaccaaacgcactaacttcagcctcagcggcccactgggcggcgattttagcttccgcctgttcggtaacctcgacaaaacgcaggctgacgcctgggatatcaaccagggccatcagtccgagcgtaccgggatctatgccgatactctgccggccgggcgcgaaggggtgaaaaacaaaaacatcgatggtctggtgcgctgggaattcgctccgatgcagtcgctggagtttgaagccggctacagccgccagggcaacctctacgctggcgacacccagaacaccaacaccaacgacctggtaaaagagaactacggtaaagagaccaaccggctgtaccgcaacacctactcggtcacctggaacggcgcctgggacaacggggtgaccaccagcaactgggcgcagtacgagcgcacccgcaactcgcgcaaaggcgaaggcctggccgggggcaccgaggggatctttaacagtaatcagttctcggatatcgatctgtcagatgtgatgctgcacagtgaagtcagtatcccgttcgactacctggttaatcagaacctgacgctgggcagcgagtggaatcaacagcggatgaaggataacgcgtccaacacccaggcgctgtcgggaggcgaaattccgggttacgacagcaccggccgcagcccgtactcgcaggcggaaatcttctcgctgttcgccgagaacaacatggagctgaccgacaccaccatgctgactccggcgctgcgtttcgatcatcacagcattgtcggcaataactggagcccgtccctcaacctgtcgcagggcctgtgggacgacttcacgctgaagatgggcatcgcccgcgcctataaagcaccgagcctgtatcagaccaacccgaactacattctctacagtaaaggccagggctgctatgccagtaaagacggctgctatctgcagggtaacgacgacttaaaagccgagaccagcatcaacaaagagattggcctcgagtttaaacgcgacggctggctggcgggcgtcacctggttccgcaacgactaccgcaacaagattgaagcgggctatgccccggtctatcaaaacaataaaggtaccgatctctaccagtgggaaaacgtgccgaaagcggtggtggaaggtctggaggggacgttgaacgttccggtgagcgagaccgtcaactggaccaacaacatcacctatatgctgcagagtaagaacaaaaagaccggcgatcgtctgtcgattatcccggaatacacgctgaactctacgctgagctggcaggtacgcgatgacgtttcgctgcagtcaacctttacctggtacggtaagcaggagccgaagaagtacaactacaagggtcaaccggttaccggtagcgagaagaacgaggtcagcccctacagcatcctcggcctgagcgcgacctgggacgtcaccaaatacgtcagtctgaccggcggcgtggataacctcttcgacaagcgccactggcgcgcgggcaacgcccagaccaccgggggcgccaccggctatatgtatggcgccggcgccgagacctataacgaatcgggccgcacctggtacctgagcgtcaacacccacttctga

SEQ ID NO: 6224 - DNA, 1908 bp, Klebsiella pneumoniae
gcctcatcggggtctcatagggggaataagatgaatattttaggtttctttcagcgactgggtagggcgttgcagctccctatcgcagtgctgccggtcgcggcattgctgctgcgtttcgggcaaccagacctgttgaatgtacccttcatcgcgcaagcgggtggggcgatcttcgataatctggcgctgatcttcgcaattggtgtggcatcaagctggtccaaggataacgccggttctgcggcgctggccggtgcggtagggtatttcgtgatgaccaaagcgatggtcaccatcaacccggaaatcaatatgggcgtgctggccggtatcattaccggtctggtggcaggggcggtatacaaccgctgggccggcatcaagctgccggacttcctgagcttcttcggcggcaaacgcttcgtgccgatcgccaccggcttcttctgtctgatcctcgcggcgatcttcggctacgtctggccgccggtgcagcacgctatccactctggcggcgaatggatcgtctccgcaggcgcgctgggttccggtatctttggtttcatcaaccgtctgctgatcccaaccggtctgcatcaggtgctgaacaccatcgcctggttccagattggtgagttcactaacgccgctggcgctgtgttccacggcgacatcaaccgcttctacgccggcgacggcaccgcggggatgttcatgtccggcttcttcccaatcatgatgtttggtctgccgggtgcggcgctggcgatgtatctggcggcgccgaaagcgcgtcgtccgatggtaggcggtatgctgctgtccgtggccatcaccgcgttcctgaccggggtaaccgagccgctggaattcctgttcatgttcctggctccgctgctgtacctcctgcatgcggtgctgaccggtatcagcctgttcatcgcaacggcgctcgggatccatgcgggcttctccttctccgcaggtgcaattgactacgtgctgatgtacagcctgccggccgccagcaaaaacgtctggatgctgctggtgatgggcgtggtgttcttcttcgtctacttcctgctgttcagcgcggtgatccgcatgttcaacctgaaaacgccgggtcgtgaagacaaagccgctgacgtggtaacggaagaagccaacagcaacactgaagaggggctgacccagctggcgaccagctatatcgccgcggtgggcggaacggacaacctgaaagccattgacgcctgtatcacccgtctgcgtctgaccgtgggcgattcggcgaaggtgaacgacgccgcctgtaaacgtctcggcgcgtccggggtggtgaaactgaataagcaaaccattcaggttatcgtcggtgcgaaagcagagtctatcggcgatgagatgaaaaaagtggttacccgcggcccggtagcggcagcggcagccgcaccggctggcaacgtcgccaccgcagcgcccgcggctaaaccgcaggcggtagcgaacgcgaagaccgttgagtcgctggtttcgccgattaccggtgacgtggtggcccttgagcaggtgccggacgaagccttcgccagcaaagccgtcggcgacgggatcgcggtgaaaccgaccagcaacatcgtggtggccccggccgccggtaccgtggtgaaaattttcaacactaaccacgcgttctgcctcgaaaccaacaacggtgcggaaatcgtcgttcacatgggtatcgacaccgtggcgctggaaggcaagggcttcaaacgtctggttgaagagggcacggacgtgaaggcgggtgagccgattctggaaatggatctggactttctcaaacgccaacgcgcgctcaatgatcagtccggtcgtctgcagcaacagcgatga

SEQ ID NO: 6225 - DNA, 831 bp, Klebsiella pneumoniae
ggaagaacgggatattctgaaaaaggcagcgcggtactttgcaagggagcccgactgaagtaccgctttatcaacgatcaccgtgaaatctggtcgatcgttacaatgtgtcgggttctcaaggttgcccgtgccggattttatgtctggctccataaccctgtatctgccggagaaaaggataaccagcgactgctggcgctcatccgcgactcctatacgctgagtggtggggtttatggttatcgccgaattcacggcgatcttcgtgaaattggtgaagtgtgcagcagaaaccgggtcgccaaaatcatgaggaaaaacaggatacaggccatacatggttataaagtgccacgcgggacccggggacgaccgtcactgatagcgcctaaccgcgtacagcgtgaatttactgtagtaaagcccaatcaggtctgggtaacagatattacctatatccgcacctggcagggctggctgtatctggcagtggtcatcgatctcttcgcccgtaatgtggtgggctggtcgatgaaaccaacactgtcgcgcgagctagcactggatgcgttgctgatggcggtctggcggggtaagccctcagaaaacgtcattgtgcacagcgatcagggtagtcagtatggcagtgatgactggcagcggttctgccgggccaacaatctggcgccaagcatgagccgtcgcggaaactgctgggataatgcagtggcagaatcgttcttcagttcactcaaaaaagagcgcatcaggaagcggatatataaaacccgggacatggcccgggcgggatattttcgattacattga

SEQ ID NO: 6226 - DNA, 309 bp, Klebsiella pneumoniae
cgaccggcgggcatcagcgatcaggtcgtgcgctttcttccgggcttgctcaagacccaggagggcgggataggtgcttttacccaattgctggtcggcaccctgacgtttgccaagggtcgcagtatcccctaccacgtcgagaatgtcatcctggacctggaaggcaagaccgatattttccgcatagcgatccagcgcgggcagggcagcgcggccgcgttcgccggcgctcagggctcccatccggacggcggcgcggatcagggcgcccgttttatggcgatggatacgctccagcgcctgtaa

SEQ ID NO: 6227 - DNA, 183 bp, Klebsiella pneumoniae
agctgccaggggagaaaggtcatcagataccagaacgggatcgccgccagcgagcccatcgtccccggcaccaccgggcttaagccgctgccaaagccggtcgccagcagatgccacggattacgcatactcaggcggctaagcgcctcgtctcgactacgcaaagtgatcgtatccctttaa

SEQ ID NO: 6228 - DNA, 246 bp, Klebsiella pneumoniae
ggcggcgaggggcgcctatacttaatagttctgctaccagaagaaggaagaactatgccaaacaggcccccctatccgagagaagcgcgcgtggttgcggtagagaaaggtcctcagggtcagacggtgacctggtatcagctccgtgcggattatcctgagcctgattcgcttatcagcgaacatcctaccgagcaggaagccgtggatgccaaacggcgttatgaagatcctgacaagtcgtaa

SEQ ID NO: 6229 - DNA, 1725 bp, Klebsiella pneumoniae
tcaacggagggaaaaagggcgcatcaaaacctgaatctctgcgacctcatgtcgaaagccgtgctgatggtatttattgggttgaacccaaatcagacaaagatgccggagagatcatctgccgtgagagttggctatgttctgctcttaaggttatcggcatcggccattgatgacagtaaaacccggtatttgatcctgcgttggcaggcatttggtgcgaagagtgaaaccgtacaggcgataccctttgctgacattggtgagcgtgaaggctggcgaacgctcaaagccggtggcgtgaatgtaacaactaagagcggtttacgcgcaacgctagccgactggcttcagagctgtgccaatggtgaggtatggcgcattgctcatgctacgggctggcagtgtggcgcctatatcatgcccgatggtgagatcatcggtacgccagaacaaccggtgctttttaatggacggagttctgcagcatccggttacaccaccagcggcaccgttgatagctggcgggagagtgtaggacgtcttgcctttgggaattactcgatgatgactggtgtagccgcagcattggccgccccgctgattggccttgctggtgctgatggattcggtatccacctctacgaacagtcgagcgcgggtaagactaccactgctaatgtggcctccagtctttacggcaatccagatgtactgcgtctcacctggtacggtactgcgctggggctggcgaatgaagccgccgcacataacgacgcgctgatgccgctagacgaaattggccagggcgctgacccggtggaagtctataaatcagcctatgcgctatttaacggtaccggtaagctgcagggggcgaaggagggagggaaccgcgatctcaagcgctggcgtactgtggcaatcagcactggtgagatggatcttgaaacattcatcgccagcgccggccgtaaggctaaagcgggccagttggttcgcctgctgaatatccctatgcggcgggcagtacgcttccatgagcatgctaatggtaagcaccatgctgatgctctcaaagatgcataccagcatcaccatggagtggcagggcgtgagtgggtgaagtggctggcggaccaccagcaagaagcggtaagcgctgtcagggtaacggaagagcgctggcgtagcctgatcccttcggattatggggagcaggtccatcgtgttggcgctcggtttgccattctggaagccgcactattgttaggtaatgtgatcaccggctgggatgagcagacctgtcgggatgctatccagtacagttataacgcctggctgagagagtttggtaccgggaacaaagagcaccagcagattatcgagcagaccgaggcattcctgaacgcctacggtatgagccgctttgcaccgttcccatatgacccatccagtctgccgatctccaatatggcgggataccggcagaaaggtggccacgatgccgacccaatggtgttctacaccttcccggcggccttcgaaggggagattgcccgcggctttaatgctcgtcagtttgccgaagtactgaagaaagctggcatgctaacgcctccgacgtcaggccgggggttccagagaaagtcaccacgcattgatgggcgacagattcgggtttatgtcctgcagtatttgccggacgatgaccaaccagagtaa

SEQ ID NO: 6230 - DNA, 1326 bp, Klebsiella pneumoniae
gcttgctgggggactaacaggatgagcactacaccgttaacgctttcttttgccggacaacaaccgcccatcgccctgccgcaggtgccgggaacgcgggggccggtgggagtcgatatgcgcgggctaaatcagtccggattctgcagctatgaccccggcttcgccaataccgccggatgccagtcggcgatctcgtggatcgatacggaaaacagcgtgctattgcaccgcggctatccggtggatcagctggctcgccagtgcgattttctcgaagtggcctacatcatgctgaacggtgacgcgccggatgaggccagctatcaaacctttcgcgagaccatcacccgccatactctggtccatgagcagatagcccgcatgtgcagcggctttcgtcgcgactcgcacccgatggcgctgatgtgcgccctggtgggggcgctggcggcgttttatcatgacgtcctggacgtggaaaatccgcagcaccgggcgctggccgccacccggctgctgtcgaaaatgcccactatcgccgccatgagctacaagtacaccattgagcaacccgcagcgtatccgcgcaacgatctctcctatgccggtaatttcctgcagatgctgtttgctatcccggcggaaaaatacgttctcaatccggttatcgagcaggcgatgaaccagatcctggtgctgcatgccgatcacgggcagtgcgcctcgaccagtacggtgcgcgcggcgggctcctccggggcgaatttattcgcctgcgtcgccgccgggctggcgtcgctgtgggggccgatgcatggaggagcaaatgaatcgagcatgcgaatgctggaggagattgaaagcgtcgatcaggttccggcgtttctgcgccaggcgaagcgcgatccgcaggcatttcgccggctgggttttggcaactcgcgctaccgtcaccgtgacccgcgcgccgatatcctgcgtgaaaccagccatcgggtgctggcggaggtaggcatgtccgaccgcctgctgcaggtggcgatggcccttgaggacgtggcgctgaccgacccctattttgtggacaatggcctgtcgccaagcgtggatttctataccgcggtgatccttaaagcgatgaatctgccttcgtcgatgtttgcggtggtcaccgcggtcggtcggacggtcggttgggtggcgcactggaacgagatgcaccaggcgccgctgaccatctaccggccacggcagatttacgttggcgagggctatcgggattacgtctcccgacgcggcgagcggtcaacgggcccgcagtga

SEQ ID NO: 6231 - DNA, 579 bp, Klebsiella pneumoniae
acgtgccggggcgaagatcagtatcgcaccaagggcgtgacctactgccttcactgcgatggtccgctgtttaagggcaaacgcgtagcggtaatcggcggcgggaactccggcgtggaagccgccattgacctggcgggcgtcgtagagcacgtaaccctgctggagtttgccccagagatgaaagccgaccaggtgttgcaggataaagtccgcagcctgaagaatgtcgacatcattcttaatgcgcagaccacggaagtgaaaggcgatggcagcaaagtcaccggtctgcagtatcgtgaccgggtgagcggcgatgagcatcatgtcgcgctggcggggatcttcgtccagattggcctgctgcctaacaccacctggctggaaggcgccgttgagcgcaaccgcatgggtgagatcatcatcgatgcgaagtgcgaaaccaacgtcaaaggcgtgttcgccgcgggcgattgcaccaccgtgccgtacaaacagattattatcgcggcaggggaaggggcaaaagcgtcgctgagcgctttcgactacctgatccgcacgaaaaccgcataa

SEQ ID NO: 6232 - DNA, 864 bp, Klebsiella pneumoniae
tgtaccaggggagacaggtcgacgagatgccggcgcgggcgctgccgagcgcgacgcacccttacacccgcaccctgtggacctgccggccaaatgcgcatacctacggccagatgctgccgaccctcgacagaacccaggactttacggagacagcccatggcgatcgttaatcttcaggatttacaggttacattcggcgcgaagacggcggtctccgccgccagtttccgtgtcgacgccggggaaaccttcagcctgatcggcgcctcgggctgcggcaaatcgacgattttgcgcgtgctggccggattgcagcgtgaatggcgcggcagcgtggatctgctcggccaggccattatgccgggcgcccgctttcagggcgatctgcggcgcaacgtgcagatggtgtttcaggatccgtacgcctcgctgcatcccaaccataccctgtggcgcaccctggcggagccgctgcagatccacggcatccgcgacgttgccccgcgagtaaccaccgcccttgagcaggtgggtctggccgccgacgccgtgcgccgctatccgcatcagctctccggcggccaacggcagcgcgtggccattgcccgcgccctgctgctgcgcccgcagatcctgctgctggatgagccgacctcggcgctggatatgtcggtgcaggcggaaatccttaatctacttaatcgtctgaaacaggagcacggcatgacctatctgctggtcagccatgatgccgacgtcatcgcccatatgtccgatcgggcggcgtttatggcggagggcgtgatccagcgctttttcgatcgcgaagcgttggtcaacggagagcaccggatgaggtga

SEQ ID NO: 6233 - DNA, 1302 bp, Klebsiella pneumoniae
aaaacagggggcattttccgctgcatcctgcattgcgctggcgaaatggtgataggagctggactcgttgacgaagcgtaccgcccgctgattgacggcaatcacgcccggttttgcgcgatcggttaccagatgggggaagcgctcctcgctgccgtcggcccgggtcagcaccgataccggcgcccagaaaaagttggaggcccgatcggctccctcgcgagcgttaagcgccgccgcgagacgcagcgcggcgccatcgttggccggcggcgacatggtgaagtgttcgcgggtatgtggccgatagcgcgccgccagcgcgcccgcggcgaagccgcctgcggccagcaccaccccgcgtcgggcgtgcagcgtctctctttgcccctgatactcaatctccaccccgcggaccgcgccttgcgcttcgcacagcgtcagaacattgacattcagccgcaggttcatgcctttacgcagcgccgtagtcgccatgcgggcaatcagcgcattgcccatcgccaggcgggtaccgcgagggtacttcacccggtcgcgggcatagcgcagcagcagccgggtgcaatgggccagggagcgcagcgagcggcgcatgtcgagaaaatgttgaatatcgacgcggttgaccatcatcccgccaaacagcagcatccccggcggcggcgaacgcaggtcgcgaaacgcgtcccccagttcacggccgtcatactccaccacctccagcgcacgaccgacgtcgactgcgccggattcatccggatagtaatcgggcgagagcggacgcaggctgtactttactgccccctcacgctcgagaaaggccagcgcctcccgcccggcgctgacaaacgcttcggcaagatcttctcggtactggccctcgccgataatggttcgcaggtaggttttcatcgcctcggcgctaccgcttttgccctcggcgcgcgcctggtcggtatcgtgcagccacacggcgccgccggagatggccgaggtgccgccgaactggccggctttctccagcatcagcaccgacagccctttacagcaggcggtgaccgcggcggcaaaaccggccgcgccgctgccgatgacgatcacatcccagctcttcatgccgccgctccctgcgcctgcgggatggcgccgataaactggcccatcagcctcatctgcgccagcgccatttccggcccggtctgtactttgcaaccacgtgcggcggcgaaagtgagcaacggcgtcatcaccggggcggtgacaacgtcggccacatga

SEQ ID NO: 6234 - DNA, 1392 bp, Klebsiella pneumoniae
gcgcaagggggtcaaagcatgagccgttttattgatttatacgttgagcaggccgtcattggcggaataatgcttgcagcaggtcgctcagatggcgccgacatggctaccgatgcgattgaggggctgactgaggaccacttcacagcaacgccccataaagtggctctgcggtcatataagcgactcaacgaatccggttcgaagatagacctgcttacgctgaccagcgatcttgaacggcttggcgcgctggaaagtgcggggggattcgcttacctggctgaatgcagcaaaaacacgccatcgttcgctaacctggccgcctactgcgaaaagctacgggaaatgcaccttggacgtcgtatgaccctagccctgcaggtagggatccagaaactgtccgaaccatccagtgagggtatcgctgacatcatcggcaacatacaggccgatatctccggtattgagcacagtgcggactatggcactgagcacatcaccaccgggatcgacatgtcgttagaggccatccagtcgattattaacggcgatatctggaagcacaaaaccgagcttggcatggcaaccatcgacagcgcttttggcgggtttaacaacacagatttcatcgttgttggcggacgtcctggcatggggaaaaccatgtttagcaccacagtgacagaaaccgtaggcctgaaaaacaaaaagccggtgttgttcttcagtctcgaaatgccagtggaacaaatctcggagcgagtcgctttccaccgggcgcgggtaagcaaagaagatctgctgagcaaggttagcgggaaaatggacgaggcatgggggaaggttagtcactgcatgaaggagttcatcgactctccaatctacatcaatgacaagccatccctaagcgttcaccaggtgcgtgcggaagcgcggcgtatgagcaagaagttgggcggactgggcgtggtaatcgtcgattatcttcagaaaatgcggatgtcagacccggagaacatgaaccgcagcgcaggggagatcgccactggtctgaagaacctggcgaaagaattgcgttgcccggtcatcgctctggcccagttgaaccgaaacctggagcagcgcgctaataagcgtcccgttgcggcagacctgcgagagtctggcgttattgagcaggaggcagatgtgatcttcatggtgtatcgggatgagaagtacaacgaaaacaccgaactgaaaggcatcaccgaaatcatctgtgtgaagtcccgccatgcgccgggggcagaaaagacctaccacttcagcagccgctactcaggcctagacccggtagatttcacctacagcggccaggtgcaacaggaggctgactatgagtgctaa

SEQ ID NO: 6235 - DNA, 1356 bp, Klebsiella pneumoniae
cgtggttttatacatgccgcctcctcaggagaccgtgcgcagttgaggatccactggcgcccgttcacgggccgctgcggttttgcggaaccacaggtagccgccgagcatcatcgccgcgaaaatcagcgccaacagcaggttataccagaccatcgccaccaggcagagcaccgccatgccgagggcaaaggccggcgccagcgggtagagcggggcgcggaacggacggatcagcttcggctcgctacggcgcagtttgaacagcgccgccatggaagtgatatacataacaatagccccaaataccgacatggtgacgatgcaggcggtcagcggcatgccgctgatggtgatcagcgagtcggagaagatcgcggcgatccccaccacgcccccggcgaggatcgccagatgcggggtgcgcgtgcggcggttgagggaggccagcccggcgggcagatagccggcgcgggcgagggagtagatctgccgcgagtagcccataatgatgccgtggaaggaggcgacgaggccaaacagccccagccacaccagcatatgcagccagccgctgccgttgcccacgaccgtcttcatcgcctggggcagcggatcgttaatattggacagcgcgcgccagtcgccgacgccgccggcgaagaccatcacgccgatcgccagcaccgtcagcgtcagaatgccgccgcccagggcgcggggaatggtgcgctgcggatctttggcctcttcggccgccatggaggccccctcaatggcgaggaagaaccagatggcgaacggaatggcggcgaacatccccggcagcgccaggccgctgaagctgtccgcgcccgcccagccgttagtggtgaagtggctccaggagaagccgggggcgaccacgcccatgaacaccagcaactcgaagatggccagcagggtgacgatcagctcgaaggtggcggcgatgccgacgccgagaatattgagcgtcataaagatcacgtaggcgccgcaggcgacccatttcggatccagcgccggaaactgcacgttgaggtaggccccgatggccatggcgatggccggcggggcgaagacgaattcaatcagggtggcaaaaccagcgataaagccgccggtgggcccgaaggcgcggtaggcataggcgaaagggccgccagcgtgcgggatggcggtggtcagctcggtaaagctgaaaataaaggcgcagtacatggcggcgaccgccagggcgacgaccataaaccccatcgtgcccgcctgcgaccagccgtagctccagccgaagtactccccggatatcaccagtccgacggcgatcccccataa

SEQ ID NO: 6236 - DNA, 1215 bp, Klebsiella pneumoniae
ggaagatttatgcgcctccttcacacctccgactggcacctgggccagaatttttacagcaaaagccgcgcggccgaacacgacgcttttcttacctggctactggaccgcgcgcaggagcatgaagtcgacgccattatcgtggctggcgatatttttgataccggctcgccgccgagctacgcccgcgaactgtataaccgtttcgtcgtccagttgcagcagaccggctgtcgcctggtggtgctggcgggcaaccacgactcggtggcgatgctcaatgaatcccgcgatatcctcgcctttttacacaccaccgtggtggcgaacgccggctacgcgccgattgagctgccgctgcgcgacggcacgccgggcgccatcttctgtccggtgccgtttttacgcccgcgcgagctggtgaccagccaggccggtcactccggtcgggaaaaacagcagcagctgctgcacgccatcagcgactattatcaggagcagtatcagcaggcctgcgcgctgcgcggcgatcggccgctgcccatcattgccagcggccatctgaccaccgtcggcgccagcaaaagcgatgccgtccgcgacatttacatcggcacactggatgcctttccggcgcaacacttcccccctgccgactacattgcgctgggccatattcaccgggcgcagatggtcggcggctgcgagcatatccgctacagcggctcgccgctgccgctgagcttcgatgaaaccggcaaagcgaaatcggtgcatctggtgagctttagcgaggggcgacttagcgccgtggaaaccctggaggtgcccgtgacccagcctctggcggtaatcaaaggcgatctggccgccatcaccgcccagctggagcagtggcgcggcgtcgagcaggacccgccggtgtggctggatatcgaaatcaccaccgaggactatctgcacgatattcaacggcatattcaggcgctaacggaggatctgccggtggaagtgctgctggtgcgccgcagccgcgagcagcgcgagaaaatactgctcaacgcccagcgggagacgctcagtgaactgaaggtggaggaggtattcgagcgccggctggcgctgaccgaaattgacgagatgaagcgcgcccggctgcatgagctgttcgcccatacggtgcatacgctcaccgcggaggacgaaaacgcatga

SEQ ID NO: 6237 - DNA, 642 bp, Klebsiella pneumoniae
gagggatttatgagccttgcagatcgcgtaaagcaaaagagaattgagctcggtctaacgcagaccgaggcagcgttgaatgccggaataacgcagcagtcatggcagagcattgaaaagggagacaccagaaaaccgcgtaacattattggcatagctaaggcgctaaagtgcgatcctgactggctaatgaatggcggagcctttatgcctattgctgaagttagcagcaagaaggtgcctctcataagctatgtccaggcaggggctctcgcagaaaaaaatcccattgaggcatttgatgggagttttgagtacatccttacagacaacgaagtttctgattttacttttgctttacgcatcgaaggcgattcgatggagccagacttcaaggctggagatgtgatcattgtagaccccgaagttgagccaacccccggagagtttgttgtggccaaaaacggtggggctcaagcgacctttaaaaaatatcggcctacttacacggatcacctgggctgccagcatttcgagcttgtgccattgaatgatgattacccgattatcagtagcgagcatcaaccactaacaatcatcggcgtgatgattgaacacagaatctatcgaagaaagcgctaa

SEQ ID NO: 6238 - DNA, 2187 bp, Klebsiella pneumoniae
tggctgtttatacagtattcaggttttctcatggctttgaccgctgcgctgaaagcgcaaatcgccgcctggtataaggcgcttcaggaacagatcccggactttattccgcgtcccccgcagcggcagatgatcgccgatgtggcgaaaacccttgccggggaagagggcaggcatctggctatcgaagcgccgaccggcgtcggcaaaacgctgtcatatctgatcccgggcatcgccatcgcccgcgaggaacaaaaaacgctggtggtcagcaccgccaacgtcgccctgcaggatcaaatctacagtaaggacctgccgctgctgcgtaaaatcattcccgacctgcgctttaccgccgcctttggccgcggacgctacgtctgtccgcgcaacctgacggcgctggccagcaccgagccgtcgcagcaggatctgctggcctttctcgatgacgatctcaccccgaataatcaggcggagcagaagctgtgcgcgaccctgaagcaggatctcgacagctaccgctgggacggcctgcgcgaccataccgacaaagccatcgacgatgggctatggagccggctgagcaccgataaggccagctgcctgaaccgcaactgccactactatcgtgagtgcccgttctttgtggcgcggcgggaaattcaggaggcggaagtggtggtggccaaccatgcgctggtgatggcggcgatggagagcgaagcggtgctgccggagccgaaaaacctgctgctggtcctcgatgaaggccatcatctgccggacgtcgcccgcgacgcgctggagatgagcgccgagatcaccgccccctggtttcgcctgcagctggatctgttctgcaagctggtggccacctgcatggagcagtttcgtccgaaaaccacgccgccgctggccaatccggagcggctcaccgctcattgcgaagagcttttcgagctgattgcctcgttgaataatattctcaatctctatatgcccgccggtcaggaagcggggcatcgcttcccgatgggcgaactgccgcaggaggtgatggagatctgccagcggctggcgaagctcaccgagttgctgcgcggcctggcggagctgttcctgaacgatctcagcgaaaagaccggcagccatgacgtggtgcgcctgcatcgggtgctgctgcagatgaaccgcgcccttggcatgtttgaaagccaaagcaagctgtggcgcctggcgtcgctggcgcagtcctcaggcgcgccggtaaccaaatgggcgacgcgggtggtgcgcgacggccagatccacgtctggttccactgcgtcgggatccgcgtcagcgatcagcttgaacggctgctgtggcgcagcgtgccgcatatcgtggtgacgtcagcgacgctgcgctcgctaaacagcttctcgcgcctgcaggagatgagcggtctgaaggagaaagcgggggaccgcttcgtggcgctggattcgccgttcaaccacgtggagcaggggaaaattattattcctcaaatgcgttatgaaccgctgatggataacgaagagcagcacattgccgagatggcggcctattttcgccagcaggtggagagcaaaaaacatctcgggatgctggtgctgtttgccagcgggcgggcgatgaaccgcttcctcgagcatgtgaccgatctgcgcctgatgctgttggtgcagggcgaccagccgcgctaccggctggtggagctgcatcgcaaacgggtggaaagcggcgagcgcagcgtgctggtgggtctgcagtcctttgccgaaggtctcgatttaaaaggcgatctgctaagccaggtgcatatccataaaatcgcttttccgcccatcgacagcccggtagtgatcaccgaaggcgaatggctgaaaagcctcaatcgttatcccttcgaggtacagagtttgcccagcgcctcctttaatcttattcagcaggtggggcgtttgatccgtagccataactgctggggagaggtggtgatttacgataagcgtctgttgaccaaaaactacggcgcgcgtctactgaacgcgttacctgtttttcccatagagcagccgggcgttccggaggttatagtaaaacggaaagcaaaacagacagcaaaacagacgggccgcaaacgtcgctga

SEQ ID NO: 6239 - DNA, 252 bp, Klebsiella pneumoniae
ctgcttattattcatgcagatgttaagtgttttagggttaataaaggtaactatgaaatgaatatcactgacgaagagttgcttcagcaagtacaaacactggctgataaattaccgcctgaagaacaacagctcattttagagttacttcagcgttacagtactgtctacagcgttgctcaatcatacattccggattatccatgcggtgttttggatgctttatgttttatccaaagaaacaaaccataa

SEQ ID NO: 6240 - DNA, 1755 bp, Klebsiella pneumoniae
atagatattattaattgttccgggtttacagcggcccggtggacgacggcccccatgcgactcttacaccgtttaaatcagtaccagcgattgtggcaaccctcagccggggcgccgcagcaggtcaccgtcggcgaactggcggagcgctgtttttgcagcgagcgccacgtccgtactctgctgcgtcaggcgcaggaggccgggtggctaagctggcaggccagctccgggcgcggcaaacgcggacagctctcatttcacaaaaccccggaaagtctgcgcaacgagatgatggagcaggcgctgaacaacggtcagcagcaaaacgcgctggagctggcgcagcttgccccggtggagctgaaagccctgctccatcccttcctcggcggtcagtggcaaaacaatacccccacgctgcgtattccttactatcgcccgctggagccgctgcgtcccggctttctccccggccgcgccgagcagcatctggccggacaaatctatgccgggctgacgcgcttcgacgaaggcgacaatatgccgatcggcgatctggcgcaccactggcaggtctccccggacggcctgcgctggcatttttatatccgctccacgctgtgctggcacaatggcgatacggtggaaaccgcgcagttgcgacagcggttactgctgctgcttgagctgcccgccttgcggaccctcttcgccagtatcagccgtatcgatgtcacccatgcccagtgtttaacaataaccctgcatcgccctgactactggctgccgttccgcctcgccagctactgcagcgtgttggcgcatcccgacgatccggccattggctgcggaccgttccgcctgaagcggtttagtccggaactcgtccgcctggaaaaccatccccgctaccacctgcagcatccgctgatccaggcggtggagtactggatcactcctcagctctttgaccgcgatctcggcaccagctgccgccatccggtgcagatcaccatcggcgatcgcgaagagctgcataatctgcgtcaggtcagcaaccgtatcagccttggcttctgctatttgaccctgcgccacagccctcggcttagcaaagcgcaggcccagcggctggtgtcgataatccatcactcgtcgctactggatacgctgccgctggaggaggatctgattacgccaagccatgaggtgctgccgggatggtccatcccgcagggaccggcaaacaacgcggtaccgctgccggccaggctcaccctgctctatcatctgccggtcgagctacatgcgatggccgaacagctgaggcaacgtctggctctgctgggctgcgagctgacgctcttgtttcacgacgctaaaaactgggaaggctgccagcatctggggcaggccgacctgatgatgggcgaccgtctgatcggcgaagcgccggagtacgccctggaacagtggctgcgctgcgatatgctgtggcctaatttgctgaccggggcgcaatatgctcatctgcaggcgacattagacgcggtgcagtctcagcccgacgctcgcagccgcaacgatgcgctgcgcaacgtatttaacagcctgatggaagacgccatcatgacgccgctgttcaagtataactatcggatcagcgcgccaccgggggtcaatggtctgcgcctcaacgcccggggctggttcgacttcgccagcgcctggctgccggcctcgtcgacgtga

SEQ ID NO: 6241 - DNA, 663 bp, Klebsiella pneumoniae
ggaagagttatggatatcgtatcggtcgctttgaagcgctattccaccaaggcctttgacgccacgaaaaagctgactgccggggaagcggaacagctgaaaacgctgctgcagtacagcccgtctagcaccaactcccagccgtggcactttattgtcgccagcaccgatgaagggaaagctcgcgtggcgaaagccgccagcggcacctacgtgttcaacgaacgtaaaattctcgacgcctcgcacgtggtggtgttctgcgcgaaaaccgcgatggacgacgcctggctgcagcgcgtggtggatcaggaagaggccgatggccgtttcgccaccccggacgcaaaagccgctaaccacaagggtcgtactttctttgccgatatgcaccgcaaagagctgaaagatgacgatcagtggatggcgaaacaggtgtatctcaacgtcggcaatttcctgctgggcgtagcggcgatgggtctcgacgccgtgccgattgaaggggtcgattttgcgatcctcgatgaggaatttgacctgaaagcccagggctacaccagcctggtggtggtcccggtcggccaccatagcgtagaagatttcaacgctaccctgccgaagtcgcgtctgccgcagtcgacgaccattaccgagatttaa

SEQ ID NO: 6242 - DNA, 897 bp, Klebsiella pneumoniae
ataagaattttttcttctttgccgccgacgggcaatttgtgggagcgtgatgtccacaaaacaaaacagggattcaggggaaaaactatgcgcaataaaaccacaaaaatcgcactggcgctgggtatgctgctgctcgcctcgcaggcacaggcggaccagctggctgacatcaaagccgccggcgtcgtaaaagtcgccaccttcgacgccaacccgccgttcggctccgtggacgccaaaacccaccatatcgtcggctacgacgttgactttgcccaggcgctggcgaaagcgctcggcgtcaaactcgagctggtggccaccaacccagccaaccgtattccgctgctgcagtccggcaaagccgacctgatcgtcgccgacattaccatcaccccggagcgggcccaggttattgatttctcaacgccgtatttcgtcaccggccagcagttcctcgtgccggccggctctccggataagctcgatgagtacagcaaagcgcgcatcggcgcggtgaaaggcaccaccggcgaacaggccctgcaccagcgtttcccgcaggctcgcgtcctctcctatgacgatattccgctggccctgaccgccctgcgcaacggcaacgtccaggccatcacccaggacagcaccatcctcgccggtctgctggcggaagcgccggataaagccaagtttaaaattctgcccgacctgctcagcaaagaagagattggcgtgggcgtgaagaaaggcgaaccggccctgctgaaagccgtcaacgatgagctggtgaaactggagaaaaccggcgaagccgcgaaaatttacgatgtctggtttggccctgccaccaaaacgccgcagccgcgcgcctttaccatagaagcgaaataa

SEQ ID NO: 6243 - DNA, 915 bp, Klebsiella pneumoniae
ggaatttctatgcgcaatcgtacattcgctgacctcgatcgggtggtagcgctcggcggcgggcatggtttgggccgggtgatgtcctccctctcctcgctcggttcacggctgaccggcattgtcaccaccaccgataacgggggttccaccgggcggatccgtcgttcggaaggtggcattgcctggggcgatatgcgcaattgcatcaaccagttaattgccgagccgagcgtagcgtcggcgatgtttgagtatcgttttggcggtaacggcgagctttccggacataacctcggaaatttgatgttaaaggcgctggatcacctgagcgtgcggccgttagaggcgatcaatttgatcagaaacctgctgaaagtggacgctttcctgatcccgatgtcagaacaaccggtggatttgatggcgctcgatcatgaaggccatgaagtttatggcgaagtgaatattgatcagcttgataatgtgccgcaggagctgatgctcaccccgccggtaccggccacccgcgaggcggtggaggctattgccgaagccgatttgatcctcattgggccgggcagtttttacaccagcctgctgccgatcctgttgctcgacgagatggcccaggcgttgcgccgcaccccggcgccgatggtttttatcgataacctcggcaaagagcatagcccggccgcgaggctgtcgctggcggagcgcatcgcgattatggagcgctatgtaggcaaacgggtggtggatgcggtgatcgccggtccaaaagccgatatcagcggcatcgacgaccggttggtgatccagacgccgctggaggccagcgacgttccctatcgtcatgaccgggcgctgcttcgcggggcgctggagaaagcgatccagctgccgggctga

SEQ ID NO: 6244 - DNA, 294 bp, Klebsiella pneumoniae; identical to SEQ ID NO: 3319

SEQ ID NO: 6245 - DNA, 639 bp, Klebsiella pneumoniae
ccttaccctatgcgccaccatcgcaccgctttgcctctggccggctataccatccagcagatcgacttcgacccggcgactttccagcctgaagatctgttctggctgccctatcacgccagcctgaccgggtggggccgcaagcggcaggcggagcacctggccggacgcatcgccgcggcatacgccctgcgcgaggtgggggataaacagcttcccgccatcggcgaccagcgccagccgctgtggcccacgccctggttcggcagcataagtcattgcggccagcgcgcgctggcggtggttgccgatcggccggtgggggtcgatatcgagcgccggtttaccccccagctggcggcggaactggagagcagcattatcagtccggcagaaaaaacagcgctgctgcgcagcggtctgcccttcccgctggcgctgacgctggcgttttcggcgaaagagagtgggtttaaggcgacgcctgcggcaaatcagcgcgcgctggggttcgccgattttcagatcgtggaaataacggcaagcaccttagcgcttatgtttgcggagcagcgctatctcttgcactggatagcgtcggaggagcaggtcattacactttgcgcattgcagcagtaa

SEQ ID NO: 6246 - DNA, 1230 bp, Klebsiella pneumoniae
cgtgaacctatggcaatcaatcagaccgctcaacccttgtccggccccgctgcgccgccgcaaaaagcacgcacctcgtttggcatcttaggcgcgatcagcctgtcccatttgcttaacgatatgatccagtcgcttattctcgctatctacccgctgctgcaggcggagttctcccttaccttcgtgcagatcggcatgatcaccctgaccttccagctcacctcatcgctattccagccggtgattggctacatcaccgataaacgctcgatgccgtggtcgctgccggtgggcatgtgcttcaccctctgcggtttgattctcctcgcgctggccggtagcttcggcatggtgctgctggccgccgcgctggtaggtaccggctcctcggttttccatccggaatcgtcccgcgtagcgcggatggcctccggcggccgtcacggcctggcccagtcgctgttccaggtgggcggcaacttcggcagctcgcttggcccattgctggcggcggtgatcatcgccccgtacggcaaaggcaacgtcgcctggttcgtgctggccgctctgctggctattgtcgtgctgtcgcaaatcagccgctggtatgccgcgcagcatcgaatgaataagggcaaaccgaaaccggccatcgttaatccgctgccgcgcaagaaggtcattctggcggtaggcattctgctgatgctgattttctcgaaatatttctatatggcgagcattagcagctattacaccttttatctgatgcataaattcggcttaacggtgcaaaacgcccagcttcatctgtttgccttcctgttcgcagtggctgccgggacggtgattggcgggcctgttggcgataaaattgggcgtaagtatgtgatttggggttctatcctcggcgtagcgcctttcacccttgttttaccctacgccagccttgaatggacggggattttaacggtgatcattggttttatcctcgcctcggccttttccgctattctggtctatgcgcaggaactgctgccgggacgcatcggcatggtttctggcctgtttttcggcttcgcctttggcatgggcggccttggcgccgcggtgttaggcctgctggcggaccataccagcattgatctggtttataaaatctgcgccttcctgccgctgctgggattcctgacgatattccttcctgataaccggcaaaaagcctga

SEQ ID NO: 6247 - DNA, 1224 bp, Klebsiella pneumoniae
ttgtttactatgaatgtcaccaccctgaaagatacgctggtcgcccgccgactggcactgaacccatggacgggattctactttttacagtcgctgttaattaacctggcgctgggctatgaatttagcctgctttataccgtggcatttacctgcgtgttacatctgctgtggcgcgcctttccgcgcgtccagaaagcggtggtcggcgcctattccctgctggcggctctgtactatccctttggccaggcctacggtgcccccaacttcaacactctactggcgctgcacgccaccaacgtggaagagtctacggaaatcctgaccatcttcccgtggtacaactatctgctggcggtcttcatcttcgctctcggggtcattgcggttcgtcgtaggatcgttgagccatcacgctggggaaaaatggatacgctgggcctgttgttcagcatcgggatcttctttctccagccggtgcaaaaccttgcctggggcggtgtattcaaggtgattgacaccggttatccggcctttcgttttgtcaaagacgtggtggtgaataacaacgaggtgctggacgaacaggcgcggatggcgcagctggctggcatgaaagacagctggcacgtgctggcggtaaagccaaaataccatctctatgtggtggtgatcggtgaaagcgcgcgccgcgatgccctcggcgctttcggtggccattgggacaacacgccgtttgccagctcggtaaacggttatctgtttaacaactacatcgccgccagcggctcaacgcagaaatcgctcggcctgacgcttaaccgggtggtcgatggcaaaccacagtatcaggataactttgtcaccctcgccaaccgcgccggtttccagacctggtggttctccaaccaggggcaaattggcgagtacgacaccgctatcgccagcatcgccaaacgggcggatgaagtacagttcctgaaaaacggcgatttcgaagccaataaaaacacccaggacgagcagttgctgaagctgaccgagcaggtgctctcaacccagcgtacccagccgcagctgattgtcctgcacctgatgggctctcacccacaggcctgcgatcggaccaagggcaaatacacggttttcgttcagtcgaaagagacctcatgtaacttctacggcagaaggcagacggatttcgctgcgggcttagcttga

SEQ ID NO: 6248 - DNA, 819 bp, Klebsiella pneumoniae
ggagtcactatgcaatctcaggaatcagaagcgctacaggcccgctaccgtctggcctgcgagctggcgaaagcgggggctgagctggcgtttgaatactatcaacagcgcgaggcgttgaccgtcgaccataagggcgacgacctgcaggatgtggtcagcgtggccgataagcgggtggaggcctttgtcaaacagcgcattcagagcgcgtttccggaggatggttttctcggcgaagagagcggcgctcgcctgcccgacgcgcgagtgctgtgggtggtcgaccccatcgatggcaccagctgtttcctcaacggcctgcacacctggtgcctgtcgctggcgatcgtcgccgacggcgaaccggtcatcggcgtggtctacgaccccaaccatcgcgagctgtttcacgccctgcggggccatggcgcctggctcaacgacgctccgatccgtccgcaccccgcgacgacggtcaaagagggcgtgatgggcgtcggcacctcgcatcgcgtcaccccggcggactttctgccgtttctgcaggcgctgctcagcgacggcggcatgtttatccgcaacggctccggggcgttgatgagcgcctgggcggcggcgggccggttgattggctactacgagccgcacatgaacccgtgggacgccctaccggggctggtgctgatgcgcgaagcgggcggcgccagcaacgattttctggcgcaggaggggatccagcgcggcaatccgctgctgctggccagccagacgctctacccgcagctgaaaaagatgatcccacaaccattacattaa

SEQ ID NO: 6249 - DNA, 882 bp, Klebsiella pneumoniae
gaaggaactatgacaatgaattatcaattagtgaagcaagtcagagaaaataacccattaagaaaaagcttcattgaccttgccgttaagacttttgacctgtcttttgaagagtggtatcagcaaggttactggaccgacgcctatatcccctatgcttttgtcgaacgcaataaagttatcgctaacgcttcggccaacatcatcgacctgcgctggcagggcgagccccggcgttatattcagattggcaccgtgatgaccgaaccggaccaccgtaataagggattagccggccagcttatccatcacatcctgcaggactggcagcaggaggcggacgccttctttttattcgccaatcccaccacggtggatttttaccccaaatttggcttcacccgcagcgaagagcatcaatatattatgccggtttccccgcgagccggtgattttcgtaaactggatatggacagcgctgacgatgtcgccctgctccgccattactatgaaaaatccaacccgttctcaccgctgcgggtggagcataactttggcctgctgatgttttactgctcagcctttatgaagcattttgtttattactcggcaaaaaatgaggcagtggtcatcgccatgcaaaacggtccggtgctgatctgctttgacctcttctgcgacgtgggtaagagcctgtcgacgctggtcaacgaactggccgatgaccatgtttaccaggccatcctcggttttacccctaatgaagaccggctcggcgagtatgagaaaatagagggagaagatatcctcttcgtctatgaccagaaggaaaacctgtttaaagacaggaagttgatgtttcctttactggcgcatgcctga

SEQ ID NO: 6250 - DNA, 618 bp, Klebsiella pneumoniae
ggaactgctatgtggcaagaaagactcgcgcaactggtcaccacctgtcattggatcggcgcgaaaggctgggcgccggcgaccggcggcaatatgtcggtgcgtcaggatgatacctggtgctggctaagcgagtcgggccgcgacaaaggcagcctgacaaccgaggattttctgcaggttgagatcgccaccaaccaggcgccttccggacggaagccgtcggccgagaccggtctgcacaccctggtgtatcgcctgttcccggaagccaacgtggtgctgcatgtgcataccgtcaacgccactgtgctgtcgcgcatcgaaaaaagcgacacgctggcgctgcaggggtatgaaatgcagaaaacccttagcgggcagcatagccatctcgataccgttccgatcgccatcttcgataatgaccaggatattgacgccctggcggcgcggattgccgattatgcgcaaacgcgcccgctgcgctacggctttctgctgcgcggccacggcctgacctgctgggggaaagatattcaggaggcccgccgtcaactggaggggctggagttcctgttcgagtgcgagctgatgcgccgccgctacgagccctga

SEQ ID NO: 6251 - DNA, 1041 bp, Klebsiella pneumoniae
ggagccgctatgtttccgtcacacttaccaaccccgcgccgcccggcggcgcagagcattcccatcctgcgctggggcattatcggtcctggctggatcgccgagcgctttgtgcactcattgaaaacctacagccggcagcaggtggtggcggtggcctcccgcagccaggcgaaggccgaccgggtggccgcggaatgggggatcccccaggcttacggccaggtggaggagatgctggcgcgtccggatattgatgcggtgtatattgcgacgccgcacaaccatcactttcccgacggcatgcaggcgctgaaggcgggcaaacacgtgctgattgagaaacccttcgccctcaacctcggcgaaggacgtgagctgcaggctgaagccgcccgccaggggaagctggcgctggaggcaatgtggtgcgattacgcgccgaaatatgatgtgatccgccagctgctggaggatggggcgctcggcgacctgcataccctgctggtcgatcacggcgagtatttcacccccgagcaccgcatcttcaatgccgatcttgccggcgggccgatgatggacctcggcagctatttgacctcgtttgcgctgatggtgggcggcatgccgcaggagattgtcgcccgcggcagcgccacggcggaggggcttaacggtcagacgtcgatgctgtttagctggcagaacgggatgcaggggttgttaaacaccactttgttcagcaacacgccgggcggggcggtggtggccggacgccaggcgaccctgacgatcgacggccagttttacgcccccggcggcttcacgctcgccgccagccagggcgggcaggtgctgcgctgggaagagccgcgcaatcgctacgaccagctgttctggcaggcggagcattttgcctggtgcatcgggcaggggttgcaggactcgccgctgcggccgctcagtcgggtgctgcagaatctgcaggtgatggatgaggtgcggcgccaggtgggcgcggtgtttaacgaagaacgctaa

SEQ ID NO: 6252 - DNA, 384 bp, Klebsiella pneumoniae
cgtttggctatctcgccgcctgccatctggcacaacactccacccactaatcaggaaaacatcatgatctacgaaaaacgcacgtacaccatcaatccgctgaaaatggccgactggctggcgctgtaccaaagcgatgccctggcggtgcaaaccgaccatctcggccagctaatcggcttcttttttaccgagatcggcgtggtcaatcaggtagtgcacatctgggcttatgaaagcctggacgatcgtctggtgcgccgcgcgcggatggcccaggacgaacgctggcagaccttctcgcgtaaaaatcgcgaactggccgccgtggaacgcctcgagtcggtgctgatgcgccccaccgctttttcacctctgcagtaa

SEQ ID NO: 6253 - DNA, 1152 bp, Klebsiella pneumoniae
tcaagttatatcataaagcctccgggatgggggcttttgtctggtcaggatatgaaccgtgtcactttcagcgtggtcgccatcatgttactcgcagcagcaacgacattgccgtttgttcttaatgccggttttggtaaggcgccgcagggggcacagcttagccaggtggaagcgtctccccactaccgggacggccagttccataaccagttgcccacgccagggttcaccgggcagaaaaatatgctggcggcgtggtgggatttcctgatgaccaaacgggaaaacgcccgtcccgcgcaaccgctgccgctggtgaagaccgatctggcgacgctgcccctcgggcaggacgtgatggtctggctcggccactcctcctggtacctgcagctggcgggaaaacgcatcctgatcgacccggtgttcagcgattacgcggcgccgttctcttttatcaataaagccttccccggcgactatccgtggcgggcggaagggatgccggagatcgatctgctgatcatctcccacgatcactacgaccatctggattacgccaccattcgcgccttactgccgaaaattaagcgggtcattacgccgctgggggtcggatcgcatctgcgctactggggaatggacggggcgctgattaccgaagcggactggcagcaggcggtaccggccagcgacgagctcaccgtccacgtgctgccggcgcggcacttttccggccgtgggctgaagcgtaaccagacgctgtgggccagttttctgttcgttacccggcagcaaaagatttattacagcggcgacagcgggtatgggccgcactttaaagcgataggcgatgagttcggtccggtcgatctggcgatcatggagaacgggcagtatgaccaggactggaaatatatccacatgatgccggatgaaacggctcaggctgccgacgatctgcgcgctcgcgcggtgctgcctgggcatgcaggacgattcgttttggcgaaacacagctgggatgaaccgtatcaacggctggcggctgccagcgaaggaagggcctggcgtctgctgacgcctgtgcagggcgagccggtgtgggtcgccgataagacgcaatcatttaacgcctggtggcgctaa

SEQ ID NO: 6254 - DNA, 663 bp, Klebsiella pneumoniae
cgccatctcttcatcgcctgtcagagcctgttcatgaaattgtggttagttcgccatggcgaaaccgaagccaacgttgccgggttatacagcggccatgccccaacgcccctgacgccgcgcggcgtcgctcaggcgcgcacgctcggcgaacggctgcgcctggcgcctttcgataaagtattctgtagcgagctggcgcggaccgggacaacggccgatctgctgcttggcgaccgcgctattccgcgtgagcgccatcccgcgctcaatgagatgtttttcggcgactgggagatgcgtcatcatcgcgacctccagcgagaagatgcggaaaactatgccgcctggtgtgccgactggcagcatgcggcccccaccaacggcgaaagctttcagaattttgcccgccgcgtcagcgagtttatcccaacgctgaccgactgccgccatcttgaccatctgctgatcgtcggccatcagggcgtcctgagcctgctgaccgccctgctgttgcagatgcctccggcggcgatgtggcactttcccattgcccatggcgcctggagcctcctcgaaatccgcgacgatttcaccaccctgcgggtattaaatagccaggccgtctggcagccgcaagaagaattcccgccagaccattga

SEQ ID NO: 6255 - DNA, 1527 bp, Klebsiella pneumoniae
ggaatccatatgtctgaacaacaagcacaaggtgccgatgaggccattgaccttaataatgaactgaaagctcgtcgcgaaaaactggctgcgctgcgtgagcagggcgtagctttccccaacgatttccgtcgcgatcatacctctgaccaattgcatgctgaattcgatgcgaaggacaacgatgaactcgcttccctgaacgttgaagttgcggtggctggtcggatgatgacccgtcgcgtgatgggcaaagcctccttcgtcaccctccaggacgtcggcggccgcattcagctgtacgtggcgcgcgatgacctgccggaaggcgtctacaacgaacagtttaagaaatgggacctcggcgatatcatcgccgcccgcggcaagctgttcaaaacgcaaaccggcgaactctcgatccactgcaccgagctgcgcctgctgaccaaagccctgcgcccgctgccggataaattccacggcctgcaggatcaggaagttcgctatcgccagcgctatctggatctgatcgccaacgaagagtcgcgtcatacgttccgtatccgttcgcagatcctcgccaccatgcgccagttcatggtggcccgcggctttatggaagtcgaaacgccgatgatgcaggtgatccctggcggtgcgtcagcccgtccgttcatcacccatcacaacgccctggatctcgatatgtacctgcgcatcgcgccggaactgtatctgaaacgtctggtggttggcggttttgaacgcgtgtttgaaatcaaccgtaacttccgcaacgaagggatctccgtacgccataacccagagttcaccatgatggaactgtatatggcgtatgcggactacaaagacctgatcgaactgaccgagtcgctgttccgcaccctggcgcagacggtgctgggcaaaaccgaagtgccgtatggcgaccaggtgtttgatttcggcaagccgtttgaaaaactgaccatgcgggaagcgatcaagaaacaccgtccggaaaccaacatggcggatctggataacttcgacgcggcgaaagcgctggcggaatctatcggtattcaggtagagaaaagctgggggctgggacgcatagttaccgaaatctttgacgaagtggcggaagcgcatctgattcagccgaccttcatcaccgaatacccggcggaagtttctccgctggcgcgccgtaacgacgtcaacccggaaatcactgaccgctttgaattcttcatcggcggccgcgaaatcggtaacggtttcagcgagctgaacgatgccgaagaccaggcgcagcgcttccaggatcaggtgaacgccaaagcggcgggcgatgacgaagcgatgttctacgacgaagactacgtgaccgccctcgagtacggcctgccgccgaccgcgggtctgggtattggtatcgaccgcatggtgatgctgtttaccaacagccataccatccgcgacgtgatcctcttcccggccatgcgtccgcagaagtaa

SEQ ID NO: 6256 - DNA, 1191 bp, Klebsiella pneumoniae
aaaaataatatgaaaatcagtaaagtaaaactcattgcttttatttcaactatgctcgttagcgtagatgttctgtcggtggcggggttacgcgttacactgctgccattatttttatatggtggttatatttttattaaaaataactacatagataaatgggcgtttttcgccttgacattttccgtcctttgcctcccatccctgtttttttcagcagagttttataaatcagtagggtatcttgtatggatattttttaactatatagctctatgcgtagtttataagagcttgattgttagatccctagataatacgttgcttggcgtcagagatgcatataggtttcagatttttttaggctgcttgctttatttctctggattacagccacgcgccgctgttctttattatgaaccttcatactttgctttgtcattgacgccatacgtggttatggttgttagtagctatataaaatcaaaggggtacgttggtgatgtggtaaaaagaacctcttttatagatgtttttttacttctcgcagcgatttatacgactaaaagtgcaaacctaatgcttgtatgtgcactttcagtgttaataatttcttttcttggcaaaggtaaattaaaaaagatatgcatacttgcggttgtgggtacgatatcaatcttcgggttgtacttttactcacaaaacagcaatgacttaattgccgtaacaatcaataatctgttctcagcatcagatcctgttaaagcccttcttgatagaacgggaaataggtggccaagatttaaccttgcatatgatatatcattgtcgaatttttggggcgttgggataggtgcatatgagaaatatacattatcccacacgtttgctggctacacagggctccctttctacctcagtcctatagggtatcctcctataaatatatacttagagttagcatccacttgtggttggcttgctctggctgtatggttgatatggcactttaagatgattaaggcagcgaataaaaggccggtaggcggaccggtgattgtctgctctcttattgttgccatgcttgctctcttcatagagtcaagctttatgaggccatactactggatgttaatgggtatggttatgggtcagattgcgctaaacaagcgcgccagacaaaacagttaa

SEQ ID NO: 6257 - DNA, 1224 bp, Klebsiella pneumoniae
cagttaaatattgtagttcatgagcctggtttcgctactttatggcgtatttttgcctatttccaggattattccatcactactgtaaaatcacgtttacactatttcagcgaagagatagattggagggattgcatttcattgaataagtatggcaacgctggaaagaagatgaattatcagaacgacgatttacgcattaaagagatcaacgaattattacctcccgttgcgctcctggaaaaattccctgctaccgaaaatgctgcaaacaccgttgcacatgctcgcaaagcgatccatcagatcctcaaaggcgacgatgaccgtctgctggtggtgattgggccttgttctattcacgatccggcagcggcgaaagagtatgccgcccgcctgctgaccctgcgcgaggcgctgaagggcgagctcgagatcgtcatgcgggtctattttgaaaaaccgcgcaccaccgtcggctggaaagggctcatcaacgatccccatatggataacagcttccgcatcaacgacgggttgcgcatcgcgcgcaaactgctgctggacattaacgacagcggcctgccggcggcgggggaattcctcgatatgatcaccccgcagtatgtcgccgatctgatgagctggggcgccattggcgcgcgtaccaccgaatcccaggtgcaccgtgagctcgcctccggactctcctgcccggtgggctttaaaaacggtaccgatggcaccatcaaggtggctatcgatgcgattaacgccgccggcgcgccgcactgtttcctgtcggtcaccaagtggggccactccgccatcgtgaataccagcggtaacggcgactgccatattattttgcgcggcggcaaagagcctaactacagcgcgaagcacgtggcggaggtgaaaatcggtctggcgaaagcgggtcttccggcccaggtgatgatcgacttcagccatgccaactccagcaagcagttcaagaagcagatggaagtgggcgccgacgtatgccagcagatcgccggcggcgagcgcgccattatgggcgtgatgattgaaagccatctggtggaaggcaaccagagcctcgagagcggtgaaccgctgacctacggcaagagcgtcaccgacgcctgcatcggctgggaggatactgaaacgatcctgcgtcagctggcggaagcggtgaaaacccgccgcggctaa

SEQ ID NO: 6258 - DNA, 255 bp, Klebsiella pneumoniae
ctggcaaatattttagctttgatgtttattccgggacataatgtcagagtgtacctgcgggcgtggagcgcccgccgtaagattccttttctgattatccaatcgacctcctctcctgacccctgtggttacctgagggaagcagaatataagctaaggagtactcggcatgatgacacgtcctttgggcaaaaccggattttccatcgccccattagtctttggcggcaacgtctttggctggaccatcgatga

SEQ ID NO: 6259 - DNA, 624 bp, Klebsiella pneumoniae
ggaaaaaatatgcttcgtcgcctgctgcagttatatattggtctggtgctttacggcgtgtccacggcgctcttcgtgcatgccaatctcggcgccgatccgtgggatgttttccatctcggggtggctaaacagctggggatcagtttcggtacggtgattatcctgaccggcgcggcggtactgctgctgtggatcccgatccggcaaatgccggggctcggcacggtgagcaatgtcatcgtgctgggactagcggcggacgccacgctggccgtcctgccgccgctggagtcgatggtggcgcgcagtgcgctgctggcaggagcgattgtgctgaacgctatcgctaccggaatgtatattggcgcgggctttggccccgggccgcgcgatggcctgatgaccggtctgcatgctcgcactggttggtcactgcgcggtatccggacggtgatcgagctttccgtactgctgattggctggctgctggggggcaaatttggcgtcggaaccgtcatctacgcgctgtcgattgggccgctgatccagctgtgcctaccgtggttcagccagcccgtcagccgcaacgcggtcagccctccccgggaaatagtctcctga

SEQ ID NO: 6260 - DNA, 468 bp, Klebsiella pneumoniae
tatgttgatatagacgcaaacgaacaaggaggattgcatatgtataagactatcattatgccggttgatgtctttgagatggcgctgagcgataaagccgtccggcacgcggagtttctggcccagcaggacggggtgatccatctgctccacgtcttaccgggttccgcgagctttaccatgagccgttttaccgccgacctgcggcggtttgaggaacatctgcagcatgaggcggagactcgcctgcagacgatggtcagccacttcagcattgacccgtctcgtatcaagctacatgtccgttttggcagcgtgcgcgatatggtcaacgagctggccagcgaaattaacgccgacgtggtagttattggctcacgcaatccctccatcagtacccacctgctcggctccaatgcctcgagcgtgatccgccatgcccatatcccggtaatggtcgtcaggtaa

SEQ ID NO: 6261 - DNA, 1230 bp, Klebsiella pneumoniae
gacatactcttccagcgatacggtctgcgcggaggagtcggtatgggtggtcgcgaaacgcagcagtttggcgatcgcttcctggttgctcggatcttccgccgggccctctttcagcaccaagccgaactgtttccagaaggtttggtatttttcagcgtcgtctttcgccagcttatccagcatctgcagcgcgcgtttggtcagcgcggtgcgcaggttgcgggtcacgctgctgtcctgcaggatttcacgggagacgttcagcggcagatcgttggaatcgatcaggccgcgcacgaagcgcaggtagttcggcataaactgctcggcgtcgtccatgatgaacacacgctggacgtacagcttcaggccgtgtttatgatcgcggttccacatatcccacggcgcctgcgacgggatatacagcaggctggtgtactcctgcttaccttccacgcggttatggctccaggtcagcgggtcgctgtagtcgtgagcgatatgcttataaaactctttgtattcgtcgtcgttaacttcggatttgctgcgggtccacagggcctgcgccttgttgattttttcccacgaaatcacggtttcgccgtctttctcttcccgtttttcaatctcaaccggcagcgcgatatggtcggaatacttgctgatgatagagcgcacgcgccagtcgttgaggaaatcatcttcgccttcgcgcagatgcagggtgatttcggtgccgcgatcggctttggtgatatcagctacggtatattcgccttcgccggcggactcccagaacacgccgttttccggcttgtcgcccgccgcacgggtacgcacggtcactttgtccgccacgatgaaggccgaatagaagccgacgccgaactgaccgatcagctggctatccttcgcctggtcggaacccatcgattcgaggaacgctttggtgccggatttggcgatggtgccgagatggtcgataacctcttcccggttcataccgataccgttatcggcgatggtcagggtgcggttgtctttatcaaacgaaacccgcacgcgcagctcgccgtctccctcatacaaatccggctgcgacagcgcgcggaaacgcagcttatcggccgcatcagaggcgttggaaatcagctcacgcagaaagatttctttgttggaatagagggaatggatcatcaggtgcagaagctgttttacttctga

SEQ ID NO: 6262 - DNA, 1788 bp, Klebsiella pneumoniae
caaaattgtatcatttctgttaaatcctggcttgcgcattcttgtatagacaagtatatgtatctacgtaaacaacgttcattgtcaggagaaaccccgatgtcgcaaagcaaatatcgccagctggacgtccgtgcgccaagaggcacgacgctgaccgcgaagagctggctgaccgaagccccgctgcgtatgttaatgaataaccttgatcccgatgtcgccgaaaacccgcacgagctggtggtctatggcggtattggtcgcgcagcgcgcaactgggaatgctatgacgctatcgtgaaggcgctgaagaacctggaaagcgatgaaaccctgctggtgcagtccgggaagccggtgggcgtattcaaaacccatgaaaactcaccgcgtgtgctgatcgccaactccaacctggtcccgcactgggccacctgggaacactttaacgagctggatgccaaagggctggcgatgtacggccagatgaccgccggcagctggatctacatcggcagccagggcatcgtgcagggtacctacgaaaccttcgtcgaagccggtcgccagcactaccagggcagcctgaaaggccgctgggtattaaccgccggtctgggcggcatgggcggcgcgcagccgctggccgcgacgctggccggcgcctgctcgctgaacatcgaatgtcagcagagccgcatcgatttccgtctgcgtacccgctacgtggatgagcaagccacctcgctggatgacgccctggcgcgcatcaaaaaatacaccgccgaagggcgggccatctctatcgcgctgtgcggcaacgccgcggagatcgtaccggagctggtgaagcgcggcgtgcgcccggatatggtcaccgaccagaccagcgcccacgacccgctgcatggttatctaccgaaaggctggagctgggaagagtatcagcagaaagccgaatccgacccgcagggcactattctggcggcgaaacgctcgatggccgatcacgtgcaggcgatgctggccttccatgagatgggggtcccaaccttcgactacggcaacaacatccgccagatggcgcaggaagtgggcgtcagcaacgccttcgatttcccgggcttcgtgccggcctatatccgcccgctgttctgccgcggtatcggcccgttccgctgggtagcgctgtccggcgatccgcaggatatctacaaaaccgacgcgaaagtgaaagagatcattaaagatgatcagcatctgcaccactggctggatatggcgcgcgagcgcatcagcttccaggggctgccggcgcgtatctgctgggtcggtctggagtggcggcaaaagctcggtctggcgtttaacgaaatggtgcgcagcggcgaagtctccgcgccgatcgtcattggccgggatcaccttgactccggctccgtcgccagcccgaaccgcgaaaccgaagcgatgcgcgatggttctgatgcggtctccgactggccgctgctcaacgccctgctcaataccgccagcggcgcgacctgggtgtcgctgcaccacggcggcggggtaggcatgggcttctcgcaacactccgggatggttatcgtctgcgatggtaccgatgaagcggcggcgcgtatcgcccgcgtcctgcacaacgacccggccaccggcgtgatgcgtcatgccgacgcgggttacgatatcgctattgaatgcgcggcggaacagggtctgaatcttccgatggttgcggcaacgcaggggaacgctaaatga

SEQ ID NO: 6263 - DNA, 630 bp, Klebsiella pneumoniae
ccaatctgtattacaagcgccgctggacgaagatgtatcagcagtcccttgaccgtggatacggaggacaaccaccgcaggacaactgacatggccaatctgaaaacaaaactcagcgcggcaatgttggcgctgattgccgccggtgcttcatccccagttctgatggatcagttcttgaatgagaaagagggtaacagcctgacggcttaccgtgatggttctggcatctggacgatttgccgcggtgcaacccgcattgatggtcagccggtcaggcagggcatgaagctgacgcaggcaaagtgcgaccaggtgaacgctattgaacgtaacaatgcgctggcttgggtagaccggaatatcaaggttcctctgacggcaccgcaaaaggtcggtatcgcgtcattttgtccgtacaacatcggacctggtaaatgcttcccctctacgttctacaaacgaatcaatgccggtgaccgcaaaggtgcgtgtgaagcgatccgttggtggattaaagacggtggccgcgattgccggctgaccaaaggccagaagaacggctgctacgggcaggttgagcgccgtgaccaggaaagcgcgttgacgtgctgggggttagaccagtga

SEQ ID NO: 6264 - DNA, 672 bp, Klebsiella pneumoniae
caggaacgtattatgcagtttgactggagtgccatctggcctgccattccgattttgctggaaggcgccaaaatgacgctgtggatttccgtcctcggcctggccggcggtctgataattggtctggtggccggtttcgcccgctgcttcggcggctggatcgccaaccacatcgcgctggtctttattgaaatcattcgcggcaccccgattgtggtgcaggttatgttcatctactttgcgctgccgatggcctttagcgatctgcgcatcgaccccttctccgcggcggtagtgaccatcatgataaactcgggcgcctatatcgcggaaatcacccgcggcgcggtgctctccatacataaaggcttccgcgaagcgggcctggcgcttggcctgtcgcgtcgcgaaaccattcgccacgtgatcctgccgctggcgctgcgccgcatgctgccgccgctgggcaaccagtggatcatcagcatcaaggatacctcgctgttcatcgtcatcggcgtcgccgaactgacccgtcagggacaggagatcatcgcgggcaacttccgcgcgctggaaatctggagcgccgtagccgtgatctacctgattatcaccctggtcctgagctttattctgcgtcgtcttgaaagaaggatgaaaatcctgtga

SEQ ID NO: 6265 - DNA, 1440 bp, Klebsiella pneumoniae
attatgggtattatagagacttcattacccacacacgtctacacggaatcttcgatgttaaaaatttttaatacactgacgcgccagaaagaggaatttaaacctatccatgccggggaagtcggcatgtacgtgtgtggtattaccgtttacgatctctgtcatatcggtcatggacgtaccttcgtctcctttgacgtcgtggcgcgctatctgcgttttcttggctataagctgaagtacgtgcgcaatatcaccgatatcgacgacaaaatcattaagcgcgctaatgaaaacggcgaaagctttgtcgcgctggtcgatcgcatgattgccgaaatgcacaaagattttgacgcgctgaatattctgcgtcccgacagcgagccgcgcgcaacgcaccatattgcggagatcattgagatcaccgagcagctgatcgccaaaggccatgcttacgtggcagataacggtgacgtgatgttcgacgtgccgacggacccgaactacggtttgctgtcgcgtcaggatctcgatcaactgcaggcgggggcgcgcgtcgacgtggttgacgtcaagcgtaacccgatggacttcgtcctgtggaaaatgtcgaaagagggcgagccgagctggccgtcgccgtggggcgcgggccgtccgggctggcatatcgagtgctcggcgatgaactgcaagcagcttggcaaccacttcgatattcacggcggcggttcggatctgatgttccctcaccatgaaaacgaaatcgcccagtccacctgcgcccacgacggcgaatacgtcaactactggatgcactccggcatggtgatggttgaccgcgagaagatgtcgaaatcgctgggtaatttctttaccgtccgcgacgtgctgaagtattacgatgcggagacgattcgctacttcctgatgtccggccactatcgcagccagctgaactacagcgaagagaacctaaagcaggcgcgttcggcgctggagcgtctgtacaccgcgctgcgcgggacggacaaatccgtcgatgcggcgggtggtgaagccttcgaagcacgctttatcgaggcgatggacgacgacttcaacaccccggaagcctactcggtgctgttcgatatggcgcgtgaagtgaaccgtctgaaaactgaggacgcggccgcggcgaacgccatggcggcccacctgcgtaagcttgctgcggtgctgggtctgctggagcaggagccggaggcgttcctgcagagcggcgcgcaggttgacgacgcggaagtggcggagatcgaatcgctcatccagcagcgtctggacgcgcgcaaagcgaaagactgggcggcggcggatgcggcgcgcgaccgtctcaacgagatgggcattgtgctggaagatggcccgcagggcaccacctggcgccggaagtaa

SEQ ID NO: 6266 - DNA, 210 bp, Klebsiella pneumoniae
ctcctcttcatcctttctttactcaacgtaaattttgacagcgatgatcgcctttatccttggcgatttgtgccgctatccggcggtgggctggggaaagacggcctgtttccccgtgaaggccagcaaaatatcctctttgtcagggttatagtgatgacatcaatgaataagctgcatcacattggttatgttggtctttccgcctga

SEQ ID NO: 6267 - DNA, 1056 bp, Klebsiella pneumoniae
ggaaccttcatgagcgtatttaaccccgttgaccatccacatcgtcgttataacccgttaaccggacagtggattctggtttctccgcatcgcgccaagcgcccctggcagggggcgcaggaaacgccggcaaaacagaccttgccggcccacgatccggactgtttcctgtgcccgggcaacacccgggtgaccggcgacaccaacccgaattacaccggtacctacgtatttaccaacgactttgcggccctgatgaccgacaccccggacgcaccggagagtgacgatccgctgatgcgctgccagagcgcccgcggcaccagtcgggtgatctgcttctcgccagaccacagcaaaacgctgccggaactgagccttgaagcgctggaagacgtggttaaaacgtggcaggaacagaccgcggacctcgggaaaagctacccgtgggtgcaggtttttgaaaacaaaggggcagcgatgggctgctccaaccctcacccgcatggtcaggtgtgggccaacagtttcctgcccaatgaagcggaacgggaagaccgtctgcagaaagagtattacgccgcacagggccagccgatgctgctggactatgtgcagcgcgaactggccgacggcagccgcacggtggtggacaccgagcactggctggcggtggtgccctactgggctgcctggccgttcgaaacgctgctgttgccgaaagcgcacgtgcagcgcattaccgatctcaccgacgcccagcgcagcgatctggcgctggcgttgaaaaagctgaccagccgttacgacaacctgttccagtgctcattcccctactccatgggctggcacggcgcgccgtttaacgacgaagaccataaccactggcagcttcatgcccacttttatccgccgctgctgcgctccgcgacggtccgcaagtttatggttggttatgaaatgctggccgaaactcagcgcgatctgaccgccgagcaagctgccgaacgactgcgcgccgtcagcgacgtccattttcgtgaatccggagtgtaa

SEQ ID NO: 6268 - DNA, 903 bp, Klebsiella pneumoniae
gccatgatcttcaacatccagcgctattccacccatgacggcccagggatccgcaccgtcgtcttcctgaaaggctgctcgctgggctgccgctggtgccagaacccggagagccgcgcccgtagcgaagatctgctgtatgactcgcggctgtgcctggccggctgcgagctgtgccagcaggcggcgccggcggttatcacccgcaccctcgatggcctgatcattcaccggcaaaacgttaacgacagccatatcgccgcgctgcgcgactgctgccccaccaccgcgctcacggtgtgcggcgaggagaagagcgtcgaggagatcatggcgacggtgctgcgtgataaaccattctacgatcgcagcggcggcggcatcactctttccggcggcgaaccctttatgaacccaacgctggcgcaagcgctgttcgaagccagtcatcaggcaggcattcacaccgccgtggaaacctgcctgcacgtaccgtggaaatacattgaaccgtctttaccctttgtcgacctgtttctcgccgatctgaagcacgttgacgaggccgtttttcagcagtggaccgacggcagcgcccgccgggtgctggataacctgcagcgtctggcgcaggcggggaaaaaaatgattattcgcgtgccgttgatccagggattcaacgccagcgaagccgacgttgccgcgatcaccgattttgccgccgatcgcctgcaggtcagcgagatccattacctgccgtaccacacgctgggaatgaacaaataccagttactcagtcagccctacaccgcaccggacaaaccgctggacgctcctgagctgctcgccttcgcgcaggattatgcgcaaagcaaggggctaacggcgatattacgaggataa

SEQ ID NO: 6269 - DNA, 426 bp, Klebsiella pneumoniae
atgcgactcataacacgacacgtgagagaggatattatgaaaaaagcaatgattgcgttatcggctattctggttgcggctccggtttttgctgcgacaacacatgcaacagatgataccgtcgcggcggcgaatgccaacgccaacaccgctaaagagaagctgcatcaggcccagcacgagggcgaagagcagcagctgaaggcgaaacacgccgccgaaggcaagcaggacagcgtcggcagccaggtgagcgaaggcgcgcagaaaacctggaacaagaccaaagaaggcaccgagaaggggtgggataagaccaaagaggtcagtgaaaaaggctggaacgccaccaaatccggtgcggaaaagggctgggataaaaccaaaaccggcgccgaagagttaaaaaataaagtgactgaataa

SEQ ID NO: 6270 - DNA, 619 bp, Klebsiella pneumoniae
  unsure (600),(601): Identity of nucleotide at the above locations are unknown.
tatgagatcatcatattcatccggagcgcatcccagagggacatcatgagccatcaactcaccttcgccgatagtgaattcagcactaagcgccgtcagacccgaaaagagattttcctctcccgcatggagcagattctgccatggcaaaacatggtggaagtcatcgagccgttttatcccaaggcgggcaatggccgacggccctatccgctggagaccatgctgcgtattcactgcatgcagcattggtacaacctgagcgacggtgccatggaagatgccctgtacgaaatcgcctccatgcgcctgtttgcccgattatccctggatagcgccctgccggatcgcaccaccatcatgaatttccgccacctgctcgagcagcatcaactggcccgtcaattgttcaagaccatcaatcgctggctggccgaagcaggcgtcatgatgacccaaggcactttggtggatgccaccatcattgaggcacccagctctaccaagaacaaagagcagcaacgcgatccggagatgcatcagaccaagaaaggcaatcagtggcactttggcatgaaggcccacatggggtcgattganntggacatcagttcactct

SEQ ID NO: 6271 - DNA, 270 bp, Klebsiella pneumoniae
cattctgtcattaaccctatgtatagcgtgacttttttaattaattgccattatttattgataatattattgataactatttgcatttgcaatagcgtattagcgcgccgtgggaagcgcgtctttcatcagaacatgtcaaatcgggcttattcagccagcgacggagtgcctttgcccgcttttggcaacatttatgccgcctcccctcccggtgggaaggggcgtttggggaacgtggcgacaaaaagcaggaataacaatgaataa

SEQ ID NO: 6272 - DNA, 1074 bp, Klebsiella pneumoniae
gttaccgtcatgcgcgttaccgattttgcttttgaactacccgaatctctgatcgcccactatccgatgcctgagcgcagtagctgtcgcttgctctccctggacgggccgacgggcgcgctgacgcatggcaccttcaccgacatcctcgataagctcaatcccggcgatctgctggtgtttaacaacacccgggtgatcccggcgcgtctgttcggccgcaaggccagcggcggcaagattgaagtgctggtggagcggatgctggatgataagcgcatcctggcccatattcgcgcctcaaaagcgccgaagccgggcgccgagctgctgctgggcgatgacgagagcattaaggccacgatgctggcgcgtcatggcgcgctgtttgaagtggagtttaacgacgagcgcccggtgctggagatccttaacgggatcggccatatgccgctgccgccctatattgaccgcccggacgaagacgccgaccgcgagctctatcaaaccgtctatggcaccaggccgggcgcggtagccgccccgaccgccggtttgcatttcgacgaaccgctgctggacaaactgcgcgccaaaggcgttgagatggcgtttgtcaccctgcatgtgggcgcgggcaccttccagccggtgcgcgtcgacagcattgaagagcacaccatgcactccgaatatgccgaagtgccgcaggaggtggtcgatgcggtgctggcggcgaaagcgcgcggcaaccgcgtgatcgcggtgggcaccacctcggtacgttcgctggagagcgcggcgcaggcggcgaaagacgcgctgatcgcgccgttcttcgacgatacgcagattttcatctacccgggttatcagtaccaggtgatcgatgcgctggtgactaacttccatctccctgaatccacactgattatgctggtgtcggcgtttgcgggttatcagcacaccatgaacgcctataaggtggcggttgagcagaaatatcgcttttttagctacggggatgcgatgtttatcacgtacaatccgcaggctatttctgagcgtccctga

SEQ ID NO: 6273 - DNA, 546 bp, Klebsiella pneumoniae
cacggcgtcattgaaagactggacgctttacgtgaacgacatttcagccgatgccagcaacgtcaccgtgaccgcaggcaagaccaatccgctgacgctggccaactccatcatttacaccacgaaagactatcccgggctaatcaccgtatgacacagagcgactttatcgggcttgttaacggcaagccatgggctaaccgcgcctgtagttttgagcagatggactgctggggcctggtggttctttattaccggcatgtgctcggtctggagctgcatcacatcgccagctacgaatctggagcggatttcatcacctgctacgaacaggaacacgcccactggcggcgtgtgccggtggcggcaaccggctgcatcgccgttttttaccgcggcgaagtgccggcgcatatcggtgtgatgatcagcccggtgaaatgcctgcatgcccgcggggaatttggtttcgtgcgctgcgatagcccgctggcattactgaaggtttacagcaaagtggagtacatggtgcatggttcgatatga

SEQ ID NO: 6274 - DNA, 1047 bp, Klebsiella pneumoniae
tggatttccatcatgaagagaggggcgatgaaaaacatttcactggcgatgctggccagacagattggcgtcggcgtggccaccgttgaccgggtgctgaacgagcgcggcggcgtatcgccgcagaccacgcgcaaagtgctgcaggcggcgcgcgaggcggggctgaagcggatcctgccggaggagcaccgctttccctggcagattgaggtctttctcagcagcaatgactcgttcttctttccgcagctggcgcaggattttgccgccgtggcggatagcctcggctatcgccgtctgaccttgcaccgcacctttgtcccggagtcgcagccgacgacgctggcccggcgcattgcgcgcagttgccagcaacgtcaggggatcatcgtcttcggcaatgaccatcccgcggtgcatgacgcgctgcgccgctgccgggaggctggcgtcccggcgatcaccctggcgacggacctgcccggcgccgaccgactctgccacgtggggatcaatcagctgcaggctggccgcacggcggggttaatgctggggagaatgacgccgcggcccggcgaggtgctgatggtcagcggccggcaagattacagcgcgcatcgcctgcgcattcaggggttccgcgaggtgctgagccagcgctttccccacctgcagctcagcgacgtgctggcgggcgaggagcggcgggagcagatcacccgcctggtggagcaagccctgtgccgcagccgaaatattgttgggatctataacaccgggcttggcaatacccagattgccgaggcgctggcccgccaccgccgcgaaggcgacgtctgctggatcacccatgagcgttacaacaccacccggcagcagctggcgaagggcagcctggcgttaacgctcgatcagaacacccgccagcacgcccagctggcgatcgacctgatgctgcgccatctggagtccggctaccagccgcaaacctatgccgacggtaaagtcgactttatcctctacagcgccgagaacgtggactaa

SEQ ID NO: 6275 - DNA, 1092 bp, Klebsiella pneumoniae
tggaaatccatcaaaacggcagtgtcagtgagtttagcaaaccgattatggtggcagcgtcccctcgccattctggagaaaaaaatgatctgcaaacgttttgccctggtaggcagtggttttatcggtcaggttcatgccgccagtcttgctcgtcatgaaggaagttcgctgacgatggtggccgatgccgccccggagcgcgcccaggcgctggccgcccgctatggcgcccgggcggtgaccgtgagcgaggcgatccatagcgacgccatcgacgcggtgctgatcgccagttcaaccccgtcgcatgccgaactgctggaagccgccgccagggcgggcaaggcggtctattgcgaaaaaccgatcgacctctccctggcgcgcgcccgtgaggtggtggagcgggtgctccccctgaacgtgccggtcactgtcggctttaaccggcgcttcgatagcagccatcagcagctccgccgccagctggagcaagggctgatcggccgggtcgagctggtgcagatggtctgccgcgcctccagcatgccgccgctcgactatctgcgcagctccggcggccagatgcgcgatcaggcgatccacttcttcgatctcctgcgctttctcactggcgatgaagtgcgcaccgtagcagcgatgggcgcggcgctggccctgccggacattgccgaatttggcgatgtcgacacctccatcctgatgatgcagatgcgcggcggcgcgctggcgcagctggacaatacccgccgcaccggccacgggtacgatgaacggatcaccctactgggcgccgaaggcgcgctggagtccggtagccagtcgccggcgggccctaccctgtggcgcggcaatcagcgcattgagccgggcctgtggccagactggttcagccgggtacagggatcttattaccagcatcttgacgcctttattcgctccctgaatggtgaaaccgtcgccgacctgcccggcctgctggacggcctgcaggcgcaggccattgccgaagcggcggttcagtccctgcagcatggccagtttgtcgccgtcgacgactgtcgctga

SEQ ID NO: 6276 - DNA, 1272 bp, Klebsiella pneumoniae
gatgcgtccattccaggtattagaaatgctgcttgcataaacttttcatcgcgataccgtgataagtccttaatttatttcccggagagcggcatgagtgattatgtaattccagaaattaaagcgacggaagcggaaatgatttctatccgtcattatttacatgccaatccggaattaagtcttgaagagtttaataccagcgaactggtcgccagcaagctgacggagtggggctatcaggtgacgcgcggtctcggcaagaccggcgtggtcggcagcctgagcaaaggcgattctccgcgcaccatcggtttacgcgccgatatggatgccttgccgatcgaggaaaccaccggtttaccctgggccagcacggcgccaggaaaaatgcacgcctgcggccatgacggtcacaccaccattctgctggcggcggcgaaatatatcgcctcgccggcctgtcagttcaacggcacggtgcatctgatttttcagccggcggaagaggctatcggcggcgcggatttaatgattaaagacggcctgttcgagcagttcccctgcgaacgcatctttggcttgcacaacatgccaggcctgcctgtaggcaagctgggcttctacgccggcaacttcatggcctcggcggacaccgtcaaaatcacgattaccggctacggcggccacggcgcccaccccgagcgcaccgtcgacccgatcgtcgccggtgcggcgctggtgatggccctgcagagcattgtggcgcgcaacgtgccgccgggggaaacggcagtggtcagcgtcggcaccttccaggccggtatcgcctccaacgtcattccggagagcgcggtgatggagctgagcgtgcgggcgatgaagccggaaatccgcgacctgctgatcaagcgtattcacgagctcgctgactttaccgccaaaagctatggcgccagcagcgtagtggaggtttacgactcctatccggtattaaccaacagtcctgaagagaccgatttcgcccgggcgctggcactggaggtgtttggccgcgaaggggtcctggagtcggtctcgccgatgaacgccagcgaggatttcgcttttatgctgcgcgaacgcccgggcagctacttcctgctcggcaatggcgagaaaggggagaagggcggttgcatggtgcacaaccccggctacgactttaacgatgacattatcaccatcggcgcgacgctattcgcccgtctggtggaaaaacactgtcgctaa

SEQ ID NO: 6277 - DNA, 312 bp, Klebsiella pneumoniae
tctctgcccatgaagataatctcagtgaaaaccttaagggacttctgggcggagaatcccgacgctgaacaaccgctaaaggcctgggtagacgaagcgacaaaagcagactggaaaaccccggcggagataaaggaccaataccgcagcgcaagtattctgaaaaataagcgggtggtattcaacattaaaggaaatgattaccggttaatcgtagccgttgcttatctgcgggggtgggtgttcgttaagtttatcggttcgcataaggaatatgacgagataaacgctgagacgatagagaggaagtaa

SEQ ID NO: 6278 - DNA, 3915 bp, Klebsiella pneumoniae
cccccgcccatcatgcgtcataaggagctgacaatgaccactcgtttaccgctggttgccgcgcagccggggatctggatggccgagcgcctctccactctgccaggcgcctggagcgtggcccactatgttgaactgcgcggcgccctcgacccgacgctgctgggaaaagcgattgtcgccggtctgcagcaggcggacaccctcagcctgcgctttgaggaagaggagggggaagtctggcagtgggtggcggccgaccgcacctttgccgaaccgtcgatcattgacctgcggacggcgccggatccgcatcgcgccgctacggagcggatgcaggcggatctggcgcaggatctgcgcgtcgacggcggcaacccgctggtgtgccatcagctgctgcgcgtcggcgacgaccgctggtactggtatcagcgatatcaccacttgctggtggatggcttcagcttcccggcgataacccggcagatcgccgccatttaccgcgcctggcagcggggggaagccactcctgagtcgcctttcacccccttcgccgaggtggtggacgagtaccagcgctacgccggcagcgaggcctggcagcgggataaagctttctggcaggcccagcgccaggcgttaccggcgcctgcctcactctctgccgcgccgttgggcgggcgcgccgccgggagcgatatctggcggatgaagctggagatgaacgccgacgccttccgccgcctggccagccatgcgccgcagtgtcagcccgctgacctggcgctggcgctcaccacgctgtggctgggccgcctgtgcaaccggatggactacgcggcgggctttatctttatgcgtcggatgggttcagccgcgctgacctcgacagggccggtgctcaatgtcctgcctctggcggtgcatattgacgcccgggagacgctggcggacctggcgatgcgcctcgccggtcagctgaaaaagatgcgccgccatcagcgctatgacgccgagcagatcgtccgcgacagcggcaaagcggcaggggacgaaccgctgttcggcccggtgctgaacgtcaaagtctttgattaccagctggatatcgatggtgtgcaggcagtgacccacaccctcgccaccggcccggtcaacgatctcgagctggcgctgttcccggatgagaccggcgggctgtcgctggagatcctcgccaacaaggcccggtacgacgaagccgagctccgtcgccacatggcgcgactgaccgcgctgctggcgcagttcgccgccgatccgacgctgcgctgcggcgaagcagagatgctctccgccgacgagctggcccggctggcggcggtcaacgataccgctgtgccgttgcctgccaccaccctcagcgcgctggtggccgaccaggcgcggaagaccccggatgcgccggcgctggcggacgcccgctggcagttcagctatcgcgagatgcgtcagcaggtggtggcgctcgcgcagctgctgcgtcagcgcggcgtgaagcctggggacagcgtggcggtggccctgccgcgctcggtgttcctgaccctggcgctgcacggcattgtcgaagcgggggccgcctggctgccgctggacaccggctacccggacgaccgcctgcggatgatgctggaagacgcccggccgtcgctgctgatcgccacggaggatcaactggcccgcttcagcgatattccggggctggaaagtctctgctaccagcagccgctggccgccggggatgacgcgccgctggcgctgtcaaaaccagaccataccgcctacatcatctttacctccggctccaccgggcggccgaaaggggtgatggtcggccagaccgccatcgtcaaccgcctgctgtggatgcaggatcgctatccgttatctgccgacgacgtggtggcgcagaaaacgccgtgcagtttcgacgtgtcggtgtgggaattctggtggccgtttatcgccggcgcgcagctggtgatggccgagccggaggcgcaccgcgacccgcaggcgatgcagcagttcttcgcccgctacggcgtgaccaccacccactttgtgccgtcgatgctggcggcgtttgtcgcctcgctggatgccgacagcgtcgctgcctgccgcacgctgcggcgggtattctgcagcggcgaagcgctgccgacggaattgtgccgcgagtgggagcgcttgaccggcgcgccgctgcataacctgtacggcccgacggaggcggcggtggacgtcagctggtatccggcctgcggccctgagctggcggcggtgaccggcagcagcgtgccgattggctggccggtgtggaacaccgggctgcgcattctcgatgccgcgatgcgcccggtaccgccgggggtggcgggggatctttatctcaccggcatccagctggcgcagggctatctggggcgcccggatctcaccgccagccgctttatcgccgacccgtttgcccccggcgagcggatgtatcgcaccggcgacgtggcgcgctggctggcgaacggcgcggtggagtaccttggccgcagcgacgatcagctgaagatccgcgggcagcgcatcgagcttggcgagattgatcgggtgatgtcggccctgccggacgtggggcaggcggtgagtcacgcctgcgtcttcaaccaggcggcggcgaccggcggcgatgcccgacagctggtgggctatctggtctctgactccggcctgccgctggataccgcggcgctgaaagcgcaactggcggaacagctgccgccgcatatggtgccggtggtgctgatgcagctcgctgagctgccgctgagcgccaacggcaaactggaccgcaaagcgctgccgctgccgaccctcggcggggagcgcagcggccggccgccggagcccgggatggaaacccttgtcgccacggccttcagccagctgctgggctgcgaggtgaacgatatcgacgccgatttcttcgcccttggcggtcattcgctgctggcgatgcgcctggcggcacagctcagccgccagctggcgcggcaggtgaccccggggcaggtgatggtggcctcgacggtgggcaaactgagcgcgctgctggccgccgatctcagcgatgagcaggctcagcgcctggggctggatacgcttctgccgctgcgcgagagcgacggcccgacgctgttctgcttccatccggcctccggcttcgcctggcagttcagcgtgctggcgcgctatctcagcccgcgctggtcgattaccggtattcagtcgccgcgcccgcaggggccgatggccagcgccgccagcctcgacgaggtgtgcgagcatcatctgcgcacgctgctggcgcagcagccgcacggcccttattacctgttcgggtattcgctgggcggcaccttagcccaggggattgccgcccgcttgcgccagcgcggcgaagcggtggccttcctcggcctgctggatacctggccgccggagacgcaaaactgggcagagaaagaggccaacgggctggatcccgaggtactggcggagatcgaccgcgagcgcgaagcgttcctcgccgcccagcaggggcaagcctccggcgagctgttcagcgccatcgaaggcaactatgccgatgcggtgcggctgttaaccaccgcgcatagcgcgaagtttgacggcaaggcgacgctgttcgtggcggagaagacgcggcaggaggggatggatccccaggtcgtatggggcccgtgggtgggggaactggaggtgttcagccagaactgcgcccacgtcgatatcatctccccgcaggcctttgaggccatcggtccggtggtcagggagattctggggtaa

SEQ ID NO: 6279 - DNA, 804 bp, Klebsiella pneumoniae
cagccgcccatcatgctgaagacattaaccgtttactggaggtgctgcatggccacagtgaataagcaggcggtggccgcggcgtttggccgggcggccagcggctatacgcaacatgatgaactgcagcggcgctgcgccgatctactgctgcgccagctggcgcgccgcgattttgcgcaggtgctggatgccggctgcggccccggcagtatgagtcgctattggcgtgaggcgggcagcgtggtgaccgcgctggatctctccgccgggatgctcgcccaggcgcagcgtaacgacgccgcgcagcattatctgttgggggatattgaggcgctgccgctgccggacgcctgcgtcgatctggcgtggagcaatctggcggtgcagtggtgcgacgatctacgggcggcaattggcgagctgtaccgggtggcgcgtcccggcggcagagtggcgtttagcacgctgctcgccgactcgctgccggagctcaatcaggcgtggcaggccatcgacgaccggccgcatgccaaccgtttccttagcgaagcggcggtgcgcgcggcgcttagcggcctgcgcgcgaccggcgaggttcatcagattagcctgccgttcgccgatgcgctgagcgctatgcgctcgctgaagggcatcggcgccacccatttgcaccaggggcggaccgccgccccgcttggccgcggcaaactgcgcgagctgcaactggcctggccgcagcggcagggcatctgcccgctgacgtattctctttttacaggagtcattgagcgtgactaa

SEQ ID NO: 6280 - DNA, 264 bp, Klebsiella pneumoniae
aagttggccatcatggcaatatcggcggcgaggtcgaggtcggcatcatcggcgataatcagcggcgatttgccgcccagctccatggtgacctctttcagtgatgaagcggccgagttggccatcacttttttgccgctggcgacgccgccggtgaaggagattttggcgatgtccggatgctcggtcagatactggccggtttccgcgccgatccctggcaggacgttaaacaccccgtccggcaggcccgcttcgctgtaa

SEQ ID NO: 6281 - DNA, 774 bp, Klebsiella pneumoniae
gaggcatacatgcaaggctgcgctaatgacaccggcaagctgattggtaaggtggccgtgctccgcatggcttttggctgtgctgatacggttcctgcgctttccgaatggaagcgactcggcgccatgaccaccaagggctttgactactccatgaataccgtcacctctgaggctgacgatacgaaaggtctggttgagaacctggtcaacaacatggacttcaccatctccggcgaaggtgagttccgcaagaaagacaaaacgacggaagtcggcgctattgccatctcgaaatatattttcgatgaagtgcaggccggccgtcagccgacagtctgggcccgcttcgacttcactggtgaagacgctggcacttatatcatgggctacttcaacaccacctcctggtctggtgatttcggcaccacggatatttcgaccttctccggggagtggaaagtctacgacgctgacaccgtggtatttgaagtcgctccgccggcgatggcgttcaccaccaacctgccgacgaccaagagcgtggctgccggatcggctctgaatatgtcggtcgtggttgagggtggcacttcgccttacacctacgtctggaagaaagacggcacggttgtcagcgggcaaacaacggcgaccttcaacaaggccagcgctgtttctggtgatgccggggtttatacctgtgaagtcaccgattcctccgcgacaccggtcaagatcacgtctacatcctgcacggtcactatcagttaa

SEQ ID NO: 6282 - DNA, 327 bp, Klebsiella pneumoniae
tatcgatacatgtcgcggtaccagccgggctgcacggccagcgcctcgtggcggccgcgctgggcaatatgcccatgctgcagtaccaaaatttcactggcctcggtgagcgccgacaggcggtgggcgctgataatgaccgtccgcccctccccccactggcgcaggttatgcaggatctggtgctcggtgcggccatccaccgccgataaggcatcgtcgaggatcaaaatttcggcctccagcagcagggcgcgagcaatagagatgcgctgtttctggccgccggagagcatcacgccgcgctcgcccacttcggtctcgtag

SEQ ID NO: 6283 - DNA, 1275 bp, Klebsiella pneumoniae
ggttacaacatgccaatgcaggttaacatcaccacaaaggtgaacagccagtctatccggcgcgaaacatacaacggtcgtgaacatctggtgctgccgagttacacgctgccggccaatgtcgtcatgaatggcggtctgtacacgcaggaagaaatcgacgcccattatcaggggcttgaaggcaccctggcgccgctggggcatccgcaggttaacggccagtttgtatctgccttctcaccggagggtatcaatgctggccatatcggtgcgtggaaccgcaatgttaagaagtccggtaaccgtatctatctcgagaagtgggtagatgtggcacgcgctggcgagtcggaaggcggtaaagaattgcttgagcgtgtcgcggctatcgatcgcggtgaagacgtcccgccaattcataccagtgtggcggcattcctcgaccaactcgaaccaaatgagcagcagcgcgcaacaggcgctgattgggtggcaaaaatccacagcatggaccatgacgcgattctcctgcatgaggtcggagcggccacccctgagcaaggtgttggcctgatggttaacgctgacatggcgaagccgttaaaagctaattcaggagcgctggtcggagaatcttaccgggagcttgagcagcgtcttgatcgtgcagcgaaagcgaagttcgcccccggccctgatgaatacgcctggattgccgacttcaccgactctcaggctgtcgttatccgcaatggtgggaaagctgaggtgttcggctattccactgaaggcggggaaattacctttgacgacaccggaacagctgtacagcggcaggaatcatgggttgccgttgtcgccaacaaattcaaatcacttttcacaccgcaggaacagcctgcaccaaaccacaaaacggagggcgacatgcctttaaccaaagaagaactggaacaaatcggcagcatgatcggccaggctgttgcgaccaataccgatgcggctattaagcctcttgtagaaaaggttgatgcgctgcaggccaatcagcagcaactggcagaaaccctgaccgccaactcccgcgctgaagaaaaaaccaagcgtgaagcagttgcgaaagtccatggcgatatcgtcgccaatgcgctgtctggtgaagcgctggatgcgatgtttaaaactatcggtgaagccgctccgctgggaaccaacaatgctcagcagccgaaagaaactggcgcgcctgccgcatctgaatacttcaaataa

SEQ ID NO: 6284 - DNA, 588 bp, Klebsiella pneumoniae
gacctgaacatgcttaagaagattcttttcccgttggtcgccatgtttatgctggcaggatgcgccacgccgccgaccaccattgaagtatcgccgaaaatcacgctgccgcagcaggatccaagcctgatgggcgtgaccgtcagcatcaacggcgccgatcagcgtccggaccaggcgctggcgaaagtgacgcgtgacaatcagctggtcactctcaccgcctcccgcgatctgcgcttcctgctgcaggaagtgctggagaaacagatgacgtctcgcggctacatgattggcccgaacggcgcggtcgatctgcagatcatcgtcaacaaactctatgctgacgtctctcagggtaacgtgcgctataacatcgccaccaaagccgatatcgccatcatcgccaccgcggcaaacggcacgaaaatgaccaaaaactaccgcgccagctactccgttgaaggcgccttccaggcctcgaacaaaaacatcgctgatgccgtcaacagcgtcctgaccgataccatcgccgatatggcgcaggacaccagcatccacgatttcatcaagcaaaacgcgcgttaa

SEQ ID NO: 6285 - DNA, 459 bp, Klebsiella pneumoniae
agcgtgaacatccctcaatgcggcatcaagctgcacagcggcaacttcagcgctataggcaagattcttcaggagcagctctctgacgggaaatgcctgcgcctgcaggtcaaagagtggcgcgaaaaacgcagcctgagccagaacgcacttagtcacatgtggtacgcggaaatcagcgaatacctgattaactcaggacgtaccgacgcaacgcccgagtgggttaagcgcaacctcaaaaagacctatctcgggtgtgaagaggtgacatacaccgacttcatcaccggtgagaaaactacaacctgggaaccgcggcatacctccgatcttgataccggcgaaatgcacatcttcctgaccaaagtagaggcctggtgcgctcagtttggtctggctctcaccattccaaacggttgcgaatatcagcaactgcagcaaaagcaggaggcctga

SEQ ID NO: 6286 - DNA, 804 bp, Klebsiella pneumoniae
gagaattgcatgagcagtaacttcagacatcatttattgagtctgtcgttactggttggcatagcggccccctgggccgcttttgctcaggcgccaatcagtagtgtcggctcaggctcggtcgaagaccgcgtcactcaactcgagcgtatttccaatgctcacagccagcttttaacccaactccagcaacaactctctgataaccagactgacattgattctctccgcgggcagatccaggagaaccagtaccagctgaatcagatcgttgagcgccagaaacagattctgctgcagatagatagtctgagcagcggtggcggcgcagcatcaggtgcgcaggctccgtcgtcttctggcgatcagagcgcggctgccaccagcgcagcgccagcggccacctcaggcgccccggcgatgaccggcgatgcgaacaccgattataatgccgctattgccctggtgaaggatgcctcacgccaggatgacgcgatggtggcgtttcaaaacttcgtcaaaaagtacccggattcaacctaccagccaaacgctaactactggctcgggcagttgaactacaataaggggagaaaagacgacgcggcgttttacttcgcttcggtggtgaagaactacccgaaatcgccaaaagcgcctgacgcgatgtttaaagtcggcgtgatcatgcaggacaaaggtgataccgcgaaagcgaaagcggtttaccagcaggtgatcaacaaattccccggcaccgacggtgcgaaacaagcgcaaaaacgacttaatgctcttggttga

SEQ ID NO: 6287 - DNA, 267 bp, Klebsiella pneumoniae
cattgccgcataaatgagcgaaaaatgagaagcagacaacgctttgaagcgatccctcccggcggggtggtcatttacccgccggggaaatccgtgttgtcaggaagggaggcgccgcacgccttagtccacgttctcggcgctgtagaggataaagtcgactttaccgtcggcataggtttgcggctggtagccggactccagatggcgcagcatcaggtcgatcgccagctgggcgtgctggcgggtgttctgatcgagcgttaa

SEQ ID NO: 6288 - DNA, 381 bp, Klebsiella pneumoniae
ggcggacgcataatgacgccggaaacactgcatccctgcgctcaccgtatcgccctgacctacccgtttaccgaacactgctggccctttgggccagagtacgacgtgtttaaggttgacggccgcatctttatgatcaccatgactattcgcgggcgggcgctggtcaatctcaaggccgagccgcagaagtcgctgctgaatcagcaaatttatcgcagtatcgaacccggctaccatatgaacaagaaacactggatcacggtggtgccaggagaggatatcagcgaggatctgctggccgagctgattgacgattcgtggcatcaggtggtgaacaagctgagtaaaaaggcgcagcagcgcctgcgtccgcgctga

SEQ ID NO: 6289 - DNA, 303 bp, Klebsiella pneumoniae
ggaaacagcatggctaaatacgaagtggtgcgcccgtggaatggcgtagcgctggggcaggttgttgaacttgaaaatcttcatccagccctgaagtcaaacgttcgtctcatgcgcggcgaagcaggtggggaactctctccggcaataccagaagcaggcactgatacaaaatctcgaaaagagattattcaggcccgcctgacggaattaggcgtcgagtttaaaggaaacctgggggctgaaaagcttggtgagctgttgccggatggcgaacttgaaaagcttttccctgctgaataa

SEQ ID NO: 6290 - DNA, 1398 bp, Klebsiella pneumoniae
ggaggcggcatgtataaaaccacgctatcgggccaggtatggcgctttgatagtctgaaaacgttgatggcgaaagcgtcgccggcccgctccggcgacgccctcgcagggattatcgccacctcagccgaagagcggatggcggcgaaaatggccctcgccgaggtgccgctgaccgacattctcgacaacccgcttatcccttacgagcaggacgaagtgactcgcctgatcctcgacacccatgatgcgcagggctttgccgccctgcgtcacctgacggtcggcgattttcgcgactggctgctggatgatgctaccgataccgccacgctgcagcgggtcgcccgcgccatcaccccggagatggcggcggcggtcagtaagctgatgcgcaatcaggatctgatccttgccgccagcaaatgccaggtggtgacgcgctttcgcaacaccatcggcctgcccggccacctcagcgtacgcctgcagcccaaccatcctaccgacgacctgaaaggcatcgccgccagtatgctcgacgggctgctgtacggcgccggggacgcggtgatcggcatcaacccggccagcgacagcttaccggtgctggcgcaactgaacgtgatgctggacgatattatccagcgcttcgccattcccacccagtcctgcattctgacccatgtcaccaatacgctgcagctgattgagcgcggcgcgccggtggatctggtgtttcagtcggtggcgggaaccgaagcggccaacagcggcttcggcatcaaccttgccatgctgcaggaggcccgcgaggcggccctcagcctcaggcgcggtaccctcggcaacaatgtgatgtattttgagaccggccaggggagctgcctgtcggccaacgcccaccacggcgtcgaccagcagacctgcgaggcgcgggcttacgccgtcgcccgccactttgaaccgctactggtcaataccgtggtcggttttatcggtccggagtatctctacgacggcaagcagattattcgcgccgggctggaggatcatttctgcggcaagctgatgggcctgccgatcggctgcgacgtctgctataccaaccacgcggaagcggatcaggatgatatggacaccctgctgaccttgctgtgcgccgccgggctcaccttcctgatcggcgtgcccggagcggacgatatcatgctcaattaccagagcacctcgttccatgacgcgctgtacgcccgtcgtctgctgggcttaaagcatgccccggagttcgccgactggctggcgaaaatgcagattatcgatccgcacggcgcgctgcggctcaccgacgcccgtcatccactgctgtccgtcctgccgcaaggagcctccgtatga

SEQ ID NO: 6291 - DNA, 420 bp, Klebsiella pneumoniae
cagaaaggcattagtgctatgcagacacaaattaaagttcgcggctatcatctggacgtctaccagcatgtgaacaacgcacgttacctggagttccttgaggaagcccgctgggacggcctggaaaacagccccgcgtttcagtggatgatggagaaaaacatcgccttcgtggtggtgaatatcaatattaactaccgtcgtccggcggtactgggcgatgtgctgacggtgagcagcaaactggagcaactcaacgtcaaaagcggcaccctaagccaggtggtcaccctcaaccctaatggcgaagtagtggccgatgcgctgattaccttcgtttgtatcgatttgaaaacccagaaggcgctgccgctggaaggggaattgcgtgcgaaacttgaccagatgaacctgcgctga

SEQ ID NO: 6292 - DNA, 2103 bp, Klebsiella pneumoniae
aagtttttaattaatttttttgtcgtctttttcaggaagtttattatgaataaatttgcacctttacatccgaaggttagtacgctgctgcatggcgcggattataatccggagcaatgggagaatgaccccgatattattgataaagacattgccatgatgcagcaggcaaaatgcaatgtgatgtcggtgggaatatttagctgggcgaaactggagccacgcgaaggggtatttaatttcgcctggctggatattatcctcgataaactgtatgccgccggcattcatgtctttctggccacgccgagcggcgcgcgtccggcgtggatgtcgcagcgctatccgcaggttctgcgggtggggcgcgatcgggtgccggccctgcacggcggccgtcacaaccactgtatgtcgtcaccggtctatcgcgagaaaaccctgaaaatcaataccctgctggcagaacgttattcctcacacccggcggtgctgggctggcatatttccaacgaatatggcggtgaatgccattgcgatctctgccagaaccgttttcgtgactggctgaaggcgcgttaccagaccctggagtatctcaaccaggcctggtggagcaccttctggagtcatacctatactgactggtcgcagattgaatcgcctgcgccgcagggcgagatgtcgatccacggtcttaatcttgactggcatcgctttaacaccgctcaggtgaccgatttctgccgccatgaaattgctccgctgaaggcggcgaatgcttccctgccggtgactaccaactttatggaatatttctacgattacgactactggcagctggcggaggcgctggatttcatctcctgggacagctatccgatgtggcaccgcgataaagacgaaaccgcgctggcctgctacaccgcgatgtatcacgacatgatgcgcagcctgaagggcggcaaaccgtttgtgctgatggagtccaccccgggcgccaccaactggcagccgaccagcaaactgaagaagccgggaatgcatattctttcctcgctgcaggcggtggcgcatggcgccgactcggtgcagtatttccagtggcggaaaagccgcggttcggttgagaaatttcacggcgcagtggtcgaccacgtcggacatattgatacccgcattggccgcgaagtctgccagctcggcgagatcctcagcaagctgccggaggtgagaggctgtcgcaccgaggcgaaagtagcgattatcttcgaccagcagaaccgctgggcgctggatgacgcccaggggccgcgtaatcttgggatggaatatgagaagacggtcaacgagcactaccgcccgttctgggagcagggcatcgctgtcgatgtgattgacgccgatgtcgatttaacgccgtatcagttagtgattgccccgatgttatatatggtgcgcgacggctttgccggtcgggcggaggcgtttgtcgccaacggcggccacctggtgaccacctactggaccggtatcgtcaatgagtccgatctctgctatctcggcggcttcccgggcccgctgcgcaatctgctggggatctgggcggaagagatcgactgcctgaatgacggcgagtttaatctggtgcaggggcttgccgggaatcagtgcggtctgcagggcccttatcaggtgcgccatctctgcgaactgatccatatcgagagcgcccaggcgctggccacctaccgggatgatttttatgccggacggccggctgtgacggtgaacgcgttcgggaaaggcaaagactggcatgtggcctcccgcaacgatttagccttccagcgcgatttctttaccgccctgagcaaggagctggccctgccgcgggcgatagcgacggagttaccacccggcgtggtggcgactgcgcgcaccgacggtgacaacgcatttatcttcctgcagaactacagcgcgcaaaaccataccctaaccctgccgcaagggtattgggattgcctgaccgacgcggcggtatcggctccactgaccctgacggcatgggattgccgtattctccgtcgtcacgcgtaa

SEQ ID NO: 6293 - DNA, 1212 bp, Klebsiella pneumoniae
ttattcttaatatctttatcgtttttggaggatgatatggaaacgtcactggctgaggatgtaaagaaaccgacccggaccctgtcgccggacagcttcttctttatgtcgccgtaccgcagttttaccacttcaggctgcttccgtcgcttctcacagcccgccgttggcggcgatgcactgaacggcgagttccagcagcagatggcggccgcctttgccgaggcccgggcggcggggatccgcaagccggtgatggtcggggctatcccgttcgacacctgtcagccttccgagctctatatccccgagcgctgggaagcgttctctcgcccggaaaagcagcgttccgcccgctatgccgcgccgctggaggcgatggaggtggtggagcgtcgggagatcccggagcaggacgcgtttttagccatggtggaacgcgccgccgcgctgaccgccaccccggaagtcgacaaagtggtgctatcaaggcttatcgatattaccacccgcgaccgcgtcgacagcggcgcgctgatggaacgactgatcgcccagaaccccgccagctttaacttccacgtgccgctctccgacggcggcgtgctgctgggcgccagcccggagctgctgctgcgtaaagaaggacagcacttcagctctctgccgctggccggctccgcccgtcgccagccggacgatgtgctggaccgggaagcaggtaacaggctgttggcctccggcaaagatcgccacgagcacgagctggtgacccaggcgatgaagagcgtgctgggcccgcgcagcagtcagctgtcgctaccggagtcgccgcagctgattaccaccccgacgctctggcatctggcgacgccgatcgcaggcaccgcgctggcggaagaaaacgccatgtcgctggcctgtctgctgcacccgacgccggcgctgagcggtttcccgcatcaggcggcgaagcgcctgattgctgaactggaacccttcgatcgccagctgttcggcggcatcgtcggctggtgcgatgacgaaggcaacggcgagtgggtggtgactatccgctgcgcgcgtctgcagcagcgtacgctgcgcctgtttgccggcgcgggcattgttccggcctcctcgccgctgggcgaatggcgcgaaaccggcgtcaaactgaccaccatgcttaacgtatttggcttgaactaa

SEQ ID NO: 6294 - DNA, 564 bp, Klebsiella pneumoniae
atgtccttaattaacaccaaaatcaaaccgttcaaaaaccaggcattcaaaaatggtgaattcatcgaagtcaccgagaaagacaccgaaggccgctggagcgtcttcttcttctatccggctgacttcaccttcgtctgcccgaccgaactgggcgacgtggctgaccattacgaagaactgcagaagctgggcgtagacgtttactctgtgtctaccgatacccacttcacccacaaagcgtggcacagcagctctgaaaccatcgccaaaatcaaatatgcgatgatcggcgacccgactggcgccctgacccgtaacttcgacaacatgcgtgaagatgaaggtctggctgaccgcgctaccttcgtcgttgacccgcagggtatcatccaggcgatcgaagttaccgctgaaggtatcggccgtgatgcgtctgacctgctgcgcaaaatcaaagcggcgcagtacgttgcttctcacccaggcgaagtctgcccggcgaaatggaaagaaggcgaagcgacgctggctccttctttagatctggttggtaagatctaa

SEQ ID NO: 6295 - DNA, 777 bp, Klebsiella pneumoniae
tatgacgtaatgtcatggagtgaaactatgttattaaaagataaagtcgccattattactggcgcggcctccgcacgcggtttgggcttcgcgactgcgaaattattcgccgaaaacggcgcgaaagtggtcattatcgacctcaatggcgaagccagtaaaaccgccgcggcggcattaggcgaaggccatctcggcctggcggccaacgtcgctgatgaagtgcaggtgcaggcggccatcgaacagatcctggcgaaatacggtcgggttgatgtactggtcaataacgccgggattacccagccgctgaagctgatggatatcaagcgcgccaactatgacgcggtgcttgatgttagcctgcgcggcacgctgctgatgtcgcaggcggttatccccaccatgcgggcgcaaaaatccggcagcatcgtctgcatctcgtccgtctccgcccagcgcggcggcggtatctttggcggaccgcactacagcgcggcaaaagccggagtgctgggtctggcgcgggcgatggcgcgcgagcttggcccggataacgtccgcgttaactgcatcaccccggggctgattcagaccgacattaccgccggcaagctgactgatgacatgacggccaacattcttgccggcattccgatgaaccgccttggcgacgcgatagacatcgcgcgcgccgcgctgttcctcggcagcgatctttcctcctactccaccggcatcaccctggacgttaacggcggcatgttaattcactaa

SEQ ID NO: 6296 - DNA, 1302 bp, Klebsiella pneumoniae
ttggcggtaatgacgttaaacagggtcgttttgcccgcgccgttagggccgataaggccaaagatctccgcctcgtcaacatggaagctgacgttgtcgatggcccgcaggccgccgaactgcatggtgacgtcctgcacctgcaggataacgttattttccgccatagctgctgttccttcttcccatctgccaaatctcttttttccccagcagcccctcgcgggcgaagagcatgataatcagcaacagcagggagaagaccaccattcgcaggcccgggtacgcgccgagatcgtgaccgaagaactgcagcggctgatcgaggaagcgcagccactcgccgctgccgaccaccagcacggtgccgagcagggcgccggtggtgctgccgagcccgccgaggacgataataatcagcagctggaaggtgagcataaagtcgaacagccccggggaaatggtggtcagcagggaagccagcagaccgccgccgatcccttcgaagaaggcgctggtggcgaaggcgcaggttttaatgcggaaggtgttgacccccatggcgatcgccgcatcttcatcgtcgcgaatagctttcatcatccggccatacttcgaccacaccagctggaggatcatgccggtggccagcagggcgaacagcccgcaccagaacaggagatgcggctgctgcggaatatcgttcagcccgatggcgccgttggtgatttgcgggttgttaatggcgaggatcttgatgataaacccaaagccgagggtgacaatggccaggtagtcgccacgtacccggaagaccggcacggcgaggcacaccgccagcgccgccgcgcacaggccgcttatcagcagggcagggaggaagcccgcgtgcaggctgaggatccacgggctgggggcggccatttcaaacatgtctaccttgctgtcgctggagaggatcagcagggcggtcacgtaggcgcccaccgccacgaagccgttcggctccagcgacagctggccggtcacgccgttgatcaggttgtagctgaccgcgaggatcataaagataaaaatggtgctgatgacacgaacaatgtagtcattgaaaaccacgttgattccggccagcagcgcgatacagatgacaataatgaccaggttgcgcagctgcgccccggcggtcgtcgtcgcgttgagcatcagaaacggctcctttccagacgttcgtcgcccataatgccgaccgggcggaacaagaggaccagaatcaagaacaggaaggcgaaagcgtctttatag

SEQ ID NO: 6297 - DNA, 972 bp, Klebsiella pneumoniae
gaggcggtaatgcatcagacgaaaacaggtatcttgctggccaatttaggcactcccgatgcgcccacccccggggcggtgaagcgctatctgcgacaatttctcagcgacaaacgggtggtggatacgtctcgtctgctatggtggccgctgctgcgcggcgtcatactgccgattcgctccccgcgcgtggcgaagctctatcagtccgtgtggatggaagagggatcgccgctgatggtgtatagtcgtcgccagcagcaggcgctggctgccaggctgccggataccccggtggcgctgggcatgagctatggttcaccgtcgctggccagcgcggtggatgacttactggcgcagggggtggagcacatcgtggtgctgccgctgtatccgcaatattcctgctcgacggtggccgccgtctgggacgaactggcgcggattctggcgaaaaagcgcgccattccgggtatctcgtttattcgcgactatgccgaacatccggactatatccatgcgctggcggccagcgtgcgcgcttccttcgcggtgcatggggaaccggatctgctgctgctctcctatcatgggatcccgcagcgctatgccaaccagggcgatgattatcctcagcgctgtcgcgatacgacgcgggaactggtttccgcgctggggctgccgccggagcgggtgatgatgaccttccagtcgcgctttggccgggaaccctggctgacgccgtacaccgatgaaacgctaaagatgctcggcgagaaagggacgaagcatattcaggtgctgtgcccggggtttgccgccgactgtctcgaaacgctggaagaaatcgccgtccagaaccgggaaatattcctcgaagcaggcggcaagcaatatgaatatattccggcgcttaatgcggacgcagcgcatattgagatgatggtcaatctgacggcgccttatcgctga

SEQ ID NO: 6298 - DNA, 507 bp, Klebsiella pneumoniae
ccagcttcaataatgccgttgaccatcgcctccggcgtcaggtcatcgaggaacagcgcggcgtttttgccccccagctcaagggtcacccgtttacctgacgcgctggccgactgctggactttttcaccggtggccaccgagccggtgaagctcaccttggcgcaggccggatgcgtaatcagccgctgggcaatctcgccgccggcgccgttgaccacgttaatcaccccatccgggatacccaccgcttttgccagctccgccacgcgcagcagcgtcagcggcgtatattcgctcggcttgaggacgatggtgcagccgcagaccagggccgccgccagcttccagatggcaatcatgatggagaagttccacggcacgatgccaaccaccaccccaagcggctggcggcgggtaaaggcggtatatttctccccggccatcgatggcagcgagacatccagcgtttcaccggtgactttccccgcccagccggcgaagtag

SEQ ID NO: 6299 - DNA, 954 bp, Klebsiella pneumoniae
ggtcgttcaatgagactcaggaaatacaataaaagtttgggatggatgtcattaatcgcaggtactgtattactcagtggttgtgattctgcactccttgacccaaaaggacagattggactggatctacgctctttgattctgacggccttcggcttgatgatgattgtcgttattcccgccgtcttgatggcagtaggatttgcctggaagtatcgcgcgagcaataaagatgcgaagtatagcccgaactggtcacactccaacaaagtggaagctgtggtctggacggtacctattctgatcatcctgttcctggccgttctgacctggaaaaccactcacgcactggagccaagcaaaccgcttgtccatgacgagaagccaatcaccatcgaagtcgtatcgatggactggaaatggttctttatctatccggaacagggtattgctaccgttaacgaaatcgccttcccggcgaacgtaccggtacacttcaaagtgacctctaactcggtgatgaactcgttctttattccgcgcttaggtagccagatttatgcaatggccggtatgcagactcagctgcacctcattgctgacgaagctggtacttatgacggtatctccgctagctacagtggcccgggcttctcaggtatgaagttcaaagcgattgccaccccggatcgggcgactttcgatcagtgggttgcaaaagccaaacagtctccgaactccatggactccatggccgcgttcgagaaagtggctgtgcctagcgaatacaacaaagtggaatatttctctaacgtgaaaccggatctgttcaaagatgttgtgaacaaattcatgtctcacgagagcatgaacatgtctaaacctgaaggcgagcacgctgctcacgacgggatggaaggcatggacatgagccacgcggaaaccgctcactaa

SEQ ID NO: 6300 - DNA, 549 bp, Klebsiella pneumoniae
tccccatcaatatttaaaaccgcggatgtgatctcatccatcattttcatcaatgtatttggtcatgatttaactcaggaacaggaatacgttcaggagctgaggatggaaattatttttgacccgtcgttaatcgcccttaagcagaatatttcccgtgcggaagaggccatcgaactggcgggttcattacttgccaggcgccagatttgcagcgccgaatatgtcaacgagatgctgacggtatatgaagattttggcgccgccatcgtgatagatgacgggattgccatgccgcatgcccggccggaaaaaggggcattacagaccgggttctcacttgtcaccaccgccacgccaatctccttcggccacgatgagttcgatccggtttccgtggtcatcgcgatcgccggcgccgatgctgacagtcatatcaaaatgatccaactgatagcctcgctgatcgagtcagatattgtgacctttcttcagcaggaaaatgacgttaattcagtcttacatttcattcaaaaacaaatggagtag

SEQ ID NO: 6301 - DNA, 468 bp, Klebsiella pneumoniae
ggatgcccaatgctagataaaattgaccgtaagctgctggcgctactgcaggaagattgcaccctctctttgcaggcgctggccgatgccgttaatctgaccaccacgccctgctggaaacgcctgaaacggctcgaagacgagggtattctccgcgggcgcgtcgccctgttggacgcggaaaaggtggggctggggctgacggcgttcgtcctgatcaagacccagcatcatagcagcgactggtactgtcagttcgtgagcgaagtgacgcagatggcggaagtgctcggcttctggcggatggcgggggagtatgactacctgctacgggtgcaggtggctgatatgaaacgctatgacgacttttataaacgtttagtgaacagtgtgcccggtctgtcggatgtcacttcgagttttgccatggaacagataaaatataccaccgccttgcctgtcgaataa

SEQ ID NO: 6302 - DNA, 483 bp, Klebsiella pneumoniae
ggaagcacaatgaaccgtcgcgcaggtaagccaataacaaaaaaagtgacgcagttagtgaatgttgaagagcacgtggaagggtttcgccaggtgcgggaagcgcatcgccgcgagctgatcgatgactatgtggagctgatctccgatctgatcaacgaagtgggcgaggcgcgccaggtggatatggccgcgcgtcttggcgtttcgcaacctacggtcgctaaaatgctcaaacgcctggccagcgtcggtcttattgaacagatcccctggcgcgggatcttcttaaccccggaaggtgagaagctagcccaggagagccgcgagcgccatcaaatcgtggagaacttcctgctggcgatcggcgtcagcccggagattgcccgacgtgatgcggaagggatggaacatcacgtgagcgaagagacgctggcgatgttcctgaaatttacccaaacacagggatctcaggaagcatga

SEQ ID NO: 6303 - DNA, 921 bp, Klebsiella pneumoniae
ggaggaacaatgaaagtaaccgtactgggatgcggtgcgctgggacaactatggctgaccgcgttgtacaaacagggacatgaagtccagggctggctgcgcgtaccgcagccattctgtagcgtcaacgtcattgaaaccgatggctcagtgttcaacgaatcgctgacggccaacgaccccgattttctcgccagcagcgagctgctgatcgtcaccttaaaggcctggcaggtgtcgaatgcggtaaagcacctggccgggatcctgccggacaccacgccaattgtgctgattcataacggcatgggcaccgtcgaggagctgcgcggcgtgaaacagccattgctgctggcctccacgacccaggcggcgcggcgcgatgggaatgtcatcatccacgttgcccagggcaccacgcatatcggaccggcaaaaagctacgagggggactacagctatctcgcagaagttctgcagagcgtgctgccggatgtcgcctggcataacaatatccactcggccatctggcgcaagctggcggttaactgcgtgattaaccctctgaccgcgctcaaagggtgtaaaaacggcgatctgcgcgactatacgcaggaagttgcggccatttgtcgcgaggtggcggcggtgatggagcgcgaaggtattcatacctcggcggaaaacctgctattttatgtcgaacaggtaattgaaagtacggcagaaaatatctcttccatgctgcaggacgttcgcgcccagcggcatacagagatcgactacatcaccggttttctgctcaaccgcgcccgcgcccacggcgtcgccgtaccggaaaacgcccgcttatttgaattgatcaagcgtaaggagaatgaatatgagcgcgtcggcactgatttgcctcgcccctggtag

SEQ ID NO: 6304 - DNA, 366 bp, Klebsiella pneumoniae
caggagacaatgatgtttaaatcttttttccccaaaccggggccgttttttatttctgcctttatctggtcgctgctggccgtgatcttttggcaggcgggcggcggcgactggctgctgcgggtcaccggggcatcgcaaaatgtggcgatcagcgcggcgcgcttctggtcgctcaactatctggtgttctacgcttactatctgttttgcgtcggcgtgttcgcgctgttctggtttgtctactgcccgcaccgctggcagtactggtcgattctcggcacctcgctcatcatcttcgtcacctggtttctggtagaagtcggggtggcgtcaacgcctggtatgcgccgttctacgacctga

SEQ ID NO: 6305 - DNA, 396 bp, Klebsiella pneumoniae
gtcttagcaataaatgagataagcggaaggtcttgtgcaaaaacaaggactaaagcgttacccactaaaaaagatagcgacttttatcactttttagcaaagttgcactggacaaaaggtaccacaattggtgtactgatacccgacacagcattagtgtcgatttttcatataaaggtaattttgatgtctaagattaaaggtaacgttaagtggtttaatgagtccaaaggattcggtttcattactccggaagatggcagcaaagatgtattcgtacacttctctgcaatccagtccaacggtttcaaaactctggctgaaggtcagcgcgtagagttcgaaatcactaacggtgccaaaggcccttctgctgcaaacgtcatcgctctgtaa

SEQ ID NO: 6306 - DNA, 762 bp, Klebsiella pneumoniae
tatttggcaatcaagacgcttagacgtctaaatgctaatgttattccacgctacgcccactctggagaaaccatgatccgcgccatcgtgaccgacatagaaggcaccaccagcgatatccgctttgtgcataacgtgctgttcccctacgcccgcgaacgactggccggctttgtgaccgctcagcagcacgctgaaccggtcaaaaccattctcgacaacctgcgccgcgaaacagacgcccccgccgccagcaccgccgaccttatcactaccctcttcgcctttatggatgaagaccgtaaatccacggcgctgaaggcgctgcaggggatcatctggcgtgacggctatctcaacggcgactttaccggccatctctatccggacgtactgccggcgctggagaaatggaaagcgcagggcattgatctgtatgtatattcctcaggctccgttgccgcgcagaaattgttatttggctacagcgatgaaggtgatattactcatctgttcacgggctatttcgataccctggtaggcgccaaacgcgaggtgcagtcctaccgtaacattgctgaacacctgggccatgcccctggcaccatcctgttcctgtcggatatccatcaggagctcgacgccgccgaggctgcaggtttgcgaacgatccagctggtacgcggcgaccgcgacccggcgagccaccatcctcaggttcagcgttttgacgacattcatccggagcagatcccagcatga

SEQ ID NO: 6307 - DNA, 1602 bp, Klebsiella pneumoniae
aacaataaaataaccattcttcagggattgcacatgaccaaaaaactgttgcctttactgctactatcggcgctctccgccgccgcgcatgccgccacgccgcccaacacgctggtggtcgcccagggtctcgacgatatcgtcagcctcgacccggcggaagctaacgaactctccagcattcagacggtccccagcctctatcagcgtctggtgcagccggaccgcaacaaccctgaaaaaatcgtaccgatcctcgccgaaagctggcaggccgatccggcggcgaaaaccctgaccattaaactgaagccggatgccaaattcgcctccggtaatccgctgcgcccggaagatgtgattttctcttacacccgtgcggtgacgctgaataaatcgccagcgtttattctcaacgtgctcggctggcagccggacaacatcgccagccagctgaaaaagattgatgaccataccctgacgctgcactggaccgccgacgtcagcccggcggtggcgctgaatattctctccacccccatcgcctctatcgttgatgaaaaacaggtggcgccgaacgcgaaaaataacgacttcggcaacgactggctgaagatgcactcggcgggcagcggggcctataaaatgcgcgtctaccagccgcatcaggccatcgtgctggaggccaacgccagctccccaaccggcgcgccgaagatcaagagcatcattattaaaaacgtccccgacccggcttcccgccgcctgctgatccagcagggggatgccgacgtggcgcgcgatctcggcgctgaccagattgccgccctgcaggataaacccggcgtgaaggtgctgagcatcccgtccgccgagcagaactacctggtgtttaataccgccaacagcgccaacccgctgctcaataacccggctttctgggaggcggcgcgctggctggtcgattatgagggcatcaccaaaaatctgctgaaaggccagtactttattcaccaaagcttcctgccggccggcctgccgggggcgctggagaccaatccgttcacctttgatccgcaaaaagctaaggctatcctcgataaagcgggcattaaggatgcccacttcaccctcgatgtggagaacaaaccgccgtttatcaccatcgcccaatcgctgcaggccagctttgcccagggcggggtgaaggtggatctgctacccgccgccggcagccaggtctatgcccgggtgcgcgcgaagcagcatcaggcggcgatccgcctgtggatcccggactactttgatgcccactccaatgccagcgcctttgcctggaacgatggtaaatccagcaccgtggccgggctcaacggctggcagatccctgagctgaataaagccaccctcgccgcggtggcggagccggacccggcgaaacgcctcgacctgtacaaaacgatgcaggaaaccctgctccagcattcgccgtacgtctttattgaccaggggaaaacccagatcgtggtgcgtgacaacgtgaagggctatcagcagggactgaacgccgacatggtctggtacgataacgtgaccaagtaa

SEQ ID NO: 6308 - DNA, 1419 bp, Klebsiella pneumoniae
gaaaataaaatgcaaagcacaacacaacaccaaggtgggcagctgaagcgcaccatgaaaacgcgccatctgatcatgctgtcgctcggcggcgtgattggcaccggcttattcttcaataccggctatatcatctccaccaccggcgcggccgggacgctgctggcgtatctgattggcgccctggtggtctggctggtgatgcagtgccttggcgaactgtcggtggcgatgccagagaccggcgccttccacgtttacgcggcgcgctatcttggcccggcgacgggctataccgtggcgtggctctactggttaacgtggacggtggcgctggggtcgagcttcaccgcggcgggattctgcatgcagtactggttcccgcaggtgccggtctggatctggtgcgtggtgttctgcgcagtgatcttcggccttaacatcatttcgacgcgcttcttcgccgaaggcgagttctggttctcgctggtgaaagtgatcaccatcgtcgcgtttattattctcggcggctcggccattttcggcatcattccgatgcaggatggctcgccggcgccgggcctgcgcaatatcaccgccgaaggctggttcccgcacggcggcctgccgatcctgatgaccatggtggcggtgaacttcgccttctccgggacggagcttatcggcattgccgccggagagacggaaaacccgcataaggttattccggttgccatccgcaccaccatcgcccggctgattattttctttatcggcaccgtgtttgtgctggcggcgctgatcccgatgcagcaggcgggagtggagaaaagccccttcgtgctggtgtttgagaaggtgggcatcccttatgcggcggacatgttcaacttcgtgatcctgacggcgatcctgtcggcggctaactccggcctgtacgcttcggggcggatgctgtggtcgctgtcgaacgagaagacgctgccggcctgctttgccaaagtcaataaacggggcgtgccggtgaccgccctgtcggtgagtatgctgggcggcgtgctggcgctgttctccagcgtggtggcgccagatacggtgtttgtcgcgctgtcggcgatctccggttttgcggtggtggcagtgtggttgagcatctgcgcctcgcactttatgttccgccgccgccatctgcagcagggtaaggcgctgagcgatctgcagtatcgcgctccctggtatccggtagtgcccgttctgggctttgtgctgtgcctggtggcctgcgtgggcctcgcttttgacccgagccagagaattgcgctgtggtgcgggatcccctttgtggccctgtgctatggtgcctggtatcttactcgttcacggaatatgactcaggagccccaacatgtcgcagactaa

SEQ ID NO: 6309 - DNA, 1122 bp, Klebsiella pneumoniae
aaatgtaaaataaatcctgaatctgaggggaatattgtgaaccgttatttttctctcatcccggttgttattatatttacaaccgcttgcgatcagaaagcactcaccgtcgagtccgccccgcgcatggttaaagtggcgcaggtgaccgccgtgggcaatacccagcagcgaacgtttccggcacgcattgagtctggcgattccaccgaactgtcgtttaagcggggtggccaagtggagtcgctagatattcgtcagggggcaagcgtcgcccaggggcaaacgctggcgcgcctgaatgcccgcgaggcccagcaacgggtcaatgagcggcaaacggcggccactctcgcccagcgtcagttcgaccgcttccagactctggccgggcgccaggcgatttcccaggcggagatggacgtgcagcgcgccaatcgcgatgccgccaatgcggccttaaaaatcgctcgcgaagagctggcgcaaatgagcctcatcgcgccctttagcgggattgccgccggcgtgcatatccgcaaccatcaggtggtcgccgccggccaaccggtgatcaccctgacgcggaccgacctgctggatgtggtcttcagcattcccgaaaatctgttcacctccctggatatccgcaataccgcctaccgtcccgtcgtcaggatcaataccctgccgggccgcgagtttaccgcggaatacaaagagcataccggcagcagcgacaatagcaccctcacctggcagatcgtgttaaccatgccgcggccagatgattttcccgccgtcggcggggtcagcggcaccgtgacggtcaatctcggcaatttaccggccagcgccgggcgggaaaccctcattgtgccagcggaggcggtgtttaaccccgataaccggccaaagaacgagccggtagtctgggtggtgaaaggcgataacgcgcatcgatatcttgaggagcgtaaggtcaccgtcggcgaggtgacttcgcagggagtggcgatcaccgacggtctccgcgcgggtgaacaggtggttgcggcgggcgtgagcgagctgcatgccgggcagccggtgcgggtctggacgcgtgaacgaggattataa

SEQ ID NO: 6310 - DNA, 318 bp, Klebsiella pneumoniae
aactgcaaaatgtggggcggtaaaaaagaccgcgaaaccactgtagatagactatttttcgtggcgcgaattatcaatgtttttcgtgaggcaaagcttaagattatgacaaagcgcacatattttatgtcgttttgttacagtcttatctctgatgattttgttatggaagtcattgcaaaatcagggaaaaacgcaatcattgaaagcgattacattggttttttgtatgtgacaggaaacatcagaagcgctatttattaccacgcagaaacagaattaattcgcatcgcgaaaatgaaaagtttaattagctga

SEQ ID NO: 6311 - DNA, 1317 bp, Klebsiella pneumoniae
tacaaaaaaatggctaagattggatttttatcattagggtgcccgaaaaacctcgtggactcagagcgtatcctgaccgaactgcgcaccgaaggttatgacgtcgtaccgacctacgacaacgccgatatggtgatcgttaacacctgcggctttattgatagcgctgtgcaggaatcgctggaagcgatcggcgaagcgttgaaagagaacggcaaggtaatcgtcaccggctgtctcggcgcgaaagaggatcagatccgcgaagtgcatccgaaggtgctggagatcaccggtccgcacagctatgagcaggtgctggagcatgtccatcattatacgccgaagccgaagcacaacccgttcctgagcctggtgccggaacagggggttaagctgacgccgcgccactacgcctacttaaaaatttctgaaggctgcaaccatcgctgcaccttctgcatcatcccgtccatgcgtggcgatctggtgagccgtccgattggcgaagtgctggccgaagccaaacgcctcgctgacgccggcgtgaaagagctgctggtgatttcgcaggacacctctgcctacggcgtcgacgtcaagcaccgcaccggcttccacaacggtatgccggtgaaaaccagcatggtcagtctgtgcgaagagctggcgaagctcggcatctgggtgcgcctgcactatgtctatccgtacccgcacgttgacgatgtgatcccgctgatggcggaaggcaagattctgccgtacctcgatattccgctgcagcacgccagcccgcgtattctgaagctgatgaagcgtccaggttctgcggaccgtcagctggcgcgcattaagcagtggcgtgaaatttgcccggatctgaccctgcgctccacttttattgtgggcttcccgggcgaaacggaagaagatttccagatgctgctcgacttcctgaaagaggcgcgtctcgaccgcgtcggctgcttcaagtacagcccggttgaaggcgctaccgccaacgagctggcggaccaggtgccggaagaggtgaaagaagagcgctggaaccgctttatgcagctgcagcagcagatctctgccgagcgtctgcaggagaaagtggggcgcgaaatcctggtgctggtagatgaagttgatgaagaaggcgccattggccgcagcatggccgacgctccggaaatcgacggcgcggtgtacctgaacggcgaaacccgcgttaagccgggcgacgtggtgcgggtgaaagtcgagcacgccgacgaatacgacctctggggaacccgggtctag

SEQ ID NO: 6312 - DNA, 564 bp, Klebsiella pneumoniae
ggcaaaaaaatgtcacaccataatacttgctatcgttctgagcattacgatctgtggtttgataatggttttcttctctatgggatgtcgctgatcctgaatagcctgccggcatcttacttccgcaaaaaacatgttttcttcaccagcgacaattatttcgcggtactgcagcacaactataatcggcgggatacattatttattctgttaaccgaaggcaacgatcttaattttcttagtgaactgcctatgctgcgcttaccggccaactcgacgccggaagagttaaagatatttctgcatcaacccacccgctattacaaaacccatccggcgccaggcgcctcggtgcagtttaccgagcgggaaaagaaagttattcaacttatcagcaatggcgaagcagtcgccagcattggccggtcgctaaacctgcatataaaaaccatttatcagatccggctgaatctgattaaaaagctcggctgcagcggtagaaccgatttttttaatatcagccgcagcgaaacgttcaaatcctggagccagattcacctgtaa

SEQ ID NO: 6313 - DNA, 549 bp, Klebsiella pneumoniae
gcgatgaaaattgatttaaatgccgacctcggcgaaggctgcgccagcgatagcgcgctgctgcagctggtctcttccgccaatatcgcctgcggctttcacgccggcgatgcggttctcatgcagcaatgcgtgcgcgaggcgctgaaaaacggcgtcgctatcggcgcacacccgagcttcccggaccgggaaaatttcggtcgaaccgcgatgcagttaccgccagagacggtctacgcccaggtgctgtaccaaattggcgcgctggcggcaatcgtacacgcccaggggggcgagctgcggcacgtcaaaccgcatggcatgttgtacaaccaggcggcgaaagagccggcctttggccgacgctatcgcccgtgcggtgcgcgatgccgacgccgacctggtgctggttgggctggcgggcagcgagcttatccgcgccggacagcattatcagttgacgacgcgccaggaagtcttcgccgatcgcggctatcaggccgacggcagcctggtgccgcgcagccaaccgggcgcgctgattga

SEQ ID NO: 6314 - DNA, 516 bp, Klebsiella pneumoniae
ggagggaaaatgcgcggtaaaagcgtgatgctcctggccgggttagtctctctcgcgcaggcgaacgaacttaacctctattcggtgaataccggttcctatgtttaccatctgaccaataatcacggacaatatacagagaatttcgaaaatcattttttctcagtggagcggaaattctctgcagactccaaatacagccttctgcttggcactatgaataacagcttcaacgatcgctgcctggcgctgggggtgagaagagactggtaccacagcggcagcgggtggaccttcaaaggcgtttacggctataccggcgaattcttcttcgacgccttcgagcattgcggcgatcatggctcctataaagactttaaggacgccacggggatcggcttttcaccctatatctaccacgctatccagtataacttcaccgattatttcgccgttgaaagcggcattattattcccagcgtgtttgtgatcagtatccagtggagcttccgctaa

SEQ ID NO: 6315 - DNA, 318 bp, Klebsiella pneumoniae
cgcaacgaaatcagaatccctttgattctgcgcatcctgaaactggttatttctcccggtgtttgtcagatgctttgcaccaagacggtcagtatagaaatcaccgaggccagtaacttcttcgtcaagcttcgcgcctgcaaataccgcattacgaatatcggtactcggtaccggaacctgcgtcggcgttgggagtggaacttctgccatgtcttgtcgccctgtaaaaggcgcactaccccctcagaagtcaatctgatggtgtgcgcgaaggttggtaattactgctgtgtgttacggataaatcgagtctga

SEQ ID NO: 6316 - DNA, 729 bp, Klebsiella pneumoniae
ggggaggaaatggatttttttagcacgcagaatattttagtacatatacccatcggcgctggggggtacgatctctcctggatagaggccgtggggacgattgccgggctgttgtgtatctggctggcgagcctggagaagatcagtaactatgctttcgggctggtcaacgtcacgctgttcgccatcatcttctttcagatccagctttacgccagcctgctgctgcagctgttcttttttgccgctaacgtttacggctggtatgcatggtcgcgacaaagcagcaaccatgaggctgagctgcagatccgctggctgccgcgcagcaaagcgctgggctggctggcggcctgcgtggtagcgatcggcttgctgaccctgtttatcaacccgttctttgctttcctgacgcggatcgcggtcagcctgatgcaagcgctcggtttgcaggtcactatgccggaactgcagccggatgctttcccgttctgggactcctgtatgacggtgctgtcggtggtggcgatgatcttaatgacccgcaagtatgttgaaaactggctgctgtgggtgatcgtcaacgtgataagcgtggtgatttttgcccgtcagggcgtctatgccatgtcgctggaatacctcttgctgacgttcattgcgttgaacggcagccggatgtggataaacagcgcgcgtgagcgaggttctcacgcgttttctggctaa

SEQ ID NO: 6317 - DNA, 462 bp, Klebsiella pneumoniae
ggagccggaataatggcacgttatcgtcgcgttaatatcgacggtctgtctctttacaagaccgaaacccgcaccacggccgccgatcttcttccaggcaccgcggctaccatcaactcctctgatgaatttgctcaggcaaccgcactaactggccgcctgtacattatcgatgtcggctaccaccagggactgactatcaccgaagcaattcctgccggtgattctgcggtcggcaactacgtagaagaggggcgagagctggcgttacgctgcctgcctggtgcgtataagaaagacagccctatcaaacttgggacggctggtcagttcactcttgccacctccgacaccgattcagtgatcggctacagccaggatgaatacaccatcgcggccagcactaccgatttcattcgcgtgcgcatgcgcgttggcactgtcgccgcagctggcgcgtaa

SEQ ID NO: 6318 - DNA, 1314 bp, Klebsiella pneumoniae
ctccttaccttagtacagcgagtgggtattcttttcgatgtcttcgcgcgtgatgcggccaaacatcttccagtaacaccagctggtgtaggccagaatgatcggcacgaaaacaatcgccacgtaggtcatcaggttcagcgtccgctgactggaggtcgcgtcccacattgtcaggctggcgttcagcatggtgctggacggcatgatgaacgggaacatcgcgataccggcagtcagaatgatgcaggccagggtcagcgaggagaacaggaatgcccaggcacctttatccgctttggtcgaaacgacggtcagcagcggcaacaccacgcccagggcaggcaccgcccacagcgctggcatattgttaaagttcaccatccacgcgccagcttcccgcaccacttccttggtcagcgggttagacgggccggtatggtcaatcaccgatttcaccacatagccgtcgatgccgtagtagacccacacgcccgccagcgcgaagcagaccagcgtcaccagcgccgccaccatggaaacggtgcgagtacgcaggtgcagttcgcctacggtacgcatctgcaggtaggtggcgccctgagtcaggatcatcgccacgctgacgataccggccagcagaccaaacgggttcagcaattggaagaagttaccggtatagaacagacgcaggtattcatcgacgtggaacggcacgccctgcagcaggttgccaaaggccacgccaatcaccagcggcggcacaaagctaccgatgaagatgccccagtcccacatgttgcgccagcgggtgtcctcgatcttggaacggtagtcaaaaccgaccggacggaagaacagcgaggccagcaccagaatcatcgccacatagaagccagagaacgccgcggcgtaaaccatcggccaggcagcgaacagcgcgccgccggcggtgatcagccacacctggttaccgtcccagtgcggggcgatggcgttgatcataatccgacgctcggtgtcgttgcggccgaggaagcgggtgagcatgcccacccccatgtcgaacccgtcggcgacggcaaaaccaatcagcagaatgccaatcagcagccaccagataaaacgcaatacttcataatcgatcatttgacgactcctgtcttagcgtgccgactgaatagccgcagaggactgttcaaagtgatagcggccggttttcaggctgctaggtcctttgcgggcaaacttgaacatcaggaacagttcagccaccaggaacagcgtgtacagaccgcagatcagcaacattga

SEQ ID NO: 6319 - DNA, 2553 bp, Klebsiella pneumoniae
ttacatctgattaatgggtatggaattttgggtcagttcaatttcaatatgaaatatgcatgcctcttgatgatgtctgcgctattcaatgctccagccatatcgtttgcggatgagttttttaatcctgctttgcttgaggttcgcgaaggagaaggtgcgccgacgacagacctctccgtatttgaagtcgtcaatggacagccagcaggaaactaccgggtagatatctacgtcaataacgaaatggtgaccgcagatgcccgcgatgtgatgttttcaaagaaccaggatggaaagctggagccctgcgtcacgttggcagaactcggccaatggggagttgatacggcctcatttccagaactcgccgtcagtgatagcgaatgcgctaatcttgcgggcatccctgatgcatttgccgacttccagtttaaccgccaaaagctgaatctgagtattcctcatgcggcaatgaatacgcgcagcctggatgaagtgcctattgaacgttgggatgaaggtattccagcccttctcctcaattacaacatgaatagctatcagagccgatataagggtgcagaaacttacgaaagcacgtatttgaacctgcgtcccggtctcaatatcggtccctggcgtctgcgcaactataccacctttgagcatagtaatcagagtggaagtaaatgggacaacgtctatagctatcttcagcggaatattgtctctttgcgaagccaactgacgttaggcgacagttcagcaccagctgatgtcttcgatagcgtgccgtttcgtggttttcagatggcctcggatgatgacatgctgccttccagcgtacgtaactatgcgcctgtgattcgaggggttgcccgcagcaatgccctggtcaccatccgtcagaatggttacgttgtctatgagaccaaagtggcgccgggggcgttcgagatctccgatttggcctccaccggaggagcaggcgatcttgacgtgaccatcaaagaagccgacggcagcgagcagcacttgcgcatcccctacgcatctttgcctgttctacagcgtgaaggtaagtttcgctatagcgttacgggcggtcaattccgcgcctacgattctcacacggaaaaaaacctgtttgttcagggcaccggaatttatggccttccgtggggctttacgctctacggcggcgtgcaaaatgcaggcaataaatatcagtcatatgcgttgggggtgggtaagaatatcggtagctggggcgccttttccgccgacgccatccattcccgatccatgtcgaccgatgccggcaggcaacagggccagtcgctccgggtgcgctatagcaaaaatttcctgcagacgggaacaaattttaccatcgccggctatcgctattccacctccggatttcgctcgctggaagaaacgctgggtacctaccgtagcgataataacattccttcttatatcaccgatcgccggcgtaaccgggctgagctgtcgctgaatcaggatcttggcgataactttggggcgttgaatgcatccttgatcagcgaggattactggcagaacgaacgtaacagcctgtcggcaaatctgggctattacaaaaatttcaacgcgattggtatcagtctgaactactcctggaaccggaataccgggctctatggccatgccgaacaggataatgtggtctcctttgagatcaatgtgccgctggataaattcctcaaccggacatacgcctcatacgggacaacccatgcgagtggaaacggaaccagccacaacctccgactgaatggttcagcctttgatgatgccagtcttgactgggggataaacgcgacgcttgcggggcgcagcgaacaacaagtcgtcgggggtaacgtcagctggaaggcaagccacggaacgttaaatggttcctacagccgcagccgcgacagccaacagctggggtatggcatagccggtggggtagtgattcatgagaatggtatcacgctgtcccaatccctgggtgaaaccattggtttagttaaggctcctggcgcagaaggcattggcgtcaataactacgccggtatctcaacggatagtcggggttacgcggttgttccgtatctgaccccctatcgccgcaatgatattagcctgaatagtaaaaccctgcgggacgataccgatatcacctatatgaccaataaagtcgtccccacccgcggggctatcgttagagcagagtataaaaccgccattggccaccgtgtcctgatgacgttaacgcggcctgggggtaaaccggtcccctttggcgcgatggcgtcgctgcttaaaagtgaagaaaacgcgtcaattgtcggtgacggcggagaagttctgctgagcggtttaccgcaaaaagggacgctgcaggtgaaatgggggaatggccaggggcaggaaaccacctgtcgggcggattatatagcccataaatctgctggcgcgtccggtctctggaacgcgacgagcgtctgtcaataa

SEQ ID NO: 6320 - DNA, 345 bp, Klebsiella pneumoniae
ccgccgctgatggtgctgattaccctgatgaactccgccggtggtaaagcctctgacctgttcggcgaactgaccggtatcgcggtactgctgaccatgctgccttacttctactcctgtgttgacctgattcgtttcgaaggcatcgacatccgtaacttcgttagcctgatttgttcggtactgggttgcgtgttctgcttcatcgcgctgatgggcgcaagctccttcgaactggccggcaccttcatcgttagcctgattatcctgatgttctacggtcgcaaaatgcaccagcgccagaacaacgcatcggataacaacaccaccgctaacgcgcactaa

SEQ ID NO: 6321 - DNA, 615 bp, Klebsiella pneumoniae
ccaacgctgatgaatggagtggcaaaaatgcccaaactggggatgcagccgatccggcgcaggcagctgatcgacgccacgctggacgcaataaatgaagtcggaatgcacgacgcgaccatcgcgcagatcgcccggcgggcgggcgtatcgacagggatcatcagtcactatttcaaagacaaaaatggtctgctggaggcgaccatgcgcgacatcaccagccagctgcgcgacgcggtgctcaaccgtctgcacgctctgccggacggcagcgccagccagcgcctgcaggcgattgtcggcggcaactttgatgagacgcagatcagcagcgcggcgatgaaggcctggctggccttttgggccagcagcatgcatcagccgatgctttatcggttacagcaggtcagcagccgtcgcctgctgtcgaacctggtgtacgaattccgccgcgagctgccgcgcgagcaggcgcaggaggccggctacgggctggcggcgctgatagacggcctgtggctgcgggcggcgctcagcggcaaaccgctggataaaacgctggcgcagtcgctgaccagccactttattcgtcagcatttaccgaacccataa

SEQ ID NO: 6322 - DNA, 438 bp, Klebsiella pneumoniae
tggctcatgatgtccctctgggatgcgctccggatgaatatgatgatctcatatcaggaacttgttcgcaccttccttaacatgaacaaaaaaatggtctttctggccgcttttatgctaacagcttgtagcgctaactccttacaacatggcgctgagggagtacgtataacacataacgaacctgatgcttcgtgcacctatttaggggacgtgactggtagccagggtaattttttcacgggaggatggacgtcaaatagcaacctcgagacgggggcccgaaatgatctaaaaaataaagcgtggaaaatgggggggaacgtcgtggtactgttaacccaaagagcgggtcagaccggtagcgtctatcatggcacaggttcaagccagcaaacaaacgttacattaagcggcacggtttatcggtgtcggtga

SEQ ID NO: 6323 - DNA, 654 bp, Klebsiella pneumoniae
ggagggatgatggctggcgtattgattaccggttttgagccgttcggcggcgaaacggttaacccttcatgggaagtggttaagcagctggatggcatgattattcgcggacagcaggtggtggctaaacagttaccctgcgtattcggcgaagcgctgacggtgctgaaggcggcgctggaaacctatcaaccgcggctgacgattgccgtcggacaagccggcggccgtgtcgatattaccgtcgaacgtgtagcgatcaatgtcgatgatgcgcggatccccgacaataaagggcagcaaccgatcgatgagccgatcgtcgctaatggccctgcggcctgcttcagtacgctgccgatcaaagcgatcgtcagcgcgctgcgccagcaggggatcccggcctcggtgtcgcaaaccgcgggcaccttcgtctgcaatcacgtgatgtatggtttgctgcatcagctgcagggaaaaagcgggcagaagggcggttttatccatattccgtatctgcctgaacaggcggcggcccaccccggcgaggcgagtatgtcggtcgcgacggtacgcgcggcgctggaaacggcgattgccgtcgctcttgaacaggatgacgatgtcaaaattggcggcggcgccacccattaa

SEQ ID NO: 6324 - DNA, 684 bp, Klebsiella pneumoniae
ggaattgtgattaacgttctgattatcgaagacgaacacgctatccgacgctttcttcgcaccgcgctggaagccgacggcatgcgcgtatttgaagcggaaaccctgcagcgtgggctgattgaagccgccacccgtaagcccgacctcgcgatcctcgatctcggcctgccggatggtgacggcattgattttattcgcgacctgcgtcagtggagccagatgccgattatcgtcctgtcagcgcgtagcgaagagcatgacaaaattgccgccctggatgccggcgccgatgactacttaagtaaaccctttggcatcggcgagctgcaggcccgcctgcgcgtcgcgctgcgtcgccacggcgcggcgcaggccgatgagccggtggtgcgcttcgctgacctggaggtcaatatccccgcccgccgcatcctgcgcggcagcgaagagatccacctgacgcctatcgagtttcgcctgctggcggcgctgttgaataatcccggcaaagtgcttacccagcgccagctgctgaatcaggtgtgggggcctaacgccgtggagcacagccactatctgcggatctatatgggtcatctgcgacaaaagctggaggccgatccggcacggccgcagcatttgctgaccgaaaccgggattggctatcgctttatgccctga

SEQ ID NO: 6325 - DNA, 2055 bp, Klebsiella pneumoniae
gggggtgtgatacagcagacattatgccagcaaatgacacacttttcacggcctgcggtaaattccaccgcggcgcttgtgctaaggtctttgtcagatgagccggaaacccgcgctcaaacggttattctgtacgtatttataaggagtcccatgaccagcagcctatcgcgacacccggcttttttatccctgcagggcggcatcaattttcgcgacctgggcggccagcttgccgccgacggacgccgcgtccgcagcggcaagctattgcgatccggcgcgctaaaccggttaacggcggaggatctcaaccacctcgatactttgccgctcagccgggtgctcgactatcgcgaccccggagaggtagcccgtactccggacaagcttagcccgcttacccattatctcaacgcgccggccaatccgccggtgagcgaggttaatgcgaaggtcaccgagctgaatgccgccacccttaacgcgctgaacggcgagcagtttatgctgcaactctaccgccagctgccgtttaacaacccggcctatcgccagctcgccgcctggctgaccacgccttttgaaggcgctttactgcaacactgcgcggttggcaaagatcgtaccggcgtcggctgcgcgttaacgctgttcgccgtcggctgcgacagcgaaacggtgatggaggagtatctccttacccacggcatgctgacgcaggtggaggcttggatgttggagctgctcggcaacgacctcactgcccagggggcgccaaagcctggcggatattttgacggtaaaagagtcctatctcgccgccgcgctgtcggctattcaccagcgctatggcaccgtcgacgcctggctggcggcagagtaccagcttaccgcgccggttcgcgccgcgctgcaggcccggctgctggaagagtaaccgcccgttacccgcgcggcgagcgatgcttcggccgcctgccggaccgcggcagccgaggcgacagggaaaaaaatgtgatttcgtacacatctgatttacctgttcagcggaatgcacatataatgcgctcccatctactgtctcaatcattaacaaaggcctgtgtggcgttgatttcgcacacgacattaaagactatgaaattatctacactcttagcggcagccttcgccatcgtaggcttttgcaatacagcgtctgctgtcacctatcctttgccaaccgatggcagccgtttggttggtcagaatcaggtcattaccattccggatgataacaaacagccgctggaatacttcgcggcgaaatatcagatggggctttccaacatgctggaagccaacccgggggtggatacttacctgccgaagggcggtagcgtcctgaacatccctcagcagctgattctgccggataccgtgcatgaagggatcattatcaacagcgcggaaatgcgtctgtactactacccgaaaggcaccaataccgtgatcgttctgccgatcggcatcggccagttaggtaaagatacgccgatcaactggaccaccaaagtcgaacgcaagaaggccggcccgacctggacaccgaccgccaaaatgcatgctgaatacgccgccgccggcaacccgctgcccgccgtcgtaccggccggtccggataacccgatggggctgtacgcgctgtatatcggccgtctgtacgccatccacggcaccaacgctaacttcggtatcggcctgcgcgtgagccacggctgcgtgcgtctgcgtaacgatgacatcaaattcctgtttgagaacgtgccggtcggcacccgcgtacagtttatcgatgagccggtaaaagcgaccaccgagccggacggcagccgttacatcgaggtgcacaacccgctgtcgaccaccgaagcgcagttccagggcggcgagatcgtgccgatcaccctgactcagccggtacaggcagttaccagccagtctgatgtcgatcagaacgtggttgagcaggctatccagaaccgctccggtatgccggtgcgtctgaactaa

SEQ ID NO: 6326 - DNA, 720 bp, Klebsiella pneumoniae
ctaaacgtttttttgtcaccgggaccgatactgaagtcggtaaaaccatcgccagcagcgccctgctgcaggcggctaatctgctgggttgttcacactgccggctataagccgtggccttccggtagcgagcttaccggcgatgggctgcgtaatgaagatgcgctggcgctgcagcgtcatagtcgggtcgcgttgcgttacgaccaggtgaacccctatactttcgccgagccgacctccccgcacatcatcagcgccgacgaagggcggccgatcgccgcggccaggctctccagcgggctgcgtgagctggaaggtctcgccgactgggtgttggtggaaggcgccggcggctggtttacgccgctctcggattccctgaccttcgccgactgggcgcaggcggaacagctgccggtcattctggtggtgggcgttaagctcggctgtatcaaccacgcaatgcttaccgctcaggcggtacgccaggcgggactaccgctggcggggtggatcgccaatgacgtacagccgccgggcaagcgccacgccgaatatctggcgacgctgaaaaaccgactggccgcgccgttcctcggcgaaataccgtggcttgccgacatcgcgcagcgcgacgatctcggccagtatctggacctcagggcgctggatccggcgttatccactgcgccagcagcggctcatccagcgccataa

SEQ ID NO: 6327 - DNA, 1194 bp, Klebsiella pneumoniae
ccaacatcgattatacggttcgccgatcccgtaggccgggcaaacgcaatgccgcccggcgtggttgaatgggccaaaggagctattatgtttcaccgtttatggacattaatccgcaaagagctgcagtcgctgctgcgcgagccgcagacgcgggcgattttaatcatgccggtgctgattcaggtgctgctgtttccctttgccgcgacgctggaggtgaccaacgccaccatcgccatctacaacgaggacagcggtcgccacgcggtggaactcactcagcgctttgcccgcgccaaagcctttacccacgtcctgctgctgcaaagcccgcaggcgatccagccgaccatcgatgaacaaaaagctctgctggtggtgcgcttcccggccgatttctcgcgcaatctggataactatcaaaccgccccgctgcagcttctgctcgacggacgcaactccaacagcgcgcaaatcgccgccaactatctgcaacagattgtgaaaaactatcagcaggagctgctggagggtaaagcgaagccgaacaacagcgagctggtggtgcgcaactggtacaacccgaatctcgactataaatggttcgtggtgccgtcgcttatcgccatgatcactaccatcggggtgatgatcgtcacctcgctgtcggtggctcgcgagcgcgagcagggcacccttgaccagctgctggtctcccccctcgccacctggcaaattttcgtcggcaaggcggtgccggcgctgatcgtcgccaccctgcaggcaactatcgtgctggcgattggtatctgggcctatcagatcccgtttgccggctcgctgctgctgttctatttcaccatggtgatttacggtctatcgctggtgggctttggcttattgatttcgtcgctgtgcgccacccagcagcaggcgtttatcggcgtgttcgtctttatgatgccggctattctcctgtcggggtacgtctcaccagtggaaaacatgccgcagtggctgcaggatctgacctggataaatcccatccgccactttaccgatatcaccaagcaaatttatctgaaggatgcgagtctggagattgtgtggggaagtttgtggccgctactggtcatagcggccaccaccggctcagcggcgtatgcgatgttccgaaggaagattgcgtaa

SEQ ID NO: 6328 - DNA, 585 bp, Klebsiella pneumoniae
gaagcatcgattactgtaagcaatacgaacaagggcattcccgttcttattcagtcatgggtggacgaaggggagaatagcaaagctaaggccccgtttatgattaccccaccattgtttcgtcttgagcccggccaggacaatactttgcgcgcggtttttacgggggcaaaccttgcgcaagaccgtgagtcattattctggctaaacattaagacgatcccttcagttaaaaaaaacgaggtacaggaaaatacattgcagttggcgatcaaaaaaaggctgaaatttatttatcgtccttcagctgtaaaaggcttgcctgaagaaaacgcggataaacttgtctggaaaaaaatcggtaaccagattcaggtgactaacccaacgccgttttacatgaacttcagcgtcattacggtgggcggaaagacgtttaaacccaccttgccagagcagacctatgtggcaccagcaacagaacggctatttaccattcctgcaggagcagtcggtaacactattagctggaaaataattaacgattacggtacgagtggcaaagagtttcactcaaaatattaa

SEQ ID NO: 6329 - DNA, 1059 bp, Klebsiella pneumoniae
ataaaatcgataacgataattactatcattatcatatcagggatgtcagttatgtcgttttctacgaccgcggtacgctctgtcgccgtgcccggattgttgctattactcgccttagccgccgcgcttagcctgaccatcggcgccaaatcgttgccgatcggcacggtattcaccgccttcagcggaacctgtcaaagcgctgattgcactatcgtgctggacgcgcgcctgccgcgcactctggccggtctgctggccggcgtcgccctcggcctcgccggcgcgctgatgcagacgctcacccgcaacccgctggccgaccccggcctgctgggggtcaactccggcgccagcttcgccatcgtcctcggcgcggcgctgtttgggatcacttccccgcaggagcagctgctgctggcattctgcggcgcgctctgcgcctcgctgctggtagcctttaccggcagccagggcggcggtcagctgagcccggtgcgcctcactctcgccggggtcgcccttgcggcggtactcgaggggctgtccaacggcatcgccctgctcaacccggacgtctacgatcagctacgcttctggcaggccggttcgctggatatccgcaccctgcaaacgctgaaaattgtcctgctgccggtagtggtggcggggatcgccgctctgctgctgagccgggcgctgaacagcctgagcctgggcaacgataccgccaccgccctcggcagccgcgtcgcccgcacccagctgatcggcctgatcgtcatcaccgtcctgtgcggcagcgccaccgccgtcgtcggccccatcgcctttatcggcctgatgatgccgcatatggcgcgctggctggtgggggccgatcatcgctggtcgctgccggtcaccctgctcgccaccccggccctgctgctgtttgccgacgtgattggccgcctgctggtgcccggcgaactgcgggtatcggtggtgagcgcctttctcggcgcgccggtgctgatctggctggtgcgccgccagccgcggggaggtggcctgtga

SEQ ID NO: 6330 - DNA, 1569 bp, Klebsiella pneumoniae
tcgccgtcgatatctcttcgcgcaaggccgccggggccgcgctcggcaccatcggcatcgccagctacgccggcgccggcctgggcgagtttctcaccgggatcattattgataaaacggctatccttgaaaacggcaaaacgctgtatgatttcagcacgttggcgctgttctgggtgggtaccggtctgggttccgcgctactctgttttaccactgccgccatcgtcgcccggcgccatgccgtcgaacggcagacctcgttctcctcataaccgattaacgaataaggaagaagatatgatgcctgcaagacatcaggggctgttacgcctgtttatcgcctgcgcgctgccgctgctggcgctgcaatctgccgccgccgcggactggcagctggagaaagtggtcgagctcagccgccacggtattcgtccgccgacggccggcaaccgggaagccatcgaggccgccaccggccgaccgtggaccgagtggaccacccatgacggggagctcaccggccatggctatgccgccgtggtcaacaaagggcgtgcggaaggccagcattaccgccagctcggcctgctgcaggccggatgcccgacggcggagtcgatatacgtgcgcgccagcccgctgcagcggacgcgagcgaccgcccaggcgctggtggatggcgccttccccggctgcggcgtcgctatccattatgtcagcggggatgccgatcccctgtttcagaccgacaagttcgccgccacgcaaaccgaccccgcccgccagctggcggcggtgaaagagaaggccggggatctggcgcagcgtcggcaggcgctggcgccgaccatccagctattgaaacaggcggtttgtcaggccgataagccctgcccgatcttcgataccccgtggcaggtcgagcagagcaaaagtgggaagaccaccattagcggactgagcgtgatggccaatatggtggagacgctgcgtctcggctggagtgaaaacctgcctctcagccagctggcgtggggcaagatcacccaggccaggcagatcaccgccctgctgccgctgttgacggaaaactacgatctgactaacgatgtgttgtataccgcgcaaaaacgcgggtcggtgctgctcaacgctatgctcgacggcgtcaaaccggaggcgaatccgaacgtacgctggctgctgctggtggcccatgacaccaatatcgccatggtgcgcacgctgatgaactttagctggcagctgccgggctacagccggggaaatatcccgccgggcagcagcctggtgctggagcgctggcgcaacgcgaagagcggagaacgctatctgcgggtctatttccaggcccagggcctcgacgacctgcgtcgtctgcagacgccggacgcgcagcacccgatgctgcgtcaggagtggcatcagccgggctgccgtcagaccgatgtcggtacgctgtgtcccttccaggcggctattaccgccctcggtcagcgtatcgaccgatcatccgccccggcggtagccatggtcctgccgtag

SEQ ID NO: 6331 - DNA, 519 bp, Klebsiella pneumoniae
agggatacgatcactttgcgtagtcgagacgaggcgcttagccgcctgagtatgcgtaatccgtggcatctgctggcgaccggctttggcagcggcttaagcccggtggtgccggggacgatgggctcgctggcggcgatcccgttctggtatctgatgacctttctcccctggcagctttactcgctggtggtgatgatgagcatctgtatcggcgtctatctgtgccatcgcacggccaaagatatgggcacccatgaccacggcagcatcgtctgggacgagttcgtcgggatgtggatcaccctgatggcgctgccgaccatggactggcagtgggtggccgccggcttcgtgattttccgtatcttcgatatgtggaagccgtggccaattcgctggtttgatcgcaatatccacggcggaatggggattatggtcgacgacatcgtcgccggcgtgatctccgctggcgtgctgtacgtcattggtcatcactggcccatcggtctgctttaa

SEQ ID NO: 6332 - DNA, 1827 bp, Klebsiella pneumoniae
ggattcacgatgttgaaggcatggcaccttccggttgcaccctttatcaaggtgcaacaggaccgactgtttattactctgtggttaagcggtgagtcgctgccgcagcggatcacgctgcgcgcggaagaggataacgaagagctgtcgctgccgatgcagcggctccgccaggcgccgcagccaggcgtggtggcatggcgcggcgaaatctctctcgccagcggccagccgcgccgccgctacagctttaagctgctgtgggccgaccatcagcgctggtttacgccacaaggcttcacccgattcccgccggcccgactggagcagttcgccattgacctgccggacgccggcccgcagtgggtggccgatcaggtgttctatcaaattttccccgatcgctttgcccgcagcgccgcgcgtgacgccgaccaggatgcggtctattaccatcacgcggcgggacgggagattgtgcgcaaggcgtgggacgacccgcttaccggcgaggcgggcgggtcgacgttctacggcggggatctcgacggcatcagcgaaaaacttccctacctgaagcagctcggcgtaaccgctctgtatctgaacccggttttcgccgcccccagcgtgcataaatacgataccgaggattatcggcgcgtcgatccgcagtttggcggcgacgcggcgctgctccggctgcgccacaacacccagcgggcgggaatgcgcatgatcctcgacggcgtgttcaaccataccggcgattcccatccctggttcgaccgtcaccagcagggcagcggcggcgccggccacgatccggactccccgtggcgcgactggtttaccttctcagaggaggggcaggcgcacaactggctgggctatgccagtctgccgaagctcgactatcggtcgaccagcctggtcaacgagatctatgccggtgaagacagtatcgtacgccactggctgaaggcgccatggagcatggacggctggcgtcttgacgtggtgcatatgctgggcgaaggcggcggggcgcggaataacctgcagcatatcgccggcattacccaggcagcgaagcaagcgcagccggaagcttttgtctttggcgaacattttggcgacgcgcgccagtggctgcaggcggatgccgaagacgcggcgatgaactatcgtggcttcaccttcccgatctggggattcctcgccaataccgatatctcttacgatccgcagaaaatagacgcccagacctgtatggcgtggatggataattatcgcgccgggctgtcgcatcagcagcagctgcggatgttcaaccagctcgacagccatgatacggcgcgttttaaatctcttcttggcaaagacgtagcgcgcctgccgctggcggtggtgtggctgttcagctggccgggggtaccgtgcatctactatggcgacgaggtgggcgtggatggcaataacgatccgttctgccgcaaaccgttcccgtgggatccggcgctgcaggatacccagctgctggcgctgtatcagcggatggcgaaactgcgtaaggcccaccaggcgctgcgctacggcggctgtcaggtgatttacgccgaggataacgtggtggtgtttgtccgcgtctacaaacagcagcgggtgctggtggcgattaaccgcggggaagcctgcgaggtggttatcgaagattccccgctgctgaacgtggccgggtggacgctgcaggagggcgccggcgccttccaggacggggtgctgaccctcccggccatctccgccaacgtctggtccggccgttaa

SEQ ID NO: 6333 - DNA, 2817 bp, Klebsiella pneumoniae
gggatcacgatgcagaacggcgcaatgaaagcctggctggactcttcttacctctctggttcgaaccagagctggatagaacagctctatgaagacttcttaaccgatcctgactctgttgacgccaactggcgttcaatgttccagcagttacctggcaccggagttaaaccggatcaatttcattccaaaacgcgtgattatttccgtcgactggcgaaggatgcctcacgttacacttcttcgatttccgacccagacaccaatgtgaagcaggttaaagtcctgcagctcatcaacgcataccgtttccgtggccaccagcatgcgaatctcgatccgctggggctgtggaagcaagagagagtggcggatctcgatccggcctaccacgatctgaccgaggccgatttccaggaaagctataacgtaggttcatttgccatcggtaaagacacgatgaagctgggcgagctgattgccgccctcaagcaaacctactgcggctccatcggcgcggaatacatgcatatcacctctaccgaagaaaaacgctggatccagcagcgcattgaatcggtagctggcaaagcgagctttaccgcggaagagaaaaaacgcttcctcagcgaactgaccgccgcggaaggtctggagcgctacctcggcgccaaattcccgggggcgaagcgcttctcgctggagggtggcgacgccctgatcccgatgctcaaagagatgatccgccatgcaggcaaaagcggcacccgcgaagtggtgctgggcatggcgcaccgcggccgtctcaacgtgctggtcaacgtgctgggtaaaaaaccgcaggacctgttcgacgagttcgcgggcaaacataaagaacacctcggcaccggcgacgtgaagtaccacatgggcttctcttccgatatggaaaccgaaggcggtctggtgcacctggcgctggcgtttaacccgtcgcacctcgagatcgtcagcccggtggttatcggttccgtacgcgcccgtctggatcgtctggacgagccaagcagcaacaaagttctgcctattaccatccacggcgacgccgccgtcaccggccagggcgtggttcaggaaactctgaacatgtccaaagcccgcggttacgaagtgggcggtaccgtgcgcatcgttatcaacaaccaggtgggcttcacgacctctaacccgctggatgcgcgctcgacgccgtactgcaccgacatcggtaaaatggtgcaggcgccgattttccacgtgaacgcggacgatccggaagcggtcgccttcgtcacccgtctggcgcttgatttccgcaatacctttaaacgcgatgtcttcattgatctggtgtgctaccgccgtcacggccacaacgaagccgatgagccgagcgcaacccagccgctgatgtatcagaagatcaaaaagcatccgactccgcgcaaaatctatgctgacaagctggagcaggagaaggtggcgactctggaagatgcgaccgagcaggttaacctctaccgcgatgcgctggatgccggcgaatgcgtggtgcaggaatggcgtccgatgaatatgcattcctttacctggtcgccgtacctcaaccacgagtgggacgagagctatccggataaagttgagccgaaacgtctgcaggagttggccaaacgcatcagcacggtaccggaaggtatcgaaatgcagtcccgcgtggcgaaaatttacgccgaccgccaggcgatggcggcaggcgagaagctgtttgactggggcggcgctgaaaacctggcctacgccacgctggttgacgaaggtattccggttcgtctgtccggcgaagactccggccgcggcaccttcttccaccgtcatgcggtgatccataaccaaaccaatggttcaacgtacacgccgctgcagcatgtccataacggccagggccagttccgcgtttgggactcggtgctgtccgaagaagcggtgctggcgttcgaatatggttacgccaccgccgagccgcgcactctgaccatctgggaagcgcagtttggcgacttcgccaacggcgcgcaggtggtgatcgaccagttcatctcctccggtgagcagaagtggggaaggatgtgcggcctggtgatgctcctgccgcacggttacgaaggccagggcccggagcactcctccgcgcgtctggagcgttatctgcagctgtgcgctgaacaaaacatgcaggtctgcgtgccgtccacgccggcacaggtttatcacatgctgcgtcgccaggcgctgcgcggtatgcgtcgtccgctggtggtgatgtcgccgaagtcgctgctgcgtcatccgctggcggtctccagcatggatgagctggcgaacggcactttcctgccggctattggtgaaatcgatcaacttgatccgcaggctgtgaagcgcgttgtgctgtgctctggtaaggtttactacgacctgctggaacagcgccgcaaaaacgagcaaaaagatgtcgctatcgttcgtatcgagcagctctatccgttcccgcatcaggcggtgcaggaagcgctgaaagcgtatgcgcacgtgcatgattttgtctggtgccaggaagagccgctcaaccagggcgcatggtactgcagccagcatcacttccgtgaagtgattccgtttggggcctctctgcgttatgcaggccgcccggcctccgcctctccggcggtagggtatatgtccgttcaccagaaacagcaacaagatctggtcaatgacgcgctgaacgtcgattaa

SEQ ID NO: 6334 - DNA, 1383 bp, Klebsiella pneumoniae
aaaaccacgatggaaagtagtaacaagcttaagcgcgggctaagcacccggcacattcgctttatggccctgggttccgccatcggcaccgggcttttttacggctcggccgacgccattaaaatggccggacccagcgtactgttggcctacattatcggcggcgtcgcggcatatatcattatgcgggcgctcggtgagatgtcggtgcataaccctgccgccagctcattctcccgctatgcccaggaaaacctcggcggactggcgggctatatcaccggctggacctactgctttgaaatcctgatcgtcgccatcgccgacgttaccgccttcggcatctacatgggcgtctggttcccgacggtgccgcactggatctgggtgctcagcgtggtgctgatcatctgcgccgtcaacctgatgagcgtcaaggtgtttggtgagctggagttctggttctcgttcttcaaagtggccaccattatcatcatgatcctcgccgggttcggcatcattatctgggggatcggcaacggcggccagccgacggggattcataacctgtggagcaacggcggcttcttcagcaacggctggctgggaatggtgatgtcgctgcagatggtgatgttcgcttacggcggcatcgaaatcatcggcattaccgccggtgaggcgaaggacccggagaaatccattccgcgcgccatcaactcggtgccgatgcgcattctggtgttctacgtcggcacgctgttcgtcattatgtccatctacccgtggaatcaggtgggaaccgacggcagccccttcgtcctgaccttccagcatctgggcattaccttcgcggccagtattcttaacttcgtggtcctgacggcttcgctgtcggcgattaactccgacgtgttcggcgtgggccgtatgctgcacggcatggctgagcagggcagcgcgccgaaggtgttcgctaaaacgtcgcgtcgcggtattccgtgggtgacggtgatggtgatgaccattgcgctgctgtttgcggtatacctaaattacatcatgccggagaacgttttcctggtgatcgcctccctggccaccttcgccacggtgtgggtgtggattatgatcctgctgtcacagatagccttccgccgccgtctgtcgcccgaagaggttaaggcgctgaaattcaaagtccctggcggggtggtgaccacggtgatcggcctgctgttcctggcctttattatcgcccttatcggctatcatccggacacccgcatctcgctgtacgtcggtatggcatggattgcgctgttgctgctcggctgggtctttaagacccgccgtgagcgccgcctggcgcaggctcagtaa

SEQ ID NO: 6335 - DNA, 858 bp, Klebsiella pneumoniae
ccggcaacgattcacatcttccgccgggcctggtgcccggctcagcgaaagggaaaaaatatgcaacgagatttccagaacaaaacggtggtgatcaccggcgcctgccgcggcatcggcgcaggcattgccgagcgctttgcccgcgacggcgcaaacctggtgatggtctccaacgccgagcgcgttcacgagaccgccgaaaccctgcgtcagcgctatcaggcggatattttatcgctgcaggtcgatgtgaccgacgaagcgcaggtgcagtcgctgtatgagcaggccgccgcccgcttcggcaccatcgacgtctccattcagaacgccggggtgatcaccatcgattactacgaccggatgccaaaagccgatttcgaaaaagtgctggcggtcaacaccaccggcgtgtggctgtgctgccgcgaggcggccaaatatatggtgaaacagaatcacggcagcctgatcaatacctcttccggccaggggcgacagggctttatctacacgccgcattatgccgccagcaaaatgggcgtgatcggcattacccaaagcctggcgcacgagctggcgccgtggaatatcaccgtcaacgccttctgcccgggcattattgaaagcgaaatgtgggattacaacgatcgcgtgtggggcgaaattctcagcaccgagcagaagcgctacggcaagggcgaactgatggccgagtgggtcgagggcattccgatgaaacgcgccggtaaaccggaagacgtggccgggctggtggccttcctcgcctccgacgacgcgcgctatctcaccgggcagaccatcaatatcgatggcggtttgattatgtcgtaa

SEQ ID NO: 6336 - DNA, 2061 bp, Klebsiella pneumoniae
tcctcgacgatgccttatcggcggtggatggccgcaccgagcaccagatcctgcataacctgcgccagtggggggaggggcggacggtcattatcagcgcccaccgcctgtcggcgctcaccgaggccagtgaaattttggtactgcagcatgggcatattgcccagcgcggccgccacgaggcgctggccgtgcagcccggctggtaccgcgacatgtatcgatatcagcagctggaggccgcgctcgacgaggttccgcagacgcaagaggaggccctggatgcgtagctttaccgaactctggccgacgcttaaacgcctgctggcctatggttcaccgtggcgcaagccgttggccatcgcggtggcgatgatgtggattgcggcggcggcggaagtgagcggcccgctgcttatcagctatttcatcgacaacatggtggcgaaacatacgctgccgctgaagctggtggccggcctggcggtagcctatatcggcctgcagctgctggcggcgctcctgcactataaccagtcgctgctgtttaaccgcgccgcggtcggcgtcgtccagcagttgcgcagcgacgtgatggatgccgccctgcatcagccgctcagcgagtttgatacccagccggttgggcagcttatctcacgggtaaccaacgatacggaagtcattcgcgatctgtacgtgacggtggtggctacggtactgcgcagcgcagcgctgatcggcgcgatgctggtggcgatgtttagcctcgactggcggatggcgctggtggcgatcgcgattttcccggcggtgctgatcgtgatgattatctatcagcgctatagcacgccgatcgtgcggcgggtgcgcgcctggcttgccgacatcaacgatggcttcaacgaagtgatcaacggcatgggcgtcatccagcagttccgccagcaggcgcgctttggcgaacggatgcgcgaggccagctatgcccactatctggcgcggatgcagacgctgcgcctggacggttttctgctgcgcccgctgctgagccttttttcctcgctggtgctgtgcgggctgctgatgctgttcggctttagcgccgtgggcacgatcgaggttgggttcctgtacgcgtttatcagttttcttggacgccttaacgagccgcttatcgagctgaccacccagcagtcgatgctgcagcaggcggtggtcgccggcgagcgcgttttcgagctgatggatcgcccgcgccaggcgtggggcgccgatgacgcgccgctgagcagcggtcgggtggaaattgaccatctctcctttgcttaccggggggaccgtctggttctccaggatatcacgctggatattccctcccgcagcttcgtggcgctggtcggacataccggcagcggaaaaagtaccctcgccagtctgatgatgggctattacccgttaacccacggcgagatccgcatcgatggtcgaccgctcgcatccctcagccacagcgcgttgcgtcggggcatcgcgatggtgcaacaggatcccgtagtgctggcggataccttttacgccaacgtcgcgctgggccggggcatcagtgaggcgcaggtttgggaagcgctggaggcggtgcagctggcggcggtggcgcgcagcatgagcgatgggctgtacacccaactgggcgagcagggcaataatctctccgtcgggcagaagcagctactggcgctggctcgcgtgctggtggacaccccgcaggtactgattttggatgaggcgacggcaaacatcgactccggtaccgagcaggcgatccagcaggcgctggcgaaggtccgccagcataccaccctcgtggttattgcccatcggctgtcgaccattgtggaggccgataccatcctggttctgcatcgaggtcaggctgtcgagcggggcacccatcagcagctgctggcggcgaaaggccgctactggcagatgtatcagctgcagctggccggcgaagagctggcggccagcgccagagaggagtcgctcagcgcctga

SEQ ID NO: 6337 - DNA, 231 bp, Klebsiella pneumoniae
catcgcgttttacgacaggagtttgatatgcaattcagtaaccccttcgacaatccgcaagggcagttttacattctgcgcaatgatcagcagcagtacagcctgtggccggcgcactgcgacctgcctgccggctgggcggtggtgtgccccccgcagtcggccgaggcctgcaacgcctggctggcggccaactggtcaaccctgacccccgcccatcatgcgtcataa

SEQ ID NO: 6338 - DNA, 210 bp, Klebsiella pneumoniae
acccaggcgattcgcttcccgacagaggagaaaacgaaagtggcattgtggcaacggttaacgggctggctggcttttttgtccaacggtgaagccggacagcaggatacccagcgcgtcatggaggcgatcctgccggtagccagcctctacggcgtggacattggcaacgtggaaacccggtggttccgtcatgataagacatactga

SEQ ID NO: 6339 - DNA, 1308 bp, Klebsiella pneumoniae
ggtaacaagatgcaagtttcagttgaaaccactcagggccttgggcgccgtgtaacgattactatcgccgctgacagcatcgagaatgctgtcaaaagcgagctggtcaacgtagcgaaaaaagttcgcattgacggcttccgtaaaggcaaagtgccgatgaatattgttgctcagcgctatggcgcttccgttcgccaggacgtgctgggcgacctgatgagccgtcatttcgttgacgcgatcatcaaagaaaaaatcaatccggccggcgcgccgaactacgttccgggcgaatacaaactgggcgaagacttcacctacgcggtagagttcgaagtgtatccggaagttgaactgcagggtctggacgcgatcgaagttgaaaaaccggttgttgaagtcaccgacgctgacgttgataccatgctggaaactctgcgcaagcagcaggcgacctggaaagaaaaagaaggcgcggttgacgctgaagatcgcgtaaccatcgacttcaccggttctgttgacggcgaagagttcgaaggcggcaaagcctctgacttcgtactggcgatgggccagggtcgcatgatcccgggcttcgaagacggtatcaaaggccacaaagcgggtgaagagttcaccatcgacgtgaccttcccggaagagtaccacgcagaaaacctgaaaggtaaagcggctaagttcgttatcaacctgaagaaagtcgaagagcgtgaactgcctgagctgaccgaagagttcatcaaacgtttcggcgtggaagatggttccgtcgctggcctgcgcgctgaagtgcgtaaaaatatggaacgcgagctgaaaggcgctgtgcgtaaccgcgtgaagtctcaggctatcgaaggtctggttaaagccaacgagatcgacgttccggctgccctgatcgacagcgaaatcgacgtgctgcgtcgtcaggctgctcagcgtttcggcggcaacgagaaacaggctctggaactgccgcgcgagctgttcgaagagcaggctaaacgtcgcgtcgttgttggtctgctgctgggcgaagtgatccgcaccaacgagctgaaagctgacgaagagcgcgtaaaagccctgatcgaagagatggcttctgcgtacgaagatccgtctgaagtcgttgagttctacagcaagaacaaagagctgatggacaacatgcgcaacgtggcgctggaagagcaggctgttgaagccgtgctggcgaaagccaaagtgtctgaaaaagccacttccttcaacgaactgatgaaccagcaggcgtaa

SEQ ID NO: 6340 - DNA, 558 bp, Klebsiella pneumoniae
tcccctgagatatttactgggcatgaaaatttccgaactcaaggcggtgggaaaaaagttgaaaaaaacgtggctgataaacgcaccgcatctttatggtgtcaggccatcagggaagccgcaactccctatacctcttcggaaattctactggatgtcgataaagagtttggaaccaacacaaaatcattatggggtaagatcttcgatttgctgcccatatatgcgattttcaaagccgacagggaaagtagcgatggggattccgaagctaaaaaaacctccttacagcaggccgtaaaagacgctcaggctgcgctgcaggacaaaattacagcacttgaaaaggatattcaggatagtgttcttgatgtcgcacagagaacgctggataaattacgtgaaatggcaccagaacttgccagtgaacttactccgcgatttaaggagtggagtgaccacgctccggtagacagtttctgtcctcacggcgaggccttttcgaaggcctccgggctgacgccaccgaggtggctgtggcgtcggttacggttgtag

SEQ ID NO: 6341 - DNA, 966 bp, Klebsiella pneumoniae
gcccaggagataacaatgctcgacaccaacatgaaaacccagctcaaggcctaccttgagaagctgaccaagcctgttgagctgattgccacgctggatgacagcgctaaatcggcagaaatcaaggaactgttggctgaaatcgctgaactgtcagacaaagtcacctttaaagaagacaacacgctcgcggtacgtaagccctcgttcctgattactaacccaggttccgaccaggggccgcgttttgcgggctcgccgctgggccacgagtttacctcgctggtgctggcgctgctgtggaccggcggtcatccgtcgaaagaggcccagtcgctgctggagcagatccgcgatattgatggcgatttcgaattcgaaacctactattcgctctcctgtcataactgcccggacgtggtccaggccctgaacctgatggcggtgctcaacccgcgcatcaaacacacggcgattgacggcgggaccttccagaatgagatcaccgagcgtaacgtcatgggcgtgccagcggtgttcatgaacggtcaggagtttggtcagggacggatgacgctgactgaaatcgtcgccaaagtggataccggtgcggaaaaacgcgcagcggaagagctgaatcagcgtgacgcttacgatgtactgatcgttggctccggcccgtccggcgcggcgggggcggtctactctgcacgtaaagggattcttaccggcctgatgggcgaacgcttcggcggtcaggtgctggataccgtggatatcgaaaactatatttcggtgccgaaaaccgaaggccagaagctggcaggcgcgctgaaagcgcacgtcaatgactataacgtcgacgtgatcgactcccagagtgcgaccaaactgacgccggcggcgacagagggcggcctgcatcagatcgaaaccgcttcggggcgcggtgctcaaggcgcgtag

SEQ ID NO: 6342 - DNA, 261 bp, Klebsiella pneumoniae
ggaggatggatatgggctttcatgctgacctcttcattacgttataacataacgttaagggtacgccgtgctgtgacaaagatcaaccctgctcaatttaagagtaaggtgataaggcgagtttccccgcctttggcgtcagggtgccagacggtgggcgatggcgcggagctgttccgcaatggcctgcagatcttttccctgctcgattcgggcgccgctggaatggcgtatcaccaggcgcgccggcagaatggatga

SEQ ID NO: 6343 - DNA, 231 bp, Klebsiella pneumoniae
cggaggtggatcatgcgtaataactgcctccctacagcgatcgctgagaagccttatctgctcgatgaactcacctacgaaacagaatgtgtgttggcaatcctaagaacaattaatgatgtcagcgatccacacaccaaaagccacctcgtagactccgccgaacttattggtactcagttgttgaaaaagctagagcataacgcacgtctggaagatggtgattgctaa

SEQ ID NO: 6344 - DNA, 714 bp, Klebsiella pneumoniae
acgttacggatttaccacccgctgatgtttctgagcgaacccgaatggcaggcggtgctgctgagcctgaaagtctcctccctggcggtggccttgagcctgccctttggcatctttttttcctggctgctggtccggcgcacctttcccggcaaggccctgctcgacagtattctccatctgccgctggtgctgcctccggtggtggtggggtacctgctgctggtggccatggggcggcgagggtttattggcagctggctgtatgactggttcggcatcagctttgcttttagctggcgcggggcggtgctggcggcggcggtgatgtctttcccgctgatggtgcgcgccattcgcctggcgctggaaggggtggacgtcaaactggagcaagcggcgagaaccctcggggccagccgctggcgggtatttttgaccattacgttgccgttgactctgccggggattattgtcggcacggtgctggccttcgcccgctcgttaggggagtttggcgcgaccatcacgttcgtttccaatattcccggtgaaacgcgcaccctcccttcggcgatgtacaccttgattcaaaccccgggcggggagggggcggcggcccgcctctgcctcatcgccatcggtctggcgctggtttcgctgctgatttcggaatggctggcccgcgtgagccgccagcgcatgggaggataa

SEQ ID NO: 6345 - DNA, 714 bp, Klebsiella pneumoniae
ttacccaggataacgccgataaagtccaggatttcaacattaagtcctgagttcgggtggttgcgcccctgcgggggcgcagaggagagcattatgtttaagaaaacctgtctgacgctggccgtactggcgctagggggctgtcgcatcgtctcgcagcaggagctggcagacctgaaatccccgcccaacccgcatatggcgaatatggataaaacctggcagcagagcatcgtaccgcaggtggtgacgaaagcgcgtccggcggcggaactgatgagcgcgctcaaggcggcaaaagacattgatagcgcctgtaaaaccctcggctaccgtgcgcaggatgaaaacccctgcatcttctacgtcaaggtttcaggtaccgtcagcaaactcgataccgcctcgcgcagcggcaaaatgaccttgaccgaagccagcgtcgggaaggtgacggtgcagattggccctaccctgcgcggcacccagctgcgcgacggctacagcggcgccagctatcaggactttaatgaccaggtgctgttcggcgagtacagcaagaatatcaacagtcaggcggtcaaaatgattcagacagccaacgtcaaaaccggcgacagcgtggaggtgtacggcgtcttctcggcctgggatattccacaaactctcccggaaattaccccggcgaaaatcattcatgcagggggacaataa

SEQ ID NO: 6346 - DNA, 936 bp, Klebsiella pneumoniae
attaacaggattactatgtcaaatttacccaaattttcccgcgcgctgttgcacccgcgttactggctgttgtggctgggaattggctttttgtggctgctggtgcaattaccgtatccggtgatctaccgtctgggaacggcgcttgggcggctggcaatgcgggtgatgaaaagccgcgcgcggattgccagacgtaatctcgaactctgctttcccgagatgagcgccgccgaccgcgaggcgctgctggtgaaaaactttgaatcgctgggcatggggctgatggagaccggcatggcctggttctggccgacgcaccgggtagcgcgctggaccgagaccagtggcgttaacgaggtggtggagcttctggaagaaaagcagggcattttactgatcggtatccattttctgaccctcgaaatgggtgcgcgaatgtacggcatgtttaccccaggcattggcgtctaccgtcctaacgataacccgctgattgactggctgcaaacctggggacgcttgcgctctaacaagaccatgttggatcgaaaaaatctgaaagggatggtcagggcgctaaaagagggggaaattctctggtacgcgccggatcatgactacggtccggccagcagcgtcttcgccccgctgtttgccgtcgaacaggcggcgaccaccaccggtacctggatgctggcgaaaatgtccggggcgacgattgtgccgtttgttccgcggcgcaagcccaacggcatggggtatgaattgatctccctgacgccggagcgcacgccgccgctggcgagcgccgaggttacggcggcctggatgaatcagattatcgaacagtgcatcctgatggcgcccgagcaatacatgtggctgcaccggcgctttaagacccgcccggaaggagtaccgccgcgttactga

SEQ ID NO: 6347 - DNA, 1617 bp, Klebsiella pneumoniae
gaggcaaggatgattgcatttacccgttggccggaagagtttgcggcccgctatcgtcaaaaaggctactggcaggatctgccgttaaccaatctgatcacccgtcacgcggaaaacgacgccgtggcgattatcgatggcgagcgacagattagctaccgccagtttaaccagctggtggacaacctcgcctgctcgctgcagcgccagggactgaagcgcggggagaccgcgctggtgcagttgggcaatgtcgccgagttttacatgaccttctttgcgctgctgcgcatcggcgtcgcgccagtgaacgctttgttcagccaccagcgcagcgaacttaacgcctacgccgcgcagattaaaccggcgctgctgattgccgatcgcgagcatgcgctgtttgctgacgatagctttctccacgcgtttatcgcggaacatccttccctgcgcgtcgcactgttgcgtaacgacggcggcgagcgcgatctggcgacggagattaaccgcccggcggataactttatcgccaatccaacccctgccgacgaagtggcctttttccagctctccggcggcagcaccgggacgccgaagcttatcccacgcacccataacgattacgactacagtatccgccgcagcaacgagatctgtgggattaacgctgaaacgcgctacctcaacgcgctgccggcggcgcataactatgcgatgagttccccggggtcgctcggcgtcttcctcgccggcgggcgggtgatcctcgccgccgacccgagcgccacgctctgtttcccgctgattgaacaacatcagatcaacgttgcctcgctggtgccgccggcggtcagcctgtggctgcaggcgattcacgaatggggcagcaacgcccagttgcaatcgctgcagctgttgcaggtcggcggcgcgcgcctgtcagcgaccctcgccgcgcgcattccggcggaaatcggctgccagctgcagcaggtgttcggcatggcggaggggctggtgaattacacccgccttaacgatagcccggagcggatcatcaatacccagggctgtccgatgtgcccggacgatgaagtgtgggtagcggatgccgacggcaacccgctgccgcgcggcgaagtgggccgcctgatgacccgcgggccgtacactttccgcggctactacaacagcccgcagcataacgcggaagcctttgacgccgaggggttttattgctccggcgatctgatttcgatcgacgaagatgggtatatcaccgtccagggccgggaaaaagatcagatcaaccgcggcggcgagaagatcgccgctgaagagatcgaaaacctgctgctgcgccatgaggcggtgatccacgccgcgctggtcagcatcgaagacaatctgctgggcgagaaaagctgcgcttatctggtggtgacctcgccgctgcgcgccgtcgccgtgcgccgcttcctgcgcgagcagggggtggcggaatttaaactgccggaccgcgtggagtgcgttgccgcgctgccgctgacgccggtgggcaaagtcgataaaaaacaattacgtcagtggctggccgaaggcaagctgggctga

SEQ ID NO: 6348 - DNA, 402 bp, Klebsiella pneumoniae
  unsure (348): Identity of nucleotide at the above locations are unknown.
ttttcgaggattaatatggctaagcaggatgaacaacggctattggttaagattgccacgctttactatctggaaggacgaaagcagtctgatatcgcccaacttctctcgctgtctcagtcatttgtctcccgcgccattacccgctgccagaaagaaggcgtcgtcaagatcagcgtcgttcagccgtccaacatctttctgaagctggaaaaagggcttgaggatcgctacggccttaagcaggcggtggtggtggataccgaggaagaggccagcgatcataacatcaagcgggcgattggctccgccgccgcccactatctggaaacccggctgcggccaaanagatctgattggcgtctcctcgtggagctcaaccattcgcgcgatggtcgatga

SEQ ID NO: 6349 - DNA, 330 bp, Klebsiella pneumoniae
gtgacgaggatcagggtggtgccgtgttcgcgattaagcgagaacagcagatcggcaattttgtccccggtctggcgatcgaggttgccggtgggctcatcggcgaacagaatggccgggcgcccgttaaaggcccgggccagcgccaccctctgctgttcgccgccggagagctgcgccggcaggtggtgcaggcgtttgccaagtcccagctgctcaagcagcgcgcgggcatcgccccggctctggctatcgctggcgccgcgcaacagcgccggcagctcgacgttctccagggcgttgagcgtcgggatcagcataaacgactga

SEQ ID NO: 6350 - DNA, 960 bp, Klebsiella pneumoniae
gagaagaggatggcagcgaagaagacgaagccaccgattctaccgcgtaactatcaggacccgaccggagctgatgcgctggaacgccgggcgatgaaagacttcgccaggcggatgaataagattggcaaagcgtacaaagcagcactcgacaaaataccttcctctctcgcagtaaacgccagatacgaataccagctaaacccaacgctactctccatcatcctgaatgatgccagttatctggttgatcaggtgcttctggatggtaacgagtacaacctgtggttttatgagtatgtcgatttggcgtcagagaaaggcacaggacagtcgttctacaacctcagccagcagtcgccggtttacgccgccggacgtgagtccctggcatccatccttgcaagcgacccgtaccagcaacgaatggcgttggtgcatgcccgtgtgtttgaggaaatgaaggggctgagcgcggacgttaaacgcgacatggcgcgagtgctgactgatggtgtgggccgcggccttaatccccgcgacattgcccgcaacctcacagaacagacgggcatcgagaagcgtcgggctaaccgtatagcccgcactgaagtcactaccgcgctgcgccgggctagatgggatgaagcggagtcatcaatggatgatctcggcttaaacatcaggcttctccacctttccgcattaagccccacaacgcgaataaagcacgccctgagacacgcgcatacatacacagtccaggaggtcaggtactggtatgccgttgatgcgaactcaataaactgcaaatgcagccaggtggaagtgcttgttgatgcggatggtaagccgctttatccgaacgtcatcgaaatggctaagaaggaattcgacagtcattggaaaaagatgaaggtcaatcattcagtttgtcactgctgcaaaaaggcagcttga

SEQ ID NO: 6351 - DNA, 1575 bp, Klebsiella pneumoniae
acagttgggatacggcgagctgcagtgattaatcaacatcctggcggggaacgccccgccgctggtctggtcatggagcagatcggtaaacgttttgccagcgtcaccgcgcttaatgcggttaccctgcgcctcaatccgggggagattcatggcctgattggcgagaacggcgccggtaaatcgacgctgatcaagatcctcgccggtgtctatcaggccgacagcggcagcgccaccctcgacggtcacccgctgcccctcggcaatccggcagccatcgaagccgccggcatccgcgttatccaccaggagctgaacctgatcccgcactttaccgtcgcggaatcggtgtttctgggccaggagtatcgcacccgctggggggcgctggatcgccgacggatgaaggccgccacggcgcaatttttccagcaaaactggcagctggcgatcgaccccgaacggttggtgcgcgacctgagcctggccgagcgcaagctggtacaaattgcccgcgcgctgatcgacggcgcagcgcggctggtggtgttcgacgaacccaccgcccccctggaggcgcaggaggccagtctggtctcctccgctatcctgcgcctgcgcgaccagggcattgccattctgtatatttcccactacctcaatgagatagccaccctctgcgaccgcggcaccgtgctgcgcaacggggaagtggtcggctacccggaccgtgacctgctgcagaataccgaagcgctgatcgccatgatggtcggccgggaaatcgaccagctgtatactccgcgccagcgcccggcggcagacaatggggcgaccccgctgctctcggtgcgccagctgagcgacgggcggcagctgcaggatctttcttttgatattcagccgggcgaaatcgtcggcgtcgccggcctgctgggcgccggacgcgatgtgctggtcgacttactctacggcttacgcccggcggaacgcggcaccatccacctcgagggccggccgcggcgcattcgtacgccgaagcaggcgatccgcgccggcatggcgctggtgccacgcgaccgccgccatcaggggctgatcctgcccttcaccaccgccgacaatattaatctcgcctcgctgccggagaccgccacctttggctgggagcggcggggtatcgccgagcagaaagcgcgcgactggatagaacagctggcaatccgcccgggacgcccggggctgccggtacgctacatgagcggcggtaatcagcaaaaagcgatcctcgcccgctggctggggaccgatgcccggctgtttattctcgatgaacccaccctgggggtcgatatcggcgcccgccgggatatttatcaacgtacgcgccagctggccgatcaaggacgggcggtgctggtctcctccagcgacgcccccgaactgctcggactatgcgaccggatcctggtcctctggcgcggcgcgctggcggccaatctgcccacccgcgggctaacgctggacgccctactggtggcgatcaacggcggacaggagccttcaccatga

SEQ ID NO: 6352 - DNA, 417 bp, Klebsiella pneumoniae
cggcatgggattgccgtattctccgtcgtcacgcgtaatttcttcttctccacgcctgctctgacgagcaggcttttttttatcttaaacctggagtttattatggtgagtttaaaatccttcctgcactatttctccccagcgcgtccggcacagccattaagcgaggcggaaaaacagcaaatcgaggcgcttattcaggcctttggtggcgaagcgaatattacgcaagtggacgcctgtattacccgtctgcgggttagcgttcgccatcttgcggccgtggactccgaagcattacagcagcagggcgcgctaggggttattattcttggtcagcaggtgcatgctattttcggtaaacagtccgatgcgctgcgtcagcttctggatgaacattttgccgcccggaaataa

SEQ ID NO: 6353 - DNA, 3102 bp, Klebsiella pneumoniae
ggagaagggatgctgaccttttttatccgtcgtccgcgatttgccatggtgatcgcgctgctgctgacctttgtcggcgcggtgtcgctgaagctgatcccggtggagcagtacccggcgatcacccccccggtggtgaacgtcagcgccagctggccgggcgccagcgcgtcagacgtggcggaagccatcgccgccccgctggagacccagctcaacggcgtcgatcatatgctgtatatggagtccaccagctcggatgaggggacgtaccgcctgagcataaccttcgcggcgggcaccgatgccgacctggcggcgatcgacgtgcaaaaccgggtggcgcagacgctggcgcagctcccggcggaggtgcagcagaatggcgtccaggtgcgcaagcgcgccagcaatctgcttatgggggtaagcctctactcgccgctgggcacgctgtcgccgctgtttgtcagcaactacgccagcacccaggtgcgcgaggcgctggcccgcctgcccggcgtcggcgaggtgcagatgtttggcgcccgggattacagcatgcgtatctggctgcgcccggaccgcatgaacgcgctcaacatcaccacggatgatgtcgcccaggcgctgcgcgagcagaatgtgcagggcgcggcggggcaggtgggcaccccgccggtatttaacggccagcagcagacgctgaccatcaacgggctggggcgtctgaacgaggcggccagctttggcgagattattatccgccgcggcgcgcaggggcagctggtgcgcctcgccgacgtggcgaccattgagctgggcgcccgcagctacagctccggcgcccagctgaacggtaaagcgtcggcctatctggggatctatccgacgcccaccgccaacgccctgcaggtcgccagcgcagtgcgtgcggagcttaaccgcctgcacactcgctttccggcggatctcacctgggaggtgaagttcgataccacccgctttgtggcggcgacgatcaaagagatcggcgtctcgctggcgctgaccctgctggcggtggtcgtggtggtgtcgctgtttttgcagagctggcgggcgacgctgatcgtagtgctggcgatcccggtgtcactgatcggcacctttgcggtgctctatctgctgggctacagcgccaacaccctcagcctgttcgcgatcattctcgccctgacgatggtggtggatgacgccattgtggtggtggagaatgtggaaaccaaaatggcggaagggctggatcgcctgcaggccaccgcccaggcgctgcggcagatcgccgggccggtgatcgccacgaccctggtgctgctggcggtgtttgtgccggtggcgctgctcccggggatcgtcggcgagctgtaccggcagtttgccgtgacgctttccaccgcggtggccctgtcgagcctggtggcgttaaccctgactccggccctctgcgcgctgctgctgcgcccgcgtcccgcccggccggcggcggtgtggcgggcgtttaaccgtcttctcgacggcacccgcgacggctatggccggctggtaggctggatgaaccgccgtccctggctggcgctggcggcgacggtggcggcaggcgcgctggtggcgttcagcttcacctcgatgccgaaaggcttcctgccgcaggaagatcagggttacctgtttgccagcgtgcagctgccggaggcggcgtcgctggagcgtaccgaagcggtgatggcccaggcgcgcaagctgctgatggctaacccggcggtggaggatgtgattcaggtgtccgggttcaacattctcaacggcaccagcgcctctaacggcgggtttatctcggtaatgctcaaggactggcatcagcggccgccgctggatgcggtgatggcggatattcagcgccagctgctgtcgctacccgaggcgacgatcatgaccttcgcaccgccgaccctgccgggcctgggcaatgcctcggggtttgatctgcgcatcctggcgcaggccggtcagtcgtcggcggagctggagcaggtgacgcgggagatcctccagctggcgaaccagcattcgcagctgagccgggtgtttaccacctggagcagcaacgtgccgcagctgaccctgacggtcgaccgcgaccgggcggcgctgctggatgtgccggtggcgcagatcttcagcagcctgcagacggcgttcggcggcacgcgcgccggcgatttcagccgtaacaatcgtgtctatcatgtggtgatgcaaaatgagatgcagtggcgtgagcgggctgagcagattagcgagctgtacgtccgcagccgcgacggcgagcgggtgcggctgagcaatctggtcaccattacgccgacggtgggggcgccgtttattcagcagtacaatcaattcccgtccgtgtcggtgagcggttcagcggccgagggggtcagcagccgcacggcgatggcggccatggagcagattttgcaggcccatctgccgccgggatatgactatgcctggagcgggatctcctggcaggagcagcagaccggcaatcaggcggtgtggatcgtgctggcggcggtggcgatggcgtggctgttcctggtggcgcagtatgagagctggacgctgccggcgagcgtcatgctctcggtgctgttcgccatcggcggagcgctgctctggctgtggaccgcgggctatgccaacgatgtgtatgttcagatagggctggtgctgctgatcgccctggcggcgaagaatgcgattctgatcgttgagttcgcccgcagccggcgcgaggaggggctgtcgatagtcgacgctgcgcgcgagggggctacccgccgcttccgcgcggtaatgatgaccgcggtgtcgtttattatcggtatcatgccgatgatgctcgccaccggcgccggggcgcagagccggcggatcatcggcaccacggtattcagcgggatgctggtggcgacgatggttggcatcctgtttatcccgtcgctgtatgtactgtttcagcgtatgcgcgagtgggcgcatcggcgggggtaa

SEQ ID NO: 6354 - DNA, 663 bp, Klebsiella pneumoniae
gtccgggggatgctgtacgggaagtcgcacgcagaatggatacatttgcgtcattactcagcacaaaatcgttactggggggagaaaatgtttaacccaattcaacctccctgctcgcctgcagttcgcgctgtatccatatattgcggctgtaatcacattgcagggactatacgcaaaaaacagttgcgagagcctggctccttagtctatgttgaaaaggcaccagcaaaatctggtgccgggattggcgtcctgataacctgtatagtgccgacacgcactaagcgtgtttttttgtcggcaaaattcctgcacacccaaattatggtgggctggatgaggcttccgaaaggaaggccggtgtctatacaggccggttacgccaaccttgttcagctcaccaccagtctgagattggcgtctcatggtggtgaatttacgattcactgtatagaggctgccactatggctactacccctacccaaaatccacaatttatctggatcatcgctgctatacgccgcgatatcgaatccgtcactgtaaaaatcttccacgttaccgcggtctctgaacgcgaagcccgtcgcactttagtgcgtgatcatgtttgttttttcgctggccgcatccgtctgacggaggtggatcatgcgtaa

SEQ ID NO: 6355 - DNA, 1455 bp, Klebsiella pneumoniae
tggccagttttggaaaagtggatcgctatgtcagcccgacgctttggaacccaatcgctggtacgcctgctcggcaactggcaggagaccagctcacgcacgccgctatggcgccagctggcggaagcgctccgcctgctgatccttgatggtcgcctgacgctgcaaacgcgcctgcccggcgagcgcgagctggcggcggccctgaacgtcagccggaccaccatcgccagcgccctcggccagttgcgggaggagggctttctctacagccgccaggggagcgggtcacgcattgttttgccggaacgccccgccgatcttcctctgcctgccggtatctcatctacgcttaatctctctaccgccgccctcagcgccgggccggaggtccatcaggccttccagcacgctatgaccctgctgccgccctatctcgcacagactggctatgaccagcaggggctgccggtgctgcgggaggcgattgcccggcgctacagcgaacgcggtctgccgacgcggcccgatgaggtgatggtggtcaacggcgccctcagcgccttcgcgctgatcctgcgcctgttcaccgggccgggcgatcgggtggttattgacgctccaacctatccgatggccatcagcgccattcagggcgcctcctgccgccccgtcggggttgcgcttccgcagcagggatgggactgcgatggactggcggcgactattgcgcagactgcgccgcggctggcgtggctgatgccggattttcacaaccccaccggacgctgtatggatgcccccacccgccagcgggtcgcggacatcgccgccaggacgcgaacaacgctggtaatcgacgagaccatggccgacctttggtataacgcgccgccgcccccgccgctggccagctttaatcccgatgccgcggtgctcaccattggttcggccgggaaaagcttctgggggggactacgtatcggctggatccgcgccagcgcgcggaccatcgcctcgcttattcaggcccgcgattcgctggatttgggtacgccgctgctggagcaactggcctgcagctggctactggaaaatgccgccacactgctgccgtcgcggcgggatatgctcaaggcgcgccgggacatgtgcgaaacgctgatggcggaatattttccccgctggcggttttcgccaccggaaggtgggctctctttttgggtggaacttcctgacatgctggccaccctgttctctgcgcgtgcggaaagccaggggatccatatcggcaccggtacgcggtttgggctggaaggggcgttcgatcgctatttacgtctgccgtttacgctgccggatgaagcattgcgccgggccttctccacgctacaaccgctgtggcaaagccttgctgaacagaaggaaaatacacgtatgcgaaaaataatataa

SEQ ID NO: 6356 - DNA, 438 bp, Klebsiella pneumoniae
ttagggcactttcacttgcccaataaggttacgattatgaaattagttatcgcctccgtaatttctctactcagcttcagcgcgctggcggcgccagaggggacgctcagcgtacacattcttaatcagcaaaccgggctcccttcaccgggggtgcagattgagctggataaacagcagggggagagctggcagcatatcgccaccggtaaaacggatgccgatgggcggattaaatcgctctatccgcaggcggagaatatggagccgggggtgtataaagtgacgtttaaaaccggtgactattttaaaagccaaaatatgaatacgttcttcccggtgattccggttattttcaatgtcacaaagcaaaatcaaaaactgcatatcccgctgctgctcagtcagtacggatactctacctaccgcggcagctga

SEQ ID NO: 6357 - DNA, 1518 bp, Klebsiella pneumoniae
tgggttaactttgctgaaaaacgggtgctgacgatgagcgagataaccttactggcggaagtgaccgccttcttacgccagccgcacgggcagtttattgccggtcaacgtgaggcgggccgcggcgcgccgttcgcggtgatcaacccggcgaccgggcaggcgattgccgaggtcaccgcggcggatagtgaccaggcggatcgcgctatggagagcgcccgccaggcgtttagtcagtggcgcgagatgccgacgctggcgcgcggcgcgctgctgctgaagctggcggacacgctggcagagcatcgcgaagcgctggcgcagctggaaagtctctgttccggcaaaactatcacgctggcgcggatgctcgagctggaccagtcggtggcgttcctgcgctacttcgccggctgggcggggaaagtcaccggtgaaacgctggatgtctcgctgccatcgatggccggggagaaatataccgcctttacccgccgccagccgcttggggtggtggttggcatcgtgccgtggaacttctccatcatgattgccatctggaagctggcggcggccctggtctgcggctgcaccatcgtcctcaagccgagcgaatatacgccgctgacgctgctgcgcgtggcggagctggcaaaagcggtgggtatcccggatggggtgattaacgtggtcaacggcgccggcggcgagattgcccagcggctgattacgcatccggcctgcgccaaggtgagcttcaccggctcggtggccaccggtgaaaaagtccagcagtcggccagcgcgtcaggtaaacgggtgacccttgagctggggggcaaaaacgccgcgctgttcctcgatgacctgacgccggaggcgatggtcaacggcattattgaagctggctacctgaaccaggggcagatttgcgccgctgcggaacgtttttatctgccgcagggaaaactggatgcggtactggcgctgctgaaagacaagctcagcgcttttgcgccggggtcgccgctggatgaacggacgctgatggggccgctggccaaccgccagcagtatgacaaagttttgcggctcattcagaccgcccgcgacgagggcgataccatcgtctgcggcggcgaagcgctgccgggggagggctatttcctgcagccgaccgcggtcaaagtgcgcagcgaagagagcaccctgatgcgcgaggagaccttcggtccggtgtgcagttttattggctatcgcagcgaagaagaggcgctggcgcggatgaatgcttcgccgtatggactggcggccagcgtctggtcggataatattcgtcaggcgctacgctactcggaggcgattgaggccggcatcgtatgggtcaatatgcataccttcctcgacccggcggtaccgttcggcggcatgaagggctcgggcatcgggcgcgaattcggcagcgcgtttatcgatgattatacggagctgaagtcggtgatggtgcgctattaa

SEQ ID NO: 6358 - DNA, 1248 bp, Klebsiella pneumoniae
catatttttgtcacattccctctccaggatgcccgatcccgcgcaataaaatggcgcgcccgccgccccgggtgttggcaagcgggccgactcctgctacaacatcagctcgatatcgatattccttttgaacggcagagaatcatgagtgaaagccagacgctggtggtaaaactgggcaccagtgttttaacaggcgggtcccgtcgcctgaaccgcgcccatatcgtcgagcttgtgcgccagtgcgcacagttgcacgccatgggacaccgtattgtcatcgtgacctccggggccattgccgccgggcgcgagcaccttggttacccggaactgcccgccaccatcgcctccaagcagctgctggcggcggtgggacaaagccgtctgatccagctgtgggaacagctgttttctatctatggcattcacgttggccagatgctgctgacccgcgccgacatggaagacagagaacggttcctcaacgcccgcgacactctgcgcgcgctgctggataacagcatcgtcccggtcattaacgaaaacgacgccgtcgccaccgcggaaatcaaagtgggcgataacgacaatctctccgcgctggccgcgatcctcgccggggcggataagctgctgctgttaaccgaccagccaggcctgttcaccgccgacccgcgcagcaacccgcaggcggagctgattaaagacgtctacggcatcgacgacgcgctgcgcgccatcgccggcgatagcgtctccggacttggcaccggcggcatgggcaccaagctgcaggccgcggacgtcgcctgccgggcggggattgataccatcatcgccgccgggaaccgcccggacgtcatcggccatgcgatggcaggcctgccggtaggtacctgcttccacgcccaggagtctccgctggagaaccgtaagcgctggatcttcggcgcgccgccggcgggggaaatcaccgtcgatgcgggcgcgacccaggcgatcctcgaaagaggcagctcgctgttgccaaaagggatcaaaatcgtcagcggcaacttctcccgcggcgaagtgatccgcatccgcaatagcgaaggacgcgacatcgctcacggcgtcagccgctacaacagcgatgcgctgcgccttatcgccggccagcactcgcagcaaatcgatgccattctgggctatgaatacggcccggtggccgtccaccgcgatgatatgatcatccgttaa

SEQ ID NO: 6359 - DNA, 204 bp, Klebsiella pneumoniae
ggcagatttgtctacgggctcgggggcactccaatagatcgtattggacgaaacacaatcgatctattacaaacagtcgaagcattaaaagaaaaaggagtcagtgttatcagcatgcatgaaggcttcgatctaagcactcctgctggggaagcatgcttaccatcatggcagcattggcaaaaatggaactgtctgtattag

SEQ ID NO: 6360 - DNA, 2559 bp, Klebsiella pneumoniae
ccgggggttgtaatggctaacgaatttcttacgcaatgtgaaatgaccgtcaatacggctgccgggcgcaagctgtctgaggacgaaatggaatcgctggtgcgcgatatgaacgacaccaccaacagaatcttggctggcaacgaagccctgtcattggaagatgcggcgatgcgcgccgcgcaggagcttggcaaccgtgaacaactggcgaaagtaatagaggcgcgcaataaggccattaacacgcgcattgcagcgcagcgccttggagagcttcgccggacgtggaaagaccgcccagatatcggccttgaagctatgctggtggggcgcaacgacgcgcgcacaggatcccgcagatcggtgtcatctgaagtggcgcaattgcgcggtaagtatcacgctggtatcaactacgattttgaccaggcgggtctggttaagtttatcgccagtggtagtaacgatcgtgagatcgccgatgctatgtggcgcatcgggcgcggacagaaaactgacgggatgacacctcaatcagtcagtgctgcgaagatcatcatgaagtggcaggaaactgcgcgtgttgatgaaaaccgcgctggtgcatggatcggtaagatgccaggctacatcgtcaggcagtcgcatgacatactggaaatacgcgctgccggttatgaggcttggagaaactccattcttccacgtctggatgatgtcacctttgacgggataacagaccgagaaagctttttgagtgacgtttatgatggactggcatctggtgtgcacctgacatctgagaagcctgactggatgaatggcttcaagggggcggctaacgcggcgaagcgagctagccaggaacgcgtgctgcactttaaggatggcgttgcatggcacgaatacaacgagcagttcggcacaggaagcctgcgtgaggcggtattcggcggcctgaacagcgcggcgcgtaccactggaatgatgcgtgtactcggaacaaacccgcaaaatatgttcaattatctggccagcaccattgaaaaagatatcaaaaagtcaggaaatcccgcagcattggctgactttaataccaaagtaaaacgtattaaccgcacagtaatgccgcaggttgatggttcgctaaacatacccggcagtgtgggatgggccaacgcttccgctaacgtgcgcggatggctgcgtatgagccagcttggtggcgcggtcatttcgtcttttaacgacgtgcctatctcggcgacagaaatgcggtatcagggccagaacttcatgcaggcgctgaccggcgcgatgaaggggcgtttatcccgttacacaagtgatgaacaaaaggagatcctgtcatccatcggtgtttactctgacacgatgacgcaggagataatccggcgtatgtccggcgatgatagcatgagcggaaagatgggacgcgcgcagcagcttttcttcaaatacaatctcatgaacttctggacacaatccgggcgtaacagcaacgccatgatgattactaactggctggcgaagaatgcagaccatcagttttctgcacttcaggaagatttgcggcgcgtgctggacctgcatggcatcggggacgctgagtggaatatctatcgcaacatggatatggcagacagcgaaggaagaaagttcatgactagcagcggtatccgcggcgtgccagaagatgtgatcgcttcctatgttgaagggaaagggattaaaccaaccgaacgatccatagctgatgccagagatacactggaaggtcagttgcgtggatacgttctagatcggcttaacatagcgatgtcggagcctggcgaccgcactcagtcacttatgaagatgggcacagtgccaggcaccgtcgcaggggaagcaattcgtttcgccgggcagtacaaatcttttactgccagcttcatgcagaatgttcttggccgagaggtatttggtcgcggatacactcccgcaggccttggtgaatcgaaaaccggatcgctgaccaatgcgcttttgcgtaatggaaaaggtgccttcatgggggctgcaaacctgtttgtatggtccacgttgtttggatacgtctcactgcaggccaagttgatgttgaaggggcaaaccccgcgacctgcagatgctaaaacattccttgcggcggcggcgcagggtggtggactcggtatctttggtgatttcatgtttggtgaagttaaccggatgggggcaggtccggtaacgtcgctgatggggcctgcagcttctaatgccgacagcatcatcacgctattgcgacagacaacgcgtggtgaagcagacctgggtgactggtatcgcacctctctggacaatacaccattcctgaacgtattctggctgcgaacagcaatgaacggtctgatattgaaccgtatacaggatgcgcttgccccaggctctttggaacgataccaacgacgggttgagcgtgagcagggtaacgacttcctgatcccaccctcacaattcatgttagggaaataa

SEQ ID NO: 6361 - DNA, 675 bp, Klebsiella pneumoniae
tcgatttctgttttacatgggggcggcattccgcgcttcaactcagccgtggataattttgtccatcgcgcgggcaggcagcaggcgcttaagcagcgccaccgcgtgggtgaccagggtgaccggatagcgcagctttggtttatcgctggtaaaagcatggcgcactttttccaccaccgcctccggcccgagggtaaagcgggcggcgatgcccggattttctacgggcttatcgctttgcgtctggttgacgttatcggtaaagcgggtgcggatcgggcccggttcaatcaggctgacctgaataccgctgtggcgcagctccatgcgcagcgcgtcggaccatgcctcgagggcatatttactggcggcataggctccgcggccgggactggcgataagccccatcaccgaggaggtcatcacgatgcgcccttcgccgtgcggcgtcatcgccggcagcagcagcatggtgagctgatgcgcgccgaaaaagttagcggaaaattgctgttccatctgctggcggctgatggtgttcagcgggccatagacgccatacccggcgttattgaacaggccgtagagacgattatcggtcagcgcaatcacctccgctgccgcgcgctccacgctctgcgggtcatccagatcgagcaaaataccggttag

SEQ ID NO: 6362 - DNA, 567 bp, Klebsiella pneumoniae
gcatcctctgtaaacggaatcctgaccatgacaagacgttacctgaagctcgccatcgcgggctgcctgttcaccctgaccgcctgcgcccagcaaagcgaaatccgccagatgcaccagagcgtgagtacgctgagccaggagatgacccagctcaaccagcaaacgatcaaaatcacccagcaaaacgcgctgaacgccaaatccacccgcggcgtctatctgctgccggaggccaagaccccggcgcggctggagagccagatcggcaccctgcgcatgtcggtgggcagtattaccccggatggcgatgggtcacgcctgaccttacgcattcagggcgaatccaacgatccgctgccggcctttaccgccaccgtcgcttccggacagatcaccggcaccacccacagctatcaggaagtcaatgttcaggatcagctgattagcgcgccggccagcaccctcgcccccagcgatgtcgatatcccgttgcgcctcaatgtaacgccagataaagtcggttttattcgcgtacacgatatccagcccgccgccgcccagtaa

SEQ ID NO: 6363 - DNA, 930 bp, Klebsiella pneumoniae
ccgaggcctgtcagtttctctgctctccgcaggccgccatcatcagcggcgctacgctggtcgccgacggcggggccagtatcgtcgatgttcccactctggcgtttgcctaacgccctacactgttcaggagcccctatgacttcagaagccgtatttatccaggtcggcgcgctggccgatggttttgcgccgcacggtaacctgctggctaccgccagcctgcccgccggcgaaaactttaccttttatgtcgccgggagcgagccgcagcagctggttatcgaagatgagcagacgctaagctggaacggcaagcgcgccccctggcgggcgaccgccctgcgcccggacattctgtttatcgacttccttgacccggagcgggataacgccagcattagcgcggtatgcaacctgacgcagcgcaatgccacgctggtatacggccagctaccggacgaagccgccgcgcggctggacgccttcagccgggtagaacaagggttgccgctgaccgcggttgaggcccgtttcgtcttcgcccgcctggatgcccagccggggccgctgccgggctttaccaccgcgctggtcggcatgcgcaatcagtacacctatagcccgaccgagcgctatgagcacatctatctcaacgacaatttttacgcctggcagtgtctggacggcgtggaaaaggggctggcggatgtcgatcgctgccactatgtgcaggtggctgaggatctctatttgttcgtctggcgggagaaaatcattcccacgctgggggtgatcctcatcgatctgcagcagatgcgcactgacggcaagatcatgggctatcagggcagcgatttcggcgccctcagcaattttccggtcggcgccagcgcgaagatcctcaacgtcacccgccatcaggaatag

SEQ ID NO: 6364 - DNA, 1233 bp, Klebsiella pneumoniae
cgtcgggctgttcttcggcgaagatatttttgtcgccttcggcgcgatcatcttcatgcacaactttatgctggagtcgggtgggatccagacagaaccgttgcatattgccctgtgggggatcccgacggcgatctgcgcctttctgatccacgccgcgcgcctgtggcgactcgatcgccatctccagcgcgagctggaccggataaacgccggacaggcgaaaggcggtgcggcatgaatttccagcaaacctatttatactggctggccggcgcggtactgctggtcgtggctatcatgtcctggcgtgacaaaagcaatccgcggcgtctgacaaccggtctgttctggggcctgtacgggctggtgttcttgctcggcgactggacatatcaactggtgggcgataagcgtacggtgaatatcgctgtcggcggggtggtggtcatcctggcgctgatcgccggttttggcggcgtgcgcctcggcagctaccatcagcgtacccaggaagagaaaaccgccagcgcgaaacgcctcggcaacaaacttttctttccggcgctggcgattccggtcgtcaccgtcattggcgtactgctgtttaacaatctgccctcatggcaggtggcgctcttcgggccgggcaaccacgcgacgctgattactctgttctcgatgactgtcggtacgctgattggcctggcgatggcgattcgtatgacgcatgaaacggtggcgcagccaatgcaggaagcgcgccgtttgcttgattccgtcggctgggcctttatcctgccgcaaatcctcgcggtgctggggctgctgtttaccgcagcgggcgtcggaaccagcatttcatggctgaccgagcactatctggcggtcgataaccgctttatcgccgtggctgtgtatgccatcggcatggcggtgctgacaatggtgatgggcaacgcctttgccgctttcccgattgtgaccgccggagttggcattccgattttagtcctgcagcacggcggcaatccggcggtaatggcggcgattggtatgttttccggctactgcggcacgctgatgacgccgatggcggcgaacttcaatattgtcccggcggcgctgctggaattgccggataaaaacgcggtgattaaagcccagataccgaccggtatcctgctgcttatcgtcaatgtattcttactctatttcctgatgttcctgtaa

SEQ ID NO: 6365 - DNA, 363 bp, Klebsiella pneumoniae
atgatgaatgtgaagcctatccgcactgaacaagattacgaggccgcgttacgcgcggttgaacctttttttgataatgaagctgcgccggacacgccggaaggggatttttttgaggtgatgtgcctgctgattgctgaatatgaaaaaaagcactatcccatcgagccgccgacgccgatagaggcgatcaagtttcgcatggagcagcaggggctgaccgtcaaagatctggagccggcgattggtaaatcgaatcgcgtgtatgaaattctcaatggtacgcgcaacctgacgctcccgatgattcgccggcttcacgcacagttcggcattcctctggagagtctgatcggcgcgtga

SEQ ID NO: 6366 - DNA, 2736 bp, Klebsiella pneumoniae
tggcgggatgtcgccctgacttccgcttcagaaatcgagggaaagagtatgaatacagataaaccgggggcgccctattatcagcgctccgtcgaggagactctcgccagcgtgcagagttcgccggaagggattagcggaacagaggcggctacgcgcctgcagcagtatggcgaaaacgccctgccgcagaagccgggtaaacccgcctggctgcgttttattgcgcattttaacgatgtgctgatctacgtcctgctggcggcagcgttgctcaaggcggtgatgggccattggatcgacatggcggtgatcctcgccgtggcggtggtcaatgcgctgatcggcttcattcaggagagtaatgcggaaaaatcgctgcagagtatccgcaatatgctgtccagcgaggcggtggcgatccgtcagggcaaccatgaaaccatccccaccacctcgctggtacctggcgatatcgtggtgatccgcgccggcgaccgtatccccgccgatctacgggtgattgaggcgcacaacctgcgggtggaagaggcgatcctcaccggcgagtcgacggtggtggaaaaaaccaccgagccgctaaacggcgatttaccgctcggcgatcgcagcaacctgttgttttccgggaccaccgttagctcaggggcgggaaaagggatcgtggtggccaccggcggcaataccgagctgggccatatcaaccaaatgatggcgggcattgagaaacaccgcacgccgctgctggtgcaaatggacaagctaggcaaagccatctttatccttattctggtgatgatggcggcgctgttcgtctttagcctgctgttccgcgatatgccggtctccgaactgatgctgtcgttgattagcctcgcggtggcatcggtcccggaagggttgccggcgattatctcgattattctgtcgctcggcgtacaggcgatggcccgtcagaaagcgattatccgcaagctgccgacggtggaaaccctcggcgcgatgacggttatctgctcggataaaaccgggaccctgaccatgaacgaaatgacggtgaaggcggtgatcactgccgacagcgtctatcgggtggaaggggatagctatgagccggtcggtaagatccacgccattgacgatccgacgccggtcacgatcgcgcccggctcgctgttcgagcgctatctgcgcaccatcgatctgtgtaacgacagccagcttatcaaagaggagagcgggctgtggaaaatcaccggcggcccgaccgagggggcgctgaaggtgctggcggcgaaggtcactctgccgccgctgaccagcgaactgcgcagtaaaattccttttgattcgcaatataaatacatgtcgaccctctaccggctgggtgaagaggaggtagtgctggtcactggcgcgccggatgtcctgttccgcctgtgccagtatcagcagagcgacagcggattgcagccgctggatctcccgtactgggaaggcaaaattgaagagtacgcccgggaagggctacggatggtggccgcagcctggaagccggctgccgcaggccagaccgaactgacccatcaggatctgcagcaaggggtgattttgctaggggtcgccgggatgatggatccgccgcgtccggaggccatcacggcgattgccgactgcctgcaggccgggatccgcgtgaagatgatcaccggcgaccacccgcaaacggcgatgagcatcggcaagatgctggggattggcaatgcgggaaatgccattaccggacgcgagctggaggtgatggacgacgcgcagctgagcgtagccgcgcagcagtttgatatcttcgcccgcaccagcccggaagataagttccgcctggtgcaggctctgcagagtaagaaagaaattgtcggaatgaccggcgatggggtgaacgatgccccggcgttgaagcaggctgacgtcggcgtggcgatggggatcaaggggaccgaggtgaccaaggaggccgccgatatggtgctgaccgatgataacttcgccaccatcgccagcgcagtccgcgaggggcgccgggtgtatgacaacctgaagaaaaccattctcttcgtcatgccgaccaaccttgcccaggggttactgatcgtgatcgcgctgctggcgggcaacgtactgccgctcacgccggtgttgatcctgtggatgaacatggccacctccgccacgctgtcgtttggcctggcgtttgaagccggtgagaaaaatattatgcggcggccgccgcgcgatccgaaaattcacgtgatggacggctttgccatctggcgcgtagcgtttgtggggtcaatgattgcggtcagcgcctttattctcgaagcctggctgcagccgcgcggctattcgccggagtttattcgtaccgtgctgttgcagactctggtcaccgcccagtggttctatatgctgaactgccgcgtatcggatggattctcgttaaccaaaggtctgctggccaacaaagggatctggatcgtcagcggcgtactgctgctgctgcagctgctgattatctacgcgccttttatgcagatgctgttcggcaccaccgggctgccgttccgctactgggtgatcacctttatcatcggcttcgccatgttcctgatcgtggaactggaaaaaccgctgacccgcaaatggcgttccgcctga

SEQ ID NO: 6367 - DNA, 642 bp, Klebsiella pneumoniae
agaagttgtgtaattttttctttacgtatgcattgcgggacagacagcgataatacgtgctttcgttttcatttttttgcgacagacggaaccagggggtcttcggttatgacacagcctatctttcttattgggccacgcggctgcggtaaaaccaccgtcggccatgcgctggcgcgagcgcggcattttcagttctccgataccgatcatcggctacaggcccatgagcagcggacggtggctgagatcgtgcaggcggaagggtgggcgcgttttcgcgaactggagaccctgtcgctgaaggccgtgaccctgccgaatacggtaatcgccaccggcggcggcattgtgctggcggaaggtaaccgtcagtttatgcgggagaatggcgtggtgatttatctgcaggcctcggtgtcggcgctgattgaccgtctggaagcctacccgaaagccgaacagcggccgacgctgaccggaaaaccggtgcgcgaggaagtgggcgaggtgctggcgcagcgcgaagcgttataccgggacgctgcccaccatattgtggatgccacggcctcgccggatcgggtggtggagcagattatgtccatgctgtgcagcgcgacggcaaccccggtaagttaa

SEQ ID NO: 6368 - DNA, 492 bp, Klebsiella pneumoniae
gacaaatgtgttatcatcgcgcctttccctttttgtctggggctttcttgtatgctacaacctgttgttcgcgtcggtgaatggctggtaaccccctctgtaaaccaaatcagcaggaaggggcgccagcttacccttgaaccgcgtttaatcgatcttctggtcttttttgcccgccatccgggggaagtgcttagccgggacgagcttatcgaaaacgtctggacccggaacgttgtgaccagccacgtcgtcacgcagagtatttctgaactgcgcaagtcgctcaaagacggcgacgacgttagccttgagtacatcgcgacggtacccaaacgggggtataagctcacggtgccggtgatctggtgcaccgaagagggggaggagctagccccgtcgatggaggcgctgacgccttcgccgtcgaccgccgttcctgcgccgccggcccgccggtgcgccatccgacgtctctgtccctctccctga

SEQ ID NO: 6369 - DNA, 384 bp, Klebsiella pneumoniae
ttttggagtgttaactgcttgttgcgcaacaaagcggggaagcttgacgattgcgcagcgagtcggacggtggttcctggttatacatttcctgttcgtgacttggcgcgtatcaacggtacgctgcgacttttattgtctgtttgctttatacgtgggagagttcgagctatgcatattaaaaataccattccagcagagtttgtcttcaattcggccctgatgaagaatattgagaatacgctcattaagcagcacagaacggtaaataatgagcggatgattacggaaatccagcatcgtctgcaaacggaaagtaacgaaatactttccgatctctatctgcaggcgctggatatgctgtacagcaaacctcatcattaa

SEQ ID NO: 6370 - DNA, 1164 bp, Klebsiella pneumoniae
atccggagtgtaatgatgagtctgaaagagaaaacccaaaccctgttcgctgacgccttcggctacccggccagccatgtcattcaagcgccaggccgcgtcaacctgatcggcgagcataccgattacaacgacggttttgtgctgccctgcgctatcgactaccagacggtgatcagctgtgcgccgcgcgacgatcgtaccgtgcgggtgattgccgccgattacgacaatcagaccgatgagttctctctcgacgcgccgattatcagccacgacacccagcagtggtcgaactatgtccgcggcgtggtaaagcatctgcagcagcggaacagccactttggcggcgcggatctggtgatcagcggcaatgtaccgcagggtgcggggttaagctcctcagcctcgctggaagtcgccgtcggcaccgtgttccaacagctgtatcatctgccgctggatggcgcgcaaatcgccctcaacggccaggaggcggaaaaccagttcgtcggctgcaactgcggcatcatggatcagctgatttcagcgctgggcaaaaaagaccacgcgctgctgatcgactgccgttcgctgggcaccaaagccgtctcgatgccgaaaggcgtggcggtggtgatcatcaacagcaactttaagcgcaccctcgtcggcagcgagtacaacacccgtcgtgaacagtgcgaaaccggcgcgcgcttcttccagcagcccgccctgcgcgatgtcacccttgagcaatttaacgccgtcgcccatgagctggatccggtcgtcgcgaagcgcgtacgccatgtgctgacggagaatgcccgcactgtggaagccgccagcgccctcgaaaaaggcgacctgaagcggatgggtgagctgatggcagagtcccacgcctcgatgcgtgatgatttcgagatcaccgtcccgcagatcgacaccctggtggagatcgttaaggccgcgatcggcgataagggcggcgtgcgcatgaccggcggcggctttggcggctgcgtggtagcgttaatcccggaagatctggtcgataccgttcagcaggccgttgccaacgagtatgaagcgaaaaccggtattaaagagacattctatgtctgcaaaccgtcacagggggccgggcaatgctaa

SEQ ID NO: 6371 - DNA, 2652 bp, Klebsiella pneumoniae
ggagatctcgttatgccaacagtgccaactgtacaaggagtgccaactgtacaaggccgccaggttgaaagccgcggcgtttcatctccgggattccagaccttcgaccagcccaatgttagcgatgcgctggtaaacgtcggcagccaggcgctggatgtgttcggccaggccaaacagcaagcggaccttgcactgacccaagatgcgactcaaaggctttatgctgttgggagcgggttgatggatgatcccaaggaaggtctgatgactctccaggggaaaaatgcaattggtcaggctcctgggtatatccagaaatttgataacgagatgcaaactattgctggcacgctgcctgagtccacacgaaatgtattcttaaagcatgctcaacagcagcgaatgcaatttgccactcaagcagagcggcatgaattagggcaacgtaggcagtatgagtctggtcagcaggacggttatttatccttgcaagctcagcaagctatatctaatccacagttgttcaaccaatcagctttgaatgccagagcctcaattatggcttatggccaagcgcatggacaaagtcctgaagaaatcgaggcaaactgggggcggtggcgcgaacaggccgcgaaccgtgctagcgaggcatggtataacccgatctaccagcagatgatggggccggaaggaaaaatagaggtcaccaacacgccgcaagaggcgcagctcttttcgtcgattatctggcaggagagtggcggcaatcagtttggtaaagatggtgcaccgctggtatcaccgaaaggtgctgttggcgccgcgcaggtgatggaaagtaccggtccggaggctgctagcctcgctggtctttcgtgggatcgcgacaaatggctgaatgacccgcgatataatgtgcagcttggtaaggcatatttcggcgcacaactgaaaaaatacgacaacaacccggttctggcggttgcggcgtataacgccgggcctggagctgtcgatggatggattaagcagtttggtgatccgcgagatggcacggtttcgaatgcgcagttcgccgcggcgatcccctacgaggaaacgcgcaactacgtggcgaaagttaccggtagcgccggcgcgataccaggcaatgccaccattgagaacctggtaaatcagccattctggaatgcgatgagcccgcagaaaaaatcggagatgctgagcaagcagtctggcctctacgatatgcagaccgccgccggacgcgtctctttgcagacacgcatgcaggatgatctggctaagctggaagcggggcaggaagtcaacccgatcacggaacatgaatgggctgcggttatgccactgcaggccagtccttcagagcgcattcagttgcagcagtccttcgagcagtaccaacaggcaatgatgcttcagccggcctacaagacgattgtgcagggttctgctcagcagggtattgctgcggtacaggccatgattccgcaggaatcagactctgatttcaaattcaagcaggggctgtacgcgacagcgcaggccaagcttaatgccacgcttaaggcacgggagtccgacccgggaacctggctacagactcactcaccggtggcaaaaaatgccttcgaccagtacagcaacggtcaggcatctggcgaatggttggtgtcccgtcttcagtctgagaaagaccgcctcgggatccgtagcaaaaaggtactgcctgattcaatggtcaacagcctgatcgcccgcattgacaacaaccaggaatcgagcgtcgctgccattcagcagatggcacagtccttcgggaaatactctggtcaggttatgcagcaggtgcagaaaagcgcctacccggcgttgcaggtcatcatggcgaccaataacccgcgcgctgccaacgccctctggcaaaaccgcagcgttaaaacctctgatctgcgtggcaactttgagaaaaccgacgccgacagcgccgactcatcctggaatgaccaggccaaagactttgctgggacgatggtagtccagcctggcggggccgctgtgtggaacaacttcaacgagcagggtaagcgcctgacttacacctatatgcagcgtggcatgtcaccgagcgatgccgcaaaacaggcttatcaggacgttctcggcgagcagtatcagaccagcggcacatggcgtatgccgaactcagccgggcaggatattcgcgacgttaacgacggcgctaatgagtacctgaaaaacctgtcagcggatcagatcatgccgctgattggtgatgcccgtctgccggatgaggttaaccgcgagcagagtatttcgcgcattcgtgaaaatgcgcagtgggtgacgaatagcaacgaaacagggctgacactgatgatgaacggcctgctgatcaacaacgcgcaagggcagccgatcaccgtgccgtttgctgatctggcgaaacttggcgctggcaatcgcaccacctggaacagcctgaccaaattcgtgcagacgccggttaagtacacgccgggccagtcgaagaattacaccgtggaaagtcagcgcgaaaacctgctcaacattatccagaacggccagcagacgggacgataa

SEQ ID NO: 6372 - DNA, 234 bp, Klebsiella pneumoniae
ttcacgctcgtgaacacctcttgcagggccgatatagctcagttggtagagcagcgcattcgtaatgcgaaggtcgtaggttcgactcctattatcggcaccatcaaatgcatcccgtttcaacatgcccctgtttttattaaatataaaaattttctcatcggcgggatggcgtcagtccaccgaatgcgattgccgccgccgaggtggggctctccttttttgactggatga

SEQ ID NO: 6373 - DNA, 1209 bp, Klebsiella pneumoniae
aacctggccgtcggcgccgctgatcctgctgatgctggtgggcagcgccctgctggttcgccggatgcggctgctggagatgggcgacgataccgcctgcgcgctgggggtgcaggtcgagcgttcgcgcctgctgctgatgctggtggcggtggtgctcaccgccgcctcgacggcgctggccgggccgatctcatttatcgcgctggtggcgccgcatatcgcccgccgcctgagcggcacggcccgctggggactaacccagtcggccctgtgcggcgcgctgctgctggcgctggccgattacggcgcccaacggctgtttatgccgtggcagctgccggttggcgtgttaaccgtcagcctcggcggtatttaccttattgcattgttgattcaggagtcccgcaaaaaatgagtgctgtcccctcccgtttgcgcggcgagcagttaaccctggcctacgggaacaagaccatcgccgagtcgctgaacgtgaccatccctgacggtcacttcaccgccattatcggccccaacggctgcggcaagtcgacgctattgcgcaccctcagtcgcctgatgacgcccgccagcggccacgtctggctcgacggcgcgcagatccagcagtacgccagtaaagaggttgcccgccgcatcgggctgctggcgcagaatgccaccacccctggcgatatcacggtgcaggagctggtggcccgcgggcgctatccgcaccagccgctgtttacccgctggcgcaaagaagatgaagaggcggtgaacaaggcgatgcgggcgaccgggatcagcgatctggcgctgcagagcgtcgacacgctttccggcggccagcgacagcgggcgtggattgcgatggtgctggcccaggaaacggcgattatgctgctggatgagccgaccacctggctggacatcagccatcagatcgacctactggaactgttgagcgagctgaaccgcgagaagggctataccctggcggcggtgctgcacgatcttaaccaggcctgccgctacgccacccacctgatcgccctgcgcgacggcaggatcgtcgccgagggggcgccgaaggagatcgtcaccgccgatctgattgaacggatttacggtctgcgctgcacgatcattgaagatccggtggcacatacgccgctggtggtcccgctgggccgccggtaa

SEQ ID NO: 6374 - DNA, 426 bp, Klebsiella pneumoniae
aaagacagcgtgcgaaatatcgtcgaaacaaaggagttcgtctggaacctggcgacgcgaccgctggccatggcgatgaatgaaacgtcagcctcgattccgcaccatgaggacgaattcgtgcgcgccggcctcaccgccgccgccagccgcctggtcagcgctccccgggtcgcggagagtccggtgaactttgagtgccgtctgtcgcagtgtattcaactcaccaccgccgacggcaaccctgtcgatacgtggctggtgctcggtgaagtggtcgccgtgcatatcgatgaatcactactggacaacggtatctatcaaaccgcccgggcccagccgatcctgcgcgccggtggcccgagcgcctattacggtattgatgacagcctgcgctttgacatgatccgccctgacgcccgctaa

SEQ ID NO: 6375 - DNA, 1137 bp, Klebsiella pneumoniae
ttttgcagcgtgaggtggagcacatccgctacccggcatagggcgcaaggcgctgcgcgacgacgcctttctgtgataccttttcaggcagtgtgcgtgaccgacgcccgcccgggcgtcggcctcctggaaaacagacggcgcgaaacgacgatgagcgataaaaaatggattaaggccgaggacgtggccagactggccggggtctcgcgctcggcggtctcccgcaccttcacccccggcgcctcggtgtcggagaagacccggcagaaggtgctgagcgccgcggaagccctgggctatcaggtgaatatcatcgcccggacgatgatcaccggcagcagtaattttatcggcatcgtcaccgccggtttcgacaacccgtttcgcagcaaactgctggcgccgctggtccatcagctggcgctcaatggctttatgccgctgctgatgaacgctgacgatccgcagcagctcgccccctcgcttaaacaactgctgagctatcacgtcgccggggtgatcatcacctccggcgcgccgccgctgtcgctggcggaggagtatctggcgcgcaagatccccgtcaccctgatcaaccgccatgcggacctcgccggctgcgaccgggtgtgcagcgataacgcccagggagcgaagctggtggcggatctgttcagccgccgaggctggcggcaggttggctttattggcgaaaatcgcgagaacttcagcacccgccagcgctatgaggcttttatcgcccggacgtcggatatggcggtgagcagccgcttctgcgacggcggcggctatcaggccggcaaccaggctgccagagaattggttgctgaaaaccccgggatgcaggcgctgttttgcgccaccgatatgctggcgctgggcgcccaggacggcctgcgggacgccgccgccccgctgccggccatcgtcggctttgacgatatcccgcaggcggactggcagccctatcagctcaccaccgttcagcagaataccgccctgctggcccaccacgcggtggatttgttaatgacgcggatcgcccgcttcagcctgccctcgcgccatcgcgaagtgccggtgaaactaattattcgtcatagtgcgaaatga

SEQ ID NO: 6376 - DNA, 1173 bp, Klebsiella pneumoniae
agtgaaggcgtaattttaatgtctatcacaaagagaattaataaaatgaattcatttaaatggattttactggctttcccattggctctattgtccgggtgtacaattgtacctggatcttctatatctacaatatcaaaagataaacaagacgtcccagatagtgacttcaatattaatgacatggttgatgtgaccacaataacaccaagccttgttaaccaaatgagtgctgacataatcaaaactaattctaatccaagcacatcttttggtaataaaagctacgcgtataaagtaggggccggtgatattttacgtataactgtttacaaccacccagagcttaccaatcctcaaggacaatacagaagcgctaaagaagctggggttcttgttaaaaatgatgggacaattatatttccatacgttggtgagttaaaagtttctgggatgtcggtggaaaaaataaggtcgacactttcagaaagattagttaaatatatagaagatccgcaggttgatgtaagcgttgctgaatttgcatcacaaaaagtatatgtgtcaggatccgtaaacataccaggaaaacagccggtaaccgatgttccgcttactgtcatggatgctattggcgcggctggagggattacatctgatgctgactgggagcatgcggtaataacccattctggtaaaaatgaaattgtgtcgttaaggtcacttttgcaaatgggtgacctctctcagaacaaaactctttatcctggagattcactttacgttccaaggaatgatgaacttaaaattacagttatgggagaggtaacaactcaaaccacattgaacactggactttacggaatgaccttagctgaagccatcgcaaattctgaaggaatttctcaatcacacgcagatgcttccggtatatttgtcattagacctacaggaactaatgaaggcaagatagcaaaaatatatcaacttaatatgtctgatgcggcatcaatggttatggctacacagtttcatcttaagccaaatgatgtggtttatgtgacaactgcccctatcacaaagtggaatagtgttataaaacaattgcttccatcaataagtttaattaataaaacaataacgacaacaaggatgattaaaaattggccgtga

SEQ ID NO: 6377 - DNA, 1527 bp, Klebsiella pneumoniae
tcagaaatagtcctggccaacctgtggtacggaggtggatgtatgaacgcttttgcccttgaagccgaaggtatcagtaagttcttccccggcgtgaaggcgctcgataatgtctcattgcgcgtgcgtccgggaacggtgcatgccctgatgggcgagaacggcgccggtaaatccacgctgatgaaatgcctgatcggtatctatcgccccgataaagggtcgattcgcgtgaaaggggagccggtggagtttaccgacaccatggatgcgctgcgctcggggatctcgatgatccaccaggagctcaatctggtgccgcatatgacggtggcggagaatatctggctggggcgcgagccgatgaagtacggctttgtcgaccacggccagctgacccgccagacccaggcgctgctggataagctcaatatccgcttaaccgctgaccggctggtgggcgacctgagcatcgccgcccagcagatggtggagattgccaaagcggtttcatggaacgcggatatcgtgatcatggatgagcccacctcggcgctgaccgaaggcgaggtggctcacctgttcaccatcatccgcgacctgcgcgcccagggtaaagcgatcatctatatcagccacaaaatggatgagatctttgccatcaccgatgagatcagcgtctttcgcgacggcacctgggtagggagcaaaaacaccaccgaatttacccggcagtcgctgatcacccagatggtgggccgcgaattaacccagctgtttccgaaatttaataacaccatcggcgaagaggtgctgacggtgcgcaacctgacgcgtcagggcgtgttccatgacgtcagctttagcgtacgccgtggcgaaatcctgggcgtggccgggctggtgggcgccgggcgcagcgaggtgatggaaagcctgttcggtatggagcgcttcgacagcggcgaagtgctgatcgacggggcgccggtgaccatcgattccccctccgtggcgattgaaaaggggatggcattattaaccgaagaccggaaaaagtcgggcctatttctggtgctgtcggtgctggaaaatatgagtatcgtcaaaatgccggaatatatcggcaagagcggttttgtccagcacgtgaaaatggccgaagactgcatggagcaaatacgccggctcaatattaaaacgccgacgatggatcaaattattaataacctcagcggggggaatcagcaaaaagtcctgattgcgcgctggctgttagcgcaaccgaaaatcttaattctcgatgagccgacccgcggtatcgacgtcggggcgaaggcggagatttatcatcttatcagtgaactggcgaatcggggggtggcggtgattatggtctcctctgaactgccggaaatccttggcatgagcgatcgggtcatggtgatgcatgaaggtcgtatcaccggcatcctggaaaaagacgaagccgaccaggaaaccattttgtcgttggcatcccattga

SEQ ID NO: 6378 - DNA, 537 bp, Klebsiella pneumoniae
aatagtgtagtagacgtcacaaaaagatgcggtgttacggaattttccgtaaagtgcggtactctgagtagcagagaaaaatccttcaggagagaagccatgaagtggcaacaacgtgtacgcgtcgcaacgggtcttagttgctggcagattatgttgcatctactggtcgtggcagtactggtgatgggttggatgagcggcgcgctggtgcgcgtcggattgggactgtgcgtcctctacagcgtcacgctgctggcgatgctgtttttacagcgtcaccatgaggcgcgctggcgcgatgtgggagacttccttgaggagctcaccacgacctggtacttcggcgcggccatgatagcgctgtggctgctgtcgcgcgtgctgcacaacaacctgctgctggccctcgccgggctggtgatactggcaggcccggcggtggtctcgctgctggcgaaagataagagccgttaccctaaagcgttcgggctacaacaaggcggcaacgcagcgaatccccagaagcatagataa

SEQ ID NO: 6379 - DNA, 1212 bp, Klebsiella pneumoniae
atacgcgtagttatggaatcctggaaggttaatctcatctccgtctggtttggttgcttttttaccggcctggcgatcagtcaaattctcccctttttacccctctacgtctcccagctcggcgtcacctcgcatgaagcgctatcgatgtggtcggggctgaccttcagcgtcacttttcttgtctcggcgatcgtctcgccaatgtggggaagcctggcggaccgtaaaggccgcaagctcatgctgctgcgcgcctcgttggggatggcgattgccattttactgcaggctttcgccaccaacgtctggcagctgtttatcctgcgggcgatcatgggcttaacctccggttatattcccaacgccatggcgctggtggcctcccaggtgccgcgcgagcgcagcggctgggcgctaagcacgctgtcgacggcgcaaattagcggggtgatcggcggtccgctgctgggcggtttcctggcggaccacgtcgggctgcggatggtcttttttattacggcgatcctgctgaccatcagttttctggtgaccctgtttctgattaaagagggcgttcgcccgcaggtcagcaaaagcgagcgtctcaccgggaaacaagtctttgcctctttgccctatccggggctggtgatcagcctgttcttcaccaccctggtgatccaattgtgcaacggctcaatcggcccgattctggcgctgtttattaagtcgatggcgccggacagcaacaatatcgcttttctggccgggatgatcgccgcggtgcccggcgtgtcggcactgatttctgcgccacggttgggtaagcttggcgaccgcatcggcacctcgcggatcctgctggcgacgctctgctgcgcggtggtgatgttcttcgccatgtcctttgtcaccaccccgctgcaattgggtacgctgcgttttctgctcggctttgccgatggcgcgatgctcccggcggtgcagaccttattgctgaagtacagcagcgacagcgtcaccgggcgtatctttggctataaccagtcgtttatgtatctgggcaacgtcgccgggccgctaattggcgcctctgtgtcagccatggccggcttccgctgggtgtttattgccaccgccattatcgttttcattaacctctggcagctggcgtggatgctgcgccaaacccgccgggctaacgcctga

SEQ ID NO: 6380 - DNA, 516 bp, Klebsiella pneumoniae
gttagttcagtaacacccaggcaattctgttttttaaatggttcaccgggacatcatgtccttaattcaactcaggatgaaaaagcgatgaaaaaaaaggttctggcaatagctctggtaacggcgtttaccggtatgggcgtggcgcaggctgctgacgtaacggctcaggctgtagcgacctggtctgcgaccgctaaaaaagacaccaccagcaagctggttgtgaccccgctcggcagcctggcgttccagtacgccgaaggcattaaaggctttaactcgcagaaaggtctgtttgacgtggcgattgaaggggacacaacggcgaccgcctttaagctgacctcgcgtcttatcaccaacaccttaacccaactggatacctccggctccacgctgagcgtgggcgtggattataacggcgccgcggtggaaaaaactggcgataccgtgatgatcgataccgccaacaatattatgggcggcaacctcagcgcgctggctaatggctaa

SEQ ID NO: 6381 - DNA, 1230 bp, Klebsiella pneumoniae
cctcgggcagtactaaaggataagcacatgaaaagattcacacccgcatggcttgcggtttgtctggcatgcagtttctccacctcttctctggccgcggacgcgcttacaacccgcgcgtttcagggcatgtcggcggactttatcaaaggagcggatatctccacgctgctggacgccgaaaagcacggggcgacgttctacgatcagaataatcagcgcaaggatccgatcgctattctgaaagagaacggcgtcaactatgtccgcctccgtctgtgggtggatccgcaatcggcgagcggcgaggactatggcggtgggaacaatgatctggccaccaccctggcgctggcgaaacgggcgaaagcccaggggatgaagctgttgcttgattttcactacagcgatttctggaccgatcccggcaagcagttcaagccgaaagcctgggaaaagctggattacccgcagctgaaaacggcgattcatgactatacccgcgataccatcgcccgctttaagcaggcgggcgtgctgccggatatggtgcagatcggcaacgaaatcaacggcggcatcctgtggccggaagggaaaagctgggggcagggcggcggagagttcgaccggctggctggcctgctgaacgcggctatcgctggcctgaaggagaacctgcgccagggcgagcaggtgaaaatcatgctgcatctggccgaagggaccaagaacgataccttccgctggtggtttgatgagatcgacaagcgccgggtaccgtatgacgtgattggtctgtcgatgtacacctactggaatggcccgatcagcgccctgaaggccaatatggatgacatcagcaaacgctataacaaagacgtcatcgtcgtcgaggcggcctatgcctataccctggccaactgcgataacgcggaaaatagtttccaggcaaaagaggaaaaggatgggggatatcccgccagcgtacaggggcaatataactatattcacgatttaatgcaggcggtggttgatgtgccagaccagcgtggcaaaggtattttctattgggagcctacatggattgccgtgccgggaaatacctgggccaccccggcggggatgaaatatatccacgacgagtggaaagagggtaatgcacgtgaaaatcaggcgctatttgattgccagggaaaaatattgccgtcggtaaaagtttttaattaa

SEQ ID NO: 6382 - DNA, 432 bp, Klebsiella pneumoniae
aaacagggcttcattctcacggagccgataatggtaactctcgaccaagcgaaggagtatctggaaggtcaggtgattaccatccctgactttgtactccaggcgttcgttgatgaggcgaacagcattcaggactgccttgatgcacattacccgacatcgacagccttgcttattcagctctacctcctagcgctgatggggctcgggagtggggataaatacatttccagccagacggcgccaagcggagcatcccgctcattccgttatcagtcattctcagacagatggaaggcatccgtaaacctgctgcgcagtctggataaatacgggtgcgccagcgcgctgattcctgcagaccctaccgcctctccggcattcgctggtatctggataggtaaaggcggatgtatgtgcggggataagtaa

SEQ ID NO: 6383 - DNA, 1272 bp, Klebsiella pneumoniae
aaaagggaagtggcaagccacttccctggtgtgcgtctattacttgttattctcttctttcagcactttaacggtgtaacgaccatccgcctgacgataggcgccgtggatatcggtttcgaagcctggatagtgggcgccgatttcgcacagcatctgcaggaactccagcaccggacggctctcttcggtgatcatctcacccggcatcaccagcggcactcccggaggatacggcaggatcatgttggcgttgacgcggccgaccatctcttcgagatacacttcttccgtctgaccgtgcagctctttctggaacgcggcatacggggtcatcaccatcgatggcagcacttcaaacgcgcggaacatcagatccggcaggttgtgatgctcaatcagtttgtgaatgttctgcgcgaggtcctgaatacgcatgttttcatagaattcaggatcttcacggtacagcgacggcagcatgtttttcacccgcaggttcaggtcgaacgcgcgtttgaagtcggtcagcgcacgcagcaggctcagcgctttagtcttatcgataccgatactgaacaggaacagcaggttgtacggaccggttttctcaaccacgatgccgtgttcgtcgaggtatttcgccacgatgcttgccggaataccgaagtcatccatggtgccgtctttcttcatccccggagtcagcagcgtgactttgatcgggtcgaggtacatgtgttcgttatcgatgtttttgaaaccgtgccatgcgctgtcggaacgcagcggccagcattcaggaccatcgatatgctccggctgccagacgtcgaagaaccagccgtcagactcgcctttcagacgtttgatctctttacggaacttaatggaacgttcaatagagccgtcgatcagacgcttaccagcgttccccttcatcatcgccgccgcggtttcggtggaggccacgatcccgtagtgtggagaggtggtggtgtgcatcatgtaggcttcgttgaaggtctcttcgtttacgtcgcctttcacgtggatcatcgacgcctgggagaacgccgccagcagtttgtgcgtggactgggtttcataaatcactttcccttcgacgcggccgccgctcatcccgcatttgccttcatagatcggcgagaagttggtgtaaggcacccacgcggagtcaaagtgaatggatttcacatccagggttttcttgatgaagtcggtgttatacagcagaccatcataggttga

SEQ ID NO: 6384 - DNA, 210 bp, Klebsiella pneumoniae
ttcgatcgagtcgtcgctgaattcgatcactttgccgcagtcgaggcagatcaggtgatcgtggtgatgctgctgggtcagttcgaaaacggattttccgccttcgaaattatgacgagtcacgatgccggcgtcatcaaactggttgaggacgcggtaaacggtcgccagaccgatctcttcgcccatgtcgatcaggcgtttatataa

SEQ ID NO: 6385 - DNA, 315 bp, Klebsiella pneumoniae
ggacgcatggtgatggtcatggtggtgatcatgttcgtggtggtgatcatgttcgtggtagtgatcatgttcgtggtggtgatcatgttcgtgatggtgatcatggtgcgtgtggggctgcgtttcgcgccaggtgcgccagagcatccagcaggcaatcagcacaatcgctatccccgagaccagctgaaaccagggttcagaggtttgggcgttccagccgcggccaaaccacaggccggccatggcgatcagccagaccaccgccgtatgcgaaaccgtggccgccagccccagcagtaccgcctgttttaa

SEQ ID NO: 6386 - DNA, 255 bp, Klebsiella pneumoniae
ataatgatggttataataaataaaacagaactaatgaccaaccttagcaaatgctgcaccggcgccgcccctacgtgccaggcagacatgataaacgattcttatatcgcgcaagaagagggctacgggttcccatcagcaaaaaacatcttgtttaacatgaaaccatcgttatcccgatgccaggctttatacgctaaggatgacgatgctcttggatgctggcaaaaaaagcatagattagacaataactaa

SEQ ID NO: 6387 - DNA, 975 bp, Klebsiella pneumoniae
tcaggagtggttatggctattttgtccattggatttgcttgtttcgatcagtttttctttctcaatgaatggccccaggagaataccaaaaacttttgtcatgattttattgaaagcggcggcggtccggcggccaatgcggcctggctgctgggattatggggcgaggaggtttattacattggtcatctgcagcaggacctttacggtcagcgcattatcgatgagtttgccgaggcgggggtggataccagccaggtggttttctccgatgacatgatcaccccgctggcctcggtgctggtcaatcgcttaacgggttcacggacgattattacccgcaagatgcaaacgccgccttccctaacctacgagcaaaagctcaaactggacgacctcgccgagcgactgattgccagcgaggagccggttaccattttaattgacggccatgaggcggaaatcagtgaatatttaattaagaaactgcccaacgccagggtcgtgatggacggcgggtcactgcgcgccagcaatattaaactggcggcctggactgactattttgtagtgagcgaacatttcgcccgcgattatatgagctatcgctcgctgagcaccgaagcagaaattaaagcggccctgattgagttgaataaaatttgccgcggtgaagcatttattacccttggcgaaaaaggctgcgcttttttaaaaagcggtatgctgcagatcgtcccgtcctggctgtgcaatgccgttgataccaccggcgccggggatgtatttcacggcgccttcacctatggcgtccattactcatggcatatcgataacattattttatttgccagcctgaccgccgccatttctattgagaaaaaaggggttcgggaatcgatgccggacctggcggtcgtccaccactcgttaaatagctacgagagaaacttaacgcaatattttgaagaataa

SEQ ID NO: 6388 - DNA, 1686 bp, Klebsiella pneumoniae
aaatccccggtggcgctatcgcttaccggggctacagcactatgcggtttggtagcccgggtaaggcgtagccgctacccgggtaacggacagggattactcgatacctttgctgcgcaggtagtcttcgtagttgccgctgaagtcgatcacgcggtccggagtgatctccaggacgcgggtcgccagcgagctgacaaactcacggtcgtgggagacaaagatcagggtgccctgatacatctccagcgccatgttcagcgattcaatcgactccatatccaggtggttggtcggttcgtccatcaccaggatgtttggcttctgcatcatcagcttaccgaacagcatgcgccctttctcgccaccggaaagcaccttcgccggctttttgatatcgtcctggctaaacagcagacggccgaggatgctgcgtactgcctgctcgtcgtcgccttcctgcttccactggctcatccattcgaagaccgtcaggtcgttttcgaactcgtactcatggtcctgcgcgtagtagccgatttgcgcgttttcagaccatttcacgctgccgttgtccggctgcagttcgcctaccagggttttcagcatggtggatttacccacgccgttggcgcccagaatggcgatcttttcgcccacttccagcagcaggttgacgtttttgaacagcggaccttcatcaaagcctttggtaagggcttccacttccagcgcgttacggaacagtttcttatcctgctcgaagcggataaatgggttctgacggctggaggctttaacctcttccagcttgattttgtcaatctggcgcgcgcgcgaggtggcctgacgcgatttagaggcgttggcgctgaagcggctaacgaaggactgcaggtccgcaatctgcgcttttttcttggcgttgtccgccagcagacgctcacgcgcctgggtggccgcggtcatgtattcgtcgtagttgcccggatacacgcgcagctcgccgtagtcgagatccgccatgtgggtgcagaccatgttcaggaagtgacggtcgtgcgaaatgataatcatggtgctgtcgcgatcgttcagcgtctgctccagccagcgaatggtgtcgatgtccaggttgttggtcggttcatcgagcagcaggatatccggattggaaaacagcgcctgcgccagcaggacgcgcagcttccagcccggcgcgacttcgctcatcgggccataatgctgttcaaccggaatgccgacgccgagcagcagttcgccggcgcgcgcttccgccgagtagccgtccatttcgccatatttgacttccaggtcggccactttgtagccatcttcttcactcatctcagcgagggcgtagatacgatcgcgctcctgcttcacttcccacagctcgccgtggcccatgatgaccgtatccagcacggtgaacgcttcaaaggcgaactgatcctgacgcagcttaccgatgcgctcgttcgggtcgagagaaacgttgcccagcgtcggttcgagatcgccgccgaggatcttcataaaggtcgatttaccgctgccgttggcgccgatcagaccataacggttgccgccgccaaatttaacggagatattttcgaacagcggcttactgccaaactgcatggtaacgttgctggatactag

SEQ ID NO: 6389 - DNA, 963 bp, Klebsiella pneumoniae
tccgcaccggtaataaacaggactgcattaatggcaaatctttacgatctgaaaaagttcgatttgaatttattggttattttcgaatgtatctatcaacatttgagcatcagcaaagcggcggcgatgttatttatcaccccctcagcggtgagtcagtcgttgcagcgtctgcgccagcagttaaacgatccgctatttgttcgtgttggcaaaggaatgacgcccaccaccgcctgcgtcaatcttcattatcatctacagcaaaatctggagcagctggaaaaaaccatcaatcttaataatcgctcagaactgcgtaaacgtattgtgatatatggccccccgctgttctgttcagtcaatagccacgttatgattaaccagctctgtcatcaggcgaacttgcaaattgagcaccataacctgaccaccaccgaatcggctgaggagctgctggcgtatcgccaggcggacctggtgttcacccgcatgcccattaccaaccgcgccacgatctgtcagccctatcagacggtgcagacgctggcggtttgccgggcgggccatccgcgacgcgaaacgcttacctcggtagagtcactggcgcaggagtttttcactcactatattaccaacgatcccgttattcagcgcgtgcagcaaagcagcatcgcctggctgaatccgcgcaatattgcctttcgcagcgactcttttatgaccattcttaacatgattaataaaaccgacttaattggctttttgccttcctatttatatgactttatctcacccactatgcagcttcacgccatcaacatagataatctttttccggatatcacgatctacattaattaccaccatgcatcttcgcaaaatcattttttaactgaattaatcaccatattaatgaatgatcgagaggcatcacggcccaaatttaatcacagcgaataa

SEQ ID NO: 6390 - DNA, 234 bp, Klebsiella pneumoniae
gcgactacggtttctcctacggtgctggtctgcagttcaacccgatcgaaaacgttgctctggacttctcctacgagcagtctcgtattcgtaacgttgacgtcggcacctggattgctggcgtgggttaccgcttctaatcactccggtgatatgaaaaatccgcctctcggggcggattttttttgcctgctgacggccggcccgggcgactggccgggccggcgcgattaa

SEQ ID NO: 6391 - DNA, 318 bp, Klebsiella pneumoniae
cccgccacggtgggctttcatctggagatgatcatgtaccttcacatcactttaaattcaggccggacgatgcatggcggcatgactcagtccataattgaagtctacgacgtttccctcggggtaacagctccctgcaaaggtgatgatgacaacgcccatcctgttgttttatggcgcacgaaagggaataaggattgcgagggaataatgttccttcatgagttggacatcgccgtcgttaaatcaaccgatggaacagtgctccatgaatggcacggcgctaaaagccagaagcagaaaagaaagagtgaatag

SEQ ID NO: 6392 - DNA, 453 bp, Klebsiella pneumoniae
ctaatgacggtcttaagtatccgcagtccggcacgctggaattctcggatgtcactgttgatcagaccaccggctcaatcacgcctacgcgctattttcccgaacccggatcacaccctgcttccggggatgttcgtccgtgcccgtctggaagaagggattaaccctgacgccctgctggtaccgcaacagggtgttacccgtacgccgcgcggcgacgccagcgtcatggtagtgggggaaggcgataaagtcgaagtccgccaggtcactgcttctcaggcgatcggcgataaatggctggtcactgacggtctgaaatccggcgatcgcgttatcgtcaccggcctgcaaaaaatcaaaccaggtgtgcaggtaaaagcgcaggaagtagcttctgatgataaacagcaagccgcaggcaacgcgccatcagaacaaaccaagtcttaa

SEQ ID NO: 6393 - DNA, 948 bp, Klebsiella pneumoniae
tggaacgcggtgttaagtaccgcgacgccgataaaatggcccttatcccgtgtgaaaaacgtggccactgagcgtgaagctttgctcagaaaaccggaatggatgaaaatcaaacttccggcagactcgtcccgtatccagagaatcaaagcagcgatgcgtaagaacggcctgcactctgtgtgcgaagaggcctcctgcccgaaccttgcagaatgcttcaaccacggtactgcgacctttatgatcctcggcgcgatctgtacccgccgttgcccgttctgcgacgtcgcgcatggacgcccggtcgcgccagatgcaaacgagccacaaaagctggcgcaaactatcgccgatatgggtctgcgctatgtcgtagtcacctcggtagaccgtgacgacctgcgtgatggcggcgcacagcattttgccgactgcatcagcgccattcgcgagaaaaacccgtcgattaagatcgaaacgctggttccggatttccgcggccgcatggatcgcgcacttgatattctgacggtgaccccgccggatgtcttcaaccataacctcgaaaacgtgccccgtctttatcgtcaggtacgtccgggcgcggattacaactggtcgctgaagctgctggagcgttttaaagaagcgcacccggagatcccgacgaaatccggcctgatggtaggtctgggcgaaaccaacgacgagatcatcgaagtgatgcgcgacctgcgtcgccatggcgtcaccatgctgacgttaggccagtatctgcagccgagccgtcaccacctgccggtgcagcgctacgtcagcccggaagagtttgaagagatgaaagcggaagcgatggcgatgggcttcacccacgccgcctgcggtcccttcgtccgctcttcctatcatgccgacctgcaggctaaagggatggaagttaaataa

SEQ ID NO: 6394 - DNA, 1410 bp, Klebsiella pneumoniae
tcgcttcaggtaggtgcgtccgcgcggcgtccggtggcgggtatcgctcgccgtcggtgcgcatcgcggatacaggcgaacagtttttgggaaccgatagtgtcaaaggcaaccgaacaaaacgacaagcttaaacgagcgatcatcatttcagtcgcgctgcacatcattctgatcgcgctgctgatctggagttcgtttgacgagcatctggatgcctctgccggcggcggcggcggatcgtcgattgatgccatcatggtcgatccgggggcggtggtaaataactataaccgtcagcaacagcagcaggccagcgcacgtcgcgccgctgaacagcgtgaaaaacaggcgcagcagcaggcggaagagttacgtgagaaacaggcggcggaacaggaacggctgaaacagctcgaacaggagcggctgcaggcgcaggaagcggcgaaagaagcgaaggagcagcagaagcaggctgaagaagcggctgccaaggccgccgcggcggcaaaagccaaagcggacgcacaggcaaaagaagcgcaggaagccgctgccaaagcggccgccgaggcgaaagcgaaggcggatgcccaggcgaaagcggcagaacaggcggcggccaaggcggctgctgacgcgaagaagcaggccgaagccgctgcagcgaaagccgctgccgaggcgaagaaacaggcggaagctgaagcggcgaaagctgcggccgaggcgcagaagaaagcggaagcggcggctgcgaagaaagcgcaacaggaagcggagaaaaaagcccagcaggaagcggctaagcaggcggcagctgaaaaagcggctgccgaaaaagccgctgagaaagccgccgcgcaaaaagcggccgctgagaaggccgccgccgagaaagccgcagccgctgaaaaagcggctgcagcagagaaggctgcagctgataaagcggccaaggcggcagcagcaaaagccgcggcggcgaagaaagcggcggctgcgaaagaagcggacggcgttgacaacctgctcggcgatctgagttctggtaagaatgcgcctaaaacaggcggtggggccaaaggaaacaatgccgccgctgccgggagtggtaatactaaaaacagtgcctcaggggctgatatcaacaactatgccggacagataaaatcggcgattgaaagtaagttttatgacgcatcgtcctatgcgggcaaaacatgtaccttgcgtatcaaacttgctcctgacggcctgttgttaaatatacagtccgaaggtggtgatcctgctctgtgccaggccgctcttgccgcagcccgacaggctaagtttccgaaaccacctagccaggcagtatatgaagtcttcaaaaatgcgccactggacttcaaacctcagtga

SEQ ID NO: 6395 - DNA, 1080 bp, Klebsiella pneumoniae
cgaaaacaggtttgtcatcagtctcaaggaatgcctatgaacgtaacccgaaaagagcagcgcattattcagcgcgcgctgaatgcctggcaggccagcggggagttaaccccctcggacagccagcggctggcgcaaacgatgcgcgtctcccccttcgactggcggcgcctgagccgctatgccttctggaccgcgctggcctgcgtgctgatttccctgggcagtctgttcgccgacagcgagctggtggcgtggctgctgagcctgttcagccactcggcgctgatgcggatcctgctgcctgcgctgctggcagtcgtctgctacggctggggttttcgtcgccagcggcgggagacgcagtggcactacagcaccgaggcgattttgtttctgggcgtcgtctttaccgccgtggcgctatggcagcttggcgaacggctggataacggcagcggccatatcgcaccgctgtttctggccggatgcgtgatttacggcgccatcggctatattgcccgctccgggctggtgtggctcttttttctgctggcgctgggcaactggttcggcgcggaaaccggctacgtctcggggtggggcgcctactggctgggcatgaactacccgattcgcttcgtcctgttcggcggcgcgctgctggcgctctgctacggcgcgcaatccctgcttcgccagcggcagctgtttaccgtcagcaaggcgatgggcctcacgtacctgtttattgcgctgtggatcctgtcgattttcggcaattacgacgcagacagctggtaccaggtgagccaggcgcgactcctgccgtgggggctgctgtttgccgtagcggccggcgtctgcatttttatcagcctgaaaaccgatgacggaatgctgcgcggcttcggactaaccttcctggcgatcaatctctatacccgtttctttgagtttttctggaacgggatgcacaaggtgctgtttttcctgatccttgccgtctcgctggcggtgattggccgctatgccgagcgcatctggcatgccggcgaagggcaggtggagaaaaaataa

SEQ ID NO: 6396 - DNA, 1122 bp, Klebsiella pneumoniae
tgcatgaaggtcgtatcaccggcatcctggaaaaagacgaagccgaccaggaaaccattttgtcgttggcatcccattgaggcacagagaatgagtaatatgaaattaacggcggctccggccagcgagggttcctccttcttcgctaatttgcggcataaaatgccgaaagataccggcatctttgtggtgatgctggtgattgccctgacctttgaaatcgccggctggtatgttcgcgaccagtcgttcctgctcaataccaaccggctggtgctgattgtgctgcaggtggcgattatcggcatcatcgccgtcggcgtcacccaggtgatcatcaccaccgggattgacctctcctccggctcggttattgcccttgcggcggtggtggcggccagcctggcgcaaacctccgatagcctgtcgccaatgttcccggcgctggtcaacctgccggcggtgatccccatttgcgcggggatcggcgtcggcctgctgtgcggcctgaccaacggtttcctggtgacgcggaccggtatcccgccgtttatcgccaccctcgggatgatggtttcggcgcgcggtctggcgcagtattacactcagggcaacccgatcagcttcctctccgacagctttacggcgataggccagggggcgatgccggtgattatcttcttcgtgatcgccgccgtgtttcacattgcgctgaagcatacccggtatggcaaatatgtgtatgccatcggcggcaacatgacctcggccaaagtgtccggcatcaacgtgaataaatatctggtgatcgtctacaccatcgccggggcgctctcagggctggcgggggtggtgctggcggcgcgcgtcagcagcggccagtcgagtatggggatgtcctacgagctggacgcgattgccgccgcggtgatcggcggcagcagcttaatgggcggagtggggcgcattaccggcaccctgattggcgcgatgatccttggcctgatcaaaagcggttttacctttgtcggcgtcgatgcctatgtgcaggatattattaaaggcatcattatcgttgcggcggtaaccatcgatatgcgtcgcaaccggaaaaaacactaa

SEQ ID NO: 6397 - DNA, 651 bp, Klebsiella pneumoniae
ccgtcgaaggtaatggtgcctccctgggtctctaccagcctcagcagcgcccggccggtggtcgacttgccgcagccggactcgcccaccagcgacagggtctctcccggccagagatcaaaactgaccttctccaccgcatgcacttcgcgcgtcacgcgattgagcagcccgccgcgcacgggaaaacgggccaccaggtcacgcacctgcaggatcggctcgccggcgactaccgtatcgggcgtttcgctctccgccagcggctggcccggcagcggaaaacggcgcggcagatcctggccacgcatctcccccagccgcgggaccgccgccagcagcgactgcgtatacgggtgctgcggcgaacgaaagatctcctcaacgctgccggtctctaccgcctcaccgcgatacatcaccagcacccgatcggcgatatcggccacgacgcccatatcgtgggtgataaagatcacccccatcgccatctccttttgcaggacagcaatgagttgcagaatttgcgcctggatggtgacatccagcgccgtggttggctcatcggctatcaacaccgccggccgacaggagagcgccatggcgatcatcaccctctggcgcatgccgccggagagctggtgcggatag

SEQ ID NO: 6398 - DNA, 1047 bp, Klebsiella pneumoniae
ggtggcgaggtgcttcttgtcatgctaccggtccgcaaccaccttcatcacaggatcataataacaatgtcgcagaaaagaaaattattgcctgccgcgctgggactgctttcccttgcctcgctgagcgtcgctgccgcagacgccctctccttacagggaaaaaccattggcgttgccgtggtcggcactcagcatttctgggatcgcgaggcctttaaaggcgcgacagaggaggtggagaaactggggggcaaattcattggcgtcgatggcggccgcgataatcaggtgcatgccaataaccacgatattttactgtcacgcaaggtggacgcggtaattagtattctcggcgatagcgccgtcgaaccaaaatttaaagcattgcgtgatgccggtatcccggtatttaccgtagatcatgtttctcaatattcggtcaacaataccacctccgataactacaccttaggctcaaccatcggccgctacatggcggatgaattaggcggcaaaggcaacgtcgccgtatttaacgccttctccagcgcgctgcgtatttgcggaattcgctacgatcagtggaaatatgtccttaaggattatccggatattcatattatccagcccgagctcgcggaacagttcgccaactcgccggaagacgcgcgcaagaaaaccctcgaattactcagccagtatccgaaaggtaaactggacgccatccatgtcgcctgctgggatcaaccggccatcggcatcgtccaggcgctggaagagaccggtcgcgataaagacgtgaaagtgacggccatcgacgccggtccggagaccctggagatcatggcggagcccggcagcccgttcgtggctaacgtcgcgcagcagccgcatctgatcggccagacctcggctgacaacgtggcccgctactttgccggccagaaactaccggtgcaaacctttattccggtggttccggtgaaaggtccgcaggaagcgaaagcggtgtataaacagttgggatacggcgagctgcagtga

SEQ ID NO: 6399 - DNA, 273 bp, Klebsiella pneumoniae
gactgccgggtggtggatttgctttcggcccgcgcctgcatacgttaccagtttgttatgttgcacacagctctgcgtcagcgaaaagggcagggtacagagcaacggcgcttgatggcacgtcctcagggctgcggtgaaacaacagcaaatcagcgttttagcagtccgaatattaaaacctatataccactaataactgtcctgattacatcggtcaatactgacacactgttacataacttattctcaggtgaaagagtgaccccataa

SEQ ID NO: 6400 - DNA, 276 bp, Klebsiella pneumoniae
gggcgaagggtttctcaatcagcacgtgtttgcccgccttcagcgcctgcatgccgtcgggaaagtgatggttgtgcggcgtcgcaatatacaccgcatcaatatccggacgcgccagcatctcctccacctggccgtaagcctgggggatcccccattccgcggccacccggtcggccttcgcctggctgcgggaggccaccgccaccacctgctgccggctgtaggttttcaatgagtgcacaaagcgctcggcgatccagccaggaccgataa

SEQ ID NO: 6401 - DNA, 201 bp, Klebsiella pneumoniae
gcggtgggggtaacgccctgtcctttgcggataaatagcggatcggggaacagcgcccgcagtttgttaattgactggctaatcgccgacggtgtgatattgagtatcttcgcggcgttgacgatacctttatgcacgtataccgcttcaaagatcgtcaacagattgaggtcaatattacgcaggatgcgaaacatttga

SEQ ID NO: 6402 - DNA, 495 bp, Klebsiella pneumoniae
ccatcattattcaaggtttttaatgtattatttaatttctcattcgacaggtgtttattatatcgtggctatgttatgattaaaaaaaaaggaggaactatgttttcttatattatgctgggaaccaatgaccctcaagcttcatataaattttatgcgcctttgatgcgtgtgcttggtcatcctctggatgggcgtagcgaaaaaggcgccgcatggggaacattcaaagataaccatactaccggattatgcgttggcatgccgtttgataatctacccgccactcgcggcaatggcgttatggtagcgctgaacgcggtatccgttgacatggtccaggaactttatcgattagcgatagagaatggaggagaggatgaaggtccacgagattatcgtccacattacggcgctgatttttatagtgcttacgtacgcgaccctgacaaaaacaaaatcgcttttgttttttatgacgcgtctaaaagatag

SEQ ID NO: 6403 - DNA, 3417 bp, Klebsiella pneumoniae
gaagtgctattctgcgcgcttgcgacgacccccggtattctccggcatttgcattcattcatattaactatgctgcacacgatctccaggcaacgcgccacgttcatctttattatcacgctgctctgttttattggccttttcagcccagtccagggccgcgccgcggatctccccgatcgggcagaggtgcagagccagctcaatacgttaaacaagcaaaaagaactgactccgcaggacaaactggtccagcaggatctgactcagacgctggaaacgctggataaaatcgagcgtatcaaaagcgagacggcacagctgcgacagcaggtcgagcaggcgccggcgaagctgcgccaggcggtggagagcctcaataacctgagcgatgtcccgaacgacgacgcgacgcgcaaaacgctaagtacgctctccctgcgtcagctggagtcgcgcgtcacccagacgctggacgatctgcagaatgcgcaaaacgatctggcgacctataacagccaactggtttccctgcaaacgcagccggaacgcgtgcaaaatgcgatgttcaacgcctcccagcagctgcagcagatccgcaatcgtctgaatggcacctcggtgggcgacgagaccctacgcccgacccagcaggtgctgttgcaggctcaacaggcattgctcaacgcgcagatcgagcaacagcgcaagagcctcgaaggcaacactatcctgcaggataccctgcagaagcagcgtgactacgtcaccgcctggagcaaccggctggagcatcagctacagctgctgcaggaggccgtgaacagcaaacggctgaccctgaccgagaaaaccgcccaggaggcggttacccccgacgaaacggcgcgtattcaggccaacccgctggtcaagcaggagctggatattaaccatcagctcagcgagaagctgatccaggcaacagagaacggtaaccagctggtgcagcgcaatatccaggtcaaaaactggctcgaccgcgcgctgcagtctgaacgggatattaaagagcaaatttcagttctgcgggggagcctgctgctgtcgcgtattctttaccaacagcaacagacattaccgtcggcggatgagctgcaggatatgaccaaccgcatcgccgacctgcggcttgaacagtttgaggtgaaccagcagcgcgacgcgctgttccagagcgatgcctttgtcgccaaactggaggaggggcacagcagcgaagtgaacgatgaagtccacgccgcgctactggaagtgatcgacatgcgtcgcgaactgcttgatcagttcaacaaacagttgggtaaccagctgatgatggccatcaacctgcagatcaaccagcagcagctgatgagcgtctcgagcagtctgaaggaaattctgacccagcaaattttctgggtgaacagcaataaaccgatggactgggagtggattaaggccttcccggaggcgctgaaaggtcagtttaaggcgatgaaaatcaccgtgaactgggaaaaagcgtggcctgcggtgtttgtcgctttcctggccggtttaccgctgctgttgattgccggcctcatccgctggcgtctgcagtggctcaaggattatcaggcaaagcttgcttcccaggtgggacagctgcgcaacgatacccagctgcatacgccgaaggcgatcctgatcgatctgatccgcgccttaccggtggtgctgttgattctggctatcggtctgatcttactcaccatgcagttaaatattagcggactgctgtgggcgtacagtaaaaagctggctatgttctggctggtgtttggcctgtgctggaaagtgctggaaaagaacggcgtcgcggtcaaccactttaatatgccggcgcagttgaccagccactggcggcggcagattgttcgcgtcagcctggcgctgctgccgctgaatttctggtcggtgatttccgaactgtcgccgctgaacctgatggacgacgtgctggggcagttggtgattttcttcaacttactgctgatcgcggtgctggtttggccgatgtgccgggaaagctggcgcgataaagagtcgcacagcctgcgcctgctgacgatcacggtgttgtctatcgttccggtggccctgatggtgctgacggcaaccggctacttctacacgacgctgcgtctggcgggacgctggatcgagaccgtgtatctggtgatgatctggaacctgctgtaccagaccgtgctgcgcggcctgagcgtggcggcgcggcgtatcgcctggcgccgcgcgctggcgcgccgtcaacatctggtgaaggaaggggcggaaggcgccgagccgcaggaagagccaactatcgctctcgagcaggtcaaccagcagacgctgcgcatcaccatgttggtgatggtcgcgctgttcgcggtgatgttctgggcgatttggtctgatttgatcaccgttttcgcctacctcgacagcattaccctctggcactacaacggcaccgaggcgggggccagcgtggtgcgcagcgtgacgatgggcagtttgttgttcgccattgtggcgtcaatggtcgcctgggcgctgatccgcaacctgccgggtttgctggaggtgctggtgctgtcgcggctcaacatgcgtcaggggacctcctacgccatcaccaccattctcaactatgcgattatcgctatcggggcgatgacggtattcggggcgctgggtgtctcctgggataaactgcaatggctggcggccgcgctgtcggttggtttaggtttcggtctgcaggagatcttcggtaactttgtctccggcctaatcattctgttcgaacgtccggtgcgcattggggatacggtcactatcggaaccttctcggggacggtaagcaaaatccgtattcgcgccaccaccatcaccgacttcgatcgcaaagaggtgattatcccgaacaaggcgttcgttaccgagcgcttgatcaactggtcgctctccgacaccgtgacccgggtggtgatccgcctcggcgtcgcctatggctcagacctggataaggtgaaagaggtgctgctgaaggccgcgcacgatcatccgaaagtgatgcaggagccggcgccagcggttttcttcaccaccttcggggccagtaccctggatcatgaactgcgtctgtatgttcgagaactgcgcgatcgcagctacacggtggatgagctcaaccgcgccatcgaccgcctgtgccgggagaatgacatcaacattgcctttaaccagctggaagttcatctgcgcaatgaaaaaggcgatgaagtcaccgaagtgaaacgggacgggaaaggcgacgatctggcgcccaccaccgcgtcctga

SEQ ID NO: 6404 - DNA, 1527 bp, Klebsiella pneumoniae
atgaaatctttaacgctaattccggggcaactgagcctgtcgcagctccgcgacgtttacagccacccgctgaacattacccttgatagcagcgcgtttgcggcaattgatgagagcgtggcctgcgtcaacgccatcctcgccgaagggcggaccgcctacggcatcaacaccggttttggcctgctggcgcagacccgtatctcgacggaagatctggagaacctgcagcgttcgctggtgctatcccacgcggcgggcgttggcgagccgctggacgatgatctggcgcggctgattatggtgctgaagattaacagcctgtcccgcggtttctccgggatccgcctgagcgtgatccaggcgctgattggcctggtgaatgccggtgtgacgccgtggatcccggccaaaggctccgtcggcgcctccggcgacctcgcgccgctggcgcatatgtcgctgaccctgatcggagaaggtaaagcgcgggtacgcggcggcgactggctgccggccaccgaagcgctgcgtcaggtggggctggagccgattaccctggcggcgaaagaggggctggcgctactcaacggcacccaggcctcgaccgcttttgccctgcgcggtctgttcgaagccgaggatctgttcgcctccgcggtcgtctgcggggcgttaaccaccgaagcggcgctgggctcacgtcgtccgtttgatgcgcgcatccatgaagtgcgcggccagcgcgggcagattgatgcggcggcgctgtatcgccacctgctgaccgacgatagcgcgatctcgcagtcgcaccataactgcagcaaggtgcaggacccgtactccctgcgctgccagccgcaggtgatgggcgcctgcctgacgcagatccgccaggcggctgaggtgctgctggctgaagccaacgcggtctccgataacccgctggtctttgccgccgaaaatgacgtcatctccggcggtaacttccatgccgaaccggtggcgatggccgcggataatatcgcgctggcgatcgccgaaatcggctcgctctccgagcgccgcatcgcgctgatgatggacagccatatgtcgcagctgccgccgttcctcgtcaaaaatggcggcgtcaactccgggtttatgattgcccaggtcacggcggcggcgttagccagtgaaaacaaagcgctgtcgcacccgcatagcgttgacagcctgcccacctctgccaaccaggaagaccacgtctcgatggcgccggcggccggtcgccgcctgtgggcgatggccgagaacacccgcggggtgctggccgttgagtggctggcggcggcgcaggggctggatatgcgcgaaggactgaccaccagtccgctgctggaagaggcgcgtcacttgctgcgcgaacgcgtgccgcactatacgcaggatcgctacttcgccccggatatcgataacgccattgcgcttctggcggcccgtcacctgacgcgtctgctgcctgccgtactgcattaa

SEQ ID NO: 6405 - DNA, 1497 bp, Klebsiella pneumoniae
aaagtgccattagagtatgtttttatggggccacgaggaggcaatatgaatataccggacgaggggttttttacgctgttgacgcaggggatgcggaaccgcacggtcgaaaccttacagcgcgccctttaccacaccttacgtgacgctatcctgcagggaaccctgacggcccgctgccgtttacccggatcgcgggtgatggccgaacggctacacctgtcgcggaatacggtcaatgccgcactggaacagctggcgctggaggggtacctgacacggagccgtcagggaacgcaggtggcaccactcgcctcctgccgccaggaggcgggtcagatgccgcccgtcgtgctgcctgagcggctgcaaaggctgccagccgcgatgcgccgcgactcaccgacgctggcatttacgccaggcatgccggcggtaaactatttcccgctgccgctgtggcggcgactgatggataacgtgctacgcgaagatggtaccgcgctgctgggttatggcgaagccgcgggcgatcctttgctgcgagaggctatcgctcgtcatctggcgctctcccggggcatccggtgcgatatccggcagatcgtcatcaccgaaggcgcgctggaaggcgtcaacttatgcgcctcgctactgaccaacccgggcgacagcgtgtggctggaagaaccggggtacctgggggcgaggagtggctttcagcgggcgggactgcgggtcagaggaatggctgtcgacgatgaagggatgtgtattgccaacagcttcacggagccgccccggctcattttcacctctccttcacaccagtatccctgtgggagcatcgtgagcgtcgggcgccgtctggcgctcgtggaatatgcccgccggcacggggcgtggattgtggaagatgactacgacagcgagtttcgtcatagcggagaaccgatcccggagatgctgggaatggtgcctgatatcccggtggtctatctcggcaccttcagcaaaacactgtttccggcgttgcgtatcggttttatggttatgccgcccgcgctggtggatgctgctcaagacgccatcggcgcgctgctgcgagggggaaaccgtgctgaacagcgggcgctggccatctctatcgacaagggacactatgcgcgccatctggcagcgatgcgccgcctgtaccgtaaacgtcagcaacagctgcgcgaggcgctggcgcaagagataaccgtgccgtgcgacgttctcggcgggggaggggggatgcacctgacggtggcgatggagggcgttaatgaccggacgcttgcgcagcaggcgcgccagtttcagctggcgcccgccgcgttaagtcatttctatctcgacccgcagcgagcgcggagcggactggtgcttgggtatggcaatacctctgcttctcgctatctcccggcgctgcggaccctaaatcgccttattgcgcagcaccggcgcgcgtga

SEQ ID NO: 6406 - DNA, 375 bp, Klebsiella pneumoniae
ctgcggccattaccgaatactgactggaggggacttatgaagctggttaccgtggtaatcaaaccattcaaactggaagacgtgcgtgaagctttgtcttccatcggcattcagggcctgacggtcactgaagtcaaaggatttggccgtcagaaaggtcacgcggagctctaccgcggcgccgagtatagcgtcaactttctgccaaaagtgaagattgatgtggcgattgccgacgatcagctggatgaagtcatcgatgtcatcagcaaagcggcttacaccggaaaaattggcgacggcaaaattttcgtcgctgaattgcagcgcgtcattcgcatccgtaccggcgaagctgacgaagcggcactgtaa

SEQ ID NO: 6407 - DNA, 1050 bp, Klebsiella pneumoniae
tgtttgtttttatatcactttatctttaggacttatctcgtacaaatcagtaatcttgttggcagttggtcgggtcaattaatggttctgtatcatgatctgtacctcccaaataaacttaggagaaaaacaaccatgagttctgccaagaagatcgggctatttgcctgtaccggtgtcgtcgccggtaatatgatggggagcgggattgcattattacctgcgaacctggccagcatcggtggtattgccatttggggctgggtaatttcaattattggtgcgatgtctctggcttatgtttatgcccgactggccactaaaaacccgcagcagggcggtcctattgcctacgctggcgaaatatctccggcgttcggtttccagaccggtgtcctttattatcatgcaaactggattggtaacctggccatcgggattaccgccgtttcttatctctctacgttcttcccaattttaaataacccggtgccagcaggtattgcctgtattgccatcgtgtggatctttactttcgttaatatgctgggcgggacctgggtcagccgtctgaccaccattggtctggtactggtgcttattccggtagtcatgaccgcggtcgtcggctggcactggtttgatgtcgctacctatcaggcgaactggaatacctccagcaccactgatagccacgcggttattaaaagtatcctgctctgcctgtgggccttcgttggcgtagaatccgccgccgtgagtaccgggatggtgaaaaacccgaaacgtaccgtgccgctggcaaccatgctgggtaccgcgatggccggtatcgtctacatcgccgcgactcaggttatcgccggtatgtatcctgcttctcagatggccgcgtccggtgcgccgttcgcaattagcgcctctaccatcctcggcggctgggctgcaccgatggtatccgctttcaccgcctttgcctgcctgacttctctgggctcgtggatgatgctggttgggccaggccggtgtacgtgccgccaacgacggtaa

SEQ ID NO: 6408 - DNA, 1767 bp, Klebsiella pneumoniae
ccatctcctttagccacgggaacggacatgagtgagaccgtcatcgccttaaacggcctgagccgccgttttcccggtatggacaggccagcggtagcgccgctcacctgcacgatccgcgccggctacgtcaccgggctggtggggcccgacggcgcggggaaaaccaccctgatgcgaatgctcgccggattgctcaaacctgatgagggccgcgccagcgtgataggcttcgacccgctaaaagacgacagcgccctgcacgcggtgctcggctatatgccgcagaagttcggcctgtatgaagatctgacggtgatggaaaacctgaccctgtacgccgacctgcgcagcgtcaccggcgaggcgcggaagaaaattttcgaccgcctgctggagttcacctctcttggtccattcaccgaacggctggcaggcaagctttccggcgggatgaagcaaaagctgggcctcgcctgtaccctggtgggcgatccgaaagtactgctgctcgatgagcccggcgtcggcgtcgaccctatctcgcgccgcgagctatggcagatggtgcacgagctggccggcgacggcatgctgattctgtggagcacctcctatctcgatgaagcggaacaatgccgcgacgtgctgctgatgaacgaaggcaaactgctctaccagggtgagccgacggcgctgacgcaaaccatggccgggcgcagctttctggtttccagccagcaggagaacaaccgccgcctgctgcagcgggcgctgaagctgccgcaggttagcgacggggtgatccagggcaaatcggtgcgtctgatcctgaaaaaggacgcgcgcattgaggaagtccagcagcatggcgacatgccgcccctgcaggtggccgacaccgcgccgcgctttgaagatgcgtttatcgacctgctcggcggcgccgggaccgctgaatcgccgttgggggcgattatccatcgcgttgacggcagcaaagaggaaacggtcattgaagcccagtcgttaacgaaaaagtttggtgatttcgccgctaccgaccatgtcgatttccaggttaagcgcggtgaaattttcggcctgcttggccccaacggcgccgggaaatccaccaccttcaaaatgatgtgcggcctgctggtgcccacctccggcaaagcgctggtgctgggaatggatctcaaggtcagctctggcaaggcgcgccagcatctgggctatatggcgcaaaaattttcgctgtacggcaacctcagcgtcgagcaaaacctgcgctttttctccggcgtctatggcctgcgcggccgggcgcaaaatgaaaaaatcgcccggatgagcgatgcctttggcctgaaaagtatcgcccgccacgccgccgacgagctgccgctcggctacaagcagcggctggcgctggcctgctccctgatgcatgaacccgatattctgtttctcgatgaacccacctccggcgtcgaccccctcacccgccgcgagttctggctacatattaatagcatggttgataaaggcgtgacggtaatggtcaccacccactttatggatgaggcggaatactgcgaccgcatcgggctggtctatcacggcaagcttatcgccagcgggaccccggatgagctgaaagcccaggcggcggacgacagccagacggacccgaccatggagcaggcgtttattaccctgattaaccgctgggacaaggagaatagccatgggcaatag

SEQ ID NO: 6409 - DNA, 249 bp, Klebsiella pneumoniae
cgcagacaattaaccgggagcgcaaactacgctgaagccaccgataacataaacaacaacactgcagtgcttcccctcaccctggccctctcccgaagggagagggaactgtccggctggcgtttaggcccgtgcaagcgcagcgccgccgggcaagatatcaggcacggtatccttgatttcgccgggtggcggctgcgccttacccggcctacagccccaaatcaccgctggcgctggggtcgctga

SEQ ID NO: 6410 - DNA, 234 bp, Klebsiella pneumoniae
cactttaaatttgaatgcgtatttaaacgaaataataacatgacggttaaggctgtaaccaataaaaactcaaccctcaaaggagcgcttgctattttgaaaataaaaaacaaggtaaaagaagaggtaatggcattacgcattgtgataaatgtacatcgagcccttttacacaatcgtaaaaatcatggcgcatcttttataggctggaagaaggattttatcaggcgctaa

SEQ ID NO: 6411 - DNA, 1032 bp, Klebsiella pneumoniae
accattaaatttttgaaccacagcatgataatttccacggctttgtcgttaaatcaggcgggcatgatagcgaattgtcgctatgcttgcattgttaatcggggtgaggagctgagcgtgcgtattggtattgatttaggtggaacaaaaaccgaagtgatagccctgagcgaccagggagagcagctgtttcgccaccggttacccacgccgcgggaggactaccggcaaaccatcgagaccatcgccactctggtggcgatggccgagcaggcgaccggacagcagggtaccgtggggatgggcattcctggctcaatttcgccttataccggggtggtgaaaaacgccaactcgacctggctcaacggccagccctttgataaggacctcagcctgcgccttgagcgggaagtccggctggctaacgatgccaactgtctggcggtgtcggaagcggtggacggcgcggcggcgggggcgcaaacggtattcgcggtgattatcggcaccggctgcggcgccggggtggcgctcaacgggcgggcgcatatcggcggcaatggtaacgctggcgaatggggacataacccattgccgtggatgaacgacgatgagctgcgctaccgtgcggaagtcccttgctactgcggcaaacaggggtgtatcgaaacctttgtctccggcaccggtttcgccaccgactatcagcggctgagcggcaaagggttaaccggcagcgagattatgcgcctggtgggagaaggtgacgaaaaggctgaactggcgctgagccgctatgaacagcggctggcgaaatcgctggcccacgtggtgaatatcctcgacccggacgttatcgtgctgggcggcgggatgagcaacgtcgaacggctgtatcagacggtgccggacctggtgaagcagtgggtcttcggcggcgagtgtgaaacgccgatccgcaaagcgatgcacggcgactccagcggggtacgcggcgcggcctggctgtggccgctccaggggacctga

SEQ ID NO: 6412 - DNA, 228 bp, Klebsiella pneumoniae
ttatcaaaattctgcacgttacgggggtgttcaatggctaactcaattcctaacagcggacgcgccgtgatgatgcgcaatcgccgcaccggcgccgcctggctggtcagcttcgactatcgcgacggcagctactggcatgagccgcagggaaatctgcgccacatccgccggccatacgcttcacgcagtatcgagccgaacctggtaccagccgggacgcattaa

SEQ ID NO: 6413 - DNA, 1083 bp, Klebsiella pneumoniae
ttttccttttctctttccagtacaacgagaaagagccgcactaatttttcaggagggggtatgaaaacgattaagggaccgggcatttttctggcgcagtttatcgggacgcaggcgccgttcaacaccctggcggggatagcgcagtgggccgccggcctggggtacaaggcattgcagatcccctgcaaccacccggcgatttttgatgtcgagcgggcggcggcgagccagacctactgcgacgaggtcagcggcatcctggcggagcatgggctggtgatcagcgagctgtccactcaccttgaaggacagctggtggcggtgcatccaacgtatgacgcggcgttcgacgcctttgccccggcggcgctgcatggcgatccgcaggcgcgccagcgctgggcggtggagaaagtgcgccaggcggcggtagcctccggccgcctggggctgcaggcgcacgcgaccttttccggggcgctggcatggccctttttttatccgtggccgccgcataatcagccgcttctggatgaggcctttgccgagctggcccggcgctggcggccgctgctggacctcttcgacgagcagggggtcgatgtctgctatgagatccaccccggcgaagacctgcacgatggcgtgacctttgagcgttttcttgcgctggtggataaccatccgcgctgcaatatgctctatgacccgagccacctgcatctgcagcagatggactacttggcctatatcgatatctatcatgcgcgtattaaagcgtttcacgtcaaggacgccgaatttcgccgcaacgggcgcaatggcgtctacggtggataccagccctggcagcagcgggccgggcgttttcgctctcccggcgacgggcagatcgacttcaaaggggtgttcagtaagctgaccgaatatgattttgccggctgggcggtgctggagtgggagtgctgcctgaaggatagtgagaccggcgcgcgcgagggcagcgagtttatccgccgccatatcattcccgttgcaggacgggccttcgatgactttgccgccggcgggagggaataa

SEQ ID NO: 6414 - DNA, 1257 bp, Klebsiella pneumoniae
cgggaattttctactattaaaggattaatggtcatgtcgtttattaaatatcccttaccggaatcggtgctgcaggcaactgagcagcggatccagtgggtcatcgataatttttcgcgcatctgtgtctctttttccgggggaaaagactccaccgttatgctgcatttaaccgcccaggcggcgcggttacaggggaaaaaaatctgcgtgttgtttattgactgggaagcgcagttctcctgcaccatcgcccactgtgaaaaactgcgtgcgctgtatgcggatgtcatcgaaaccttttactgggtcgccctgccgctcaccacccaaaatgccctgacgcagtataagccgcaatggcaatgctgggagcccggaaccgagtgggtacgccagccgccgccttgggccattacccacccgggctatttttcattttatcaacccggaatgagctttgaagccttcgtcagccatttcgccgagtggttttcgcagcgtcgtcccgccgccgtgctggtgggcattcgcgccgacgaatcgctaaatcgctttatgacgatttcttcacagcgtaaacagcgcttcgccgacgataaaccatggaccacttcagcgccgggcggccacgcctggtacatctacccgctctatgactggaaaaccgccgatatctggacttggtttgccaaaagcggcgagccctataacccgttgtacgatctgatgtatcaggccggggtgccgctgcgctatatgcgcatttgcgaaccgtttggtcccgagcagcgccaggggctgtggctgtatcacgtgctggaacctgagcgctgggccgcgatgtgccagcgagtgagcggcgcgcacagcggcggggtctatgccgggcatgataatcagttctacggtcatcggaaaatcgacaagcccgaccacctgacgtggaaaagctacgccctgttcctgctcgacagcatgccggaaaccaccgccgagcactaccgcaataaaatcgccgtctacctgcgctggtaccagaaaaaaggtatggaggatattccggatacccaacctgcggacattggcaccaaagatatcccatcctggcggcgagtctgcaaagtactgctcaataacgattactggtgccgtcagctttcgtttagcccaaccaaaagcagccactatcagcgctaccgtaaacgcatggaaaaacatcgccaacaatgggggatattatgcaacaacaactga

SEQ ID NO: 6415 - DNA, 516 bp, Klebsiella pneumoniae
aagtccctttcttccacccaagggcgttttgaaatagcctgtgaattcgatggtctgcccgattttatcatgatcgacaacagggtgcagaccattcttccctcagaacatttgctgaataaagacggcaattttgaaataatcaaatcgtttaaagcaacgaccacaggaaaaactgagcagacctgcatcagctgcatccacccggatgataatcccctgagatatttactgggcatgaaaatttccgaactcaaggcggtgggaaaaaagttgaaaaaaacgtggctgataaacgcaccgcatctttatggtgtcaggccatcagggaagccgcaactccctatacctcttcggaaattctactggatgtcgataaagagtttggaaccaacacaaaatcattatggggtaagatcttcgatttgctgcccatatatgcgattttcaaagccgacagggaaagtagcgatggggattccgaagctaaaaaaacctccttacagcaggccgtaa

SEQ ID NO: 6416 - DNA, 372 bp, Klebsiella pneumoniae
tgcgcccctttcgcctgggtctcaatcgcgtccaggttttcaggcattggctcatacggcgtctctttcgccgtcggtttatcctctttcagcgccgccagcgcggttttaatcgagaacagcgccagcaccaccaccacaatcataaagaagatggtcagcccggcatcgagacggttgttaaacaccagctgcgccagctgtgattcggtatattgcggcggaatgttgccgctgtcgatcatcgcctggaatttattagcgatcgccaggaaaccaactttggtgtccgggctaaacgacttctgccagccggcggtcaacgtacagatcagcaaccagctggtcggcagcagcgccacccacgcgtag

SEQ ID NO: 6417 - DNA, 306 bp, Klebsiella pneumoniae
ccgactatttcgttgctttgtcaacgccagccgggaaaacccggccagtctatcgtgttagaattattacaatcaaaaggtggaattatgtctgataagccattaactaaaacagactatttgatgcgcttacgtcgttgccagacaattgacacgctggagcgcgtcattgaaaaaaataaatatgaactgtctgataatgagctggcggtattttactcagctgccgaacatcgtctggcggaactgaccatgaataagctatacgataaaatcccgacctctgtctggaaatttatccgctaa

SEQ ID NO: 6418 - DNA, 3066 bp, Klebsiella pneumoniae
atggatatttcccgtcagtttattaacaacccgacccgcgtctggttagccattttgctgttaggggtgggtggcctgctcgccctgctcaatatcggccgcctggaagatcccgccttcaccatcaaaacggcggtgatcgtcacccactaccctggcgcgtccgctcagcaggtggaagaggaggttaccctgccgctggaaaacgcgattcagcagcttccctcgctggataacgtcagctccatctcctcgaatggcttatcgcaaattacggtgaatattgcttcgcagtaccattccagcgagctgccgcaaatctgggatgagctacgtcgccgggtcggtgacgccagccgccttttcccccctggcgtagtcccccctttcgtcaacgatgactttggcgatgtgtttggctttttcttcgctatctcgggcgacagttttaccaacccggagctggtgcgctatgccgaacagttgcgccgggagctggtgctggtgccgggggtcggtaaagtcgctatcggcggcgtcattccgcagcagatcaatgtggatatctcgctggcgaagatggcggcgcgcgggatcaccttcaaccagctcgccgcaatcctggcccgactcaacgtggtgtccagcgccggggagatccgcgttggcagcgaatcgatccgcctccaccccaccggtgagtttcagagcatcgatgagctgggagatctgctggtcagccctcacggcgccagcgccaccacccgactgcgggatattgctacgctgacgcgcgggctaaccgactcgccggccagtatctatcatgccaacgggcgccaggcggtgaccatgggagtttcttttatccctggcgtcaacgtcattgacgtcggccacgctctcgaggcccgcctccagcagatggccgccgacaaaccggcgggcatcgacatcgctattttttacgatcaggcagctgaggtggcccactcggtcaatggctttattaccaattttctgatggccctggcgattgtcgtcggcgtgctgctggtatttatgggggtgcgcagcgggattattattgctctgtcgctggcgctcaacgttctcggcaccctgcttatcatgtatatctgggggatcgaactacaacggatctccctcggagcgctaatcatcgccctgagtatgttggtggacaatgccattgtgattgtcgaaggggtgctcatcgcccgtcagcaaggctctccgttactgggcgcgattaactatgtgatccgtcgctctgccctgccgctgcttggcgcgacgatcatcgccatcctcgccttcgcgccgattggcctctcccaggactctaccggggagtattgcaaatcgctgttccaggtgctgctgatctccctgatgctgagctggttttccgctctgaccatcaccccggtgcttattaagtggtggctgtttaaaaacgccccgtcggccgccgccgcggaggaaaaggccgatccttaccgcggcagcttttaccgtggctatcagcaggcgctgcgaatactgctgcagcaaaagaccatgaccctggtgctgatgggcgcgctgttagccggagcgatctggggctttacctttgttcggcagaatttttttccgtcatcgaatacgcctatattctttgtcgacctgtggctaccctacggtaccgatataaacgccacggagaagatgacccgggatatcgagcggtcgatagccggtcagccgggggtggtcaccaccgtctccaccatcggccagggcagtatgcgtttcattctcacctacagcgggcagcgccagtacagcaactacgcgcagattatggtgcggatggatgatcaacgcggcatcgcccctgtcacccgccacgtggaggactggattgccagaaactacccgcaggttaacgccagcaccaaacgcattatgttcgggccctccggggatagcgcgattgaggtgcgcattaagggcccagacccggatacgctgcgcgcgctggcgagtcaggtaggcgatatcctcgccgcggacccggcgaccgacagcgtgcgtaatgactggcagaaccgcagcaaagtgatccgcccgcagtattccccggcgctgggacgcgagctgggggtggataaacaggatattgataacgcgctggagatgaatttctccgggagtcgcgccgggttatatcgtgaaggggccgatctgctgccagtgatcgtccggccgccggaagcagaacgtcaggatgccaaccatctgaataatgtgctggtctggagccagagtcgccagcaatatatcccgctgagtaacgtcatcaatggtttcgccctggagtgggaagatccgttgatcctccgccgggatcgtacccgggtgctgacggtccagaccgaccccagcccgctaagcggccaaacctcgggtgatattctcgcgcgggtgaaaccgcgcattgacgcactgccgctgccccacggctaccgtatcgaatggggcggcgatgccgagaactccagtggggcgcagcagggactgtttacaaccctgccgcttggctatctggtgatgtttatcataacggtgctgatgttcagttcgctgaaaaacgccgtcgccatctggctgaccgttccgctggcgctgatcggggtcacacccggctttctgcttaccggcatccccttcggctttatggccttaatcggcttgctcagcctgagcggtatgctgatccgtaacggcattgtgctggtagaagagatagagcaacaaaaacaggagaaagatcaacgacaagctattattgatgcggcaacctctcgtctgcggccgatcctgctgaccgccttcaccaccgtacttggcctggccccgctgctgcgcgatgtctttttccagagtatggcggtggtgatcatgttcggcctcgcctttgccaccgtgctgacgctgctggttctgccggtgatttacgcctgctttcaccataaggatatgacgcctcaacgatga

SEQ ID NO: 6419 - DNA, 2538 bp, Klebsiella pneumoniae
ttaaccatttcactcaagcagttaacaaaaaggggggattttatctccccttttatttttcctgcattcccgccgttgaatgtgtggaatacatccccatatactggattacatattaacgacgatgcagtggagtgtggcgtcgtcggctacctggcggactttaaactaagagagagctctatgaatcctgagcgttctgaacgcattgaaatccccgtattgccattgcgcgatgtggtggtttatccgcacatggtcatacccctgttcgtagggcgggaaaaatctatccgttgcctcgaagcggccatggaccatgataaaaaaatcatgctggttgcgcagaaagaagcgtcgacggatgagccgggtgtaaacgatcttttcaccgttggaaccgtggcgtctattttgcagatgctgaagctgccggacggcaccgtgaaggtgctggtcgaagggctgcagcgtgctcgcatttctgcgctgtctgataatggcgagcatttctcggcgaaagcggagtatctcgactcgccggcgattgacgaacgcgagcaggaagtgctggttcgcaccgctatcagccagtttgaaggctatatcaagctgaacaagaagatcccaccggaagtgctgacgtcgctgaacagcatcgacgatccggcgcgcctggcggataccatcgcggcgcacatgccgctgaagctggctgacaagcagtctgtgcttgagatgtccgacgttaacgaacgtctggaatatctgatggcgatgatggaatcggaaatcgatctgctgcaggttgagaagcgcattcgcaaccgcgtcaaaaagcagatggagaaatctcagcgcgagtactatctgaacgagcaaatgaaagcgattcagaaagaactcggcgagatggacgacgccccggacgaaaacgaagcgctgaagcgtaagatcgacgcggcgaaaatgccgaaagaggcgaaagaaaaaaccgaagcggaactgcagaagctgaagatgatgtcgccgatgtctgcggaagcgaccgtcgtgcgtggctacatcgactggatggtgcaggtgccgtggaatgcgcgcagtaaggtcaaaaaagacctgcgtcaggcccaggagatcctcgataccgatcactatggcctggagcgcgtgaaggatcgcatccttgaatatctcgcggtgcagagccgggtgaacaaaatcaaggggccaatcctttgtctggtgggaccgccgggggtaggtaaaacctcgctgggtcaatccatcgccaaagcgaccggacggaaatacgttcgtatggcgcttggcggcgtgcgcgatgaagcggaaatccgcggtcatcgtcggacctacattggctcgatgccgggcaaactgatccagaaaatggcgaaagtgggggtcaaaaacccgctgttcctgttggacgagatcgacaaaatgtcttccgacatgcgcggcgacccggcttccgcgttgcttgaggtgctggatccggaacagaacgtggcctttaacgaccactatctggaagtggattacgatctcagcgacgtgatgttcgtggcgacttccaactccatgaacattccggcgccgctgctggaccgtatggaagtgattcgtctctccggctataccgaagatgaaaaactgaacatcgccaaacgtcatctgctgccgaaacagatcgaacgtaacgcgctgaagaaaggcgagttgaccgtcgacgatagcgccattatcggcattattcgttactacacgcgggaagcgggggtacgtagcctggagcgtgaaatctccaagctgtgccgcaaggccgttaagcaactgctgctggataaatcgctgaaacacatcgaaattaacggtgagaatctgcatgattatctcggcgtacagcgcttcgactatggccgcgccgatagtgagaaccgcgtcggtcaggtgaccggtctggcgtggacggaagtgggcggcgatctgctgaccatcgaaaccgcctgcgtgccgggcaaaggcaagctgacctacaccggctcgctgggcgaggtgatgcaggagtcgattcaggctgcgctgacggtggtacgttcgcgggctgacaagctgggcattaacgccgacttctacgagaagcgtgacattcacgtgcacgtgccggaaggggcgacgcctaaggatggtccgagcgcgggtattgccatgtgcacggcgctggtctcctgcctgaccggcaacccggtacgcgctgatgtggcgatgaccggtgaaatcactctgcgtggtcaggtgctgccgatcggcggtctgaaggaaaaactgctggcggcgcatcgcggcggcattaagactgttctgattcctgatgagaacaaacgcgaccttgaagaaattccggataacgttatcgccgatttggatatccatccggtgaaacgaatcgaggaagttctgacacttgcgctgcagaacgaaccgttcggcatgcaggttgtgaccgcgaaatag

SEQ ID NO: 6420 - DNA, 366 bp, Klebsiella pneumoniae
ctgatgtcttcggtagcaaactggagctataccgctacggcgacaatctggcggcgtatacgcgatgctgacggtagtgataccgacggcggaggtcagccgtacggatgggaagcgccgatcgctatcctttgcgactaccagggcggcctttcagccaaaatcggtaaccttggccgggagatcgtggttaaaaacacgatatggaccgagcactcaacggcgcgggagggagattacatcctgattggcgcgtcgaccgatgcggctccgccggatgaggccgacgagatacggcaaatcgtccagttcgccgatacgttcgagcgactggcggacgatttcgcactgattacgggagtctga

SEQ ID NO: 6421 - DNA, 312 bp, Klebsiella pneumoniae
agccgtccttcttccgtgatgcgcactccgcggccgtggcggataaagagcgtgacgccgaccagggcttccagctgtttgatgtgctggctgaccgccgaatgggtcacgctcaactcgtgggcggcctgcgtcacgctgccgaggcgcgccaccgcttcaaagctgcgcaggctggcgacagggggaaaatctgccatggtggtttctctgtcagtgagtcgatacgttaacgttactaccgggttagcggcttttaaagccgctgcaaacaggctgaaaaggagccaaatgccgcctcagtcggtatag

SEQ ID NO: 6422 - DNA, 285 bp, Klebsiella pneumoniae
ctaattacttccctcgtttttggtattttaaccggtgagcatttaccgcattctactactgtcatctcccgtagattgaggttaaaaatgtctaaaactctaatccgtttatctgaggtccgccgcaggacaggctacagtaaagcatggatttaccgactgattagcgaacatcgctttcctcagccaatcaagataggagctcgcgcaatcgcgtttgttgaaggtgaaatcgatgagtggatcgagcgacgcattgctgaatcgcgtggtgagttggcctga

SEQ ID NO: 6423 - DNA, 1281 bp, Klebsiella pneumoniae
aatccacattcatgtgggggtacatttgggggtagattcctgttcaatgaaatgagatacccccaagtgaagctcacagcccgccaggtcgatacatctaaagctaaggacaaaccctataaactgtctgatggcggtggcctttacctcttggtgaaccccaacggcgctcgatactggcggcttaagtaccgggtcgccggtaaagaaaagtcattggctttaggtgtataccctgaggtctcgctggccgatgcacgtcaaaaacgagcagaggctaaaaaagtactggctgctggtggtgacccggggcaggaaaagcaggaaaaaaaacatgccagggcgatggccgtatcaaacagctttgagagactggcgctggaatggcatgaacataaatcgatgaactggtcagcaggctatgccagcgacatcttggagtatctgagaaaagatatttttccttatattggctcccggtcgatcactgatattaagcccgttgatatgttggctgttcttcgcaagatggaacaacgtggagtacttgataagctcaaaaagacacgtcaagcctgccggcagatcttcacctatgctgtcatcaccggcagagcagaacataatcccgtggtcgatctcgccagtactctaaaagcaccaaagcaaaaacacttccctcatttatcggttgaacaaatacctgactttctgcgagctctgaacgactatagcggcagcgtggtgactcgaaatgctacccgcctgcttatgcttactgggctcaggacaattgagctccgtgcttctgaatgggttgatatcgacttcgataaagggatctggaatatccctgcagagcgaatgaagatgcggcggccacatctcgttcctatttcaactcaggttcgcgaactgcttgaagaaatccaccagcttaccgggcgaggaaagtatgttttccccggacggaatgatgccggcaagccaatgagtgaggccagcattaaccaggtgattaagcgtattggctatgacggtaaagcgaccgggcatggcttccgccacactatgagtaccatcctccatgaacagggctataacaccgcctggattgaaacgcagttggcgcacgtcgataagaactccatccgcgggacatataaccacgctcagtatctggatggccggcgggaaatgctccagtggtatgccgactatatgcaggcgcttgagaacggtgaaaatgtggttcatggctcgttcgggaaacgtgcctga

SEQ ID NO: 6424 - DNA, 1029 bp, Klebsiella pneumoniae
atttcgcattccagggcgcgtattgtaatgctttggtcgccccctgaccagtgcgagcgttatcgccgcaagagggcgaaaaatccggtaaacttaacggattctgctttaaggataatagccatgacaattcacgtaacagatgtcgccatcgtgggcggcggcatggtcggcggcgccctggcgttagggctggcgcaacagggatttaccgtgacggtgcttgagaaagcggcgccaccggcgttcgatccggcatccgccccggatgtgcggatctcggcgatcagcgcggcttcgatcggcctgctgaagagtctcggcgtctgggatgccatacgggcgatgcgcgtccatgcttatcgccgtctggagacctgggagtgggagagcgcgcacgtcgccttcgacgccgcggagctcaagctgccggagctgggctatatggtcgagaacaaggttctgcaatggggcctgtggcaagcgctggcggcgcatgaggcggttaccctgcgcgtcggtagcgaactgaaaaagatgcagcgcggcgagacgcagacggcgttgcatttgcgcgagggggagacgatccacgcccggctggttatcggcgccgacggcgctaactcccaggtgcgggagatggccggcatcggcgtgcacgcctggcaatatcagcagtcctgtatgctgatcagcgtcgaatgcgccgacgatcccggcgacagcacctggcagcagtttactcccagcggccccacgcgctttcctgccgctgttcgaccactgggcctcgctggtctggtacgacgccccggcgcggatccgtcagctgcagagcatgaccatggcgcagctccagcaggagatcgccagtcactttccggcgcggctgggacgggtgacgccgcaggcggccggcgccttcccgctcacccggcgtcatgcgctgcagtatgttcagcccggcctggcgctggtgggcgatgcggcgcacaccattcatccactggcggggcagggggttaa

SEQ ID NO: 6425 - DNA, 339 bp, Klebsiella pneumoniae
caaaaattctctaccgcggcccggcgacatacatccccccgccgcggcaaaacaaagactggagtaaagattatgaaacgcgcaatgatcatcgcatcccttggcctggcttcccttctctctttcggtgccagcgcggctgtccagcaagtgaacgcagagcaagcccaaaatctgcaatccatgggcaccatctccgtatcccaggtaggtagtgcgccaatggacatgcgtcaggaactggcggctaaagccgagaaagaaggcgccagcagctaccgtattattgaagcacgtaccggcgatagctggcacgccaccgctgagctgtacaaataa

SEQ ID NO: 6426 - DNA, 435 bp, Klebsiella pneumoniae
gcagtagactctttctgcgcttccgtcatcaccatggagcgacgttccgcacccatcatgattttgtctttcgctttctcgaactcaaccatcgacacaacgcgtttgttaccgcgggcagcaaacagcgccgcttcgttgaccaggttggccagatccgcaccggagaagcccggggtaccgcgcgcaatgattgccgcatcgatatccggcgccagcggaacgcgacgcatatgcactttcaggatctgctcacgaccgcgaacatccggcaggccaaccaccacctggcggtcaaaacggcccggacgcaacagcgcggggtcaagaacgtccggacggttagtcgccgcgataacgatgataccttcgttaccttcgaagccgtccatctcaaccagcatctggttcagggtctgctcacgttcatcgtga

SEQ ID NO: 6427 - DNA, 1272 bp, Klebsiella pneumoniae
agaacagaatcaatggataaattccgtgttcaggggccgactcgccttcagggtgaagtcaccatctccggggcaaaaaacgccgccctgccaatcctcttttccgcgctgcttgccgaagagccggtagagatccaaaacgtacctaagctgaaagacatcgataccaccatgaagctgctgagccagctgggcgcgaaggtcgagcgcaatggttcggtatggattgacgccggcccggtcgatgtattctgtgctccgtacgatctggtgaaaaccatgcgcgcctctatctgggcgctgggcccgttggtggcgcgtttcggtcaggggcaagtttctctgcctggcggctgcgctatcggcgcgcgtccggtcgatctgcatattagcggtctggagcagctaggcgccgagatcaaactggaagaaggttatgtcaaagcctcggtcagcggtcgcctgaaaggcgcgcatattgtgatggataaggtgagcgtcggcgccaccgtaaccatcatgagcgcagcgacgcttgcggagggaacgacgattattgaaaacgccgctcgcgagccggagattgtcgataccgccaacttcctgaacgcgctgggcgcaaaaatcacaggccagggtagcgatcgcattaccatcgaaggcgtgcagcgcctgggcggcggcgtctaccgtgtgctgcctgaccgtattgaaaccgggactttcctggtggccgcggcgatttccggcggcaagatcctctgccgtaacgcgcagccggataccctggatgccgtactggcgaagctgcgcgacgccggggctgacatcgaaacgggcgaagactggatcagcctcgatatgcacggcaaccgtccgaaagcggtcaacgtgcgtaccgcgccgcacccgggcttcccgaccgatatgcaggcccagttcacgctgcttaacctggtagcggaagggaccggcgtgatcaccgaaacgatctttgaaaaccgcttcatgcacattccggagctgatccgtatgggcgcgcacgcggagatcgagagcaataccgctatctgtcacggcgtgaagcagctttctggcgcgcaggtgatggcgaccgatttgcgcgcgtcggcgagcctggtgctggccggctgtatcgctgaagggaccaccatcgtcgatcgcatctatcatatcgatcgcggctatgagcgtatcgaagataaactgcaggccctgggcgccaatattcaacgcgtgaagggcgagtaa

SEQ ID NO: 6428 - DNA, 363 bp, Klebsiella pneumoniae
cagaacttgttagaaccctacatagtacgcgggtatagtgtctctatcgcccatgtgggacgatctggacttttaacaccaggagaatttatggataagttcatcgactggcatcccgcagatattgttgcgggattacgtaaacggggaacatcgctggcggcagagtcgcgacggcacggactaagttcttcaacgctggcgaacgccctgacccgcccctggccgaaaggcgaattgattatcgccacagcgctggaaacgcagccgtgggtcatctggccgtcacgctaccacgacccggtgactcatgagtttatcgacagaacgcagatgatgcgtcagaagaagatcgacaagtga

SEQ ID NO: 6429 - DNA, 321 bp, Klebsiella pneumoniae
tttcggcctccggcccggacaatccgcggtgataaaataagccattccgttctgcactggctttcagtacaacccagcggattatccagaggtaatatcatgaaaaagtatttaatcgtggcgctgctggcctctctactggcaggctgtgcccatgactctccctgcgtaccggtttatgactcgcaaggccgcttagtccataccaatacctgtatgaaaggcacaacagaagacaactgggaaaccgcaggcgcaatcgccgggggtgcggccgcggtagccggcctcacgttagggatcgttgctctgacccgctag

SEQ ID NO: 6430 - DNA, 1863 bp, Klebsiella pneumoniae
gaggttaatcccttgagtgacatggcgaaaaacctaatactctggctggtcattgccgttgtgctgatgtcagtattccagagctttgggcccagcgagtcgaatggccgcaaggtggattattctaccttcctgcaagaggtcaatcaggaccaggttcgcgaagcgcgtatcaacggacgtgagatcaacgttaccaagaaagatagtaaccgttacacgacttacattccggttaacgatccgaagctgctcgataacctgttgactaaaaacgtcaaagttgttggcgaaccaccagaagagccgagcctgctggcttccatcttcatctcctggttcccaatgctgctgctgatcggcgtctggatcttctttatgcggcaaatgcagggcggcggcgggaagggcgcgatgtccttcggcaaaagcaaagcccgtatgttgacggaagaccagatcaaaaccacttttgcagacgttgccgggtgtgacgaagcaaaagaggaagtcggcgagctggtagaatacctgcgtgagccgagccgcttccagaaactgggcggtaaaatcccgaaaggcgtcctgatggtcggccctccgggtaccggtaaaacgctgctggcgaaagcgatcgctggtgaagcgaaggtaccgttctttaccatttccggttctgacttcgtcgaaatgttcgtcggtgtgggcgcttctcgtgtgcgtgacatgttcgaacaggctaagaaagccgcgccttgcatcatcttcatcgatgaaatcgacgccgtcggccgccagcgtggcgcaggcctgggcggtggtcacgatgaacgtgagcagaccctgaaccagatgctggttgagatggacggcttcgaaggtaacgaaggtatcatcgttatcgcggcgactaaccgtccggacgttcttgaccccgcgctgttgcgtccgggccgttttgaccgccaggtggtggttggcctgccggatgttcgcggtcgtgagcagatcctgaaagtgcatatgcgtcgcgttccgctggcgccggatatcgatgcggcaatcattgcgcgcggtaccccgggcttctccggtgcggatctggccaacctggtcaacgaagcggcgctgtttgctgcccgcggtaacaaacgcgttgtgtcgatggttgagttcgagaaagcgaaagacaaaatcatgatgggtgcggaacgtcgctccatggtgatgacggaagcgcagaaagagtctactgcttatcatgaagcgggccacgcgattattggtcgcctggtgccggagcacgatccggtgcacaaagtgacgattatcccgcgcggtcgtgcgctgggtgtgaccttcttcctgccggaaggcgatgcaatcagcgccagccgtcagaaactggaaagccagatctccaccctgtacggcggtcgtctggcggaagagattatctacggtccggaacatgtttctaccggtgcgtccaacgatattaaagtggcgacgaacctggcgcgtaacatggtgacccagtggggcttctccgacaaactcggtccgctgctgtatgcggaagaagagggtgaagtcttcctcggccgtagcgtcgcgaaagcgaagcatatgtccgatgaaaccgcgcgtatcatcgaccaggaagtgaaatcgctgattgagcgtaactacggtcgtgctcgccagctgctgaacgacaacatggacattctgcacgcgatgaaagatgcgctcatgaagtatgagaccatcgatgcgccgcagattgacgacctgatggctcgtcgcgaagttcgtccgccagcgggttgggaagaacctggttctttttacaaactctga

SEQ ID NO: 6431 - DNA, 3840 bp, Klebsiella pneumoniae
tgtaagacaccgcgtcattgtgcggctgacaaggagagaggcgtgaggcgactgcccgggattttattgctcaccgtggcaacattgattgttatcgtcgcgctgctggtgagtggcttgcgtctcgtgttgccacagctcgacgcctggcgtccgcagctgctggagaagatctccaccctcaccggtacgccggtggacgcctcgcagatcaccgccagctggcagacttttggtccgacgttagatgcccgcgatatccatgtcgggctgaaagatggcggcacaatggcggtcaagcgcgtaaccctggcgctggatgtctggcagagcctgctgcatatgcgctggcagttccgcgacctcaccttctggcagctgcaggtccataccaatacccctattcagaccaatgacggtggcgaaagcctgaaaaccgaccgtatcagcgatctctttttacgtcagttcgatcactttactctgcgcgacagccatctgagcttcctgaccctttccggtcagcgggcggagctggcggttccgcagctgacatggcttaacggcaggaaccgtcatcgcgccgaggggcagctcagcctctccagcctcaccggccagcatggcgtcatgcaggtgcggatggatcttcgcgatgaggatggcctgctgaataaaggccgggtctggctgcaggcggatgatatcgacgtcaaaccgtggctgggacgctggatgcaggacaatatcgccctgaaaagcgcccgcttcagcctcgaaggctggatgaccattgaaaaaggcgatgtggccagcggcgacgtatggctgaaaaaagggggcgccagctggcagggcgataacgaagtccatcatttgtcggtggataacctgacggcgcatctctcccatgataagcaaagctgggccttttatattcccgatacgcggatcgctatcgatgataaaccctggccaagcggagccctggcgatggcatggatcccggcgcaggacgttggtggcgacgatcgtcagcgtagcgatgagttacgtattcgcgccagcaatttggccctcagcggcctgagcgggttacagccgtttgctgataagctggcgccttctctgggcgaactctggcgtaccacgcagcctggcggcaaaatcaatttgctggctctcgatatccccctgcaggcgacggagaaaacgcgttttcaggcgcagtggagcgatctggcgtggaagcagtggaaactcctgcctggggcagagcacttctccggcagtctgaatggcagcgttgagcacggggaattacgcgcccatatggcgaaggcgctgatgccgtatgccggcgtcttccgcgcgccgctggagatagccgctggcgaagccacgctcagttgggtgaaaaacgacaaagggtttatgcttgatggccgcgatatagacgtgcaggcgacaggcgtacgcgcccgcggcggcttccgctatctgcaaccgcagggggacgatccctggctgggcattctggcgggcatcagcaccaatgacggtggccaggcatggcgttatttcccggaaaatctgatgggcaaagcgctggtggactatctgagcggcgcgattaaagcggggcaagccagcgatgcgacgctggtgtatggcggcaatccgcatctattcccttatccgcataatgaaggccagttccaggtttatgttccgctgaagaacgccacttttgccttccaaccggactggccggcgctaaccgggctgaacatcgacctcaattttatcaacaacggcctgtggatgcgggcggataaagcgatgcttggcaacgtgaccgccagcaatctcgatgccgcaatcccggactatgcgcaggaaaaactgctgattgatgccgatatcaaaggcccgggcaaagaggttggaccttactttaatactacgccgctgaaagagtcgctcggggcggcgctggattccctgcagctggatggggatgtgagcgctcgcttacatcttaatatccccctcgacggcgagatgaccaccgcgaaaggcgatgtgcgcctgcagaataatagcctgtttatcaaaccgttagatactacgctgcagaacctgagcggtaatttcagctttgtgaatggcgatctcaatagtcaaacgttgagcgcgacctggtttaatcagccgctgaacctcaatttttccacccgcgaaggtgaaaaagcgtttctggtggatgtcgggatgaatgccaactggcagccgtcgcgcaccgggctgctgccgaaagccgtgagtgaggcgttgagcggtagcgtcccgtgggatggcaaggtcgccatcgaactgccgtaccatggcaatgccagctataaggtcgatatcaacggcgatctgaagaatgtgagcagtcgcttaccttcgccagtcagtaagcccgccggcgaaccccttccggtcaaaattaacgtcgccggcggcctgagcagcttcgacctgaccggctccatcggggcgaagaatcatattaacagccgctggttactcaatcataagctgacgctggatagagcgatccttaccactgacagcaaagggtactctccgctgcccgatcagcccggtatcgagctcaatctgccgccgatggatggcgcgcagtggctggcgctcttcgagaacggcgcggcaaatgaagtgagcagcaacgtgctctttccaccgcgcattgtgctgcgtacaccgtcgctggccctcgcgggtcaacagtggaacaacgtcagtctgatgtcccagccggtcgccggcggctcgcaggttgaggcgcaggggcgtgagatcaatgccacattgacgatgcgcgacaatgctccgtggctggcaaatgtgcgttatctctatttcaatccggccagcgccagcggccagaacgcaacagagaatgtggccccccagacggtgacgcggctggatttccatggctggcccgatctgcagctacgctgcgcggaatgctggctgtggggacaaaaatatggccgcatcgatggggatgtggcgatcaaaggggataccttaacgctctccaacggcctggtggataccgggtttggccggctgacgaccaacggcgtgtgggtgaacgccccttcaggggttcgaacctcgctgaaaggcagactgcacggcaataagacggatgcatttgcggatttctttggcgtctccacgccggtgaaggattcgccgtttgatatcgactacgatctgcactggcgcgcgccgccctggtcacccgatgtcgcgtcgctcaatggcatcattaaaagccacctgggcaaggggcagtttaccgacctgagtaccgggcacgctggccagctgctgcgtctgctgagtgtggatgccctgctgcgtaaactgcgtttcgatttcagcgataccttcagcgaaggcttttacttcgattcgattaacagtacggcatggattaaggatggcgtactgcataccgatgatacgctggtagatggccttgaagcggatattgctatgaaagggtcggtcgatctggtgcgtcgccagctggatctgcaggcggtggtggcgccggagatctccgcgaccgtcggcgtggcggcggcctttgccgtcaaccccatcgtcggcgcggcggtatttgccgccagcaaagtgctgggtccgctgtggaataaagtttcgattctgcgctaccgcatcaccggcccgattgaccagccgcagatcaatgaagtgctgcgccaggcgcgcagcaataaaaagcaatga

SEQ ID NO: 6432 - DNA, 312 bp, Klebsiella pneumoniae
agatcggcaccctttctttcttttaatttttggagttataaaatgtctctaagcgttgaagctaaagcaaaaatcgtttctgagtttggtcgtggcgaaaacgacagcggttctaccgaagttcaggttgcactgctgaccgcacagatcaaccacctgcagggccactttgcagagcacaaaaaagatcaccacagccgtcgtggtctgctgcgcatggtttctcagcgtcgtaaactgctcgactacctgaaacgtaaagatgttgcccgttactctgcgctgattgagcgtctgggtctgcgtcgctaa

SEQ ID NO: 6433 - DNA, 981 bp, Klebsiella pneumoniae
ccctccgcttttgcggagggcgttttacgggcaggacgcctcgtttgcagccggggaacaggacgttcatccaatcgttgtcttcgggagtgggaaatgaagccttttttgcgctggtgtttcgtggcgacagctctcacgctggcaggatgcagtagcaccgcctggcgtaaggacgccgtcctcgcagtaccattgcaaccgactttacagcaagaagtgattctggcacgcatggaacaaattcttgccagtcgggctttatccgatgacgaacgcgcacagcttttatatgagcgcggagtgttgtatgatagtctcggtctgagggcacttgcgcgaaatgatttttcacaagcgctggcaatccgacccgatatgccggaagtattcaattacttaggcatttacttaacgcaggcaggcaattttgatgctgcctatgaagcgtttgattctgtacttgagcttgatccaacttacaactacgcgcacttgaaccgcggtatcgccttgtattacggcggccgggctaagttagcgcaagatgatctgctggcgttttatcaagacgatcccaatgatcctttccgtagcctgtggctttatatcgccgagcgtaaactcgacgagaagcgggcgcttgaagcactcagagagcgcttaaacaagtcggataaagagcaatggggatggaacattgtcgagttctaccttggcgacattagcgaaaaagagctgatgactcgtctgaaggcagacgcaacggataacacctcgctcgctgagcatctcagtgaaaccaacttctatttaggtaagtactacctaagtctgggggacaaggacagcgctacggcactgttcaaactggcggtcgccaacaacgtacacaactacgttgagcaccgatacgcattgttggaattatcgctcttgggccaggagcaagatgacctggcagaatcggaccagcaatag

SEQ ID NO: 6434 - DNA, 474 bp, Klebsiella pneumoniae
tctgcgatgccactcatgcgctgccgatccaggttctgcgtaacgacattcgcgtcattgccgccggtaacggctgcacggacgatctccagcttgagcatctgccgggcgaataccgatattcgcgtccgcgacgtgctggtgacctccggtctcggcggtcgtttccctgaagggtatccggttggggtagtctcctcggtgaaactggacacccagcgcgcctataccgtgattcaggcgcgtccgacggccgggctgcagcgcttgcgctatctgttgctgctgtggggcgccgatcgtaatggcgctaacccgatgaccccggaagaggttcatcgggtggctaacgaacgtctgatgcagatgatgccgcaggtactgcctgcgccggatgcgatggggccgcagatgccggcgcccgccaccgggttgacgccgcctcagccgtcgcagcctgcaggggggcaatag

SEQ ID NO: 6435 - DNA, 951 bp, Klebsiella pneumoniae
tcctggtcgccgccaccgatggcactctggccgccgacgttcgtccgctggttcgtctttccgtcagcgtgctggtggaagaggatggcaagcgtgagcgcggcagcagcggcggtggcgggcgttttggttatgactatttcctcgcctcccaggagggcgacgtgcgggctgatgcctgggcgaaagaagcggtgcgcatggcgctggtcaacctctcggcggtcgccgcccctgcggggatgctgccggtggtgctcggcgccggctggcctggcgtcctgctgcatgaaagcggtcggccatgggctggaaggcgatttcaaccggcgtggcacctcggtctttagcggccatatgggggaattagtcgcctctgagctgtgcaccgtagtggatgacggcaccatcgccgatcgccgtggctcggtggccattgatgacgaagggacgccggggcaatacaacgtgctgatcgaaaacggcattctgaaaggctatatgcaggataaactcaacgcgcgcctgatgggcgtcgcaccgacaggcaatggccgacgtgagtcgtatgcccatctgccgatgccgcgtatgaccaacacctatatgctggcgggccagtcgacgccacaggagattatcgaatcggtcgactacggtatctttgcgcctaacttcggcggcgggcaggtggatatcacctccggtaaattcgtcttttccacttccgaggcctatctgatcgaaaaagggaaggtcacgaaggcggtgaaaggggccacgctgattggctccggcattgagaccatgcagcagatttcgatggtgggcaacgacctgcgcctggataacggcgtcggcgtctgtggcaaagagggccagagcgtgccggtgggcgtcggccagccgaccctgaaggtcgataaccttaccgtcggcggcaccgcctga

SEQ ID NO: 6436 - DNA, 294 bp, Klebsiella pneumoniae
gcaaagccgccggtcatccctgcgccaaagttgacgccggtttttccgagcacgcagacgatgccgccggtcatatattcgcagccgttgtcgccgatgccttccaccacggtgatggcgccggagttacgcacggcgaaacgctcgcccgcgcggcctgcggcgtacagacgaccaccggtcgcgccgtacaggcaggtgttgccgataatgctggcttcatggctgcggaacgcagagcccaccggcggacgaatggccagcagaccgcccgccatgcctttcccgacgtag

SEQ ID NO: 6437 - DNA, 696 bp, Klebsiella pneumoniae
cctatgaagccaatttttagccgtggcccctcgctacagattcgccttattctggcggtgctggtggcgcttggcgtgattatcgccgacagccgcctgggtacgttcagtcaaatcagaacgtacatggatacagccgtcagccctttctactttgtctctaatggtccccgggaactgctcgacagcgtatcgcagacgctagctacccgcgaccagctcgaactggaaaaccgcgcgctgcgccaggagctgttgctgaaaaacagcgatctgctgatgctgggccagtacaagcaggagaacgcgcgcctgcgtgaactgcttggctcgccgctgcgccaggacgagcaaaaaatggtgacgcaggtcatctcaacggtcaacgacccttacagcgatcaggtggttattgacaaaggcagcgtgaacggcgtctatgaaggccagccggttatcagcgataaaggcgtcgtggggcaagtcgtggccgtggcgaaaatgaccagccgggtgctgctgatctgcgatgccactcatgcgctgccgatccaggttctgcgtaacgacattcgcgtcattgccgccggtaacggctgcacggacgatctccagcttgagcatctgccgggcgaataccgatattcgcgtccgcgacgtgctggtgacctccggtctcggcggtcgtttccctga

SEQ ID NO: 6438 - DNA, 492 bp, Klebsiella pneumoniae
ctgggctatacgccctttttttatgtcttgggggtgggtttgtccacattagagcaaaaattgacagagatgctcactgcgccggttgaagcgcttggctttgagctggtcggcatcgaatttattcgcggtcgcacatccacactgcgcatctatattgatagtgaagatggcatcaacgttgatgattgtgctgatgtgagccaccaggtaagcgccgtcatggatgtcgaagacccgatcactgtcgcttacaacctggaagtctcttcgcctggtcttgaccgtccgatgttcaccgccgaacactatcaacgtttcaccggcgaagaagttgcgctggtgctgcgcatggcggttcagaaccgccgcaaatggcagggcattatcaaagcggtagacggtgagatgatcacggtaaccgtcgaaggcaaagatgaagtgttcgcgctgagtaacatccagaaggcgaacctggttccccacttttaa

SEQ ID NO: 6439 - DNA, 1329 bp, Klebsiella pneumoniae
cgccttcaaacgccgtcatcgcgacccattcaaatgcgatacaagtccatgtcacccacgtcagacggctcacgtttcggacgatcttcgcgatcgccgcgcggcccgcgatcattacggtcgccacgaccggtcgaaccgatcgtcacgatcgcggaattcacgacgtggacgcatcggcgcgtccggcggaacgatcagcgaacgttcgccctgagccatcttcagcagcgcagcagccagcgtttccacgtccagctcttcaccttccgccgtcggctggattttcgccagcagtgcacggtactgatccagatcgctgctttccagctgctgctgaactttcgcggcgaatttttccagacgacgcttgctcagcagctccgcgttaggcagttccacttcaggaatggtcagcttcatagtgcgttcgatgttgcgcagcagacgacgctcgcggttctcaacgaacagcagcgcgcggccagcacgaccggcacgaccagtacggccgatacggtgaacgtaggattcagaatccattgggatgtcgtagttcaccaccaggctgatacgctcaacgtccaggccacgggccgcaacgtcagtcgcaatcaggatatccagacgaccatctttcaggcgttccagagtctgctcacgcagcgcctggttcatgtcgccgttcagcgccgcgctgttgtagccattacgctccagcgcttcagctacttccagggtcgcgtttttggtacggacgaagataatcgccgcatcaaagtcttccgcttccaggaaacgcaccagcgcttcgtttttacgcatgccgtaggcagtccagtagctctggctgatatccgggcgagtcgtcacgctggactgaatgcgcacttcctgcggctctttcataaagcgacgggtaatgcgacggatagcttccggcatggtggcggagaacagcgcggtctgatgcccttccgggatctgcgccataatggtttctacgtcttcgataaagcccatgcgcagcatttcatctgcttcatccagtaccaggccgctcagtttggagaggtccagggtgccgcgcttcaggtggtccagcagacgacccggggtaccgacgacgatctgcggaccctgacgcagggcgcgcagctgcacgtcataacgctggccgccgtacagggcaaccacgttcacgccgcgcatatgtttagagaattccgtcattgcttcagcaacctgtaccgccagctcgcgggtcggcgccagcaccagaatctgcggtgctctcagctcaggatcgatgttgttcagcagcggtaa

SEQ ID NO: 6440 - DNA, 444 bp, Klebsiella pneumoniae
gctggcagaacgctttttacctgtcatttaacattcccgttcgggttcatcgtactttactgcgtaaaaatcgacgcggtagtttggcgatatatgggagatggcggtagaatgacccgttttcaatcccaacgtaagcaaaaaaatacgatgaatctgagtactaaacaaaaacagcacctgaaaggtctggcacatccgctcaagccggtagttatgcttggcaacaatggtttgaccgaaggggtactggccgagatcgaacaagcgttagggcaccatgaactcatcaaggtgaagatcgcctcagaagatcgcgaaacaaaagccttgatcgtggaagccatcgtacgcgaaaccggcgcctgtaacgtacaggtcatcggtaaaacgctggttctgtaccgcccaacaccagagcgtaaaatctcgctgccacgctaa

SEQ ID NO: 6441 - DNA, 516 bp, Klebsiella pneumoniae
gtttgctggacaatgtcgtgtgaacctcaactgactaaacgtttgggtgttcaccaacgtgtaacttattatttgggtaagcttttaatgaaaacttttacagctaaaccagaaaccgtaaaacgcgactggtatgttgttgacgcgaccggtaaaactctgggccgtctggctactgaactggctcgtcgcctgcgcggtaagcacaaagcggaatacactccgcacgttgataccggtgattacatcatcgttctgaacgcagaaaaagttgctgttaccggcaacaagcgcgaagacaaaatgtactaccaccacaccggccacatcggtggtatcaaagaagcgacctttgaagagatgattgcccgccgtcctgagcgtgtgattgaaatcgcggttaaaggcatgctgccaaaaggcccgctgggtcgtgctatgtaccgtaaactgaaagtttacgcgggtaacgagcacaaccacgcggcacagcaaccgcaagttcttgacatctaa

SEQ ID NO: 6442 - DNA, 666 bp, Klebsiella pneumoniae
  unsure (6): Identity of nucleotide at the above locations are unknown.
ctgctncatgcagcgccgtcatcagtaaagtggtcgaaagaagcgccggcgccgggcatcaccccggaactgcgtcgctacatcggcgagcgttgcgcgaaagcctgtgtggatatcggctaccgcggggcgggtacctttgagttcctgttcgaaaacggcgagttctacttcattgaaatgaacacccgtatccaggtagagcatccggtaactgaaatgatcaccggcgttgacctgatcaaagagcagctgcgtatcgcagccggccagccgctgtccatcaagcaggatgaagtggtggttcgcggccatgcggtggaatgccgtatcaacgccgaagacccgaacaccttcctgccgagcccgggcaaaatcacccgtttccacgcgccgggtggctttggcgtgcgctgggagtcacatatttacgccggttacaccgtaccgccgtactatgactccatgatcggtaaactgatctgctacggcgaaagccgtgacgtggcgattgcccgcatgaagaatgcgctgcaggagctgatcatcgatggcatcaaaaccaacgtcgatctgcagatgcgcattatgagcgacgagaatttccagcatggtggcaccaatatccactatctggagaaaaaactcggcttgcaggaaaaataa

SEQ ID NO: 6443 - DNA, 324 bp, Klebsiella pneumoniae
attgctgccgcccggtcgaaaaaaggggccgtcaggcccctttttctgaaactcgcagaattagcgacgcagacccagacgctcaatcagcgcagagtaacgggcaacatctttacgtttcaggtagtcgagcagtttacgacgctgagaaaccatgcgcagcagaccacgacggctgtggtgatcttttttgtgctctgcaaagtggccctgcaggtggttgatctgtgcggtcagcagtgcaacctgaacttcggtagaaccgctgtcgttttcgccacgaccaaactcagaaacgatttttgctttagcttcaacgcttag

SEQ ID NO: 6444 - DNA, 363 bp, Klebsiella pneumoniae
acgccagccgcgctcttcggcaacgatgcggaagaaacgatcgggtttttgcagcagcagaccgcaaccgtcgccggttttaccatcggcaaggattgcgccacggtgctgcatgcgggccagtgcgtgtattgcggttcgcactaccttgtggctaggttcgccttctatgtgggcgatcaggccgaaaccacagttatccctctcaagggatttgtcgtacaacatatcagtgaacctccccaggctctacggacaccctccgataccgattgcgcacaggcacagaaagagcatggcgacggggtttacacctcgcattcgccctctttaaatccttttcgcatcggtacacaagtttga

SEQ ID NO: 6445 - DNA, 1389 bp, Klebsiella pneumoniae
aagcgctgcgcgtggtggaagccaccctcgccgctaagggaaaaaaacgttatgagtaaccgcaagtattttggcaccgatggtattcgtggccgcgtcggcgatgcgccgatcactccggagtttgtgctcaagctgggctgggcggcgggcaaagtgttagcgcgtcacggttcgcgtaaaattatcatcggcaaggatacccgtatttcgggctatatgctggaatcggcgctggaagctggactggcggcagcggggctctctgcgtcattcaccgggcctatgccgacaccggccatcgcctacctgacgcgcgccttccgcgccgaggcggggattgttatctctgcttcacataaccctttctacgacaacggcattaaattcttctccattgagggcaccaagctgccggatgatgtcgaagaggcgattgaagccgaaatggagaaagagctcacctgcgtggattcggctgagctgggcaaagccagccgtatcgtcgatgcggcggggcgctacattgaattttgtaagggtacctttcccaacgaactgagcctgggcacgctgaaagtggtggtggattgcgcgcacggcgcgacctatcacatcgcccctaatgtcttccgcgagctgggagcccaggttatcgcgatgggctgcgagccagacggtctcaacatcaacgaagaggtcggcgccactgacgtgcgggcgctgcaggcgcgcgtgctggcggaaaaagccgatctgggtattgcctacgacggcgatggcgatcgggtgattatggttgaccacgaaggcaataaagtcgatggcgaccagatcctctatatcatagcccgggaaggattgcgtcaggggcagctgcgcggcggcgccgtcggcacgctgatgagtaatatggggctggagctggcgctcaagcagttaggcatcccgtttgcccgcgcgaaggtcggtgaccgctatgtactggagatgctccaggaaaaaggctggcgcatcggtgcggaaaattccggccatgtgatcctgctggataaaaccaccaccggcgatggcattgttgccagcctgcaggtggtcgcggcgatggtccgcaaccacatgagcctgcatgacctgtgcagcggcatgaaaatgttccctcagctgctggtgaatgtccgctttaccgagggcagcggtaacccgctggagaatgagcacgtcaaagcggtgaccgcggaagtggaggcggcgttaggaaaacgcggccgtgtcctgctgcgtaaatcgggtacggagccgctgatccgcgtgatggtggaaggcgagcatgaagatcaggtgcacgagtttgcgcaccgcatcgctgaggcggtaaaaagcgtttag

SEQ ID NO: 6446 - DNA, 681 bp, Klebsiella pneumoniae
cgatacagcgccacttcacgcgcttttttctcgtcacgcactacggtcacttcatcaccggcagccggcacaccggacaggccgaggatttccaccggaatggacggacccgcttccagcacttcgcgacccagttcgtcacgcatcgcgcgcacacggccatattcgaagccgcacagaacaatgtcgcccttatgcagagtaccttcgcgaaccagaacggtagctaccggaccacgacctttatcaaggaaggattcgatgaccgcgccgctcgccataccgttgcggaccgctttcagctcaagaacttcagcctgcagcaggatcgcgtccagcaggtcgtcgatgccggtacccgctttcgcggaaacgtggacaaactggctctcgccgccccactcttccggcaggatgccgtactgggacagttcgttcttcacgcgatccggatcggcttctggcttatcgatcttgttcaccgccactaccaccggtacctgcgccgctttagcgtgctggatagcttcgatagtctgcggcatcacgccgtcgtctgccgccaccaccagaaccacgatatccgtcgcctgcgcgccacgagcacgcatggaggtaaacgcggcgtggcccggggtatccaggaaggtgatcatgccgttgtcggtttcgacgtggtaa

SEQ ID NO: 6447 - DNA, 978 bp, Klebsiella pneumoniae
atgctcttagcgacggctctgttaattattggtttattgctggttgtctacagtgccgatcgtctggtctatgccgcctccatcctgtgtcgtatgttggggatcccgccgctgatcatcggcatgacagtggtcagtatcggcaccagcctgcctgagatcatggtcgccaccgcggcctcgctgcacgggcagaccgatctggcggtcggcaccgcgctcggatctaatatcaccaatatcttattgatcctcggtctcgccgccttactcaggccatttaccgtgcattctgatattctgcgccgcgaattaccgctaatgttgctggtcagcgtgctggcgggactggtgctctacgatggacaactgacccgtctcgacgggctatttttactggcgttagcgcttctgtggctgctgttcaccatcaaaatcgctcgcctggcggagcgccagggaagcgatagcctgacccgcgaacagctggcggagctgccacgcgaagggtcgctgccggtcgccctgctctggttaggggtagcgatgatcgtcatgccgatggcgacccgcatggtggtggataacagtacagtgctggcaaactatttcgccatcagcgaactgaccgtcggcctgacggtggtggcgataggcaccagcctgccggagctggccaccgccatcgccggggcgcggaaaggggaagatgatattgccatcggcaatatcatcggcgccaatatccttaatatcgcactggtgctgggtttaccggcgctgatcgcgccggggagctttgcgaccgaagccttcactcgcgattatggcgtgatgctgctggtcagcctgatcttcgcagtgctgtgctggcgccgtcagcagcagccgggacgactggttggcgcgctgctggtcggcggctttgtggtttggttggcgatgctgttttggacagcaccgctcttcgttgaatga

SEQ ID NO: 6448 - DNA, 3123 bp, Klebsiella pneumoniae
ggatacccagccatgtctaagttttttattcatcgaccggtcttcgcctgggtgctggccatcattatgatgattgccggcggcctggccattctgcagctgccgatagctcagtacccgacaatcgcccctcctgcggtagcgatctccgccacctaccccggtgcagatgcccagaccgtgcaggatacggtcacccaggttatcgagcagaacatgaacggcatcgacaatctgatgtatatgtcgtcgaccagcgactctgccggttcggtaaccattacgctcacctttaaatcgggtaccgatcccgatattgcccaggtacaggtgcaaaacaaactgcagctggccacgccgctgctgccccaggaagtacagcagcaagggattagcgtcgagaaatccagtagcagcttcctgttggtcgccggctttatctctgataacccgaccaccacccaggacgatatttctgactatgtcgcctccaatgtcaaagatcctattagccgcctcaacggcgtgggcgatgtgcagctgttcggcgcgcagtacgctatgcgcgtctggctggatggcaacctgctgaataaatacaacctgacgccggtggacgtcatcaatgcgctgcaggtccagaacgatcagatcgccgcgggtcagctcggcggtacgccagcgctgaaaggccagcagttgaacgcgtcaatcatcgctcagacgcggctcaaagatccgcaggagtttggcaaggtcacgctgcgggtcaacgccgatggctctgtcgtccatctgaaagacgtcgcccgcattgagctggggggagagaactataacgttgtcgccagaattaacggtaaacctgcctctggtctgggtattaagcttgcgaccggcgccaacgccctggataccgccaccgcgattaaagcgaagctggccgagctgcagccctacttccctcaggggatgaaggtggtttatccgtatgatacgacccctttcgtcaaaatctccattcacgaagtggtcaaaacgctttttgaagcaattattctcgtctttcttgtcatgtatctgttcctgcagaacatgcgcgcaacgctcattccaaccattgccgtacccgtggtgctgttgggaaccttcgcggtattgtcgatgtttggctactccatcaacacgctgacaatgtttggcatggtgttggcgataggtctgctggtcgatgacgctatcgtagtagtggaaaacgtcgaacgtgtgatggttgaggagaagctctcgccaaaagaagcgacggaaaaatctatgtcgcagatccagggagcgctggtgggtatcgccatggtgctctccgcagtatttgtcccgatggcctttttcggcggctcaaccggcgcgatttatcgtcagttttcaatcaccatcgtctccgccatggcgctctccgtgctggttgcgctggtactgactccggcgctctgcgccacgttgttgaagccagcctcagctgaacaccatgagaaaaaaggatttttcggctggtttaacgcccgcttcgaccagagcgttaaccactataccaacagcgtcagcggtattttacgtggaactggccgttatctggtgatctacctgctgatcgtcgtggggatggccgtgctgttcatgcgcttgcccacgtcctttctgcccgacgaagaccagggcgtcttcctgaccatgatccagctgccgtccggtgctacccaggagcgcacgcagaaggtcctggatacggtgacagactactacctgcataacgagaaggccaacgtcgaaagcgtctttaccgttaacggcttcagcttcagcggccagggacaaaactccggtatggcgtttgtcagcctgaagccctgggaagcacgcagcggcgataaaaacagcgtggagtccatcatcaagcgggccaccgtagcctttagccagatcaaagacgccatggttttcccgttcaacatgccagccattattgagctgggtaccgccaccggcttcgactttgaactgatcgaccagggcggactcggtcataccgctctgacccaggcgcgcaatcaattgctgggcatggtgaaacagcatccggatcagctggttcgggtacgccctaatgggctggaagatacccctcagttcaaactggatgtcgatcaggaaaaagcgcaggcgctgggcgtatcactctctgatatcaatgaaacgatatcagccgcgctgggcggatactacgtcaatgactttattgaccgcggccgcgtgaaaaaagtgtacgttcaggctgatgcccacttccgtatgctgccgagcgacattaacaacatgtatgttcgcagcgccaacggcgaaatggtgccgttctccgcctttgtcacttcacgctggatatatggctcgccgcgcctggagcgctacaatgggttgccatctatggagatcctcggtgaagcttcgccaggcaaaagtaccggggaagccatggcgctgatggaaacgctggccagtaaactgccgagcggcatcggttatgactggaccgggatgtcttaccaggaacggctctccggcaaccaggcgcctgcgctctatgccatctcgctgatcgtcgtattcctgtgtctggcggcgctgtatgagagctggtcgatccccttctcagtcatgttagtggttccgctaggggtcattggcgcgctgttagccgccacgctgcgtgggctgaataatgacgtttacttccaggtcggactcttgaccacgatcggtttgtcggccaagaatgcgatcctgatcgtcgagttcgccaaggatctgatggagaaagaagggaaagggatcattgaggccacgctggaggcatcgcggatgcgcctgcggcctattctgatgacctctctggcctttattctcggggtcatgccgctggtgattagccatggtgccggcagcggggcgcagaatgcggttggcaccggcgtgatgggcgggatgctgaccgcgacgctgctggcgatcttctttgttccggtgttcttcgtggtcgttagacgacgctttacccggcacgctgaataa

SEQ ID NO: 6449 - DNA, 669 bp, Klebsiella pneumoniae
cccgggaaagcggcgttggagatgtttgagccaggcgaatatgtccttgtgctgttggatattcagttaccggacatgaccggactggatatttcccgtgaactgaaacagcgctttgccgctgacgagctaccgccgctggtcgccctcaccgccgacgtgctgaagaataaaaaagagtattttgacgccgggatggacgatgtattgagtaagccgctatcggtgccagcgctaacggccatgatcaagaaattctgggatgcaccggatgaggaagcgcaggaagcgccggcggccgatctgcataaagccgaggcggtgctggataccgatatgctggagcaatatatcgagctggtgggaccgaagcttatcaacgatggcctcgcggtgtttgagaagatgatgccgggctacatgtccgttctggagtctaatctgaccgcccgcgaccaaaaagggattgtcgaagaggggcataagatcaaaggggcggccggttctatcggactgcgccacatccagcagctgggccagcagatccagactccggatctgcctgcctggtctgataatgtcgctgaatgggttgaagagatgaaatccgagtggcaaaacgatgtagcggtactgaaggcgtgggtggcgaaagccagcaaaaaatga

SEQ ID NO: 6450 - DNA, 732 bp, Klebsiella pneumoniae
tccgttatggcaaccttaactgcgaagaatctcgctaaagcgtataaaggccgccgcgtggtggaagatgtcagtctcaccgttaactcgggcgagattgtcggcttgctcggcccgaacggcgccggtaaaacgaccaccttctacatggtggtcgggattgtgccccgcgacgcaggcaatatcatcatcgatgacgaagacatcagcctgctgccgctgcacgcgcgcgcgcgacggggcatcggctacctgccgcaggaagcgtcgattttccgtcgcctcagcgtctatgacaacctgatggcggtcctgcagatccgtgacgatctaaccagcgaacaacgggaagatcgcgctaaagagctgatggaagagtttcatattgagcacctgcgcgacagcctcggtcaggcgctctccggtggtgaacgccgccgcgtcgaaatcgcccgcgcgctggcggcgaatccgaaatttattcttctggatgaaccctttgccggcgtggatccgatctccgttatcgatattaaacgcatcattgagcacctgcgcgacagcggtctcggcgttctgattaccgaccataacgtccgtgagaccctcgcggtctgcgaacgcgcgtatattgtcagtcagggacaccttatcgctcatggtacaccgcagcagatcctcgaagatgagcaggttaagcgcgtgtatcttggggaagacttcagactctga

SEQ ID NO: 6451 - DNA, 345 bp, Klebsiella pneumoniae
ccacccgcggcaggccaaaaatggagtacggcgggtcgtccgggtggatcgccattttcaccccaacctcttcgcaaaccgggatcaccgcctgcagaaaataaaccaggttctcccgcagcttctgatcatccaccgcgctatatttggcaaacagggtctgcacctccgccagccgttccggctcccagcccggcaaggcgaagccgtttgaattctcaagcacctccttcaccacgtcttccagccgcttatcgatatctttcttctcaaacgccatcgtcagcgagccatccggcaggacgtagttcatatccgtcttcatccagtcgaaaaccggcatga

SEQ ID NO: 6452 - DNA, 843 bp, Klebsiella pneumoniae
tcgtcagcggccgctcgggctcgggtaaatccgtcgctctgcgagcgctggaagatatgggcttttcactgcgtggataacctgccggtcgtgctgctgcccgacctggcgcggtcgctggctgaccgtaatatctccgcggccgtcagcatcgacgtgcgtaacatgccggaatccccggagatcttcgagcaggcgatgcagaatctgccggaatgtttttctccgcagctgctgttccttgatgccgaccgcaataccctgatccgccggtacagcgatacccgtcgcctgcacccgctctccagcaagaatctgtcgctggaaagcgccatcgacgaagagagcgatctgctggagcccctgcgctcccgcgccgatctgatcgtcgatacgtcggaaatgtcggtgcatgagttggccgagatgctgcgtacccgactgctgggtaaacgcgagcgtgaactgacgatggtcttcgaatccttcggcttcaagcacggtattccgatcgatgccgattacgtctttgacgtgcgctttctgcccaacccgcactgggatccgaaactgcgtccaatgaccggcctggataaaccagtggccgccttcctcgatcggcacactgaagtgcacaactttatttatcagacccgaagctatcttgagctatggttaccgatgctggagaccaacaatcgcagctatctgacggtggccattggctgtaccggcggtaaacatcgttcggtttatattgctgaacaactggctgactacttccgctcgcgcggcaagaacgtgcagtctcgtcatcggacgctggaaaaacgtaaatcatga

SEQ ID NO: 6453 - DNA, 594 bp, Klebsiella pneumoniae
ggccaaagggcaatcaatatgagtaaaaccagacgttgggttatcattttactgtcgctgctcgcgctgatccttatcggcctgaatctggcgaatacggacgacacggcccagccggaggtcaatcctaacgaccctacgtataaaagcgaacataccgacaccgtggtatacagtccggaaggcgccctgagctatcggctgattgccgagcacgtggaatatttttccgatcaggaggtctcctggtttaccaaaccggtgatgaccacctttgatactaacaaggtgcctacctggtcggtcagagcagacaaagcgaagctgacgaatgaccggatgctctatctttacgggcacgttgaggtgaatgcgctcgcgccagattctcaactgcgcaaaattacgacggataacgcccagataaatctggtaacgcaggacgttacctccgatgacatggtgacgttatacggcaccacatttaattccagcggcctgaaaatgcgtggaaaccttcgcagcaaaaatgccgagctgattgaaaaggtgagaacctcttatgaaattcagaacaaacaaactcagccttaa

SEQ ID NO: 6454 - DNA, 192 bp, Klebsiella pneumoniae
tctaattgttattccttgaaaaccgtaatgccgaagctcacgattgacgaaaaaaaggccgttctacactacgcgatgatacgccaggattccacttctgtggaattagcggttatagtggcactatcgggcgcaggcggagagcctaagagccaccctacggaaccacaatacaacgggagatgttcatga

SEQ ID NO: 6455 - DNA, 438 bp, Klebsiella pneumoniae
gagccaccctacggaaccacaatacaacgggagatgttcatgacctgggaatacgcgctaattgggttagtcgtcggtatcatcattggcgccgtcgccatgcgtttcggcaaccgcaaactgcgccaacagcaggcgctgcagtacgaactggaaaagaataaagccgagcttgaagagtaccgtgaagagctggtgagccactttgcgcgtagcgccgaactgctggataacatggcgcacgactatcgtcagctatatcagcatatggcgaaaagctctaacaacctgctgccggactcgatggcagacgccaacccgttccgcaaccgtctggaagagtctgaagccagcaacgatcaggcgccggtccagatgccgcgcgactactccgagggcgcatccggtttactgcgcggaggcgcaaaacgcgattaa

SEQ ID NO: 6456 - DNA, 324 bp, Klebsiella pneumoniae
accggccttttttctttttctctctcctcatctataccatgcggtacaatccccgctttcttcatcctcaagggacaaaaaatggacaaacgctttgttcaggcccacaaagaagcgcgctgggcgctgtggctgacccttctctaccttgccgcctggctggccgccgcctatttgccgggggtggctattggctttaccggcctgccacactggtttgaaatggcctgcctgctggtaccgctgctgttcattctgctgtgctgggcgatggtcaaactgattttccgcgatatttctctggaggacgatgatgcagtttga

SEQ ID NO: 6457 - DNA, 348 bp, Klebsiella pneumoniae
accgacgctcaggcgtcggtttttttatcgctatacttaacggcgacagaaagagaagcgggaggggctgtcatgaccacctatacgtttgattttgacgaaatcgctgaacaacaggatttctaccgggagttttcccgaaccttcgagctggctcaggataaggtcaacaacctggattcgctatgggacgcagtgaccggtggcctgctaccgctgccgctggatattgagttcatccatttaaatgacaagcagcgccggcgctttggcgcattgattttattgtttgatgaagcagaggaagagctggagggggagttgcgttttaatgcccgacaagcataa

SEQ ID NO: 6458 - DNA, 513 bp, Klebsiella pneumoniae
aacgcctgtcacaatcacactaaacaaagagtacggaacccactcatggatattcgtaagattaaaaaactgatcgagctggttgaagaatcaggtatctccgaactggaaatttctgaaggcgaagagtctgttcgcatcagccgctctgcaccggccgcaagctatccggttatgcagcaggcttatgctgcgccgatgatgcagcctcaggcgcctgccgccgcgactgccgcaccagctgctgcggctgaagcgccggcgaaagcggaaatcagtggtcacatcgtacgttccccgatggttggtactttctatcgtacgccgagcccggacgcgaaagcgtttgtggaagttggccagaaagttaacgtgggcgacaccctgtgcatcgtcgaagcgatgaaaatgatgaaccagatcgaagccgacaaagccggcgtggtgaaagccattctgatcgaaagcggccaaccggtagaattcgacgagccgctggtagttatcgagtaa

SEQ ID NO: 6459 - DNA, 1011 bp, Klebsiella pneumoniae
cgattgatccaggtcatcgccgtcggtgacgaaaagtggcaggcttggccccctttgttgagggcggtctatcagattatgcagttacagaaattagtcaatatgtttggtggggatcttatgcgtcgctatggcgaaaaggtccataagctaacgctgcacggcggttttagctgcccaaaccgcgacggcacgctgggccgcggcggttgcactttctgtaacgtggcatcgtttgccgatgaggcgcagcagcatcgctctatcgccgaacagctcgctcatcaggcgcagctcgtcaaccgggcgaagcgctatctggcctattttcaggcctacaccagcaccttcgctgaagtgcaggtgctccgttcaatgtatcgtcaggccgtcagtgccgcaaatatcgttggcctgtgcgtcggcacccgcccggactgcgttccgcaggcggtccttgacctgctgagtgaataccatcagcaagggtatgaggtatggctggagctggggctgcaaactgctcatgacaagaccctgcatcgcattaaccgtggacacgatttcgcctgttatcagcgtaccgcgcgcctggcgcgagagcgggggctgaaagtctgtgcgcatctgatcgtcggtctgcccggagagagccaggggcattgtctgcagacgctggagcaggtagtggcgaccggcgtggatgggatcaaattgcatccactgcatattgtgaaaggcagcattatggccaaagcgtggcaggccgggcgtctcgatggcattgagctggaggcgtataccgtcaccgctggagagatgatccgccatacgccgccggaggtgatctaccaccgtatttccgccagcgcccgtcggcccacgctgttggcgccgctgtggtgtgaaaatcgctggaccggcatggttgaactggatcgttatctgaatcagcagggcgctcagggctcggcgctgggccgtagctgggttgctccccaggctgagtga

SEQ ID NO: 6460 - DNA, 1062 bp, Klebsiella pneumoniae
catattcgccattcatcgccgtctccgtcatgcttaggaaaacgcatgacggaggacaccatgaaaagaaaaaaactgacggaagccgacgtcacggccgaatccgtttttatgctcaagcggcgccagatgctgaaaatgctgggcatcagcgcgaccgcgctttcccttcccgccgccgcgcaggccgacctgctggactggtttaaaggccacgaccgcccaccagcgccagcgggcaaggccctggagtttgctaaacccgccgagtggcaggctaatttgacgcttaccccggaagataaggtcgccggttacaataatttttatgaattcggcctcgataaagccgatccggcggcgaacgcgggtagcctgcgcaccgatccctggacgctcaccatcggtggcgaagtggcgaaacctctgacccttgaccatgacgatctgaccaaacgcttcccgctggaagagcgcatttatcgtatgcgctgtgtggaagcctggtcgatggtggtcccctgggtcggcttcccgctgcataaactgctggcgctggtggagcccaccagcagcgcgcgctatgtggccttcaaaaccctctatgctccggatcaaatgcccggccagaaagaccggtttatcggcggggggctcgcttacccttacgtggaggggctacggctggatgaagcgatgcacccgctgacgctactcaccgtcggggtgtatggcaaagcgctgccgccgcaaaacggcgcgccggtccgcctgaccgtgccgtggaagtacggttttaaaggcataaaatccattgttagtatcgagctgacccgcgagcggccgccaaccacctggaacctggcggcgccggacgaatacggcttcttcgccaacgtcaatccgcacgtcgatcacccccgctggtcacaggctagcgagcggtttatcggcgccggcggcgtgctcgatgtgaagcgtcaaccgacgttgctgtttaatggctatgccgacgaagtggcgtcgctgtatcgcggcatgaatctgcgggagaacttctag

SEQ ID NO: 6461 - DNA, 354 bp, Klebsiella pneumoniae; identical to SEQ ID NO: 1586

SEQ ID NO: 6462 - DNA, 1305 bp, Klebsiella pneumoniae
tataatgagcatggtgttatcatgggaaaaaatatccgctggattatcgtcctgttattatttttagtatatatgataaattatctggaccgggtggcattatccattacggtcccgatgattgaaaaggaccttgcacttaacgctgaacaattcggcattattttcggcagctttttcttcggctatgcggtatttaattttattggcggtttggccgtggataagtttggcgcaacgctggtaatgggcctggcggtcggtctgtggtcgctgttttgcggcttaaccgcggtagccaccggcttttattccatgctggtgctgcgggtgcttttcgggatggcggaaggcccgatctgcgcatcggcgaacaagatgatcaacggctggtttcctaaaaagcaagcggctaccgccgtcggctttctcagcgcaggctctccgctgggcggcgcggtcgccggccccatcgttggttacctggccctggcattcggctggcgcccggcttttatgattattttcgctatcggtattgtatggatgatagcgtggtttttcattgccgctaattcgcccgaaaagcacaaaaaagtcagccaggaagaacttaagctgattaataaaatgaaagaagaagaagtcgcgctggaaacaatagaaaatcaaacagctcactcgctgggttattatttgaaacagccaattattctggtaacggcctttgccttcttctgctacaactatattctgtttttctttctcagctggttcccgtcctatctggtacaacagcaccatctggatattaaacagatgagccttaccactatgatcccatggatagtcggctttgtcggtctggcgcttgggggctatatttccgataaaatttttaaactcaccgggcgcctgctgctgtcgcgcaaaattgtgctggtggtatgcctgctgatggccgctatctgcgtgggactggcgggtaccgtcagcagcgtcgtgcctgccgttctgctgatgtcggtctccatctttttcctctatgtaaccggggcgatctactgggcgattatccaggacgtggtgcataaatcccgcgtcggcggcgccagcggctttatccatcttatcggcagcgtctccggcatcgtggggccgattgttaccggctatatcgtgcagtctactggtaaatttgacagcgctttcgttctcgccggcactatcgccgcgcttggcgccctgctggtgctgttcgtgatcaaaactccgcgtgtgacgatgaaagccagccaggcataa

SEQ ID NO: 6463 - DNA, 1083 bp, Klebsiella pneumoniae
ccattcattaacgatatctgcatcatgcctggaaagttattacgttcagtactcatcggtttgcttgtcgggggtctgctgctggccctgatgccctcgctgcgccagtggcagttggcgccgactacccagaacgatacggcagacgactccccggcgagctataacgccgcggtgcgccgcgcggcgcccgccgtggtgaacgtctataaccgcgcccttaacagcaccagccataatcagctgacgcttggctcaggggtgattatggatcagcgcggctatatcctgaccaacaagcatgttatcaacgatgccgatcagattatcgtcgccctgcaggacggccgcgtcttcgaagcgctgctggtaggatccgattccctcaccgatctcgccgtgctcaaaatcaatgctaccggcgggctgccggtgatcccgatcaatccgaaacgcacgccgcacatcggcgacgtggtgctggcgattggcaacccttataacctggggcagaccatcacccaggggattatcagcgccacagggcgcattggcctcaatccgaccggccgccagaacttcctgcagactgacgcctcgatcaaccacggtaactccggcggggcgctggtgaactccctcggcgagctgatggggattaacaccctctcctttgacaagagcaatgacggcgaaacgccggaaggcattggctttgcgatcccgttccagttagcgaccaaaattatggataaactgatccgcgatggccgggtgatccgcggctatatcggcattagcggccgggagatcgccccgctgcacgcgcagggcggagggatcgatcagattcaggggatcgtcgttaacgatgtggctccggacggtccagcggcgcaagccgggatccgcgccaacgacgtaatcatctccgtgaatgacaaacccgccgtctcggcgctggagacgatggatcaggtggccgagatccgcccgggatcggaaattccggtggtcatcatgcgtgatgataagaaaatcacgctccatatcgccgtccaggaatacccggccaccaactaa

SEQ ID NO: 6464 - DNA, 570 bp, Klebsiella pneumoniae
aacaacactaattgtccgggcccccttgcgcccgccgctggatatcatcggcgacgggcgcgggggcgctcaggtgaaattatgatgaacaacgattcggctctacaactgagcaacgtcctgaaccaggaatgtacccgtagccaggtgcactgccagagcaagaagcgtgctctggaaatcatcagcgaactggccgccaaacagttaagtttgccgccgcaggtggtgttcgaagcgatcctcacccgcgaaaaaatgggcagtaccgggatcggcaatggtatcgccattccccacggaaaactggaagaggatacgctgcgtgctgtcggcgtttttgtccagctggaaacccccatcgccttcgacgcgatcgacaatcaacctgtcgacctgctgttcgcgctgctggtgccggccgaccagacaaaaactcacctgcatacgctctccctggtggccaaacggctggcggacaaagcgatttgtcgtcgcctgcgcgcggcgcagagcgatgaagagttgtatgagatcatcaccgaagcaggaagcagcgatgacgcataa

SEQ ID NO: 6465 - DNA, 897 bp, Klebsiella pneumoniae
attaaccataataaggagtttaggatgaaagttgcagtccttggcgctgccggtggtatcggccaggcgcttgccctactacttaagacccaactgccttcaggttcagagctctcgttgtacgacatcgctccggttacgccgggcgtggcggtagatctaagtcatatccccacagatgtaaaaattaaaggattttccggtgaagacgctactccggcgctggaaggcgcggatgtagtgctgatctccgcgggcgtggcgcgtaagcccggcatggatcgttccgacctgtttaatgtgaatgcgggtatcgtgaagaacctcgtgcagcagattgccaaaacctgcccgcaggcctgcatcggcattatcaccaacccggtgaataccaccgtggctatcgccgccgaagtactgaaaaaagccggcgtgtacgataaaaacaaactgttcggcgttaccacgctggacatcatccgttccaatacctttgtggcggagctgaaaggtaaatcggcaaccgaggtggaagtcccggtcattggtggtcactccggggtcaccattctgcctttactgtcgcagatccccggcgtcagctttagcgatcaggaaattgccgacctgactaaacgttttcagaaacgcccgtacccgaagtcctgggaaacgaaaaacgggcgggggggtcgggcaactttgttcaatggggccaaggggggtggcccgttttggtctctctctggttcgcgccatgcagggggaaaaaggcgtggtggagtgcgcctacgtggaaggcgacggccactatgcgcgtttcttctcccagccgctgctgctggggaaaaacggcgtggaagagcgacagtctatcggcaaactcagcgcctttga

SEQ ID NO: 6466 - DNA, 258 bp, Klebsiella pneumoniae
atggcacataaaaaggctggcggctcgactcgtaacggtcgcgattcagaagctaaacgtctgggcgtaaaacgtttcggcggtgaagcagttctggcaggtagcatcatcgttcgtcaacgtggtactaaattccacgctggtaccaacgttggttgcggccgtgaccacactctgttcgctttgactgacggtaaagtcaagttcgaagttaaaggcccgaaaaaccgtaaattcatcagcatcgttgctgaataa

SEQ ID NO: 6467 - DNA, 258 bp, Klebsiella pneumoniae
ctacataataaacgcatctgctcactacctgtacgcttcttattcaaggtcatcatgagtctgtttcctgtcatcgtgattttcggcttatcgtttccgccgatcttcttcgagttgcttttgtcgctggctatcttttggctggtgcaccgactgctggttccgaccggcatttacgattttgtctggcacccagcactgtttaatacggcgctctattgctgccttttttatttgatatcgcgcttgttcgtttga

SEQ ID NO: 6468 - DNA, 2160 bp, Klebsiella pneumoniae
tttatagataaaaaggatagaattttgcttaatccgatcgttcgtaaattccagtacggccagcataccgtgaccctggaaaccggcatgatggcgcgccaggcaacggccgctgtgatggttagcatggatgacactgcggtattcgttaccgttgtgggtcagaaaaaagcgaagccaggccaggactttttcccgctgaccgttaactaccaggagcgtacctacgctgccggtaaaatcccgggtggtttcttccgtcgtgaaggccgtccaagcgaaggcgaaaccctgatcgcgcgtctgattgaccgcccggttcgcccgctgttcccggaaggcttcgttaacgaagttcaggttatcgccaccgtcgtttccgttaacccgcaggttaacccagacatcgtcgcgatgatcggtgcttccgctgcgctgtcgctgtctggtattccgttcaatggcccaatcggcgctgcgcgcgtgggttacatcaacgaccagtacgtactgaacccaacccaggaagaactgaagtccagcaaactggacctggtggttgccggtaccgaagcggccgtgctgatggtggaatccgaagcggaactgctgagcgaagaccagatgctgggcgcggtggtcttcggccacgagcagcagcagattgttattcagaacatcaacgacctggtgaaagaagccggtaaaccgcgttgggactggcagccggaagcggtcaacgaagcgctgaacgcgcgcgtggctgcgctggctgaatcccgtctgagcgatgcttaccgtatcaccgacaaacaagagcgttacgctcaggttgacgtgatcaaatctgaaaccatcgccacgctggttgctgaagatgaaaccctggacgctaacgagctgggtgaaatcctgcatgccatcgagaaaaacgtggttcgtagccgcgtactggccggcgagccgcgtatcgatggccgtgaaaaagatatgatccgtggtctggacgttcgtaccggcgttctgccgcgtactcacggttccgcgctgttcacccgtggcgaaacgcaggcgctggttaccgcgactctgggtaccgcacgtgatgcgcagaacatcgacgaactgatgggcgagcgcaccgactccttcctgttccactacaacttccctccgtactccgtaggcgaaactggcatggtggggtctccgaagcgtcgtgaaatcggtcacggtcgtctggcgaagcgcggcgtactggccgtgatgccgactattgaagaattcccgtacaccgtgcgcgtggtatcggaaatcaccgaatctaacggttcctcttccatggcttccgtctgcggcgcctctctggcgctgatggacgccggcgtgccggtaaaagccgctgtggcgggtatcgcaatgggtctggtgaaagaaggcgacaacttcgtcgtgctgtctgacatcctcggtgacgaagaccacctcggcgatatggacttcaaagttgcgggttcccgcgacggtatctctgcgctgcagatggatatcaaaattgaaggtatcaccaaagaaatcatgcaggttgcattgaaccaggctaaaggtgcgcgtctgcacatcctgggcgtgatggagcaggcgattaacgcgccgcgcggcgatatctctgaattcgcaccgcgtatccacaccatcaagatcaacccggacaagatcaaagacgttatcggtaaaggcggttctgttatccgtgccctgaccgaagagaccggtactaccatcgagatcgaagatgacggtaccgtgaagatcgcagcgaccgacggcgacaaagcgcagcatgctatccgtcgtatcgaagagatcaccgctgagatcgaagttggccgcatctacaatggtaaagtgacccgtatcgttgattttggcgcattcgttgccatcggcggcggtaaagaaggtctggttcacatctcgcagatcgctgacaagcgcgttgagaaagtgactgactacctgcagatgggtcaggaagtaccggttaaggttctggaagttgaccgccagggccgtgtccgtctgagcattaaagaagcaactgaacagactccgtctgccgcagcgccggaagctccggctgccgagcagggcgagtaa

SEQ ID NO: 6469 - DNA, 1062 bp, Klebsiella pneumoniae
aagtatcgtaatttgttcagaaaaaagacaatggaaggaatcaaaatgagaagcgtcgtcgtcaaagagccaggccaactgaacattgaatcacgtccggttccagttccgggcgcccatgaagtacgggtgaaaattgcttttgccgggatctgtggttccgatgtacacatctatcacggccacaaccctttcgcgaaatatccccgcgtcatcggccatgaattctatggcatcatcgacgccgtcggcgagcaggtatctccggcacgcatcggcgagcgtgtcgcggtggaccccgttgtcagctgcggccattgttatccttgctcggtaggaaggccgaatgtctgtacgcagctccaggtcataggagttcaccgcgacgggggatttagcgactatgcctgcgtgccggcgaaaaatgcctggcgcatccccgaggctatcagcgaccgtcaggcaacgatggttgagccttttaccatcgcggcaaatattaccgcccagctgcagcccacggcgcaagatattgccctggtttacggcgctggcccgatggggctgacaatcattcaggcgctaaagggggtatatggcgttaagcaggtgatcgtcgtggatcgcattgccgaacgtctgcagatggcccgggaaaacggcgccgatctgacgctcgataacactgaccagccgctcgcggaacagctggcgcagcggcagcttgcccccacgctggtcattgatgccgcctgccacccggcgatcctgcaggaagccattctcctcgcctcccccgccgcccgcatcggtatactcggtttctccggcgaggcctcaaccctcactcagcaaagcatcaccagtaaagaaatttctattttctcctcccggctgaacagcgggcgttttccgctggtcatcgactggatggagaaaggccttattcgtccggaggcgttaatcacccattgtatgccgctggagcatgtgaaagaggccatggagatttttgctaacgaccgtaagacctgctgcaaagtgctgctgcagctgggttaa

SEQ ID NO: 6470 - DNA, 735 bp, Klebsiella pneumoniae
  unsure (635),(660),(713): Identity of nucleotide at the above locations are unknown.
ttatcgagtaacgaggcgaacatgctggataaaattgtcatcgctaaccgtggcgagatcgcactgcgcatcctgcgtgcctgtaaagaactgggcatcaagactgtcgctgtgcactccactgcggatcgcgatctaaaacacgtattgttagcggatgagacggtctgcatcggtccggctccgtccgtaaaaagctatctgaacattccggccattatcagcgccgctgagatcactggcgcggtagcgattcacccgggttatggcttcctctctgagaacgctaattttgctgagcaggttgagcgttccggctttatcttcatcggcccgaaagccgacactatccgcctgatgggcgacaaagtgtccgcgatcaccgccatgaagaaagccggcgtcccgaccgttccgggttctgacggcccgctgaccgacgacatggacgctaaccgcgcccatgctaaacgcatcggctacccggttatcatcaaagcctccggcggcggcggcggtcgcggtatgcgcgttgtacgtagcgacgctgaactggcgcaatccatctccatgaccaaagcggaagccaaaagcgctttcaacaacgacatggtctacatggagaaatacctggnaaacccacgccacattgaaattcangtgcttgcggatgttcagggtaacgctatctatctggctgaacgtgactgctncatgcagcgccgtcatcagtaa

SEQ ID NO: 6471 - DNA, 630 bp, Klebsiella pneumoniae
atgacaggtaaaaagcgttctgccagctcaagccgctggcttcaggaacactttagcgataaatatgttcaacaggcacagaaaaaggggttacgttcccgtgcctggtttaaacttgatgaaatacagcaaagtgacaaaatttttaagccggggatgacggtagtcgacctcggtgctgctcccggtggctggtcgcagtatgcggtcacgcagatcggcaacagcggccgcatcatcgcttgcgatcttttaccaatggatccaatcgttggtgtggacttccttcagggcgattttcgtgatgaattagtcctgaaagcgttacttgagcgagtgggcgacagtaaagtccaagttgtcatgtccgatatggcgccgaatatgtgcggaacaccggcggtggatattccccgggctatgtatctggtagaactggcgcttgaaatgtctcgtgatgtattagcgccaggtggtagttttgtagtgaaggtgttccagggcgaaggcttcgatgagtatcttcgagaaattcgctccctgtttacgaaggtcaaagttcgtaagccggactcttcccgcgctcgttcgcgtgaagtgtatattgtagcgaccgggcgtaaaccataa

SEQ ID NO: 6472 - DNA, 522 bp, Klebsiella pneumoniae
ataaagatcctgagctggctaaagcggcgcgccgcatcgttgaagaagaacttcagcttgagaccctgtcgattgtcggctggcgcgatgtgccgaccaacgaaggcgtactcggtgaaatcgccctctcctcgctgccccgtattgagcaaatctttgtcaacgccccggctggctggcgcccgcgcgatatggagcgccgtctgtttattgcgcgtcgtcgcattgaaaaacgtctgcaggaagacaaagatttctacgtttgtagcttgtccaatctggtcaacatctataaaggtctgtgtatgccggcggatttgccgcgcttctacctggacctcgcggacctgcgcctggagtcggctatctgcctgttccaccagcgcttctccaccaacaccgtaccacgctggccgttggcgcagccgttccgctacctggcgcacaacggtgaaattaacaccattaccggcaaccgccagtgggcccgcgcccgtacctataagttccagaccccgctga

SEQ ID NO: 6473 - DNA, 522 bp, Klebsiella pneumoniae
aaaggtgacaagggcgcattgaaggtatatgttgttttttacccgaaaatggcaggagatcgccacacaatggcagtgaagtttcacattttgcttttgaatggtccaaacattaacatgctcggtacccgcgagcctgagaagtatggccctcttacgctggctgaaattgttaaccgtttaacatctgaagcggcggcgctgaatgtgagtctggatcacctgcagtccaacgcggagcatgcgttaatcgaccgaattcatcaggctaaagacaacgtagactatatcctgattaatccggccgcgttcacgcataccagcgtagcaatccgtgacgctttgctcgccgtgaacatcccgtttatcgagattcacctgagcaatgtgcatgcacgcgaacccttccgccagcactcgtatctgtcagatgtcgccgctggcgtcatttgcgggctgggggcggatggttattcatacgctttacagacggcggtaaaacgcctgtcacaatcacactaa

SEQ ID NO: 6474 - DNA, 276 bp, Klebsiella pneumoniae
acgaatgtaaaaagccccgcaacgtgttgcggggctttcatccgttaccgggacgcgaaaaacttattcagcaacgatgctgatgaatttacggtttttcgggcctttaacttcgaacttgactttaccgtcagtcaaagcgaacagagtgtggtcacggccgcaaccaacgttggtaccagcgtggaatttagtaccacgttgacgaacgatgatgctacctgccagaactgcttcaccgccgaaacgttttacgcccagacgtttagcttctga

SEQ ID NO: 6475 - DNA, 1431 bp, Klebsiella pneumoniae
ggaatcggaaatcgcttcgacagaaccctgtacgtccgccttcagtacgatgttcacttcgtgaacttcgccttcggtcatgttagcgaacatgttttccagtttagatttctgctgacgcgccagcttaacttcacggaatttgccctgacgatacagcgccacttcacgcgcttttttctcgtcacgcactacggtcacttcatcaccggcagccggcacaccggacaggccgaggatttccaccggaatggacggacccgcttccagcacttcgcgacccagttcgtcacgcatcgcgcgcacacggccatattcgaagccgcacagaacaatgtcgcccttatgcagagtaccttcgcgaaccagaacggtagctaccggaccacgacctttatcaaggaaggattcgatgaccgcgccgctcgccataccgttgcggaccgctttcagctcaagaacttcagcctgcagcaggatcgcgtccagcaggtcgtcgatgccggtacccgctttcgcggaaacgtggacaaactggctctcgccgccccactcttccggcaggatgccgtactgggacagttcgttcttcacgcgatccggatcggcttctggcttatcgatcttgttcaccgccactaccaccggtacctgcgccgctttagcgtgctggatagcttcgatagtctgcggcatcacgccgtcgtctgccgccaccaccagaaccacgatatccgtcgcctgcgcgccacgagcacgcatggaggtaaacgcggcgtggcccggggtatccaggaaggtgatcatgccgttgtcggtttcgacgtggtaagcaccgatgtgctgggtaataccacccgcttcgccggaggcaaccttggtagaacgaatgtagtccagcagcgaggttttaccgtggtcaacgtgacccataatggtcacgaccggtgcgcgcggttcagccgccgcgccggtgtcacggtcgctcattacggcttcttccagttcgttttcacgacgcaggataactttgtggcccatctcttcggcaaccagctgtgcggtttcctggtcgatgacctggttgatggtcgccatggcgcccagcttcatcatcgctttgatgacctgagaacctttcaccgccatcttgttagccagttcgccaacggtgatggtttcgccgattacgacgtcacggttaacggcctgcgctggcttctggaagccctgctgcagagcggaacctttacggtgcttaccgcctttaccgccgcgcacggccgcgcgggcttcttcacgatcagctttcgattcagcgtgtttgttgcctttcttcgccggacgagccgctttgctgctacggctacggccgcgaccgccttcgacttcacgatcgttatcatcttcagcctgacgagcatgctgtga

SEQ ID NO: 6476 - DNA, 357 bp, Klebsiella pneumoniae
cgcactctgaatcacataaagaggtgcgcggaagcggagttttatatgtacgcggttttccaaagtggtggtaaacaacaccgagtaagcgaaggtcagaccgttcgcctggaaaagctggacatcgcaactggcgaagctgttgaattcgctgaagtgctgatgatcgcaaacggtgaagaaatcaagatcggcgttcctttcgttgagggcggcgtaatcaaagctgaagttgttgctcacggtcgtggcgagaaagttaaaatcgttaagtttcgtcgtcgtaaacactatcgtaagcagcagggccatcgtcagtggttcactgatgtgaaaatcactggcatcagcgcctaa

SEQ ID NO: 6477 - DNA, 654 bp, Klebsiella pneumoniae
tttcaggagaaatacgatatgtttaaacgcttactcatggtcgccatgctggtgattgccccgctgaccgccgtccaggctgcagatcagtccaatccgtataagctgatgaatgaagcggcgcagaaaaccttcgatcgcctgaagaatgaacagccgaagattaaagctaatcctaactatctgcgcgacatcgtcgaccaggagttattgccgtatgtacaggtgaaatatgccggcgcgctggtgctgggccgctattacaaagaagcgacccctgcgcagcgtgaggcctattttgccgccttccgtgaatacctgaagcaggcctacggtcaggcgctggcgatgtaccatgggcagacttaccagattgctccggagcagccgctgggcagcgcaaccatcgttccgatccgcgtcactatcatcgacccgaacggtcgtccgccggtacgtcttgacttccagtggcgtaaaaatacccagaccggcaactggcaggcctacgatatgatcgcggaaggggtgagcatgatcaccaccaaacagaatgagtggagcgatctgctgcgcaccaagggcgttgatggcctgaccgcgcagctgaaagcgatctctgcgcagccgatcaccctggaacagaaaaaataa

SEQ ID NO: 6478 - DNA, 612 bp, Klebsiella pneumoniae
cgaacgtctgatgcagatgatgccgcaggtactgcctgcgccggatgcgatggggccgcagatgccggcgcccgccaccgggttgacgccgcctcagccgtcgcagcctgcaggggggcaatagtggcaagttaccgtagccagggacgctgggttatctggctctcgtttcttatcgcgctattgctgcaaattatgccctggccggcggacatcagcgttttccggcccaactgggtattattgatcctgctgtactggatcctcgcgttgccgcaccgggtaaacgtggggacgggtttcgtgatgggggctattcttgatctcatcagcggttcaacgctcggcgttcgcgcgctgtctttaagcatcgtcgcctatctggtcgcgctgaagtatcagctgttccgtaacctggcgctgtggcaacaggcgctggtggtaatgctgttatccctggccgtggatatcattgttttctgggcagagtttttagtgatcaacgtctctttccgtccggaagtattctggagtagtgtagtaaacggcatcctctggccatggctcttcctgctgatgcgtaaagtgcgtcagcaatttgcagtgcaataa

SEQ ID NO: 6479 - DNA, 372 bp, Klebsiella pneumoniae
cttcaccctgaaggcgagtcggcccctgaacacggaatttatccattgattctgttctctattaaaaattcacatacgctgcaggggatcccccacagcttagaagccattgagtttgcggtctcgcgcccactcctgcggagtaaaggccttgatcgacagcgcatggatgcggttgtcggcaatatattccatcagcggcgcgtagacgctctgctgctttttcacccgactcatgccatcgaacatctcacccacagcaataacctgaaagtggctgccatcgccagagacgtggacttcctggagggggagtgcgttcatcagcacggtctgaatttcatgattttccatgggctcaaatttatctga

SEQ ID NO: 6480 - DNA, 225 bp, Klebsiella pneumoniae
ctgaaccctgagatcgccatggcgatctggaacaccttccgcaagaattctttcaaattcggctacgaaggacacctagtcctcacagtatatttgaaaaagtacttaatgggaaagtggttgcgggggccggatttgaaccgacgaccttcgggttatgagcccgacgagctaccaggctgctccaccccgcgcctgaaacgtggcatattttactctttttga

SEQ ID NO: 6481 - DNA, 396 bp, Klebsiella pneumoniae
gcaatggctgaaaatcaatactacggcactggtcgccgcaaaagttccgcagctcgcgttttcatcaaaccgggcaacggtaaaatcgttatcaaccagcgttctctggaacagtacttcggtcgtgaaactgcccgcatggtagttcgtcagccgctggaactggtcgacatggttgagaaactggatctgtacatcactgttaaaggtggtggtatctctggtcaggctggtgcgatccgtcacggtatcacccgcgctctgatggagtacgacgagtccctgcgttccgaactgcgtaaagctggcttcgttactcgtgacgctcgtcaggttgaacgtaagaaagtcggtctgcgtaaagcacgtcgtcgtccgcagttctccaaacgttaa

SEQ ID NO: 6482 - DNA, 1029 bp, Klebsiella pneumoniae
tccttctgtgatcccacctggattcatggtaacaggacatttggcccggcttttgcgatgaatttagaaaaaatcaatgagttaaccgcgcaagatatggcgggtgtcaatgcgacgattcttgagcaactcaactccgatgttcagcttatcaatcagttaggctattacatcgtcagcggcggcggcaaacgcattcgcccgatgattgctgtgctcgccgcacgcgcggtgggctatcaggggagcgcgcatgtcaccattgccgcgctgattgaatttattcataccgccaccctgctgcatgacgacgtcgtcgatgagtctgatatgcgtcgcggcaaagccacggccaatgcggcgtttggcaatgccgccagcgtgctggtcggcgattttatctatacccgcgcctttcagatgatgacccagctgggctcgctgaagatccttgaggtcatgtcggaagcagtgaacgtcattgccgaaggcgaagtgctgcagctgatgaacgtcaatgacccggatatcaccgaagagaactacatgcgcgttatctacagcaagacggcgcgtctgtttgaagctgcctcgcagtgtgcgggactgctggccgactgcactgcggaagaagagcgcgcgttgcaggattatggccgctatctcggcaccgctttccagctaatcgacgatttactcgattatagctctgacggcgagcggctcggtaaaaacgtcggtgacgacctgaacgaaggtaaacccacgctaccgctgctgcacgccatgcaccatggcacacccgatcaatcagcgatgatccgcggtgcgatcgagcaaggcaacggccgccatctactggatgctgtgctggaaacgatggcgacctgcggttcgctggaatggacgcagaagcgtgccgaagaagaagctgacaaagccattgccgcgctgcagatcctcccggacacgccctggcgtgaagccttgattgggctggcgcacattgcagtccagcgcgatcattaa

SEQ ID NO: 6483 - DNA, 981 bp, Klebsiella pneumoniae
gcgtcgtgtgaacccggacgacagcaaggaggactgatgagtcgtcctcgtcgtcgcggccgcgacgtgcatggcgtattgttgctggacaagcctcagggcgcctccagtaacgatgtgctgcagaaagtaaaacgtatttataacgccaaccgcgccgggcataccggcgcgctggatccgctggcgaccggtatgctgccgatctgccttggcgaagcgaccaagttttcccagtatctgctggactccgataagcgttaccgcgtgatcgccaaacttggccagcgcacggatacctccgatgccgacggtcaggtggtggaagagcgcccgctgacttttagcgacgaacagctggcggcggcgctggacagcttccgcggcgagacgcagcaggtgccgtcgatgtattcggcgctgaaatatcagggcaagaagctatacgaatatgctcgccagggtattgaagttccgcgggaagcccggccgataaccgtctatgagctgctgtttattcgccgcgaaggcgatgagctggagctggagatccactgctcgaaaggcacctacatccggacgattatcgatgatttaggtgagaagctcggctgcggcgcgcacgtgattttcctgcgtcgcctggcggtaagcaaatacccggtcgagcggatggtgaccctcgagcagctgcaggcgctggtcgatgaggcggcggcgcaggatattcctgccgctcagttgcttgatccgctgctgatgccgatggacagcccggcctcggattacccgctggttaatattccagaaacctccgcagtctactttaagaacggcaacccggtacgtcagtcaggcgcgccgcttgacgggctggtgcgggtgatggagagcgagtccggcaagtttctcggcatgggcgaaattgacgatgaaggccgcgtggccccgcgtcgtctggtggtggaatacccggcgtaa

SEQ ID NO: 6484 - DNA, 972 bp, Klebsiella pneumoniae
attccccgcctgttgctgaaggcgatggatgcgctgcctccaacgcgtatcctcgatcgcgacgatatgatgcatatcggcatctgttctttccgcagcgggcaatcggcggcgcaggtgatggaacatgcggaagcggcgacgcgcaacgcggtgctgcagggcagcaacagctggtcggtctatgatgacacccttccggagaaaggtcgcggcaacgttcgctggcgaacgctgatcgaacagatgctgagccgcggcgggccgcggttgtaccaaaaacctgctgtcacccgcgacgggcgggtacatcatcgtgaactgatgtcgcggatgtacgacggtaaagaagaggtgattgcagcggaatacatgccgatggtgctgcagtttggcctggtggaggagtatgaccgcctgcaggtaacgcgcctgctgccgtttttaggcttctggcccgaggagaatctggcgctccagctgtcggtggagtcgctgatccgtccgcgtttccagcgctggctgcgcgatgccttgatgcagtgtgaaaaatcgcagcgtcagcggattatttttgaacttgcagaggcagatgtttgtcaatatatcggccgtctgcagccggttatgcgattggttaacgctctgggcgttcgggtggcagtggttcaggcggggttaaccctggttggaaccagctggatcaagcagctggatgcggagctgatcaaactgcatccgggtctggcgcgcaacatcgaaaagcgcagcgagaaccaactgctggtgcaaagcctggtggaagcctgtaaaggcatgcctatgcaagtttttgcgacgggcgtacgtagccgcagcgagtggttggtactgtcccaatgcggtgtcacgggcgggcagggggaattttttgccgcctcacagccacttgacacaaatgtgaaaaaatattcgcaaagatactcggtttga

SEQ ID NO: 6485 - DNA, 657 bp, Klebsiella pneumoniae
atatacctggaggttttcatggctgtcgctgccaacaaacgttcggtaatgacgctgttttctggtcctactgacatctatagccatcaggtccgcattgtgctggccgagaagggtgtcagttttgagatagagcacgtggagaaggataacccgcctcaggatctgattgacctcaacccgaatcaaagcgtaccgacgctggtggatcgtgagctcactctgtgggaatcccgcatcattatggagtatctggatgagcgtttcccgcacccgccgttaatgccggtttatccggtggcgcgtggtgaaagccgcctgtatatgcaacgtatcgagaaggactggtattcgctgatgaacaccatccagagcggtaccgcagcgcaagctgatgctgcgcgtaagcagctgcgtgaagaactgctggccatcgcgccggtcttcacccagaaaccttacttcctgagcgatgagttcagcctggtggactgctacctggcgccgctgctgtggcgtctgccggttcttggtgtggagctggttggcgctggcgcgaaagagctcaaaggctatatgactcgcgtatttgagcgtgattccttcctcgcttctttaactgaagccgagcgtgaaatgcgcctcggtcggggctaa

SEQ ID NO: 6486 - DNA, 1455 bp, Klebsiella pneumoniae
agccaggcggacgttctgaccgttacggccgatcgcctgcgccaggttgcccgcttctaccgcgatatccatggtgtgtttatcttcatccaccacgatggacgcgacgtctgccggcgccatagcgttaatcacgaactgcgccgggttatcatcccacaggacgatatcgatgcgttcaccccccagctcagtcgacacggcctgcacacgcgcaccgcgcataccgacgcaagcgccaaccgggtcgatgcgcttgtcgttggttttcaccgcgattttggcacgagagcccggatcgcgagccgccgctttgatctccagcacttcttcaccgatttccggcacttcgatgcggaacagttcgatcagcatctcaggtttggaacgggtgacgaacagctgggcgccacgcgcttccggacggacagcgtacagtacgccgcgaatgcggtcgcccggacggaagttttcacgcggcagcatatcttcacgcaggatcacggcttcagcgttgttacccagatccagtgtgatattgtcgcggttcacttttttcaccacgccggtgatgatctcaccttcgtgctcgcggaactgatcgaccaccatcgcgcgctcggcttcgcggactttctgcacgataacctgcttagcggtctgggtggtgatacggtcgaaggtaacagattcgatctgatcttcgacatagtcgccgacgttcatgctttcatcttcgaaacgcgctgcttccagcgtgatctcgcgcgtcggctgggtgacttcttctacaaccagccaacgacggaaggtatcgaaatcgccgctcttgcggtcgatttcaacgcgaacgtcgatctcttgttcgtattttttcttggtggccgttgccagcgcgctttccagcgcttcgaaaattttctcacgcggcagcgctttttcgttggaaacggcttcaacaacagccaaaatttctttgttcatcggggcctttcacctcaatccagactgttaaaagtggggaaccaggttcgccttctggatgttactcagcgcgaacacttcatctttgccttcgacggttaccgtgatcatctcaccgtctaccgctttgataatgccctgccatttgcggcggttctgaaccgccatgcgcagcaccagcgcaacttcttcgccggtgaaacgttgatagtgttcggcggtgaacatcggacggtcaagaccaggcgaagagacttccaggttgtaagcgacagtgatcgggtcttcgacatccatgacggcgcttacctggtggctcacatcagcacaatcatcaacgttgatgccatcttcactatcaatatagatgcgcagtgtggatgtgcgaccgcgaataaattcgatgccgaccagctcaaagccaagcgcttcaaccggcgcagtgagcatctctgtcaatttttgctctaa

SEQ ID NO: 6487 - DNA, 1005 bp, Klebsiella pneumoniae
atgattcgggataacatcatgtcgcaaatagatttgcccacggattttgactttcaacaggcaggccgtcaggtgctggaaattgaacgtgaaggtctggcccagctcgatcaatacataaatgaagactttacccatgcctgcgaaacgattttccgctgcggcgggaaagtcgtggtgatggggatgggcaaatccggccacatcggccgcaaaatggcggcaaccttcgccagtaccggcacctcggcattttttgtccaccccggcgaagcggcgcacggtgatttaggtatggtcaccccacaggatgtggtaattgcgctgtcgaactccggcgaatcgaatgaaatcctcgcgctgatcccggtcctcaagcgccagcaggtgaagcttatctgtatcaccagccggccggagagcagcatggcgcgcgcggcggatatccatctgtgcgtgaaagtgccgaaggaggcctgcccgttaggactggcgcccacgtcgagcaccaccgccgcgctggtgatgggtgatgccctcgccgtcgccctgctggaagcccgcggctttaccgctgaggatttcgccctgtcgcatccgggcggcgcactcggccgtaagctgttgctgcgggtcaatgatattatgcataccggtgatgaaatcccgcacgtcggcctgcaggcgaccctgcgcgatgcgctgctggaaatcacgcgtaaaaatttaggcatgaccgctatctgcgatgacgatatgaacatcatcggtatctttaccgacggtgacctgcgccgggtcttcgataccggcgttgatatgcgcgatgccagcattgccgacgtcatgacccggggaggtatccgcatccgccccggcactctggcggtggatgcgctaaacctgatgcaatcccgtcatatcacctgcgtgctggttgccgatggcgaccatctgctgggtgtggtacatatgcacgatctgctgcgcgcgggcgtagtgtaa

SEQ ID NO: 6488 - DNA, 489 bp, Klebsiella pneumoniae
gcagccggggaagcgaagcgccacccggcaatcattttaaaaaggggcttttggccccttttttgtctttattctggagaacttattatggcgaaagaatttggtcgcccgcagcgtgtggcccaggagatgcaaaaagagattgccatcatcctgcagcgtgaaattaaagatccgcgtctgggcatgatgaccaccgtttccggtgtggaaatgtcccgtgacctggcctatgccaaggtgtatgtcaccttccttaacgacaaagatgaagccgcggtgaaagcgggcatcaaagcgctgcaggaagcttctggctttatccgctctctgctggggaaagcgatgcgtctgcgcatcgtaccggaactgactttcttctacgacaactcactggtcgaagggatgcgtatgtccaacctggtcaccagcgtggtgaaacacgacgatgagcgtcgtgtgaacccggacgacagcaaggaggactga

SEQ ID NO: 6489 - DNA, 897 bp, Klebsiella pneumoniae
ataaagagttttgctatgccatggatccaactgaaactaaataccaccggcgcgaacgctgaagatcttagcgatgcgctgatggaggccggatcggtctcgatcaccttccaggatacgcacgatacgccggtatttgagccattgcccggggaaacccgcctgtggggggataccgacgtaatcggcctgttcgatgctgaaaccgatatgaaagcggtcgttgcccaactggagcagcatccgctgctgggcgccgggttcgcgcataagatcgagcagctggaagataaagactgggaacgggaatggatggataacttccaccccatgcgcttcggggagcgcctatggatctgcccaagctggcgcgatgttccggatgaaaatgccgtcaacgtgatgctcgatccgggtctggcctttggcaccggtacgcatccgacgacatccttgtgtctgcagtggctggatggactcgacctcaacggaaaaacggtgattgatttcggctgcggctccggcatcctggcgattgccgcactgaagctgggggcggcaaaagcaatcgggattgatatcgacccgcaggctattcaggccagtcgtgataacgcgcagcgtaacggcgtttctgaacgcctggagctctatcttcctcaggaccaaccggagtcgatgaaagccgacgtggtggtcgcgaatatcctggcaggcccgttacgtgagctggcgccgttaatcagcgtcctgcccgtttcaggcggtttgctggggctttccggcatccttgccagccaggcggagagcgtctgtgaagcctatgccgatctcttcgcccttgacccggtggtcgagaaggaagagtggtgccggattaccggccggaaaaactaa

SEQ ID NO: 6490 - DNA, 318 bp, Klebsiella pneumoniae
tccgcaatactaagcacctcgggcacatcgtgcgaaaccacgatgcaagtgacacccagcgtgctgttgagttcagaaatcagcttcaccagcacgcccatagtgatgggatcctgcccgacgaacggttcgtcgaacataatcagatccggctccagggcaatggctctcgccagggcggcgcggcgcgccatcccaccggaaagctcagaaggcattaacttcgccgcaccgcgtagccccaccgcttccagcttcatcatcaccgtcgtatgcagcagcgcaggcggcaaatgcgtatgttcgcgcagcggatag

SEQ ID NO: 6491 - DNA, 960 bp, Klebsiella pneumoniae
tatcgcgcttgttcgtttgaggttgatgtgaaaacactaacaagaaatatcctccgtactgccattaccgtgatactggtcattctggccttcgtggcgattttccgcgcctgggtttattacaccgcctcgccgtggacgcgtgatgcgcgctttagcgccgatattgtggcgattgcccccgacgtctccgggctgatttctcaggtaaacgtcaaggataaccaactggttaagaaagaccaggtattgttcgttattgaccaacctcgttaccaaaaagcgctggcgcaggcggaagctgatgtcgcctattatcagacgttagctcaggaaaaacgcgtcgaagccggtcggcgtaataagcttggcgtacaggcgatgtcgcgggaagagattgatcaggcgaacaacgtactgcaaaccgttgaacatcagctggcgaaagcggtggctagtcgcgacctggccaggctagatctggagcggacggtcattcgcgcccctgcggatggctgggtgactaaccttaacgtctacactggggaatttatcacccgtggctccacggcggtggcgctggtgaaagagaatacgttttacgtcatggcctatctggaagagaccaaactggagggcgtccgtccaggctatcgtgcggagattaccccgctgggcagcagcaaaaccattaaagggacggtggacagtatcgctgcgggggtgaccaacgccagcagcagcagcgactcgaaagggatggcctcggtcgactccaaccttgagtgggtgcgtctggcgcagcgtgtgccggttcgtattcgcctcgatcaccagcaggggaatctgtggccatcgggcaccacggcgacggtagtgatcaccggtcaagaagatcgtgataccagccaggccaacttcttccagaaactggctatgcgcctgcgcgaatttggttaa

SEQ ID NO: 6492 - DNA, 768 bp, Klebsiella pneumoniae
tatgcgcgatgccagcattgccgacgtcatgacccggggaggtatccgcatccgccccggcactctggcggtggatgcgctaaacctgatgcaatcccgtcatatcacctgcgtgctggttgccgatggcgaccatctgctgggtgtggtacatatgcacgatctgctgcgcgcgggcgtagtgtaagtaaggaaaaaataatgaataatgctgatgctcagttagcgacctgctacgggccggtaagccaggcgtttgtcgatcgcgcggcgaagatccgtctactgatccttgatgtcgacggtgtattatccgacgggcttatctatatgggtaatcacggcgaggagctgaaagcgtttaacgtccgtgatggctatggtatccgctgcgcgctgacctcgggtattgaagtggcgattattaccgggcgaaaagctaaactggtagaagatcgctgtcagacgctgggcatcacgcatttgtaccaggggcagtcggacaagctgctggcgttccgcgatctgacggacaaactgcacgtgcggccggaagaagtcgcctacatcggcgacgatcttattgactggccggtgatggccgaagtgggccttagcgtcgccgtcgccgatgcgcatccgctgctgctaccgcggacgaattatgtcacgcgaattaacggcggacgcggcgcggtacgcgaagtctgcgatttgttactattggcgcagggcaagttggatgaggccaaagggcaatcaatatga

SEQ ID NO: 6493 - DNA, 1737 bp, Klebsiella pneumoniae
gtattattgtgcggagttgtcgtgaaggaatcccctatgaagcaaattcgtatgctggcgcagtattatgtcgacctgatgatgaagctgggtctggtccgcttttcgatgctgttggctcttgcgctggtggtgctggccatcgtggtacagatggcggttaccatggtgctgcatggccaggttgaaagtatcgacgttatccgctctatcttctttgacctgctgatcacgccttgggcggtctactttctctcggtggtggagcagctcgaagagtcccgtcagcgtctttcgcggctggtggacaagctggaggagatgcgtgagcgcgatctaaagctgaacgtccaactgaaagataacatcgcgcagttgaatcaggagattggcgaacgtgaaaaagcggaagccgagcgcgagaccaccctcgagcagttgaagattgagatgaaagagcgtgaagagacacagatccagctcgaacagcaatcctcctttctgcgctctttccttgatgcttccccggacctggtcttctatcgcaatgaggataaggagttttcaggctgtaaccgggcgatggaactgctgaccggcaaaagcgagaaacagctgatccacctcaaaccgcaggacgtctatagcgaagaggcggcggaaaaggtactggagaccgacgagaaggtgttccgccataatgtatcgctgacctatgagcagtggctggactatcccgatggccgcaaagcgtgctttgaaatccgcaaggtcccctactacgatcgcgtcggtaagcgtcgcggcctgatgggcttcggccgcgatatcaccgaacgtaaacgctatcaggacgctcttgagcgcgccagccgggataaaaccacctttatttccaccatcagtcatgagctgcgtaccccgctaaacgggatcgtcgggctgagccgaattttgctggataccgaactgaccagcgaacaggaaaaatacctgaaaactatccatgtatcggcggtgacgctggggaatatcttcaatgatattatcgacatggacaaaatggagcgccgcaaggtgcagctcgataaccagccggtggacttcaccagcttccttgccgaccttgaaaacctatccggcttgcaggcacagcaaaaggggctgcgctttgtgctggagccgagcctgccgctgccgcataaggtaatcacggatgggacccgcctgcggcagatcctgtggaatcttatcagtaacgccgtgaagtttaccccgcagggcggaggggtgaacgtccgcgtgcgctatgacgaaggcgatatcctgcacttcgaagtggaagactccggaattggtattcctgaagcggaacaggacaaaattttcgccatgtattaccaggtcaaagacagccacggcggcaaaccggccaccggaaccgggattggtctcgccgtctcgcgtcgcctggcgcgtaatatgggcggtgatatcagcgttaccagccagccgggtaaaggggcgacctttacgctcaccgtccatgcgcctgccattgcggaagaagtgggaagatacgcttggcggaagacgacatgccatgtccggcgctcaacgtgctgctggttgaggacattgagctcaacgttattgtggcccgttcagtgctgggaaaaactgggtaacagcgttgatgtggcgatgacccgggaaagcggcgttggagatgtttga

SEQ ID NO: 6494 - DNA, 624 bp, Klebsiella pneumoniae
tgcgtaaagtgcgtcagcaatttgcagtgcaataaggttgatatgacaactctgtatctcgcttctggttccccgcgtcggcaggaactgctgactcagcttggtctcgctttcgagcgtctggttcctggtattgaggagcagcgccagccgcaggagagcgcccagcactatgtcgtccgcctggcgcgcgaaaaagcgcaggccggggtggcgatggccacccgcgatttgccggtgctgggagcggatacgattgtcattttgaacggcgaagtgctggaaaaaccgcgcgacgccgaacacgctgcagcgatgctgcgtttgctttccggccacacccatcaggtcatgaccgcggtggcgctggcggataagcagcaaacgctggactgtctggtggtcacggaagtgaccttccggcggctcagcgagcaggatatcgccgattatgtggccagcggcgagcctttagataaagcaggtgcatacggtattcaagggttgggtggttgcttcgtcaggaagattaatggcagctatcacgccgtagtcggcttaccgctggtggaaacgtatgagttgctcagtaactttaactcactgcgtaaaggaaagggataa

SEQ ID NO: 6495 - DNA, 252 bp, Klebsiella pneumoniae
caacggattcgacggctatattcgcccggatcatggtcgctttatctggggagagaccggacggccgggctatggcctgttcgaccgcgccctcggcgtgacctacctgaaaggactctgggaggcgttaagcaagcgttaatccctcttctgatccccctcttttgcggctggttcgcctcagcggccggccgccgtatcgactcctgcccgcattttttgcacaacttacagcgcattgctcagaattga

SEQ ID NO: 6496 - DNA, 996 bp, Klebsiella pneumoniae
tcattcactcgcggagttaacacagggatgcgattaacgacgaagttctcagcctttattacgctgctaactagcctgaccatctttgtcacgctgattggcgcttcgctgagtttttataacggcattgagaacaaggtcgaaaaccgcgttcaggcggtggcgaccatgctggataaccggctcatcaccacctctttcgataagcttgaaccgcagttggatgagctgatgacgccgatcgagatcgtgcatatcgatttcatgctcaacggcaaaccgctctacagccattcccgacccgatagctatcgcccgctcggcagccatgagcaattccgtgagatcacggttccgtcgcttaaacatcctggcattacgctgcatctggtctacgttgacccgatggtgaactatttccgttcgctgtcgatcactgccccgctgtcgatctccattggcttcatggtggtaattattttcttcgccgtccgctggatccgccgccagctggccggccaggagctgctggagctgcgttccacgcgtatcctgagcggcgagcgcgggccgcaggtgcgcgggtcggtctatgaatggccggccagcaccagtagcgcgctggatatgctgctgtcggagctgcagttcgccagcgatcagcgcagccggatggatacgcttattcgctcctacgcggcgcaggattcgaaaaccggactgaataaccgcctgttttttgacaatcagctggccacgctgctggaagaccaggagaaggtgggagcctacggcatcgtgatgatgatccgtctgccggagtttgatctgctacgggacaactggggacgggcggcggccgaagaacattactttacgcttatcaacctgctctctacctttattatgcgttaccccggcgcgctgttggcgcgctatcaccggtacgacttcgccgtgctgctgccgcacccgaccttgaaagaggccgattga

SEQ ID NO: 6497 - DNA, 234 bp, Klebsiella pneumoniae
cgctttgctcgccgtgaacatcccgtttatcgagattcacctgagcaatgtgcatgcacgcgaacccttccgccagcactcgtatctgtcagatgtcgccgctggcgtcatttgcgggctgggggcggatggttattcatacgctttacagacggcggtaaaacgcctgtcacaatcacactaaacaaagagtacggaacccactcatggatattcgtaagattaaaaaactga

SEQ ID NO: 6498 - DNA, 435 bp, Klebsiella pneumoniae
cttctgaatcgcgaccgttacgagtcgagccgccagcctttttatgtgccatttaaatctactcctcaggtcttaggcgctgatgccagtgattttcacatcagtgaaccactgacgatggccctgctgcttacgatagtgtttacgacgacgaaacttaacgattttaactttctcgccacgaccgtgagcaacaacttcagctttgattacgccgccctcaacgaaaggaacgccgatcttgatttcttcaccgtttgcgatcatcagcacttcagcgaattcaacagcttcgccagttgcgatgtccagcttttccaggcgaacggtctgaccttcgcttactcggtgttgtttaccaccactttggaaaaccgcgtacatataaaactccgcttccgcgcacctctttatgtgattcagagtgcgctataa

SEQ ID NO: 6499 - DNA, 2343 bp, Klebsiella pneumoniae
aacgccctccgcaaaagcggagggctaacggcaaccttactcgccctgctcggcagccggagcttccggcgctgcggcagacggagtctgttcagttgcttctttaatgctcagacggacacggccctggcggtcaacttccagaaccttaaccggtacttcctgacccatctgcaggtagtcagtcactttctcaacgcgcttgtcagcgatctgcgagatgtgaaccagaccttctttaccgccgccgatggcaacgaatgcgccaaaatcaacgatacgggtcactttaccattgtagatgcggccaacttcgatctcagcggtgatctcttcgatacgacggatagcatgctgcgctttgtcgccgtcggtcgctgcgatcttcacggtaccgtcatcttcgatctcgatggtagtaccggtctcttcggtcagggcacggataacagaaccgcctttaccgataacgtctttgatcttgtccgggttgatcttgatggtgtggatacgcggtgcgaattcagagatatcgccgcgcggcgcgttaatcgcctgctccatcacgcccaggatgtgcagacgcgcacctttagcctggttcaatgcaacctgcatgatttctttggtgataccttcaattttgatatccatctgcagcgcagagataccgtcgcgggaacccgcaactttgaagtccatatcgccgaggtggtcttcgtcaccgaggatgtcagacagcacgacgaagttgtcgccttctttcaccagacccattgcgatacccgccacagcggcttttaccggcacgccggcgtccatcagcgccagagaggcgccgcagacggaagccatggaagaggaaccgttagattcggtgatttccgataccacgcgcacggtgtacgggaattcttcaatagtcggcatcacggccagtacgccgcgcttcgccagacgaccgtgaccgatttcacgacgcttcggagaccccaccatgccagtttcgcctacggagtacggagggaagttgtagtggaacaggaaggagtcggtgcgctcgcccatcagttcgtcgatgttctgcgcatcacgtgcggtacccagagtcgcggtaaccagcgcctgcgtttcgccacgggtgaacagcgcggaaccgtgagtacgcggcagaacgccggtacgaacgtccagaccacggatcatatctttttcacggccatcgatacgcggctcgccggccagtacgcggctacgaaccacgtttttctcgatggcatgcaggatttcacccagctcgttagcgtccagggtttcatcttcagcaaccagcgtggcgatggtttcagatttgatcacgtcaacctgagcgtaacgctcttgtttgtcggtgatacggtaagcatcgctcagacgggattcagccagcgcagccacgcgcgcgttcagcgcttcgttgaccgcttccggctgccagtcccaacgcggtttaccggcttctttcaccaggtcgttgatgttctgaataacaatctgctgctgctcgtggccgaagaccaccgcgcccagcatctggtcttcgctcagcagttccgcttcggattccaccatcagcacggccgcttcggtaccggcaaccaccaggtccagtttgctggacttcagttcttcctgggttgggttcagtacgtactggtcgttgatgtaacccacgcgcgcagcgccgattgggccattgaacggaataccagacagcgacagcgcagcggaagcaccgatcatcgcgacgatgtctgggttaacctgcgggttaacggaaacgacggtggcgataacctgaacttcgttaacgaagccttccgggaacagcgggcgaaccgggcggtcaatcagacgcgcgatcagggtttcgccttcgcttggacggccttcacgacggaagaaaccacccgggattttaccggcagcgtaggtacgctcctggtagttaacggtcagcgggaaaaagtcctggcctggcttcgcttttttctgacccacaacggtaacgaataccgcagtgtcatccatgctaaccatcacagcggccgttgcctggcgcgccatcatgccggtttccagggtcacggtatgctggccgtactggaatttacgaacgatcggattaagcaaaattctatcctttttatctataaatcacgccatatccacgacatagcgtctattgacccgatcttctgcatcctcgcgactaatgacaacctttacccgcccctgcggatgaagcctctcattagccgcgcgaacctctgcatgaagatcattactagcaacaatacatga

SEQ ID NO: 6500 - DNA, 354 bp, Klebsiella pneumoniae
tggcctgaccgcgcagctgaaagcgatctctgcgcagccgatcaccctggaacagaaaaaataatgagcgggcagctgagctggactcgcgagggcgagacgctggcgctgcacggggagctggatcaggatctgctggtcccgctctgggaggcgcgcgcccaggcgacggcgggaacggcgatcatcgatctcagtcagaccacgcgcgtggacaccgcgggcctggcgctgttagtgcattttgtggcgctgattcgccgtcagggccgggaagcgcagctggtcggcaagagcgaaaacctgcaaacgctgatcggtctttacaacctgcctgccgatctgatctcataa

SEQ ID NO: 6501 - DNA, 669 bp, Klebsiella pneumoniae
tggctatgccgacgaagtggcgtcgctgtatcgcggcatgaatctgcgggagaacttctagtgcgtttcaccgtcaaacagatcgtctggctgaaggttttacttcaccttgcggggtttttgccgctggtctggttattctgggccgggcaccagggctactttagcgccgatccagccaaggatattcagcactttaccggcagaatggcgcttaagtttctgctggcgacgctgctggtctctccgctggcgcgctatgcgaagcagccattattgattcgcgttcgtcggctgttaggtttatggtgttttgcctgggcgacgctgcacctgaccagctataccctactggagctgggcattaacaatctggcgctgctgggctcggagattatcacccgcccctatctgacattgggcatgatcagctgggcgattctgctggcgctggcggtgacctccacgcaagcgatgcagcgaaaactggggcgtcgctggcaacttttacacaacttcgtctatctggtggcgatcctcgcgccgatacactacctgtggtcagtgaagatcgtctcgccgcagcccgttatatatgccctactggcagcggggctattgacatggcgttacaagaagttccgccagtggtggcgcgcaatccggtaa

SEQ ID NO: 6502 - DNA, 393 bp, Klebsiella pneumoniae
aacgtcccgctttattggtcgaagcacttggtatgcggcgaatccgcaaggaacaggttgattatgtacgaagctcttttggttgttttccttattgtagcgattggccttgtaggtctggttatgctgcagcaaggtaaaggcgctgatatgggagcctccttcggtgcaggcgcttccggcacactgtttgggtccagcggttctggcaactttatgacccgtatgaccggcatcctggctgcgctgttcttcatcatcagtctggcgctgggtaatatcaacagcaacaagaccagtaaaggaagtgagtgggataatctgagcgcgccgaaaacggagcaaactcagccaactgcgccggctcagccgaccagcgatatcccgcactaa

SEQ ID NO: 6503 - DNA, 933 bp, Klebsiella pneumoniae
ataatggaacgattaaaacgcatgtccgttttcgccaaagtggtcgaattaggttcattcaccgcagcggcccgccagcttcagatgagcgtttcctcgatcagtcagaccgtcgccaaactggaagatgagctgcaggtaaagctgctcaaccgcagcacccgcagccttggcttaactgaagcaggtaaaatctattaccagggctgccgtaggatgctgtttgaagcgcaggatgtccatgagcaattatacgcatttaacaatacccccatcgggacgctgcgcatcggctgctcttcaactatggcacagaatgttctggcgcgcataacggcgaaaatgctcaaagaataccccgggctctctgttaatctggtcaccggcatacctgcgccagacctgatcgccgacggccttgacgtggtgatccgcgtgggcgccctgcaggattccagccttttttcccgccgtctgggctcaatgccgatggtattatgcgccgctaaaagctatctggcgcaggctggcaatccagagaaaccggccgaccttgccggacatgcctggctggaatatagcgtgcggccggacaatgagtttgtcattatcgcgccggaagggatctcgacccgcctgaccccgcaggggcgcttcgtgaccaacgaccctatgacgctggtgcgctggctgaccgccggggtgggtatcgcctatgtacccttaatgtgggcgatcgaagagatcaaccgcggtgaacttgagatcctgctgcccagctatcagtccgatccgcgaccggtctacgccctgtatacggaaaaggataaactgccgctgaaagtgcaggtctgtatcaactatctgacggagtattttgtcgacgtggcgaagatctatcagggcatgcacgggcgcgggatcgcccggtga

SEQ ID NO: 6504 - DNA, 219 bp, Klebsiella pneumoniae
aagtttacgcgggtaacgagcacaaccacgcggcacagcaaccgcaagttcttgacatctaatcgggattataggcaatggctgaaaatcaatactacggcactggtcgccgcaaaagttccgcagctcgcgttttcatcaaaccgggcaacggtaaaatcgttatcaaccagcgttctctggaacagtacttcggtcgtgaaactgcccgcatggtag

SEQ ID NO: 6505 - DNA, 444 bp, Klebsiella pneumoniae
aaaactgcgcgaagaaactggattatcttgagtctgtgcgtcgtactgaaatcattgccgctattgctgagggcccgtgaacacggcgatctgaaagagaatgccgagtatcacgccgcgcgtgagcagcagggtttctgcgaagggcgtatcaaggatatcgaagcgaagctgtctaatgcgcaggttatcgatatcaccaaaatgccgaacaacggccgggtgatttttggttctaccgtcagcgtgctgaacctcgataccgacgaggaacagacctaccgcatcgtgggcgatgacgaagctgattttaagcagaatctgatctccgtgaactcgccgatagcccgcggtctgatcggcaaagagcaggatgacgtcgtgactatccgtaccccgggtggggaagtggaatacgaaattaccaaggttgaatacctgtaa

SEQ ID NO: 6506 - DNA, 798 bp, Klebsiella pneumoniae
ggagttgagcgactcatgctgtttaatgcgctggccgcgctaggtcatcgcggtattaaaaccaccgcgacgtttggacgcgccggattaatgcttttcaacgccgttgtcggcaaaccagagtttcgcaagcacgcgccgctgctggttcgtcaactctataacgtcggcgtcctgtcgatgctgattatcattgtatcgggcttgtttatcggtatggtgctcgggctgcaggggtatctggtgttaaccacctacagcgcagagaccagtcttggcatgctggtggcgctgtcgctgctgcgtgagctggggccggtggtcgccgcgctgctgtttgccggccgcgccgggtcggcgctgaccgccgagattggcctgatgcgggccacggaacagctctccagtatggagatgatggcggtggatccgctgcgtcgcgtcatttccccacgcttctgggccggtgtcatttcgctgccgctgctgacgattatcttcgtcgcggtagggatctggggcggtgcgctggtgggtgtgagctggaaaggcattgacggtggttttttctggaccgcgatgcaaaatgccgtcgactggcgaatggatctggtgaactgcctgattaagagtctggtgttcgctattacggtaacctggattgcgttatttaatggttatgacgctatccccacttccgccgggattagccgggcgacaacgcgtaccgtggtgcatgcgtcgctggcggttctggggctggattttgtgctgactgcgctgatgtttgggaattga

SEQ ID NO: 6507 - DNA, 696 bp, Klebsiella pneumoniae
tcatgccggcgacgcagcagagcatgctgttgctttgcatcagcctggcggcaatggcgttctttatcgggatccgaagtgcaaaaaaggcgtctcggatcgtggggggcgctggggagcaccatcaacattctggtgctggataacccgatgcagttccagttcagccagttcctcgatagcgcgctggggcagatcgtcggctgtttcctcgctctgatggttattctcattgtcagggataactcccgggccagaaccggtcgggtgctgctgaaccagtttgtctccgcggcggtctcttcgctgaccaccaactcggcgcgtcgcaaagagaatcatctgcccgcgctctatcagcagctgtttttattactcaataaattcccgggtgacgtcgcccgtttccgtctggcgttgacgttaatcatcgcccatcagcgcttgcgcgatgcgcccgtgccggtgaacgacgatctctccgccttccatcgtcagctgcgacgtaccgcggaccatgtgatctccgccggcagcgatgataagcgtcggcgctattttacccagctactggcggagcttgatgtctatcaggagaagctgcgggtctgggaggcctcgccgcaggtcaccgagccggtacggcgactggttgagatgttgcataagtatcagcatgtgctgaccagcagctaa

SEQ ID NO: 6508 - DNA, 597 bp, Klebsiella pneumoniae
ccaccgcccaggcctgcgccacgctggcggccgacggcgtcgatttcatcgatgaagatgatgcaaggcgcggctttcttagcctgttcgaacatgtcacgcacacgagaagcgcccacaccgacgaacatttcgacgaagtcagaaccggaaatggtaaagaacggtaccttcgcttcaccagcgatcgctttcgccagcagcgttttaccggtacccggagggccgaccatcaggacgcctttcgggattttaccgcccagtttctggaagcggctcggctcacgcaggtattctaccagctcgccgacttcctcttttgcttcgtcacacccggcaacgtctgcaaaagtggttttgatctggtcttccgtcaacatacgggctttgcttttgccgaaggacatcgcgcccttcccgccgccgccctgcatttgccgcataaagaagatccagacgccgatcagcagcagcattgggaaccaggagatgaagatggaagccagcaggctcggctcttctggtggttcgccaacaactttgacgtttttagtcaacaggttatcgagcagcttcggatcgttaaccggaatgtaa

SEQ ID NO: 6509 - DNA, 312 bp, Klebsiella pneumoniae
agagctgacagaactatgttcgaacaacgcgtaaattctgacgtactgaccgtttctaccgttaactctcaggatcaggtaactcaaaagcccctgcgtgactcggttaaacaggcactgaagaactattttgctcaactgaacggtcaggatgtgaatgacctgtatgagctggtactggctgaagttgaacagcccctgttggacatggtgatgcaatacacccgtggtaaccagacccgcgctgctctgatgatgggcatcaaccgcggtacgctgcgtaaaaaactgaaaaaatacggcatgaactga

SEQ ID NO: 6510 - DNA, 432 bp, Klebsiella pneumoniae
gcgacagtaagctcacctccatgctgtccgagcagggtattatggtggcgcgccgcactgtcgcgaagtacagagagtctttatccatcccgccgtcaaaccagcgtaaacaactggtctgacataaccgataaggaagacactatgcagctcaacattacaggacacaacgtcgaaattacgcctgcgatgcgcgaattcgttacggcgaagttcagcaagctggagcagtttttcgaccggatcaatcaggtctatattgtgttaaaagtagagaaagtgacgcaaattgcggacgcgaatctgcatgtcaacggtggcgaaatccatgccagtgcggaagggcaggatatgtatgcggctgtcgatggtcttatcgacaagctggcaagacagttaacgaagcacaaagataaactaaaacaacactaa

SEQ ID NO: 6511 - DNA, 294 bp, Klebsiella pneumoniae
gatgttgggctgttttcactatcagataaatttgagcccatggaaaatcatgaaattcagaccgtgctgatgaacgcactccccctccaggaagtccacgtctctggcgatggcagccactttcaggttattgctgtgggtgagatgttcgatggcatgagtcgggtgaaaaagcagcagagcgtctacgcgccgctgatggaatatattgccgacaaccgcatccatgcgctgtcgatcaaggcctttactccgcaggagtgggcgcgagaccgcaaactcaatggcttctaa

SEQ ID NO: 6512 - DNA, 1131 bp, Klebsiella pneumoniae
atcatgcaaagcctgtctccaacatcgcgttaccttttagccctgaaagagggcagtcatcaacccgacgacgtccagcaagaagcggtgagccgccttgataccatttaccaggaactgcagacgcagcccgcgccggtcgcgtcaggcggcggtttgcgcgcgaaattcggcaaactgctgggtaagcgcgagccggctgccgggacggcacctgtccgcggcctgtatatgtggggcggcgtggggcgaggcaaaacctggctgatggacctgttttaccagagcctgccgggcgagcgtaaacagcgcctgcatttccatcgtttcatgctgcgcgtacacgaagagctgaccaccctgcagggacatagcgacccgctggagatcgtcgccgaccgctttaaagcggaaaccgacgtgctctgtttcgacgagttttttgtctccgatattaccgacgccatgctgttgggcgggctgatgaaagccctgttcgcccgcggcatcaccctggtggcgacctccaatattccgccggatgaactctatcgtaatggcctgcagcgggcccgttttctgccggcgatcgacgccatcaagcagcattgcgatattatgaacgtcgatgccggcatcgattatcggctgcgtaccctgacgcaggcgcacctgtggctgtcgccgctgaataacgacacccgcgaacagatggataaactgtggctcgcgctggcgggcgcgccgcgcgctgccgggccgacgctggagattaaccatcgcgagctgcctaccctcggcgtagaaaaccagacgttggctgcgtcattcgccacgctatgcgtggatgcgcgcagccagcatgactatatcgcgctctcccgactgttccatacggtgatgctgttcgacgtgccggtgatgaccgcgcagctggagagcgaggcccgccgctttatcgctctggtggatgagttttacgagcgccatgtaaagctggtggtcagcgcggcagtgccgctgtacgacatttaccagggcgagcggctgaagtttgagttccagcgctgtctctctcgtctgcaggagatgcagagcgaagagtacctcaaacgtccgcatatgccctga

SEQ ID NO: 6513 - DNA, 474 bp, Klebsiella pneumoniae
cttatgcgaagttcggcaaaacaagaagaactggttaaagcgtttaaagcgctgcttaaagaagagaaattcagctcgcagggagagatcgtccaggcgctgcaggaagagggcttcgagaatatcaaccaatcgaaggtttcccgcatgctcaccaaatttggcgcggtacgtacccgtaacgccaaaatggaaatggtctattgcttgcctgccgagcttggggtaccgaccacctccagcccgctgaagaatttggtgctggatatcgactataacgatgccgtagtggtgattcataccagccccggcgccgcgcagctgatcgcccgtcttctcgactcgctgggcaaagcggaaggcattcttggcagtatcgccggggatgacaccatctttaccacgcctgcgcgcggttttacggtgaaagatctgcacgacgccattctggttctgtttgagcaggaactctga

SEQ ID NO: 6514 - DNA, 2019 bp, Klebsiella pneumoniae
gagagatcgagggttgagccctgggctacaagtttcatcacaaaatccctgagactgaagaggttaaaaaagaaaaaccccggagcggacgcccggggttttaaggttaaacaagcatcaacagcggtagcttacttgtcgcccagatgctctgacatggtgttgcccgggttcggcgtacgcggttcatcaaccggacgtggcgcacgaggcgtgccattgttgtcagagtttgtaaaaagaaccaggttcttcccaacccgctggcggacgaacttcgcgacgagccatcaggtcgtcaatctgcggcgcatcgatggtctcatacttcatgagcgcatctttcatcgcgtgcagaatgtccatgttgtcgttcagcagctggcgagcacgaccgtagttacgctcaatcagcgatttcacttcctggtcgatgatacgcgcggtttcatcggacatatgcttcgctttcgcgacgctacggccgaggaagacttcaccctcttcttccgcatacagcagcggaccgagtttgtcggagaagccccactgggtcaccatgttacgcgccaggttcgtcgccactttaatatcgttggacgcaccggtagaaacatgttccggaccgtagataatctcttccgccagacgaccgccgtacagggtggagatctggctttccagtttctgacggctggcgctgattgcatcgccttccggcaggaagaaggtcacacccagcgcacgaccgcgcgggataatcgtcactttgtgcaccggatcgtgctccggcaccaggcgaccaataatcgcgtggcccgcttcatgataagcagtagactctttctgcgcttccgtcatcaccatggagcgacgttccgcacccatcatgattttgtctttcgctttctcgaactcaaccatcgacacaacgcgtttgttaccgcgggcagcaaacagcgccgcttcgttgaccaggttggccagatccgcaccggagaagcccggggtaccgcgcgcaatgattgccgcatcgatatccggcgccagcggaacgcgacgcatatgcactttcaggatctgctcacgaccgcgaacatccggcaggccaaccaccacctggcggtcaaaacggcccggacgcaacagcgcggggtcaagaacgtccggacggttagtcgccgcgataacgatgataccttcgttaccttcgaagccgtccatctcaaccagcatctggttcagggtctgctcacgttcatcgtgaccaccgcccaggcctgcgccacgctggcggccgacggcgtcgatttcatcgatgaagatgatgcaaggcgcggctttcttagcctgttcgaacatgtcacgcacacgagaagcgcccacaccgacgaacatttcgacgaagtcagaaccggaaatggtaaagaacggtaccttcgcttcaccagcgatcgctttcgccagcagcgttttaccggtacccggagggccgaccatcaggacgcctttcgggattttaccgcccagtttctggaagcggctcggctcacgcaggtattctaccagctcgccgacttcctcttttgcttcgtcacacccggcaacgtctgcaaaagtggttttgatctggtcttccgtcaacatacgggctttgcttttgccgaaggacatcgcgcccttcccgccgccgccctgcatttgccgcataaagaagatccagacgccgatcagcagcagcattgggaaccaggagatgaagatggaagccagcaggctcggctcttctggtggttcgccaacaactttgacgtttttagtcaacaggttatcgagcagcttcggatcgttaaccggaatgtaagtcgtgtaacggttactatctttcttggtaacgttgatctcacgtccgttgatacgcgcttcgcgaacctggtcctgattgacctcttgcaggaaggtagaataatccaccttgcggccattcgactcgctgggcccaaagctctggaatactga

SEQ ID NO: 6515 - DNA, 1194 bp, Klebsiella pneumoniae
tttacggagagtaaaatgaagtttgtagatgaagcaacgatcctggtcgtagcaggtgacggcggcaatggttgcgtaagcttccgccgcgaaaagtatattccgaaaggcggtccggatggcggcgatggcgccgatggcggcgatgtctggctggaagcggacgagaacctgaacaccctgatcgactaccgttttgaaaaatcgttccgcgccgaacgtgggcagaatggtcaaagccgcgactgtaccggtaagcgcggtaaagacgtgacggtaaaagtgccggtcggcacccgggttatcgatcagggcaccggcgagaccatgggcgatatgaccaaacacggtcagcgtctgatggtggcgaaaggcggctggcacggtttgggcaacacccgtttcaaatcgtccgttaaccgtacgccgcgtcagaaaaccatgggtaccccgggtgataaacgcgacctgcagctggagctgatgctgttggccgatgtcgggatgctgggcatgccgaacgccggcaaatccaccttcatccgtgcggtctccgccgccaagccgaaagtggctgactatccgtttaccaccctggtgccaagcctgggcgtggtgcgtatggacaatgaaaagagcttcgtagttgccgatatcccggggctgattgaaggcgcagcggaaggggcaggcctcggtatccgcttcctcaagcacctcgagcgctgccgcgtactgctgcacctcatcgatatcgatccgatcgacggctccgatccggttgagaatgcgcgcattatcatcggcgagctggagaaatacagcgagaagctagcctccaaaccacgctggttagttttcaacaagattgacctgatggacaaggccgaagccgaagccaaagccaaagcgattgccgaagcgctgggttgggaagagaaattctacctgatctccgcggccagccagcagggcgtgaaagagctatgctgggacgtgatgaccttcatcatcgaaaacccgatcgtgcaggtggaagaagagcagaagccggagaaagtcgagtttatgtgggacgactatcatcgtcagcagcttgaagaggccgaagccgaagcagaagatgacgaagactgggatgacgactgggatgaggacgacgaagaaggcgtcgaattcatctacaaacgctaa

SEQ ID NO: 6516 - DNA, 4482 bp, Klebsiella pneumoniae
agcctggggaggttcactgatatgttgtacgacaaatcccttgagagggataactgtggtttcggcctgatcgcccacatagaaggcgaacctagccacaaggtagtgcgaaccgcaatacacgcactggcccgcatgcagcaccgtggcgcaatccttgccgatggtaaaaccggcgacggttgcggtctgctgctgcaaaaacccgatcgtttcttccgcatcgttgccgaagagcgcggctggcgtttagccaaaaactacgccgttgggatgctgttcctgaataaagatcctgagctggctaaagcggcgcgccgcatcgttgaagaagaacttcagcttgagaccctgtcgattgtcggctggcgcgatgtgccgaccaacgaaggcgtactcggtgaaatcgccctctcctcgctgccccgtattgagcaaatctttgtcaacgccccggctggctggcgcccgcgcgatatggagcgccgtctgtttattgcgcgtcgtcgcattgaaaaacgtctgcaggaagacaaagatttctacgtttgtagcttgtccaatctggtcaacatctataaaggtctgtgtatgccggcggatttgccgcgcttctacctggacctcgcggacctgcgcctggagtcggctatctgcctgttccaccagcgcttctccaccaacaccgtaccacgctggccgttggcgcagccgttccgctacctggcgcacaacggtgaaattaacaccattaccggcaaccgccagtgggcccgcgcccgtacctataagttccagaccccgctgatccctgacctgcacgacgccgcgccgttcgttaacgaaaccggctccgactccagttccatggacaacatgctggagctgctgctggccggcgggatggacatcgtgcgcgccatgcgtctgctggtgccgccagcctggcagaacaacccggatatggatccggagctgcgttcgttcttcgactttaactccatgcatatggagccgtgggacggcccggcgggcatcgtcatgtccgatggccgctacgcggcctgtaacctcgaccgtaacggtctgcgcccggcgcgctacgtcattaccaaagataagctcatcacctgcgcctccgaagtcggcatctgggattaccagcctgacgaagtggtcgagaaaggccgcgtgggcccgggcgagctgatggttatcgatacccgtgccggacgcattctgcactcagcggaaaccgatgacgatctgaagagccgccacccgtataaagagtggatggagaaaaacgttcgtcgcctggtgccgttcgaagatctgccggacgaagaggttggcagtcgccagctggatgacgacacgctcgccagctaccagaaacagtttaactacagcgcggaagagctggactccgtcctgcgcgtgctcggcgaaaatggccaggaagcagtcggttcgatgggcgatgacacgcctttcgccgtgctctccagccagccgcgcattatctacgattacttccgtcagcagttcgcccaggtgactaacccgccgatcgacccgctgcgcgaagcgcacgtcatgtcgctggctaccagcatcggccgcgaaatgaacgtcttctgcgaagcggaaggccaggcgcatcgtctgagcttcaaatcgccgatcctgctgtactccgattttaaacagctgacgacgatggaagaagagcactatcgcgccgacgtcctcgatatcacgttcaacccggcagaggcctccctcagcgagacggtgaaagcgctgtgcgataaagcggagcaaatggtgcgcgacggcaccgtgctgctggtgctctctgaccgcaacatcgccaaagaccgtctgccggtaccggcgccgatggccgttggcgcgatccagacccgtctggtcgataaaagcctgcgctgcgatgccaacatcatcgttgaaaccgccagcgcccgcgatccgcaccacttcgccgtgctgctcggctttggggcgacggctatctatccatacctcgcctacgaaacgctggcgaagctggtcgacagcaaagccatcgataaaccgtaccgtgcggtgatgctgaactatcgcaacggtatcaataaaggtctgtataagatcatgtccaagatggggatctcgaccatcgcctcctaccgctgctcgaagctgttcgaagcggtcggtctgcatcgcgatgtctccgagctctgcttccagggcgtggtcagccgcatcggcggcgccagcttcgacgacttccagcaggatctgctgaatctgtcgaaacgcgcctggctggcgcgtaagccactggcccagggcggtttgctgaaatatgtgcacggcggcgaatatcatgcctacaacccggacgtggtgcgcaccctgcagcaggccgtgcagagcggcgaatacagcgattatcaacaatacgcgaaactggttaacgaacgtccagcggccacgctgcgcgacctgctggcgctcaacccaggcgaagacgccatcagcatcgacgaagtagagccggcgaaggagctgtttaaacgcttcgataccgcggcgatgtcgatcggcgccctgagcccggaagcgcacgagtcgctggcggaagcgatgaacagcatcggcggcttctccaactccggtgaaggcggtgaagacccggcgcgctacggcactaataaagtgtcgcgcatcaagcaggtcgcttccggccgcttcggcgtcacgccagcctacctggtcaatgccgacgtcatccagatcaaagtcgcccagggggcgaaaccgggtgaaggtggccagctgccgggtgataaagtcaccccgtacatcgccaaactgcgctattcggtaccgggcgtcacgctgatttccccgccgccgcaccacgatatctactctatcgaggatctggcgcagctgattttcgacctcaagcaggtcaatccgaaagcgatgatttcggtcaaactggtttctgagccgggcgttggcaccatcgccaccggcgtggccaaagcctatgccgacctgatcaccatcgccggctacgacggcggcaccggggcgagcccgctctcttcggtgaaatatgccggctgtccgtgggagctcggcctggtggaaacccagcaggcgctggttgccaacggtctgcgtcataagatccgtctgcaggtggatggcggcctgaaaaccggtcttgatatcatcaaagcggcgatcctcggcgcggagagcttcggtttcggtaccggcccgatggtcgcgctgggctgtaaatacctgcgtatttgccacctgaacaactgcgctaccggcgtggcgacccaggatgacaaactgcgtaagaatcactatcacggtctgccgttcaaagtgaccaactactttgaatttatcgcccgtgagacccgcgagctgatggcccagctgggcgtcaagcgtctggtggatctgattggccgcaccgatctgctcaaagagctggatgggttcaccgccaagcagcagaaactggatctgggtaaactgctggagaccgcagagccgcatccgggcaaagcgctgtactgcaccgagaacaacccaccgttcgataacggcgtgctcaacgcccagctgctgcagcaggcgaaaccgtacgtggatgaaaagcagagcaagacgttctggtttgatatccgtaacaccgaccgctccgtgggggcctcgctgtccgggtatatcgcccagacccatggcgaccagggactggcgggcgacccgatcgtcgctcactttagcggcaccgcgggccagagcttcggcgtgtggaacgccggcggcgtggaactgcatctgactggcgacgccaacgactacgtcgggaaaggcatggcgggcggtctgctggccattcgtccgccggtgggctctgcgttccgcagccatgaagccagcattatcggcaacacctgcctgtacggcgcgaccggtggtcgtctgtacgccgcaggccgcgcgggcgagcgtttcgccgtgcgtaactccggcgccatcaccgtggtggaaggcatcggcgacaacggctgcgaatatatgaccggcggcatcgtctgcgtgctcggaaaaaccggcgtcaactttggcgcagggatgaccggcggctttgcctatgtcctggatgaagatggcgacttccgcaaacgcgtgaacccggagctggtggaagtgctggacgttgattctctggccatccatgaagagcacctgcgcggtttaatcaccgagcacgtacagcttaccggttcgcaacgcggcgaagagatcctcgccaactggccggccttctccgcgaagtttgcgctggttaaaccaaagtccagcgatgttaaagcactgttgggtcaccgtagtcgttccgcagctgagctgcgggtgcaggcgcagtaa

SEQ ID NO: 6517 - DNA, 336 bp, Klebsiella pneumoniae
tgtatacttggttttgtgatgagggtcacgaaacaaagacccccaacaaaaagattcgacgaggtgaacatcatgaaaatcaaaaccactgtagctgctctcagcatcctgtccgtcgtgtcgtttggcgctttcgccgctgatattatcaacagcgagcaggcccagggccgcgaggccatcggcacggtttccgtcggcgcggtagcatcttccccgatggatatgcatgaaatgctgaacaaaaaagcgcaggaagaaggggcttcttcttaccgcattattgaagcccgcactggcgaccactggcatgccactgctgagctgtataaataa

SEQ ID NO: 6518 - DNA, 279 bp, Klebsiella pneumoniae
gttcggcatggggtcaggtgggaccgccgcgctattgtcgccaggcaaattctttacaacgtgccgaactttaacctaaaaagtggtgctgatacccagagtcgaactggggacctcacccttaccaagggtgcgctctaccaactgagccatatcagcacgctaaatttgatgcctggcagttccctactctcacatggggagaccccacactaccatcggcgctacggcgtttcacttctgagttcggcatggggtcaggtgggaccaccgcgctag

SEQ ID NO: 6519 - DNA, 759 bp, Klebsiella pneumoniae
gaagctggtggcccgcgtgctggcgctgagcgcatgaggctccgcgttgcgccccttgcgctgctaaaacgtctggcattgcgtctgctgctgatcgccgccgttttctggggcggggggatcgcgctgtttagcgtgctgccggtgccgttttcggcggtgatgcttgagcggcaggtgagcgcctggctgtccggtgatttccattatctggcgcattccgactgggttgccatggataagatctccccatggatggggctggcggtgattgccgccgaagatcagaagttcccggaacactgggggttcgacgtgtcggcgattgagaaagcgctggcgcacaatgagcggcatgatacccggattcgcggagcgtcaacgctgtcgcagcagacggcgaaaaacctgtttttatgggatggccgcagctggctgcgtaaggggctggaagccgggctgactgtcgggatcgaaaccgtgtggagtaaaaagcggatcctgaccgtctacctgaatattgccgagttcggcgatgggatatttggtgtggaagcggccgcccagcgctattttcataaacccgccagtcagctgacgccgggggaagcggctctgctggccgcggtgctgccgaacccgatccgctatcgcgccgatgcgccgtcaggctatgtgcgcagtcgtcaggcctggatcttacgccagatgcgacagctgggcggggaagggttcatgcgcgagcataagctctattag

SEQ ID NO: 6520 - DNA, 1482 bp, Klebsiella pneumoniae
taccagccaggccaacttcttccagaaactggctatgcgcctgcgcgaatttggttaatcgctatggagacatataccattgctccccggcatctccgctttgccattaagcttgcatgcgcggtggtgctggcgctgtttgtcggtttccattttcagctcgaaacgccgcgctgggcggtactgacggcagcgatcgtcgccgccgggccggcctttgctgctggcggcgaaccgtactccggcgcgatccgctatcgcggtatgttgcgtattgccgggacctttattggctgtattgcggcgctggttatcatcatcctgatgatccgcgcgcctctgctgatgatgctggtctgctgtctgtgggccgggttttgtacctgggtttcgtcgctggttaaggtcgaaaactcctatgcctgggggctggccgggtacaccgcgctgattatcattattaccatccataccaatccgatgctggcgccgcagtttgctgtcgaacgctgcagcgaaattgtcatcggtattgtcagcgccatcgtcgccgatctcctgttttcgccgcgttcgattaaaaaagagatcgacctcgagctcgataacctgctgattgcacagtataagctgatgcagttatgcgtcgcgcacggtgaaaaagaggaagtggatcaagcctggggagcgctggtacgccgcactacggcgctggaaggtatgcgtagtaacctgattatggaatcctcacgctgggcaaaggcgaatcagcgcctgaaggcgatcaacaccctttcgctaacccttatcacccaggcttgcgaaacctatctgattcagaactcacgcccggaaatggtcacggacgactatcgcgagctgttcgccgagccggttgagacggtgcaggatgttcaccagcagctgaagcgcatgcgccgcttcctgacctggaaaggcgagcataataccccggtcacgatatatagctgggtgggcgccgccacgcgttacctgctgcttaagcgcggcgtggtggggaatactaaaatcagccgtatcgaggatggcgtgttgcgcggcgaaacggtggttaaagtggagtccgccgaacgtcatcacgcgatggtgaacttctggcgcacctccgtctcctgtattctcggaacgctattctggctgtggacgggctggacctcaggcagcggcgcgatggtaatgatcgccgtggttaccgcgctggcgatgcgcctgccaaacccgcgtatggtggcgatagacttcctctatggcaccctggcggcgttaccgttgggcaccttgtacttcctggtgatcatgccggcgacgcagcagagcatgctgttgctttgcatcagcctggcggcaatggcgttctttatcgggatccgaagtgcaaaaaaggcgtctcggatcgtggggggcgctggggagcaccatcaacattctggtgctggataa

SEQ ID NO: 6521 - DNA, 2712 bp, Klebsiella pneumoniae
actgtagcaggaaggaacagcatgacagatgtgactattaaagcgctggcctcagagattcagacctctgtggatcgcctgatacagcaatttgctgacgcaggcatccgcaaatcggctgatgattctgtgacctcgcaagagaaacaaactttgttgacgcacctgaaccgtgaacacggctcggcgccagacaagctgacgttacagcgtaagacgcgcagtacgttgaatattccaggtaccggtggaaagagtaaatcggtacaaatcgaagtccgcaagaaacgcacctttgtgaaacgcgatccgcaagaggctgaacgcctggccgcggaagagcaggcgcagcgtgaagcggaagagcaggcccgtcgtgaagctgaagaagcagcgaaacgcgaggcgcaattaaaagctgaacgtgaggccgcagaacaagctaaacgtgaagtcgctgataaagcgaaacgtgaagctgcggaaaaagacaaagtgagcaatcaacataccgacgaaatgaccaaaaccgcccaggctgaaaagatccgtcgcgagaacgaagccgcggaattgaagcgcaaatcggaagaagaagcacgccgcaaacttgaagaagaagcgcgccgtgtagcggaagaagcacgccgtatggctgaagaaaacgaaaaaaattggtctgaaacctcagacagcccggaagatagcagcgactatcacgtcaccacatcacagcatgctcgtcaggctgaagatgataacgatcgtgaagtcgaaggcggtcgcggccgtagccgtagcagcaaagcggctcgtccggcgaagaaaggcaacaaacacgctgaatcgaaagctgatcgtgaagaagcccgcgcggccgtgcgcggcggtaaaggcggtaagcaccgtaaaggttccgctctgcagcagggcttccagaagccagcgcaggccgttaaccgtgacgtcgtaatcggcgaaaccatcaccgttggcgaactggctaacaagatggcggtgaaaggttctcaggtcatcaaagcgatgatgaagctgggcgccatggcgaccatcaaccaggtcatcgaccaggaaaccgcacagctggttgccgaagagatgggccacaaagttatcctgcgtcgtgaaaacgaactggaagaagccgtaatgagcgaccgtgacaccggcgcggcggctgaaccgcgcgcaccggtcgtgaccattatgggtcacgttgaccacggtaaaacctcgctgctggactacattcgttctaccaaggttgcctccggcgaagcgggtggtattacccagcacatcggtgcttaccacgtcgaaaccgacaacggcatgatcaccttcctggataccccgggccacgccgcgtttacctccatgcgtgctcgtggcgcgcaggcgacggatatcgtggttctggtggtggcggcagacgacggcgtgatgccgcagactatcgaagctatccagcacgctaaagcggcgcaggtaccggtggtagtggcggtgaacaagatcgataagccagaagccgatccggatcgcgtgaagaacgaactgtcccagtacggcatcctgccggaagagtggggcggcgagagccagtttgtccacgtttccgcgaaagcgggtaccggcatcgacgacctgctggacgcgatcctgctgcaggctgaagttcttgagctgaaagcggtccgcaacggtatggcgagcggcgcggtcatcgaatccttccttgataaaggtcgtggtccggtagctaccgttctggttcgcgaaggtactctgcataagggcgacattgttctgtgcggcttcgaatatggccgtgtgcgcgcgatgcgtgacgaactgggtcgcgaagtgctggaagcgggtccgtccattccggtggaaatcctcggcctgtccggtgtgccggctgccggtgatgaagtgaccgtagtgcgtgacgagaaaaaagcgcgtgaagtggcgctgtatcgtcagggcaaattccgtgaagttaagctggcgcgtcagcagaaatctaaactggaaaacatgttcgctaacatgaccgaaggcgaagttcacgaagtgaacatcgtactgaaggcggacgtacagggttctgtcgaagcgatttccgattccttactgaaactgtctaccgacgaagtgaaagtgaagatcatcggttccggcgtaggtggtatcaccgaaaccgacgctaccctggcagcagcatccaacgcgattctggttggcttcaacgttcgtgccgatgcctctgcgcgtaaagttatcgaagcggaaagcctggatctgcgttactactccgtcatctataacctgatcgacgaagtgaaagcggcgatgagcggcatgctgtctccggaactgaaacagcagatcatcggtctggctgaagtgcgtgatgtcttcaaatcgccgaaattcggcgccatcgcgggctgtatggttaccgaagggacgatcaaacgtcacaacccaatccgcgttctgcgtgacaacgtggttatctatgaaggcgagctggaatccctgcgccgcttcaaagatgacgttaacgaagtccgtaacggcatggaatgtggtatcggcgtgaagaactacaacgacgttcgcgttggcgatatgatcgaagtgttcgaaatcatcgaaatccagcgtagcatcgattaa

SEQ ID NO: 6522 - DNA, 555 bp, Klebsiella pneumoniae
gaacctcttatgaaattcagaacaaacaaactcagccttaagattgcgctcgccggcgcgttactggccgccagcctgccggccctcgccaagacgggcgataccgatcagccgatccatatcgaatccgatcagcagtcgctggacatgcagggcaatgtcgtcaccttcaccggtaacgtggtcgtgacccaggggacgatcaagattaacgctgataaagtggtggtcacccgtccgggcaacgagaaaggcaaagaggtgatcgaaggtttcggtaacccggctactttctatcagatgcaggataacggcaagccggtaaaaggccgggcgtcgaaaatgcgctacgagctgcagaacgattacgtcgtgctgacgggcaacgcttatctggaacagctcgacagcaacatcaagggcgacaagatcacctatctggtgaaagagcaaaaaatgcaggccttcagcgacaaaggtcgacgcgtcaccaccgttctggtgccgtccgagctgcaggataaaagcggcaaccagcaaaagaagagtaactaa

SEQ ID NO: 6523 - DNA, 1425 bp, Klebsiella pneumoniae
catcaggttattcaggacatttttccatacacctcaggttacgagagccagcatctaatgaaaaaacagactttgctgttgagtgcgttagcgttaagcattgggttatcgttgtcggtcctgcctccggcagcggcatccttaccgactcaggtgcccggccagggcgcgttaccaagcctggcgccgatgctggaaaaggttctgccggcggtagttagcgtacaggtggaaggcactgcctcgccgacgctcaatatgccggaagagctgaaaaaatattttggcgataacgccccgcaggagcaggcgcagccgtttgaagggctcggctccggcgttatcatcgacgcggcgaaaggctatgtgctgaccaataaccacgtcatcaatcaggcgcagaagatcagcgtccagctgaacgatggccgtgagttcgatgccaaactggtcgggagcgatgaacagagcgatatcgctctgctgcagctgattaagccagaccacctgacgcaaatcgccattgctgactctgataaacttcgcgtcggcgacttcgccgtcgccgtcggctacccgttcggccttggccagaccgccacctccggcattatctctgcccttggccgcagcggcttgaaccttgaagggctggagaatttcattcagaccgacgcctcgattaaccgcggcaactccggcggcgcgctgctgaacctcaacggcgagcttatcgggatcaacaccgcgatcctcgcgccgggcggcggcagcatcggcatcggctttgccattccaagcaatatggcgaaaaccctcgccgaccagcttattcagtttggcgaaatcaagcgcggcctgttgggcattaaaggcatggaaatgagcgccgacatcgccaaagcgatgaatctcaacgttcagcgcggcgccttcgtcagtgaagtcctgccaaactccggctccgccaaagcggggattaaatccggggacgtcatcgtgagtctgaacggcaaaccgctgaacagtttcgccgaactgcgttcgcggatcgccaccaccgagccgggtaccaaggtcaaactgggcctgctgcgcgatggaaagccggtcgatgtcgaagtgaccctggataagagcacctcctcaaccgccagcgcggaactgattatcccggcgctgcagggggcctcgttcagcgacggccagatgaaagatggcaccaaaggagtggtgatcgataatgtggataaaggcagcgccgccgcccaggtcggtctgcataaggatgacattatcattggccttaaccggcagcgtattcactcgattgccgaactgcgcaaagcgctcgaaggcaaaccgccggtcatcgccctgaacgtgatccgcggcaacgaaagcatctatctgctgctgcgctga

SEQ ID NO: 6524 - DNA, 693 bp, Klebsiella pneumoniae
gaatatcctatattatctgcttatcgggaagtggggccttgtatggcaagaaaaacaaaagaagaggcgcagcgcacgcggcagctcctgattgagtccgcaatccagcagttcgccctgcgcggagtaaccaacaccaccctgacggatatcgccgatgcggcgggagtgactcgcggcgcggtgtactggcattttgccagtaagacggagctgtttaatgaaatgtggcagcagcagccgccgcttagagatttgattcagcccagtcaggccatagagtacgaacatgagccgctaaatgctttacgcgagcggtttattgcaggcctgcgctatattgctgcgaatcctcgacagcgtgctctgatgcaaattctttatcagcgctgtgagttttccagtgatatgctttcggaatacgaaattcgccaacgtattggttttaattattcactcattggcggcatcctgcagtgctgcgtgcgtaacaatatattgccagccgaaacaaacattgagatgatattaattgttttacacagtgctttttccgggctgattaaaaactggctgctcgatccgcaacgcttcgatctttatcagcaggcgcctgcgctggtggataatataatggcggtggtctgtgctgcgcgtttatcgggagggcctgcgctacggctggtgaattag

SEQ ID NO: 6525 - DNA, 1149 bp, Klebsiella pneumoniae
ggaaccgccatgacgactcacgccagagtgacacttttatccggtttaattatctcggccttattgctaaccggttgcgataattctgacaaccagcaaccccatgcgcaggcgccgcaggtgacggtccatgtcgtgaacagcgcgccgctatcagtcaccaccgaactgccgggccgaacctctgcttttcgcgtagcggaagtccgcccccaggtgagcggtatcattctgaagcgtaactttgttgaaggaagtgatgtcgaagcaggccagtcgctctatcagatcgatccggcgacctaccaggcggcgtggaacagcgccaaaggcgatgaggccaaagccgaagccgcggccgctatcgcccatttgacggtgaaacgctacgttccactgctgggttctaaatatatcagccagcaggaatacgatcaggcagtggccaccgcccgccaggccgatgccgatgtcatcgccaccaaagctgccgtagaaacggcccgtatcaacctggcctacaccaaagtaacctcccccattagcgggcgcatcggtaaatcgagcgtcaccgaaggggcgctggtcaccaacggccagtcggatgccctggctaccgtccagcagctcgatcccatctatgttgacgtgacggagtccagtaatgacttcatgcgccttaagcaggaaagcctgcagcgcggcggtgatactaaaagcgttgagctggtcatggagaacggccaggcctatccgctcaaaggttcactgcagttttctgacgtcactgttgatgaaagtacgggctcaattactctgcgcgctatcttccctaacccgcagcatgtcctgctgccagggatgttcgtccgcgcccgcatagacgaaggcgtcgatccgcaggctatcctggtaccgcagcaaggggtgacccgcacgccgcgtggtgatgcctccgtgatgctggtgaatgacaaaaaccaggttgaaacccgggaagtggtcgcgactcaggccgttggcgataagtggcttatcaccagtgggctgaaaccgggcgataaagtgattgtcagcggcttacagaaagtccgtccaggcgtcactgtcaaagcggaagcggagcgtacggcgccggccgtgcaataa

SEQ ID NO: 6526 - DNA, 714 bp, Klebsiella pneumoniae
ggagcagacatgtctttactcgcacaactggaccagcgtatccgtcatcatggcggattaattgtctcctgccagccggtgccgggcagtccgctggataatcccgctatcgtcgcggcaatggcgctggcggctgagcaggcgggagcggtagcgctgcgcatcgaaggcctggccaacctgcaggccgttcgtccgttagtgacggtgcccgttattgggttgatcaaacgcgatttgcccgatagcccggtgcgtattacgccatggctggaagatatcgacgcgctggcgcagggcggagcggatattattgctattgacggcacccagcgtcagcgtccggcgtcagtgtcggcgctattagcagaaattcatcagctggggaaagtggcgatggccgattgctcatctctcgacgatgccctcgagtgctggcagttgggggctgagattgtcggcacgactctctccggctataccgcagaggagacgccggatgagccggatctggcgctggtgcaatgcctgagcgcggcgggctgcagagtgattgccgaagggcgctataacacgcctgcccaggcggcggaggcgatgcgctgcggcgcgtgggcggtgaccgtcggctcggcgattacccgcctggagcatatctgcggctggtataatacggcgctgaaagcggcggtttgcccggcggatgagcaataa

SEQ ID NO: 6527 - DNA, 969 bp, Klebsiella pneumoniae
ctcatgcgcatcggacaccaccagctcagaaatcgcctgatcgcagcgcccatggctggcattactgacagaccattccggacgctgtgctacgagatgggagcgggtttaaccgtttccgagatgatgtcttctaacccacaggtgtgggagagcgacaagtcccgtttacggatggtgcatatcgatgagcccggtattcgtaccgtgcaaatcgccggtagcgtgccggaagagatggctgccgccgcgcggattaacgtggaaagcggcgcccagattattgatatcaatatgggatgcccggcgaaaaaggtgaatcgcaagcttgcaggttcagccctcttgcagtaccccgaccaggtgaagtcgatcctgacggcggtcgttaacgcggtggacgttcctgtgactctcaagattcgcaccggttgggaaccggaacaccgtaactgcgtagagattgcccaactggccgaagagtgtggcattcaggctctgactattcacggacgcacccgcgcctgtttgtttaacggagacgctgagtacgacagtattcgggcagttaagcagaaagtttccattccgattatcgcgaatggcgacattactgacccgcttaaagccagagctgtgctcgactatacaggggctgatgccctgatgataggccgtgcagctcagggaagaccctggatctttcgggaaatccagcattatctggacactggagagctgctgcccccgctgccgctggcagaggtgaagcgcttgctttgtgcgcacgttcgggagttgcatgacttttatggtcaggcaaaagggtaccgaatcgcgcgtaaacacgtctcctggtatcttcaggaacatgctccagatgaccagtttcggcgcacattcaacgccattgaggatgccagcgaacagctggaggcgttggaggcatacttcgaaaattttgcgtaa

SEQ ID NO: 6528 - DNA, 564 bp, Klebsiella pneumoniae
aggaatttaataatgaagtctattgctgcaaaaatggttgccgtaacgatcgctttgggagccagcagcgctgcctgcgcagccgttaacctgcatggagaagctggcgccgagtttaccaatctgtccgccagctttggcgccggggaaccgggtatgacgttcagttctcagtgggcccatagcgacaacgacggagatagtgtaggactgggaatgggttataactttaaccttggcccttttctgatgaccctgggcggtaaggcggtctatctgaatccaaaagatggtgatgaaggttacgccatcgccgccggtggtggcgctgaactcccccttggtcagtatttcacgcttttcggcgagggctattactcaccggactcaatgtccagcggcgttgaggattatgtggaggccaatgccggggtacgccttaacgtgcgcccatctctgaatatcgaagctggctatcgctatattgatatggcagggaaagatggcaatcgcgataacacgctggccgacggcgcttacgccggggttaacttccgcttttaa

SEQ ID NO: 6529 - DNA, 1158 bp, Klebsiella pneumoniae
actgcactaattttcaccgcagcaggtgatttttgcgccttgtcgctgctgcgtgtggttggtaaagtaagcggattttgttttccgccccagctttcaggattatcccttagtatgttaaaaaaatttcgtggcatgttttccaatgacctgtccattgacctgggtaccgcgaatacccttatttacgtaaaaggacaaggcatcgtattgaatgagccttccgtggtggccattcgtcaggatcgtgccggatcgccgaaaagcgtcgccgccgtgggtcatgaagcgaagcagatgctcggccgtaccccgggtaatatcgcggcgattcgcccgatgaaggacggcgttatcgctgacttcttcgtgacggaaaagatgctgcagcactttatcaaacaagtgcacagcaacagctttatgcgcccgagcccgcgcgtgctggtgtgtgtaccggttggcgcaacccaggtcgaacgtcgcgctattcgtgaatccgcgcagggcgcaggcgcccgtgaagtcttcctgatcgaagagccgatggcggcagcgattggcgcaggcttaccggtttctgaagcgaccggctccatggtggtggatatcggtggcggtaccactgaggtggcggttatctccctgaacggcgtggtctattcctcttctgtacgtatcggcggtgaccgcttcgacgaagccgttatcaattacgtgcgtcgtaactacggctccctgatcggtgaagcgaccgctgaacgtatcaagcatgaaatcggttcggcttacccgggcgatgaagtgcgcgaaattgaagtgcgcggtcgtaacctggcggaaggcgtgccacgcggcttcaccctgaactcaaacgaaattcttgaagcgctgcaggagcctctgaccggcatcgtgagtgcggtcatggttgcccttgagcagtgcccgccggaactggcgtctgatatctctgaacgcgggatggttctcaccggcggtggtgcgctgctgcgcaacctggaccgtctgttaatggaagaaaccggtattccagtcgtggttgctgaagatccgctgacctgcgtagcgcgtggcggcggcaaggcgctggagatgatcgacatgcacggcggcgacctgtttagcgaagagtag

SEQ ID NO: 6530 - DNA, 411 bp, Klebsiella pneumoniae
agtgacacaatgaacaagatcgggttgcttatcgtcgccggcgtgctcggtttagctgggtgcagttcaacatcgccctcccaaacggtggagacgattaatgcgctaaccgtaccggtatcgcctagtgagtctgggactacagcgaatcatgcccaggcggtgaggcgctatttccaggacaatacggcactgattagtcgccttaaccattcgttgaaaagtcattatctgcaggacgtggagcgccgcgatgtgttcgacagacacagcgaggcgtataaagtgtatggcgccctgacccgcctggagcagatggcgtccatgaatgaggtttaccgcaaagagaataatgttgcgggcctacaagagatcaaccgcgtactgaaaagcgtgccgctgaccagctga

SEQ ID NO: 6531 - DNA, 1296 bp, Klebsiella pneumoniae
acgccggaaatcgactatcacagccagcaaatggcgctcccggccagtacgcaaaaggtcatctccgcgctggcggcgctgctgcaactggggcccgattttcgctttaccaccacgctggaaaccaaaggttcccttgacggcggcgtgctgaaaggcgacctgattgcacgcttcggcggcgatccgacgcttaaacggcaggatattcgcaatatggtggcgacgctgaaaaaagccggcgtgcagcgtatcgaaggcaatgtgctcatcgatacgtcggtcttcgccagccatgacaaagcgcccggctggccgtggaacgacctgacgcagtgcttcagcgccccgccggcggcggcgattgtcgaccgtaactgcttctctgtctcgctgtatagcgcgcagaaaccgggcgatgtcgccttcattcgcgttgcatcctattatccggtcaccatgttcagccaggtgcgaacgctggcgcgtggctcatcggaagcgcagtattgcgagctcgacgtggtgccgggcgatctcaatcgctatactctcaccggctgcctgccgcagcgtagcgagccgctgcctctggccttcgccattcaggatggcgccagctacgccggagcgatcctcaaagcggagctggcccaggcggggatcacctacagcggcacgctgctgcgccagacgctggccaatgagcccggcaccgtgctggcaaccagccagtcggctccgctgcacgatctgctgcggatcatgctgaagaagtcagacaacatgattgccgacaccgtctttcgcaccatcggccacgcccggttcggcgtacctggcacctggcgggcgggctccgatgccgtacggcagatcctgcgtcaacaggctggggtcgatctcggcaatactatcatcgccgacggctctggcctgtcgcgccacaacctgatcgccccggcgaccatgatgcaggtgctgcagtatatcgcccagcacgataccgagctcaacttcatctccatgctgccgctggcgggccatgacggatcgctgcagtatcgcgccggtcttcatcaggcgggcgtcgatggtaaagtttcggcgaaaaccgggtcgctccagggggtttataacctcgcaggcttcatcactaccgccagcggacaaaagatggccttcgtgcaatatctctccggctacgccgtggagccagctgatcagcgcaatcgccgcatcccactggtccgctttgaaagccgcttgtataaagatttgtaccagaacaattaa

SEQ ID NO: 6532 - DNA, 570 bp, Klebsiella pneumoniae
tgtttgggaattgagttcatgcaaacgaaaaaaactgaaatctgggtaggggtgttcttactggtggcgctgctggcggcgctgtttgtctgcctgaaggcggcgaacgtcacctcgctacgcaccgagccgacttatcgcctttatgcgactttcgataacatcggcggcctgaaggcgcgttcgccggtgcgcatcggcggcgtggtagtggggcgggtagcggacattacgctcgatccgaaaacctatctgccacgcgtggagctcgatatcgatgagcgctacaaccatatcccggataccagttcgttggcgatccgcacctctggcctgctgggcgagcagtacctggcgctgaacgtcggttttgaagacccggacctcgggacgactatccttaaagacggcggcactatccaggacaccaagtccgccatggtgctggaagatctgattggtcagttcctttataacagtaagggcggcgacaatcagaattctggcaatgataaggccgaggcagaaggtcatactgacgcgacgccggcagccggcacgacgcattaa

SEQ ID NO: 6533 - DNA, 666 bp, Klebsiella pneumoniae
cctcaattgattaattcatatctggtgatacacatcatgaatattaaaccgccgatcaggccgcaaaagaccattgaccgactgatcgatgtacttgagccacacgcgacacccgttaacgcgatcgccagaaaaagactgacatgggaatataaaggcaaaacccagctctttatttttaaaaaaggcgagctgtcgattattcgtaattccgacaggctactgatggtgaccgtctatgagccgcatcttttcggcgtggcggaaatgctgcagcccagccgcagccacagcctgcgagccgaggtatcatgcgaactgctacggatcgactatgacctggcttcggcgctttttcgtcagcataacctgtgggaagaggtgaccagcctgttggcttatcatacctcgtatatggtgtatcgtgacgatctggtcctgcagcagcgtacctattcggtcatccgtaaccatttgctggagatgatgctattaagcgaagagacccgacagcgagtatctattcttgagtatattcaggacaggacccttctgtcgcgtagcagtattctcaatgtattgtcagcattaaagaaaggcggttatattacctttgcccgcggcggttatttacaaaatatcgtctcacttcctgaaaaattctga

SEQ ID NO: 6534 - DNA, 183 bp, Klebsiella pneumoniae
tgttacctgatgcttagaggcttttcctggaagcagggcatttgttacttcagcaccgtagtgcctcgtcatcacacctcagccttgattatccggatttgcctggataaccagcctacatgcttaaaccgggacaaccgtcgcccggctaacatagccttctccgtccccccttcgcagtaa

SEQ ID NO: 6535 - DNA, 342 bp, Klebsiella pneumoniae
ctaaacgttttcagaaacgcccgtacccgaagtcctgggaaacgaaaaacgggcgggggggtcgggcaactttgttcaatggggccaaggggggtggcccgttttggtctctctctggttcgcgccatgcagggggaaaaaggcgtggtggagtgcgcctacgtggaaggcgacggccactatgcgcgtttcttctcccagccgctgctgctggggaaaaacggcgtggaagagcgacagtctatcggcaaactcagcgcctttgaacagcaggcgctggagggcatgctggacaccctgaagaaagatatcgcgctcggcgaagacttcgtcaacaagtaa

SEQ ID NO: 6536 - DNA, 1497 bp, Klebsiella pneumoniae
aaggccccgatgaacaaagaaattttggctgttgttgaagccgtttccaacgaaaaagcgctgccgcgtgagaaaattttcgaagcgctggaaagcgcgctggcaacggccaccaagaaaaaatacgaacaagagatcgacgttcgcgttgaaatcgaccgcaagagcggcgatttcgataccttccgtcgttggctggttgtagaagaagtcacccagccgacgcgcgagatcacgctggaagcagcgcgtttcgaagatgaaagcatgaacgtcggcgactatgtcgaagatcagatcgaatctgttaccttcgaccgtatcaccacccagaccgctaagcaggttatcgtgcagaaagtccgcgaagccgagcgcgcgatggtggtcgatcagttccgcgagcacgaaggtgagatcatcaccggcgtggtgaaaaaagtgaaccgcgacaatatcacactggatctgggtaacaacgctgaagccgtgatcctgcgtgaagatatgctgccgcgtgaaaacttccgtccgggcgaccgcattcgcggcgtactgtacgctgtccgtccggaagcgcgtggcgcccagctgttcgtcacccgttccaaacctgagatgctgatcgaactgttccgcatcgaagtgccggaaatcggtgaagaagtgctggagatcaaagcggcggctcgcgatccgggctctcgtgccaaaatcgcggtgaaaaccaacgacaagcgcatcgacccggttggcgcttgcgtcggtatgcgcggtgcgcgtgtgcaggccgtgtcgactgagctggggggtgaacgcatcgatatcgtcctgtgggatgataacccggcgcagttcgtgattaacgctatggcgccggcagacgtcgcgtccatcgtggtggatgaagataaacacaccatggatatcgcggtagaagcgggcaacctggcgcaggcgatcggccgtaacggtcagaacgtccgcctggcttcacagctcagcggctgggaactcaacgtcatgaccgttgacgatctgcaggctaagcaccaggcggaagcgcatgccgctatcgataccttcaccaaatatcttgatattgatgaagatttcgcgacagtgctggttgaagaaggcttctcctcgctggaagagctggcctatgtgccgatgaaagaactgctggaaatcgacggtctggatgaagccaccgttgaagcacttcgtgagcgtgcgaaaaacgcactgactacgctggcgctggctcaggaagaaagcctgggagataacaaacctgccgatgatctgttgaatctcgaaggtctggatcgtgccctggcattcaaactggctgcccgtggtgtttgtacgctggaagatctcgccgagcagggcgttgatgacctggctgatatcgaagggatgaccgacgagaaagctggcgagctcatcatggccgctcgcaacatttgttggttcggcgacgaagcgtaa

SEQ ID NO: 6537 - DNA, 1455 bp, Klebsiella pneumoniae
attttcacgatgagttatgtagactggccgccattaattttgaggcacacgtactacatggctgaattcgaaaccacttttgcagatctgggcctgaaggctcctatccttgaagcgctcaccgatctgggttacgaaaaaccatctccgatccaggctgagtgcattccgcatctgctggacggccgcgacgttctgggtatggcccagaccggtagcggtaaaaccgcggcattctctttaccgctgctgaacaacatcgatcctgagctgagagcaccgcagattctggtgctggcgccgacccgcgagctggcggtacaggttgctgaagcaatgacggaattctctaaacatatgcgcggcgtgaacgtggttgccctgtacggcggccagcgttatgacgtgcagctgcgcgccctgcgtcagggtccgcagatcgtcgtcggtaccccgggtcgtctgctggaccacctgaagcgcggcaccctggacctctccaaactgagcggcctggtactggatgaagcagatgaaatgctgcgcatgggctttatcgaagacgtagaaaccattatggcgcagatcccggaagggcatcagaccgcgctgttctccgccaccatgccggaagctatccgtcgcattacccgtcgctttatgaaagagccgcaggaagtgcgcattcagtccagcgtgacgactcgcccggatatcagccagagctactggactgcctacggcatgcgtaaaaacgaagcgctggtgcgtttcctggaagcggaagactttgatgcggcgattatcttcgtccgtaccaaaaacgcgaccctggaagtagctgaagcgctggagcgtaatggctacaacagcgcggcgctgaacggcgacatgaaccaggcgctgcgtgagcagactctggaacgcctgaaagatggtcgtctggatatcctgattgcgactgacgttgcggcccgtggcctggacgttgagcgtatcagcctggtggtgaactacgacatcccaatggattctgaatcctacgttcaccgtatcggccgtactggtcgtgccggtcgtgctggccgcgcgctgctgttcgttgagaaccgcgagcgtcgtctgctgcgcaacatcgaacgcactatgaagctgaccattcctgaagtggaactgcctaacgcggagctgctgagcaagcgtcgtctggaaaaattcgccgcgaaagttcagcagcagctggaaagcagcgatctggatcagtaccgtgcactgctggcgaaaatccagccgacggcggaaggtgaagagctggacgtggaaacgctggctgctgcgctgctgaagatggctcagggcgaacgttcgctgatcgttccgccggacgcgccgatgcgtccacgtcgtgaattccgcgatcgtgacgatcggttcgaccggtcgtggcgaccgtaa

SEQ ID NO: 6538 - DNA, 1482 bp, Klebsiella pneumoniae
ttttccgcgatatttctctggaggacgatgatgcagtttgaggtcattattcccctgatcgcctacctggtggtggtgttcggtttatccctctacgccatgagaaaacgcgcctcaggtagctttcttaatgagtactttctcggcagccgctcgatgggcggcttcgtgctggccatgacgctaaccgccacctatatcagcgccagctcatttatcggcggacccggcgccgcctataaatacggcctgggctgggtgctgctggcgatgatccagctccccgccatctggctgtcgctgggcgtgctggggaaaaaattcgccatccttgcgcgccgctataatgctgtcaccctcaatgacatgctgtttgctcgctatcagagtcgcctgctggtctggctggccagcctgagtctgctggtggcctttgtcggcgccatgaccgtccagtttatcggcggcgcccgcctgctggagacggctgccggtattccttacgataccggcctgctgatcttcggggtcagcatcgcgctgtataccgcctatggcggctttcgcgccagcgtgctcaacgacacgatgcagggcatggtaatgctgatcggcacgatcgtgctgctggtaggcgtgatccacgccgccgggggggttggccatgcggtagagacgctgcagtcgatcgacgtcaagctggtgtccccgcagggcgcggaagatatcctctcgccaacctttatggcctcgttttgggtgctggtctgcttcggcgttattggtctgccacacaccgcagtgcgctgtatctcctacaaagacagcaaagccgtgcatcgcggcatcattatcggcaccatcgtggtggcgatcctgatgtttggcatgcatctggctggggcattaggccgggcggtgatccccgatttaaccgtgccggatctggtgatcccgacgctgatggttaaagtgcttccgccctttgccgccgggatcttccttgccgcgccgatggcggcgattatgtcgacgatcaatgcccaacttctgcaaagttccgctacgatcatcaaagatctgtacctgaactggcggccggatcaggcgactaacgaaaagcggcttaaacgcatgtccgccggcatcacgctcctgctgggggtcttgttgctgctcgcggcctggcggccgccggagatgataatctggctgaacctgctggccttcggcggcctggaagccgtcttcctgtggccgctggtgctgggcctttactgggaacgcgccaacgcagctggcgcgctgagcgcgatgatcgtaggcggcgtcctgtatgccgttctggccacgctgaaagtgcagtttctgggctttcacccgatcgttcccgcgctgctgctgagtttgctggcgtttgtggcggggaaccgtttcggtcgtcccgccccacagtcccccattttgactactgataaataa

SEQ ID NO: 6539 - DNA, 1428 bp, Klebsiella pneumoniae
ggggttaagatgagtcagaacgtttatcaatttatcgacctgcagcgcgttgatccgccaaagaaaccgctgaagatccgtaaaattgagtttgtggaaatttacgagccgttttcagaaggccaggccaaggcgcaggcggatcgctgcctctcctgtggcaacccgtactgcgaatggaagtgccctgtgcataactacatcccgaactggctgaagctggccaacgaggggcgtatttttgaagcggccgagctgtcgcatcaaaccaacactctgccggaagtctgcgggcgcgtctgcccgcaggaccgcctgtgtgaaggctcctgtacgctgaacgatgagttcggcgcggtgaccatcggcaacatcgaacgctatatcaacgataaggcattcgagatgggctggcgtccggatctctccgacgtgaagccgaccggtaaaaccgtcgcgatcatcggcgctggcccggcgggcctcgcctgcgccgacgtgctgacccgtaacggcgtcaaggcggtggtatttgaccgccatccggaaatcggcggcctgctgaccttcggtatcccggcgttcaagctggaaaaagaggtgatgacccgccgccgggagatcttcaccggcatgggcattgagttcaaactcaataccgaagtgggccgcgacgtgcagctcgatgacctgctgaaggagtacgatgcggtgttcctcggcgtcgggacctatcagtcgatgcgcggtggactggacaacgaagacgccccgggtgtttacgacgcgctgccgttcctgatcgctaacactaagcagatcatgggctttggtgaaaccgccgatgagccctatgtcagcatggaaggcaaacgcgtggtggtgctcggcggtggcgacaccgcgatggactgcgtacgcacctccgtccgtcagaatgcggcgcacgtgatctgcgcctatcgccgtgacgaagagaacatgcccggctcaaaacgcgaagtgaaaaacgcgcgcgaagaaggcgttgagttccagtttaacgtccagccgctgggcgtggaagtgaatgccaacggtaaggtttgcggcgtgaagatggcgcgcaccgaaatgggccagccggatgcgaagggccgccgccgcgcggagatcgtccccggctctgagcacgtggtgccggctgacgccgtagtcatggcgtttggcttccgtccgcacagcatggagtggctggcgaagcacagcgtcgaactggactcccagggccgtattatcgccccggaaggcagcgaaaacgccttccagaccagcaacccgaaaatcttcgccggtggcgatatcgttcgcggttccgatctggtggtcaccgcgattgccgaaggtcgtaaagcggcggacgggatcctcaactaccttgaagtctga

SEQ ID NO: 6540 - DNA, 1485 bp, Klebsiella pneumoniae
aggaaagggataaagatgacggctgaattattagttaacgtaacgccatccgaaacgcgcgttgcgtatattgatggcggtattctgcaggaaatccatattgagcgtgaagcgcgacgcggaatagtaggcaatatctacaaaggtcgtgttagccgagtgctgccgggaatgcaggcggcttttgtagatattggtctggataaggcggcgttccttcacgcctccgatatcatgccgcataccgagtgcgtcgccggtgaggagcaaaagcagtttaccgtgcgcgatatttcggagctggtgcgccagggccaggacctgatggtccaggtggttaaagatccgctgggtaccaaaggcgcgcgtctgaccaccgatattaccctgccttcccgctatctggtctttatgccaggcgcctcccacgtgggggtctctcagcggattgaaagcgaagccgagcgcgagcgcctaaaaaaggtcgtcgcagaatattgcgatgagcagggcgggtttatcattcgcaccgctgcggaaggcgttcacgagcaggagatggccgccgatgccgcttatcttaagcgcgtatggaccaaggtgatggagcgcaaaaagcgcaaccagacccgctatcagctgtatggcgagctggctcttgcccaacgcgtgctgcgtgattttgccgatgcgcaactggatcgcattcgcgtcgactcgcgcctgacctatgaggcgttgctcgaattcaccgccgaatatatcccggaaatgaccagcaagctggaacactacagcggccgtcagccgatattcgatctctttgacgttgagaacgaaattcagcgcgcgctggagcgtaaagtcgagctcaaatcggggggctatctgatcatcgaccagaccgaggcgatgaccaccatcgatatcaacaccggggcctttgtcgggcaccgcaatcttgacgatacgatcttcaataccaacatcgaagccacccaggcgatagcccgccagctacgtttgcgtaatctcggcggcattatcatcattgatttcatagacatgaacaatgaagatcaccgtcgacgggtgttgcactctttagagcaggcgctgagtaaagatcgggtgaagaccagcattaacggcttctcccagctgggcctggtggagatgacccgtaaacgcacccgtgaaagcgtggagcatgtgctgtgcaacgagtgcccaacctgccacggacgtggaacggtaaagtcggtggaaacggtgtgctatgagattatgcgtgagatcgtccgcgtacatcatgcttatgattccgatcgcttcctggtctatgcttcccctgcggtggcggaaaccctgaaaggggaagagtcgcatgcgctggcggaagtggaaatctttgtcggcaagcaggtgaaggtacaaattgagccgctctataatcaagagcagttcgatgtggttatgatgtaa

SEQ ID NO: 6541 - DNA, 942 bp, Klebsiella pneumoniae
gctaccgctgttgatgcttgtttaaccttaaaaccccgggcgtccgctccggggtttttcttttttaacctcttcagtctcagggattttgtgatgaaacttgtagcccagggctcaaccctcgatctctctcacccccacgtgatgggtattctaaatgtgacgcctgactcattctccgatggcggcgcccataattcgctgattgaggcggtgaagcatgccaatctgatgatcaacgccggcgcgaccatcattgatatcggcggtgaatcgacgcggccaggggcggctgaagttagtgtggaagaagagcttgcgcgggtgataccggtggttgaagccattgcccagcgctttgaggtatggatctcagtggatacctccaaggcggaagttattcgccaatcggccagggccggggcgcatatcatcaacgatattcgttcgctgaccgagcccggcgcgctgcaggccgccgcggaaactggactgccggtgtgtctgatgcatatgcagggacaaccaaaaaccatgcaggaggcgccgaagtatgaggacgtcttcgccgatgtagagcgtttttttaatgagcacattgtgcgctgcgaacaggcggggatcgcaaaagaaaaattgctgctcgacccgggattcggtttcggtaaaaatctctcccacaattaccaactgttggcaaggcttggggagtttcatcactttggtctgccgctgctggtcggtatgtcacgtaagtcgatggtaggtcagttgctgaacgtcgggccgtcggagcggctgaacggcagcctggcgtgtgccgtcattgcagcaatgcagggcgcgcagattatccgcgtccatgatgtcaaagaaacggtagaagcgctgcgcgtggtggaagccaccctcgccgctaagggaaaaaaacgttatgagtaa

SEQ ID NO: 6542 - DNA, 471 bp, Klebsiella pneumoniae; identical to SEQ ID NO: 1445

SEQ ID NO: 6543 - DNA, 498 bp, Klebsiella pneumoniae
ataatggatgtatcacagctgacgccgcgtcgcccgtatctgttacgggcgttttatgactggctgctggataaccagctgacgccgcacctggtggtggatgtgacgctgccgggcgtgctcgtgccgatggagtacgcgcgcgatgggcaaatcgttctcaatattgccccgcgtgcggtaggcaatctcgagctggcgaacgacgaagtgcgcttcaacgcgcgctttggcggggtaccacgcaacgtgtctgtcccgctggctgcggtactcgccatctacgcccgtgagaacggcgctggtacgatgttcgaaccggaagcggcctatgacgaagacgtcagcagcctcaacgatgatgacgtcgcgccggagagtgaaagcgaaacggtgatgtcggtgatcgatggcgataagccggataatcacgacgacgatcctgacgacacgccgccgccgcgcggtggtcgcccggcgctgcgcgtggtgaagtaa

SEQ ID NO: 6544 - DNA, 276 bp, Klebsiella pneumoniae
atcatgaccgtaaagcagaccgttgaaatcaccaataagctgggcatgcacgcccgcccggcgatgaagctgttcgaactgatgcagaatttcgatgccgaagtactgctgcgcaacgatgaaggcacggaggcggaagccaacagcgtgattgccctgctgatgctggactcggcgaaagggcgacagatagaggtggaggccagcggtccgcaggaagttgaagccctcgccgcggtgattgccctgtttaacgctggctttgacgaagactaa

SEQ ID NO: 6545 - DNA, 1059 bp, Klebsiella pneumoniae
gtttttcgcgtcccggtaacggatgaaagccccgcaacacgttgcggggctttttacattcgtctaccggaaaatttttgcagggaaacaggcatgaagcagcaggctgggattggcattattctggcgcttaccaccgcgatgtgttggggagcgttgccgattgcaatgaaacaggttctcgaggtgatggcgccgcctacggtggtcttttatcgcttactgatggccagcattgggcttggcgcgatcctggcgatcaaaggcaaactgccgccgatgcgaatttttcgcaagccgcgctggctggtgttattagcgattgccgccggcggtctgttcggtaacttcatcctgtttagttcttacctgcaatacctcagccccacggcttctcaggtcatcggccagctatcgccggtggggatgatggtggctagcgtcgtaattctgaaagagcgcatgcgcggcacccaggtggtgggcgcgttgatgctgctcagcgggctggtgatgttcttcaataccagtctgattgaaatctttacccgcctgacggactacacgtggggggtaattttcggcgttgctgccgctacggtgtgggtaagctacggcgtcgcgcaaaaggtgttattgcgccgtctggcatcacagcagatactatttttgctgtacactttgtgtacgattgcattactgccgcttgctgagcccggagtgatttcccggttaagcagttggcaattggcatgcctgattttttgcgggctgaataccctggtcggctacggggcgctggcggaagccatggcgcgctggcaggcggcgcaggtcagcgcgttaatcaccttgacgccactgtttacgctactgttttctgatttattatcaatggcctggcccgatgttttcgccagaccgatgttaaacctgattggttatctcggtgcgtttgtcgtggttgcgggcgcgatgtattccgccatcggtcatcgtctttggggacgttggcgtaagcgagaggcggtagtaccgctgccccgctcaggcgaatga

SEQ ID NO: 6546 - DNA, 702 bp, Klebsiella pneumoniae
tcgacatttttgactggtttcagcgagttgcatggaggagcgaaagcgatgaaaaaaattggtgtggtactgggcggctgcggcgtgtacgacggcagtgaaatccatgaggcggtgattaccctgctggcgatcgcgcgcaacggcgcgcaggcagtgtgctttgcgcccgataaaccgcagcgcgatgtcatcaaccatctgaccggggaggcgatgccagagcagcgcaatgtgctggtggaagcagcgcgtatcgcccgcggcgacatcctgccgctggtgcaggcgcgtgcggagacgctggacgcgctgatcgtccctggcggcttcggcgcggcgaaaaatctaagcagcttcgccgccgagggcagcgaatgccaggtggatcccgatctgcgggccctggcgctggcgatgcatcagaccggcaagccgctgggctttatgtgcattgccccggcgatgctgccgaagatctttgcgtttccgctgcggataaccattgggaccgatcttgataccgccgatgtggtggaagagatgggggcagagcacgtgccttgcccggtcgacgacatcgtggtggatgaagacaacaaagtggtcaccactccggcgtatatgctggcggaggacattgcgcaagccgccaccggaattgagaagctggtggcccgcgtgctggcgctgagcgcatga

SEQ ID NO: 6547 - DNA, 903 bp, Klebsiella pneumoniae
cctgtgcaggtaagattctgtaaaaatgttgtgattgtggcgcaagaaagggccatgcttgcccgtcaggtgtttagtaaggatgattttatgagccaaactcaggcgaatttagttgaagtgcgcggtatccgcttttcacgcggcgatcgtgtgatcttcgacgacatctcgctgtcggtgccgcgcggtaaaattactgcgatcatgggaccttcggggatcggcaagactaccctgttacgcctgatcggcggccagatcccgccggacaggggagagatcctgtttgatggcgagaacgtgccgcagatgacgcgttcgcgtctttatacggtgcgtaagcggatgagcatgctgttccagtccggcgcgctgttcaccgatctcaatgtctttgacaacgttgcctatccgctgcgcgaacatacgcatttgccgcctgcgctgctgcatacgacggtgatgatgaagctggaagcggtggggctacgcggtgcggcgaagttaatgccttctgagctttccggtgggatggcgcgccgcgccgccctggcgagagccattgccctggagccggatctgattatgttcgacgaaccgttcgtcgggcaggatcccatcactatgggcgtgctggtgaagctgatttctgaactcaacagcacgctgggtgtcacttgcatcgtggtttcgcacgatgtgcccgaggtgcttagtattgcggactacgcgtatatcgtggcggataaaaagattgtcgcccacggtagcgcccagtcgctacgggagaataccgatcctcgggttcgtcagttcattgatggtattgccgacggtccggtaccgttccgttatcctgctggcgactatcaccatgatttattaggcatagggagttga

SEQ ID NO: 6548 - DNA, 3063 bp, Klebsiella pneumoniae
accgcgcaggtgctcttcatggatggccagagaatcaacgtccagcacttccaccagctccgggttcacgcgtttgcggaagtcgccatcttcatccaggacataggcaaagccgccggtcatccctgcgccaaagttgacgccggtttttccgagcacgcagacgatgccgccggtcatatattcgcagccgttgtcgccgatgccttccaccacggtgatggcgccggagttacgcacggcgaaacgctcgcccgcgcggcctgcggcgtacagacgaccaccggtcgcgccgtacaggcaggtgttgccgataatgctggcttcatggctgcggaacgcagagcccaccggcggacgaatggccagcagaccgcccgccatgcctttcccgacgtagtcgttggcgtcgccagtcagatgcagttccacgccgccggcgttccacacgccgaagctctggcccgcggtgccgctaaagtgagcgacgatcgggtcgcccgccagtccctggtcgccatgggtctgggcgatatacccggacagcgaggcccccacggagcggtcggtgttacggatatcaaaccagaacgtcttgctctgcttttcatccacgtacggtttcgcctgctgcagcagctgggcgttgagcacgccgttatcgaacggtgggttgttctcggtgcagtacagcgctttgcccggatgcggctctgcggtctccagcagtttacccagatccagtttctgctgcttggcggtgaacccatccagctctttgagcagatcggtgcggccaatcagatccaccagacgcttgacgcccagctgggccatcagctcgcgggtctcacgggcgataaattcaaagtagttggtcactttgaacggcagaccgtgatagtgattcttacgcagtttgtcatcctgggtcgccacgccggtagcgcagttgttcaggtggcaaatacgcaggtatttacagcccagcgcgaccatcgggccggtaccgaaaccgaagctctccgcgccgaggatcgccgctttgatgatatcaagaccggttttcaggccgccatccacctgcagacggatcttatgacgcagaccgttggcaaccagcgcctgctgggtttccaccaggccgagctcccacggacagccggcatatttcaccgaagagagcgggctcgccccggtgccgccgtcgtagccggcgatggtgatcaggtcggcataggctttggccacgccggtggcgatggtgccaacgcccggctcagaaaccagtttgaccgaaatcatcgctttcggattgacctgcttgaggtcgaaaatcagctgcgccagatcctcgatagagtagatatcgtggtgcggcggcggggaaatcagcgtgacgcccggtaccgaatagcgcagtttggcgatgtacggggtgactttatcacccggcagctggccaccttcacccggtttcgccccctgggcgactttgatctggatgacgtcggcattgaccaggtaggctggcgtgacgccgaagcggccggaagcgacctgcttgatgcgcgacactttattagtgccgtagcgcgccgggtcttcaccgccttcaccggagttggagaagccgccgatgctgttcatcgcttccgccagcgactcgtgcgcttccgggctcagggcgccgatcgacatcgccgcggtatcgaagcgtttaaacagctccttcgccggctctacttcgtcgatgctgatggcgtcttcgcctgggttgagcgccagcaggtcgcgcagcgtggccgctggacgttcgttaaccagtttcgcgtattgttgataatcgctgtattcgccgctctgcacggcctgctgcagggtgcgcaccacgtccgggttgtaggcatgatattcgccgccgtgcacatatttcagcaaaccgccctgggccagtggcttacgcgccagccaggcgcgtttcgacagattcagcagatcctgctggaagtcgtcgaagctggcgccgccgatgcggctgaccacgccctggaagcagagctcggagacatcgcgatgcagaccgaccgcttcgaacagcttcgagcagcggtaggaggcgatggtcgagatccccatcttggacatgatcttatacagacctttattgataccgttgcgatagttcagcatcaccgcacggtacggtttatcgatggctttgctgtcgaccagcttcgccagcgtttcgtaggcgaggtatggatagatagccgtcgccccaaagccgagcagcacggcgaagtggtgcggatcgcgggcgctggcggtttcaacgatgatgttggcatcgcagcgcaggcttttatcgaccagacgggtctggatcgcgccaacggccatcggcgccggtaccggcagacggtctttggcgatgttgcggtcagagagcaccagcagcacggtgccgtcgcgcaccatttgctccgctttatcgcacagcgctttcaccgtctcgctgagggaggcctctgccgggttgaacgtgatatcgaggacgtcggcgcgatagtgctcttcttccatcgtcgtcagctgtttaaaatcggagtacagcaggatcggcgatttgaagctcagacgatgcgcctggccttccgcttcgcagaagacgttcatttcgcggccgatgctggtagccagcgacatgacgtgcgcttcgcgcagcgggtcgatcggcgggttagtcacctgggcgaactgctgacggaagtaatcgtagataatgcgcggctggctggagagcacggcgaaaggcgtgtcatcgcccatcgaaccgactgcttcctggccattttcgccgagcacgcgcaggacggagtccagctcttccgcgctgtagttaaactgtttctggtagctggcgagcgtgtcgtcatccagctggcgactgccaacctcttcgtccggcagatcttcgaacggcaccaggcgacgaacgtttttctccatccactctttatacgggtggcggctcttcagatcgtcatcggtttccgctga

SEQ ID NO: 6549 - DNA, 1083 bp, Klebsiella pneumoniae
gttgagcaggtgaagacaatgcagatgacaatgcgctggtttggaccagaggaagacaagatttcattagaacatattcgccaggtgcctggcgttgagggggtggtcggcgcgctctacgacgtcgcggtgggcgaagtatggccggtggataaaattgagcgtctggtcggtcaggcccatgccgcaggcctgaaaatggaggtgatagagagcgtcaacatccatgacgacatcaaaatcggcctacctacccgtgaccgctatattgccaactaccagcagaccatccgcaaccttgcccgctttggcgttaaagtcatctgctataacttcatgccggttttcgactggatgaagacggatatgaactacgtcctgccggatggctcgctgacgatggcgtttgagaagaaagatatcgataagcggctggaagacgtggtgaaggaggtgcttgagaattcaaacggcttcgccttgccgggctgggagccggaacggctggcggaggtgcagaccctgtttgccaaatatagcgcggtggatgatcagaagctgcgggagaacctggtttattttctgcaggcggtgatcccggtttgcgaagaggttggggtgaaaatggcgatccacccggacgacccgccgtactccatttttggcctgccgcgggtggtcaaaaaccgcgacgatctggactggatctgccgggccgtcgattcacccgccaacggcattacgctctgcaccggctcgattgccgaagatcctgataatgacgtgtacgccatcctggccgaatttacccggcgtaagcgaattcattttgcccacgtccgcaatataaagctgatgcaggataaagacttttacgagtgcgcccatccgtcagagtacggctccctggatatgtacaaagtgatgcaagcgctgtatgacaacggattcgacggctatattcgcccggatcatggtcgctttatctggggagagaccggacggccgggctatggcctgttcgaccgcgccctcggcgtgacctacctgaaaggactctgggaggcgttaagcaagcgttaa

SEQ ID NO: 6550 - DNA, 1392 bp, Klebsiella pneumoniae
ggttgttgggtcgaactcaccacagtctatcgagcagggttttattttatgacgacgattctcaagcatctcccggttggtcaacgtattggtatcgctttctctggtggactggataccagcgccgcgctgttatggatgcgcaaaaaaggcgccgtgccttatgcatataccgctaacctgggtcaaccggacgaagacgactacgatgctatcccgcgccgcgcgaaagagtacggcgctgaaggcgcccgtctgatcgactgccgcaaacagctggtcgcagaagggatcgccgcgattcagtgtggcgctttccataacaccaccggtgggttgacctacttcaacaccacgccgctaggccgcgcggtcaccggcaccatgctggtggcggcgatgaaagaagacggcgttaacatttggggcgatggcagcacctataaaggcaacgatatcgaacgtttctatcgttacggcctgctgaccaacgctgaactgcagatttacaaaccgtggctggacagcgactttatcaatgagctcggcggtcgtcacgaaatgtccgaatttatgatcgcctgcggctttgattacaagatgtcggtcgagaaagcctactccaccgactccaatatgctcggcgcgacccatgaagcgaaagatctcgaattcctgaactccagcgtcaagatcgtcaacccgattatgggcgtgaagttctgggacgaaaacgtgaagatccctgcggaagaggtcaccgtacgctttgagcagggccatccggtggcgctgaatggtaaaacctttgccgatgacgtcgagatgatgctggaagccaaccgcatcggcggtcgtcacggcctgggcatgagcgaccagattgaaaaccggattatcgaagcgaaaagccgcggcatttatgaagctccggggatggcgctgctgcatattgcctacgagcgtttgctgaccggtatccataacgaagatacgattgagcaatatcacgcccacggtcgccagttgggccgcctgctgtatcagggccgctggtttgattcccaggcgctgatgctgcgtgattcgctgcagcgctgggtcgccagccagatcaccggcgaagtcaccctcgaactgcgtcgcggtaacgactactcgatccttaatacggtatcagacaacctgacctataaagcggagcgtctgaccatggaaaaaggcgattccatgtttactgccgaagaccgtatcggccagctgaccatgcgtaatctggacatcaccgatacccgcgagaagctgttcggctatgcacagtctggcctgctgagcgcctcctcggcaaccggtttaccgcaggttgaaaatctggaaaacaaaggcaaataa

SEQ ID NO: 6551 - DNA, 1455 bp, Klebsiella pneumoniae
  unsure (873): Identity of nucleotide at the above locations are unknown.
ccggagatatttaccctgaacatgaagcaaggtttgcaattaaggcttagccaacagcttgccatgacgccgcagctgcagcaggcgattcgtttgctgcagttgtccacgttagaactccagcaagagctccagcaagcgctggaaagtaacccgttgcttgagcaaaccgatcttcacgacgaggtagaggcaaaagaggtggaggaccgcgagtccctcgataccgtcgatgcgcttgagcaaaaagagatgcccgacgaactgcctctcgatgccagctgggatgaaatctataccgctggcacgccgtcgggtaacggcgtcgactatcaggacgacgagcttcccgtctatcaaggcgagaccacccagacgctgcaggactatctgatgtggcaggttgagctgacgcctttcaccgacaccgaccgcgctattgccacctctatcgtcgacgccgtcgacgatacgggctacctcacgattcagattgaagatattgtcgacagcatcggcgatgacgagatcggcctggaggaggtggaagcggtcctcaagcgaatccagcgttttgatccggttggcgtcgcagcgaaagatctgcgcgactgcctgctgatccagctgtcgcaatttgctaaagagacgccgtggctggaagaggcccggctgattatcagcgaccatcttgatctgctggccaaccatgatttccgcactctaatgcgagtcacccgcctgaaagaagaggtgcttaaagaggcggtcaacctgatccagtccctggatcctcgccctgggcagtccattcagaccagcgaaccggaatatgtcatcccggatgtgctggtgcgcaaggtgagcggccgntggaccgtcgagctcaacgccgacagcattccacggttgaaaataaatcagcagtatgcggcaatgggcaacagcgcccgcaatgacgccgacggccagttcattcgcagcaatctgcaggaagcccgctggctgattaaaagtctggaaagccgcaacgataccctgctgcgcgtcagccgctgcatcgtagagcagcagcaggcttttttcgaacagggtgaagagtatatgaagccgatggtgctggccgatatcgcccaggccgtcgagatgcatgaatcgacgatttcccgtgtcaccacgcaaaaatatctgcacagtccgcgcggtatttttgaactgaagtatttcttctccagccatgtgaataccgaaggcggaggcgaagcctcgtcgacggcgattcgcgcgctggtgaagaagctcatcgccgcggaaaaccccgcgaagccgttgagcgacagtaagctcacctccatgctgtccgagcagggtattatggtggcgcgccgcactgtcgcgaagtacagagagtctttatccatcccgccgtcaaaccagcgtaaacaactggtctga

SEQ ID NO: 6552 - DNA, 894 bp, Klebsiella pneumoniae
ccttctgtatttccgcctgtcaggcggcaacaaacgagtagcataacgatgagtctgaacctggtaagtgaacaattactgtcggcaaatggcctgaatcatcaggacctgtttgccattcttggtcaactgaccgagcgccgcctcgattacggcgatctctattttcagtcgagctatcacgaatcctgggttctggaagacagcatcattaaagatgggtcgtacaatatcgaccagggcgtaggcgtgcgcgccgtcagcggcgaaaaaacgggctttgcctacgccgatcagatcagcaaactggcgctggagcagagcgcccaggcggcgcggaccattgtgcgcgacaccggcaatggcaaagtgcagaccctcggcgccgtagagcatcgtgccctgtacaccagcatcgacccgctgcagagtatgacccgggaagagaagctggatattctgcgccgggtagacaaagtcgcccgggcggcggaccagcgggtgcaggaggtttcagccagcctgagcggggtgtatgagctgatcctggtcgccgccaccgatggcactctggccgccgacgttcgtccgctggttcgtctttccgtcagcgtgctggtggaagaggatggcaagcgtgagcgcggcagcagcggcggtggcgggcgttttggttatgactatttcctcgcctcccaggagggcgacgtgcgggctgatgcctgggcgaaagaagcggtgcgcatggcgctggtcaacctctcggcggtcgccgcccctgcggggatgctgccggtggtgctcggcgccggctggcctggcgtcctgctgcatgaaagcggtcggccatgggctggaaggcgatttcaaccggcgtggcacctcggtctttag

SEQ ID NO: 6553 - DNA, 213 bp, Klebsiella pneumoniae; identical to SEQ ID NO: 1885

SEQ ID NO: 6554 - DNA, 447 bp, Klebsiella pneumoniae
atccatcgactggctctttccagccccgtggtgaagacgaactgtgagacaggggcggcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtag

SEQ ID NO: 6555 - DNA, 201 bp, Klebsiella pneumoniae; identical to SEQ ID NO: 4610

SEQ ID NO: 6556 - DNA, 240 bp, Klebsiella pneumoniae
accttgcaatttaacccccagttaagaattgggatcccgtgccggtccccttatacggttaactttgctacagaatatcagtcgcgaccccattatacaaaaggtacgcagtcacacccgaaggtgctcccactgcttgtacgtacacggtttcaggttctttttcactcccctcgccggggttcttttcgcctttccctcacggtactggttcactatcggtcagtcaggagtatttag

SEQ ID NO: 6557 - DNA, 444 bp, Klebsiella pneumoniae
ccctcaggttcagtttactacagctcttttgtcgggcatagccggcaaaacagcgtggggcagaggccattatcgcgtagaatggttcaacgctttgtctcttttacgaatcttttaatgctcaaaacaacgctgctgttctttgctaccgctctgtgtgaaatcgtcggctgttatctaccgtggctatggctcaagcgcggggcaacgccgctgctgctgatccccaccgccctggcgctggcgctattcgtctggctcctgacgctccatccggccgccagcgggcgggtatatgccgcctacggcggggtgtacgtttgtaccgcattgctctggctgcgggtcgttgatggggtcaaattaacccattatgactgggcgggcgcggccgtcgccctgtgcggcatgctaatcatcgtggcggggtggggacgggcctaa

SEQ ID NO: 6558 - DNA, 1902 bp, Klebsiella pneumoniae
gcgtgttcctccttttcagtgcccggctaccgctcccgtactggtagagagtcgcgccggtctggggataagcggctggctggccccatggccggtacgtattggcctgagcgtggtggtggtactcgccctgtggtggggactcaaccactggctcgatcacctgctgctgaccttgttaccgggggaggtgaaatgagccccccgcagcagcgtgggctggcgctgtgggccagtctgctgagtgcgctggtgtgcctgctatttttgccggttccccgctggggggcgtgggtcattctgctggtcacgctggccctgatcatcgggatctggcgcatcgccagtcgtcgtaccggacgtaacgtcgcatcaaccctggcccctctcccggagggcgcttatcgccagccggtgatcttcgtttgcggcgacctgccgtgtgtctggccgcaagcgtcaccggtgcgagtggtcaaacagggctgctggatccgcgtggaaaagacggaggagctgcagcaggtcgcgcgccaggtattgagccagcggccggaatgggggcctcagctgtcggtgctgctctgcgtctgcccgcagcggcatgcgcaaagcgatgcgctgaccagcgctctgctggccctgcgctggcaactcagccagctgcgtcagcagacggggtatgccgtaccgctggcgctgcaggggcaggtgggcagcgcgatgagtcgcgacctgttgtggcaggcggcgataccgggtgaagcggtgaaagtctggcagccctcctgcgccccctgtttcgtaccggcctgggtacgcgccggcggggcggccgcgctggagcagcaggtgctgatgaacagcctgatgggctggtctgaacagcacgtccatgccgtgttgacggaagagaataccgacctgccacctctgacccctgcggccgtgctgtggggcctcgggccctcgctgcccggaagtctggcatcgtcggcctggacgacgtggttatcccgacatagcggcctgacgcgggtagctggctggcagccagatgagagcgacaccggggacgcttcagctttgccggaattcatcctgccgcagttaccggcgggacggggactcacgccacgaggcagggcctggcgcgcggcgctcgcgattttcaccctcgcggctgtcgccgcgctgctcagcagtggctggaacaatcgacaactgctgcagcgcgtgggcgtcgatattgcccgttatgagcggattgcgatggatgattatcgaccaaaagccagcgctgtcagggtgctgcgtgaagatgccgcgctgcttgatagctgggcgcgtaacggcgtcccgctgcgcctgagtctgggcttgtatcacggggagcagattcgcctgccgttgctggaggcgattcgcggttacgtgccgcctccgcctccgcccgggccggtgcagcacgttgccccggatgtcatccgccttgacagcatgtcgctattcgataccgggaaatgggtactgaagcctggttcgacaaagcggctggtcagctcgctgatggacattaaggccaggcccgggtggctgatcgtggtggcgggtcacaccgacagcgtgggtgaggaaaaagccaaccagctattgtcgctgaaacgtgcggaatcggtccgcgactggatgcgcgataccggcgacgtgccggacagctgctttgccgttcagggctatggcgaaagccgaccaattgcaacaaacgatacgccggaaggccgtgcgctgaaccgtcgtgtcgaaatcagtctggtgccgcaggtagacgcctgccggttaccggaccaaccctctgcgtcatcccaggatgatggcgcttcactacacaatggagagtaa

SEQ ID NO: 6559 - DNA, 1698 bp, Klebsiella pneumoniae
tatgctgcctcttatgaccgtgtgctacgtgataattctattatgcctgcaatgaaaaaaacgattatttccttaaccgcattagcgatgttggtcagcgcggcgacgcatgctgaagcggatacctcgaaaaaaaccgacttcctgctgattggcggcgggatcatgagcgcctcgctcggcacctggctgcaggcgctgcagccggactgggatctgaccatggtggagaaactggacggcgtggcgctggagtcttccaacggctggaataatgccggtactggccactcggcgaatatggagctgaactatacgccggaacgggcggacgggtcgattgacgtcagcaaagcgctcgatattaacgagcaatttatgatttcccgtcagttctggtcggcacaggtgaaacgcggtattttgcacgatccgcactcgtttattaattccacgccgcatatgagcttcgtctggggtgataatgtggattatctgcagaagcgttataacgcgctgcagcagaccactttattccaggggatgaaattctccaccgatcacgcgcaaattaaacagtgggcgccgctggtgatggaaggccgcgatccgcagcagaaagtggcagccacctggacgccggtgggtaccgatgtcaactacggcgaaatcactcgccagctgatcggcagcctgaagaaaaataaccacttcaccctgcagacctcctctgaggtaacggatttcaaacgtaatgccgacaactcctggcacgtaacgattaagaatgtgcagagcggggaagcgcagactattgacgccaaatacgtctttatcggcgccggcggcggcgcgttgaagctgctgcaaaaaaccggtattccggaagcggacaactatgccggcttcccggtgggcggctcgttcctgatgaccgagaacccggcggtcactgcgcagcacctggagaaagtgtatggccaggcttcagtcggcgcgccgccgatgtcggtgccgcaccttgatgcacgttacctcgacggtaagcgcgtggtgctgttcgggccattcgccaccttctcgaccaagttcctgaaaaatggttcgttcttcgatctgctcagcactaccaccaccaataacgtgctgccgatgacccacgtcggtctcgacaacttcgatctggtgaaatacctggttagccaggtgatgctcagcgatgatgaccgtttcgctgcgctgaaagagtactacccggacgcgcgtaaagaagactggaaactgatccaggccggccagcgcgtacagatcatcaagaaagacgcagagaagggcggcgtgctgaagctcggtaccgaagtggtggtcgatcagcagaaaaccatttccgcgctgctcggcgcttcgccgggggcttccaccgccgcgccgatcaccctgaacgtgctcaagcagatgttcccgcagcagtttaactcgccggagtggcagagccgcattcacgctattgtgccgagctacggccagaagctgaacggtaacgtggcgctgacccagcaggtttgggatgacaccgctgcgaccctgcagctgacgaaaccgccggtgatccagatgccagcggctgcgcctaccgcgaccgccaagccggcagagacgccgcgcgaggcctcgccgcagcacgatatggcgctgtaa

SEQ ID NO: 6560 - DNA, 426 bp, Klebsiella pneumoniae
acgttaagctcaaagttaccggaagcaccgccgatattcaccgccacgtcgttgcccatcacctggcagcagaccatggtcagagcttcgcactgggttgggttaaccttgcccggcataatcgatgaccctggctcgttttccgggatggcgatttcaccaatgccgcagcgggggccggaggccagccagcggacatcgttagcgattttcatcagcgaggccgccaggcctttcagcgcgccgtgggcatggaccagggcatccacagtggccagcgcttcgaatttgttcggcgcggtgacaaatggctgtccgctgagcgacgccagctcggccgccacccgtacggcatattccggatgggtattcagcccggttcctaccgccgtcccgcccagcgccagctcggcaagatgcggctga

SEQ ID NO: 6561 - DNA, 1068 bp, Klebsiella pneumoniae
aacgatttatcgaaaggcaagggagtcagccagcaggttatggcaatcgcaaaaaagatcaccatcaatgatgtggcgctggctgccggcgtctccgtgagtaccgtttcactggtactgagcggcaaagggcgcatctccagcgccaccggcgagcgggttaatcaggctatcgaacagctgggatttgtgcgcaatcgtcaggcggcctcgctgcgcggtgggcagagcggcgtgattggccttatcgtcagcgacctgtcaaaaccattttatgctgaattaaccgccggcctcaccgatgccctggagaggcaggggaaaatggtatttctcacccagggaggccgcagcggcgagaagatggcccagcggtttgatacgctggcggcgcagggggtggacggggtgattatcgccggggcgatcgaccgcgggagcgagctgcgcgagcgtgcggcggaggcgggggtgccgctggtgtttgcttcccgcgccagctatcttgacgatgtcgacctgatccgcccggacaacatgcaggcggcgcagctggtgacggagcatcttatccgccgcggccatcagcggatcgcctggctcggcgggcagagtgcttcgctgacgcgcgccgagcgggtcggcggctattgcgccaccttgctgaaatacggcctgccgtttcacagcgaatgggtgctggagtgcgagtccagccagaagcaggcggcggaggcgatgaccggcctgctgcgccagaatccgaccattaccgcggtgctgtgctacaacaacgtggtagccaccggcgcgtggttcggtctgttacgggctggaagacagagcggggaagatggcgtcgagagctactttgagcagcgggtggcgctggcggcgtttgccgacgtgccggaggccgccctcgacgacctgcctctcacctgggtgaccaccccggcgcgggagatggggaaaagcctggcggattcgatgctgcggcggctggaagaggggactggcgagacgcgaaaccagattatgcccccgcggttggtgacgcgaaaatga

SEQ ID NO: 6562 - DNA, 1155 bp, Klebsiella pneumoniae
ctgcccgtatcgcgttgcaacgcgctaccggcagcaaataattatcatcatttcatctctggagtcgttatgagtcagcaggatgcggccaaacaacaggccaacacccggaataatattcgcgtggtttccatttttaccgccgcggcgataggcctcgtcggcgtgctggtgatcctctacgcctggcaactgccgccgttcactcgccatagccagtttaccgacaacgcctatgtgcgcgggcagaccacctttattagcccgcaggtcaacggctatatcaccgccgtcaacgtcaaagatttcgcgattgcccagccgggcgaggtgctgttccagatagacgatcgcatctataaacagcgggtgcatcaggcccaggctaccctggcgatgaaagaggccgcgctgcgcaataacctgcaacagcgcaaaagcgccgaggcgacgatcgccaagaatgaagccgcgctgcaaaacgcccgcgcgcagaatctgaaaatccaggccgatttaaaacgcatccagcagttaaccgccgacggttcgctgtcgatccgcgaacgtgattcggcgcgggccagcgcggcgcaaggggcggcggatattgagcaggcgaaagcggcgctggagatgtcgcgccaggaccgtgaatcgaccatcgtcaatcgcgattcgctggaggccgacgtggccagcgccaaagcggcgcttgagctggcgcagatcgacctgcagaatacccagattatcgcccccaccggcggccagctggggcagatctcggtgcgtcttggcgcctatgtcagcgccgggacccatctgacctcgctggttccgccgcagcactgggtgattgccaacctcaaagagacccagctggccgaagtacgcgttggccagccggtcaccttcaccgtagacgcgctcaacggcgagaccttccacggcaaggtgcagagtatctccccggcgaccggggtggagttcagcgccatctctccggacaacgccaccggcaatttcgtcaagatcgcccagcgcatcccggtgcgtattacggtcaacgacgggcaaaacaacagcgaacgcctgcggccggggatgtcggtgcaggtgactattgatacccgtgcggagaaacaaccatga

SEQ ID NO: 6563 - DNA, 1449 bp, Klebsiella pneumoniae
attgtcgcatcaggcgcggagatctgcgaggatacgcgcctgcagattgtctgccttttaatacgagaatacattgtgaccgctttttctaccctgactgttttacctgccgcccaattagccaaccttaacgagctgggttatctgtcgatgaccccggttcaggccgccgccctgccggcgatcctcgcggggaaagatgtgcgcgtgcaggcaaaaaccggcagcggaaaaacggccgcatttgggctgggtctgctgcagcatatcgatccggcgcgcttcgagacccagtcgctggtgttatgcccgacccgcgagctggccgatcaggtcgccggcgagctgcgccgcctggcgcgctgcctgccgaacatcaagattctgatgctctgcggcgggcagccctttggcgcccagcgagattccctgcagcatgccccgcatattatcgtcgccaccccgggccgtctgctcgatcatctgcagaagggaacggtctcccttgacgcgctgcagaccctggtgatggacgaagcggaccgcatgctcgatatgggctttagcgatgccattgatgaggtgatccgcttcgcaccggctgaccggcagacgctgctgttctctgctacctggccggcggcaatcgcggcgatcagcggccgggtgcagctcaatccgcagaccattgagatcgacactgtcgatgcgctcccggcgattgagcagcagttctttgaaatttcccgccacggtaagattgccctgctgcagcgcctgctcagccagcatcagcccgcatcctgcgtggtgttctgcaataccaaacgcgattgccaggcggtctgcgatgcgctcaacgccgccgggcagagcgccttgtcgctgcatggtgaccttgagcagcgcgatcgcgatcagacgctggtgcgcttcgctaacggcagcgtccgggttctggtggcgaccgacgtcgctgcccgcggtctggacatcaaatccctggcgctggtggtgaacttcgagctggcctgggatccggaggtgcatgttcaccgcatcggccgtaccgcccgcgccggtgaacaagggctggccatcagcttctgtgcgccggaagaggcgcagcgcgccactattctggccgacatgctgcagctttccctgaactggctgccggcgccgacgggcaacaccatcgcgccgctgacggcggagatggcgacgctgtgtatcgacggcgggaaaaaggcgaaaatgcgcccgggagatgtgctgggagccctgaccggggatatgggctttgatggtgccgatatcggcaaaattaccgtccacccggcccacgtctatgtggcgatccgccagaatatggcgcagaaggcgtataagcagttacaaaatggcaagatcaaaggtaaatcctgccgcgtacgactgctgaagtaa

SEQ ID NO: 6564 - DNA, 1659 bp, Klebsiella pneumoniae
gtgactatgtcgactaaaccgtttgtttatcaggatccgtttccgctggcgcacgacgatacggaatactatctgctcagcaaagagcacgtctccgtcgccgaatttgacggccagcaggtcctgaaagtagagccgcaggcgctgaccttgctcgctcagcaggccttccacgacgccgcctttatgctgcgcgtctcccatcagcaacaggtcggctcgattttgctcgacccggaagccagcgataacgataaatatgtcgccctgcaattcctgcgcaactcggaaattgccgccaagggcgtgctgccgacctgccaggataccggcaccgccatcattatggggaaaaaaggccagcgcgtctggaccggcggcggcgatgaagccgctctggcgcagggcgtttacaacacctataccgaagataacctgcgctactcacagaacgcgccgctggatatgtataaagaggttaacaccggcaccaacctgccggcgcagatcgatctctatagcgtcgacggtgaagaatataagttcctgtgcatggcgaaaggcggcggttccgccaacaaaacctatctgtaccaggaaaccaaggccctgatcaccccggcgaagctgaaaaactacctcgttgagaagatgcgcactctcggcaccgccgcctgcccgccgtaccacatcgcgtttgtgatcggcggcacctcagcggaagcgacgctgaagaccgtcaaactggcctcgacccgctattacgacggtctgccgaccgaaggtaacgaacacggtcaggcgttccgcgacgtgcagctggagcaggagttgctgcaggaagcgcagaacctcggcctcggcgcgcagttcggcgggaaatacttcgcccacgatatccgggtgatccgtctgccgcgccacggcgcctcctgcccgatcggcatgggtgtctcctgctccgccgaccgcaatatcaaagccaaaattaaccgcgacggtatctggatcgagaagctggagagcaatccgggaaaatatattcctgaacatctgcgtcaggccggcgaaggcgaagtggtaagcatcaacctgaatcagccgatgagcgagatcctggcgcagctgtcggcacatccggtctccacccgcctgagccttaacggcaccattatcgtggcccgcgacatcgcccacgccaagctgaaggagcttatcgacaacggcgaggcgctgccgcagtacgtcaaagatcacccgatctactacgcgggcccggcaaaaacgccagccggttacgcttccggctccctcggcccaaccactgccggccgcatggactcttacgttgatctgctgcagtcccacggcgcgagcatggtgatgctggcgaaaggcaaccgcagccagcaggtgaccgatgcctgccataaacacggcggcttctaccttggaagcatcggcggcccggcggcagtgctcgcccagcagagtatcaagagcctcgagtgcgtggcctatccggaactggggatggaagctatctggaaaatcgaagtggaagattttccggcgtttatcctcgtcgatgataaaggcaacgacttcttccagcagatccagaataagcagtgcgcgggctgtaaacagcacggctaa

SEQ ID NO: 6565 - DNA, 1347 bp, Klebsiella pneumoniae
ggacatatgtctggttttgaagcaaactttgatggcctggtcggcccgacgcaccactacgccggactctccgtcggcaatgaagcctcgcaaaataaccgcgatggtctctctaaccctaaaaaggcggcgctgcaggggctgtataaaatgaaagccctggccgaccgcggcttcgtgcagggcattctgccgccgcagccgcggccgaatctgcgtctgctgcgtgaagtgggtttccagggcagcgatgagcaggttatccggcaggcggcccacgcggcgccgcagctgctctccgccttcagctccgcctcgtcgatgtggaccgccaacgcggcgaccgtctcaccgtcggcggacagcgccgatggcaaagtccatttcaccgtcgccaacctgaacaataagctgcaccgtatgcaggaggcacccaccacctcggcgatccttggcgccacgttcgccgatccgcgctactttgcccaccatgcggcgctgccgcagcatggcgacctcggcgatgaaggggcggccaaccataaccgcttctgccgggaatatggccggcagggggtgcagtttttcgtctatggtcgacgcgccagcggcggtatcgccccggtgaagtatccggcgcggcagaccctcgaggccagcgaagcggtggcccgcctgcatcagctggatccgcgctacacggtgtttgcccagcaggcgccgcaggctatcgatcgcggcgtgtttcataacgacgtcatcgcggtcagcaatcgccatgtgctgttccaccatcagcaggcgtttgtcgatcaggcgacagtgctggccacgctgcgggctaaaagcgacagtctggatatcccgttcaccagcgtggaagtgccggacgagcgggtttcgctcgacgacgccgtggcctcttacctgttcaacagccagctgctgagcaaaccagacggcaagatgctgatcgtggtgccggaggagtgccgccagcgggaaaacgtctggcgctatctcagcgatctcgccgccgatagcgcatcgccgatcgatgaagtggcggtctttgacctgcgggaaagcatgcgcaacggcggcggcccggcctgtctgcggctgcgggtggtgctcaatgaggcggagcgcaaggcggtcaacgcccatagcctgatgaacgacgaacgttatcagcagctgacggcatgggtggaaaaacactatcgcgaccggctgcatgcccgcgatctggcggacccgcagctgctgcgcgaggtttatcaggcgctggatgagctgacgcagatcctgcgcctgggcgcggtctatgattttcagcgttaa

SEQ ID NO: 6566 - DNA, 369 bp, Klebsiella pneumoniae
cgttttccgtcaggctcagtacatggtccaggccgccgaagccgatatcgtaagcccacccgtcgccgccgatcagccagacggatttctccaccagcgcgtcggcatcggtcagcagctcttcagctcccgccacgccggccagcgcctgacgcagggccgccacctgttcgcggcgaacttccggcgtcgcctcggcgtgcagcgccgcgttcagctctgccggcagtttgtcggcgaattcgctcagcaggcgcatcacgcgctggcgatgctggtcgacggtcaagcggaagccgagcccgaattcggcgttatcctcaaacagcgagttggcccacgccgggccgcggccgttggcgtcggtag

SEQ ID NO: 6567 - DNA, 1290 bp, Klebsiella pneumoniae
cgttcaccgtcgaagtgcttcaccatagccgaaagtttatttcgaagcgcgaaaataagggagtcaatggtggtagcggatagtcaaccaggccatatcgatcaaataaagcagaccaatgcgggcgccgtgtatcgcctgattgatcagctcggcccggtatcgcgtatcgacctttcccgatttgcgcaactggcgccggccagcatcaccaaaatcgtccgcgaaatgctggaagcgcatctggttcaggagaccgagatccaggagcccggcagccgcggccgcccggcggtggggctgatggtggagaccgaggcatggcactatctggcggtgcgcatcagccgcggtgagatccatctttcgctgcgtgatttaagcagtcagctggtggtggaggatcagctggagctggcgctcaccgacagcacgccgtttttgacgcgcgttatcgaccatattgatcgcttctttattcgccatcaaaagaagctggaacgccttacctccatcgccatgacgatgcccggtattatcgataccgaaaatggcattattcatcgcatgccgttttatgaggatgttaaagatgtcccgctcggcgaagcgctggccaatcataccggggtgccagtctatattcagcatgacatcagcgcctggactatggcggaatctttgtttggcgcctcgcgcggcgcccgggacgtcattcaggtggtcatcgatcataacgtcggcgccggggtgatcaccgatgggcgcctgctgcacgccggcagcagcagcctggtggagattggccatacccaggtcgatccctacggcaaacgctgttactgcggcaaccatggttgcctggagacgattgccagcgtagaaagcgtgctggagctggcgcagatgcgcatggcgcagtcgatgagctcgctgctgcaccagcgtccgctgagcgtggagtggctttgtcaggcggcgctgcagggcgatttgttagcccgggacatcatcagcggcgtgggtaatcacgttgggcggattctggcgatcatggtcaatctgtttaatccgcagaaaattctgattggctcgccgttcaatctggcggcagaaattctttttccggcaatttccagctgtattcggcaacaatctctcccagcctatagccggcatattaccgttgaaagtactcagttctccaaccgcggaacgatggctggcgcggcgctggtcaaagatgcgctctataacggatccttactcatacgactgttacagggttaa

SEQ ID NO: 6568 - DNA, 762 bp, Klebsiella pneumoniae
tttgcggagtcaatggccatgcataagctcgccaggcaaaaacatattctcgacaggcttagcgaaaccggtcagctgagcatcagcgaactggttgcagagctgcaggtgtcggccgataccattcgccgcgatctgagcgacctggaacaacagggcgtgctgcagaaaagccacggcggggccatcgcccttaacgtcccggccatgacgcgccagggcagaaacgctcttctcacccagaccaagcagcgcctgggtcagcaggtcgccgcgcgcattccctctggctcgacgctgtttctcgacgccggaagcacgctgctggcggtggcagcccagctgaaagggccgttgaccgtgatcacggcttctctggatatcgctcagctgttcagcgaccgtgccgatatccagctgatcctgcttggcggccagtgggatagtaaacaacggctgttcgccggcagcgccaccctgtcgctggtcacccgctaccgggccgatatcgccattctcggcgcctgcgcgctccatgccgggctggggctgagcgccagccaggaagctgatgccgacgttaaacgcgccatgctggccgccagcgccgagcactggctggtggcggaccataccaaactcaaccgctgcgaaccgtggcgggtggccggactcagcgacattcaccatctttttcttgatcgtccctgggctgagctgggggatgaccccgccctctctgtacatattgctgacgcttaa

SEQ ID NO: 6569 - DNA, 1308 bp, Klebsiella pneumoniae
gctgaatggtcacaacactctgttggtaagcagcaacttctacgcaaggaattctctgtgagtcgtacaacaaccgttgacaccgtgccggcgggcgaggtcagcgtcgctggtgcatcccgcccggatccgtttattaagcgtggcaccccgcagtttatgcgcgtcactctcgcgctgttctccgccggtctggccacctttgccctgctctactgtgtgcagccgatcctgccggtgctgtcgaacgagtttggcgtgtcgccggccagcagcagtatttcgctttcaatttccacggcgatgttggcggtgggcctgctgtttaccggcccgctgtcggacgctataggccgcaagccggtgatggtcaccgccctgctgctagccgcctgctgttcactgttgtcgaccatgatgaccagctggcacggcatcctgattatgcgcgcgctcatcggcctgtcgctgagcggcgtatcggcggtcggcatgacctatctgagcgaggagatccaccccagtttcgtcgccttttcgatggggttatatatcagcggcaactccatcggcggcatgagcggccgcttgctgaccggggtctttaccgatttcttcggctggcgcgtggcgctggcggcgatcagcggctttgcgctggccgcggcgattatgttctggcgtatcctgcccgagtcgcgccatttccgcccgacctcgctgcgaccgaaaacgctgctgattaacttccgtctgcactggcgcgaccgtggcctgccgctgctgttcgtcgaaggttttctgctgatgggcgcttttgtcaccctgtttaactatattggctaccggctgatgatgtcgccgtggtcgttaagccaggcggtggtaggcctgctgtcggtagcttatctcaccgggacctggagttcaccgaaggcaggggccatgaccgtacgctttggccgcgggccggtgatgcttggctttacagcggtgatgctctgcggcctgctgctgacgctcttttcttccctgtggcttattttcatcggcatgctgctgttttccgctggcttcttcgccgcgcattccgtcgccagcagctggattggcccacgcgcccgccgcgcccgcggtcaggcatcatcgctgtatttgttcagctattatttgggttcaagtcttgccgggacgttaggcggggtattctggcatcactacggctggaacggcgtcggtgggtttatcgcgctgctgctccttgccgcgctgttgaccggcacctgcttacatcagcgactgaaatag

SEQ ID NO: 6570 - DNA, 432 bp, Klebsiella pneumoniae
agtctccggtctttcttccatctcacagagaggcacatcgccatgaaaaagacccgctataccgaagaacagatagcatttgcgctgaaacaggccgaaaccggcactcgggtggaggaagtctgcagaaagatgggcatttctgaagccatattttacaactggaagaaaaagtttggcggcatgggcgtgacaaaactgcgccgcctgcgccagcttgaggaagagaatcagcgtctgaaacgtctggtggctgatttaagtctggacaaggtgatgctgcaggaagttatcaaaaaaagttctgaggccggctcagaagcgtcaggcggtgcattttctgcgggaggcttaccgtatcagtgtccgacggggatgcggactgctgatgcagagcagaaccgtttaccactggcagagccggcgggatga

SEQ ID NO: 6571 - DNA, 1638 bp, Klebsiella pneumoniae
tccttcaggtcgcgcttactgttggtgataactcagccaggcggtctctccgcctggcttcatttatggataaatgctatgaaaaaatcgctggtcgcagcaggagtcatcgtggcgctgggcgtggtatggacaggcggcgcctggttcaccggtaaacagctggaaggccggatcgccgatatggtgcagcaggcaaacgcccagctgcgcagcagcgcgccggagtcaggtctggagctgagctatcaggactaccagcgcgggctgttcagcagccatctgcagctggtggtgaagccgatcgccggtcaggctaacggctggctggccgccgggcagagcgtggtgcttgacgaagtggtcgatcatggccccttcccgctggcctcgttaaaagcctttaatctggcgccggcaatggcttccgtccacaccacgctggtgaaaaacgacgccagccaggcgctgttcgagatagccaaaggcgacaccccctttaccgtcgatacgcgcattgcctacagcggcgacagccagtcggctatcgtccttaacgccctcgactacgctaaaggcgatgagaaagtcaccttcagcggcggtcagttccagctcgacgccgaccgcgacggcaaaaacatcagcctgaagggccaggccggcagcgggcagatcgatgcgctcaatgaatataatcagaaggtacagctgcgcttcgtcaacctgaccaccgacggcgccaccgagctggccagcttcaacgaacgtatcggccagcaaaaaatgaccctcgataaactggccatcagcgtcgaaggcaaagagctggcgctgatcgacggcatggcgctggacggcggctcgacgctgacccaggacggcaaaggcgtgaacagccaggtgaactacaccgtcaacagcctcaagctgcaggggcaggatatgggcagcggcaaactcacgctgaaagtggataacgtcgacggtcaggcgtggcaccagttcagtcagcagtacagcgcgcagtctcaggcgctgctggcgaaaccggagctggcgcagaatccggagctgtatcagcaggccctcaccgaaacgctgttcaatgcgctgccgatcctgctcaaaggcaacccgtcggtgaccatctctccgctgagctggcgcaatgccaaaggcgaaagcaccctcaacctctcggttctgctgaaagatccggcccaggtgaccgctccgccgcagaccctggcggacagcctggatcgcgtggtgcagtccctggacggcaaagtggtgatcccggtggatatggcgacggagtttatgactaagatcgccggtctggaaggctatcagccggccgatgccgccaagcttgccgatcagcaggtcaaaggcctggcggcgatgggccagatgttccgcattaccaccatggaagataacgccatcagcagcagtctgcagtacgcgaacggccaggtgacgctgaacggacagaaaatgccgctgcaagactttgccgcgatgtttggtctggaagcgccttcgctgccggacagcgcgccgcaggaaggccagccgcagcaggatgacgccgctcctcagcaggacgacgccgccccgcagccgtaa

SEQ ID NO: 6572 - DNA, 624 bp, Klebsiella pneumoniae
ccgctacttccgcgagcacctgaccactcgctacctgtaatcatacgcgccgggctacccggcgcgtcctgtcgttcccgccttgtacattcggttacacgccgataccaaacactcacggaaagctcgaaaagacaagcatatagtgatttcaccggccccgcagtggggttgaaattaagaaaacttttcgaggatatcagaatgaaaaaagtattagctctggtcgttgccgctgctatgggtctctcttccgccgctttcgctgctgacgcagtaagcaccactcaggcaccggctgccacccacagcacggctgccaagaccacccatcacaaaaaacaccacaaagccgcggcaaaaccggccgcagagcagaaagctcaggctgccaaaaaacacaaaaaagcagaagctaaaccagccgctgctcagaaagcccaggccgctaaaaaacacaaaaaagtagcagctaaaccagctgctccgcagaaagctcaggcggcgaaaaagcatcacaaagctgcggctaaaccggcagcccagaaagcgcaggcagcgaaaaaacaccacaaaaccactaaacaccaggccgctaaaccgactgcacagccggcagcataa

SEQ ID NO: 6573 - DNA, 465 bp, Klebsiella pneumoniae
aaaagaactttctctgcaaaaggagtacgggccatgtataaaaaaattttattgcctgttgatgtctttgaaatggatttaagcgataaagcggtgcgtcacgcggaatttctcgcttcggccgaaaatggcgagatcaccttgctcaacgttctgccgaacagcagccgttcgctattgcgcggttttacggcggatattcgtaagtttgaagcctatatgaaagaagagtcggagaaaaaaatgcgcgaggtggcgcgactgttcgccatccccatgacgcggatccatacccgcgtagtctttggcaacgtgcgtgacgaaattctggctatcagtaacaacgaagagttcgatgtcattgtgattggttcccgcaaaccggggatctccacccatctgctgggctccaacgccgagtcaattctgcgctacgccaaaacgccggtattggtcgttagataa

SEQ ID NO: 6574 - DNA, 597 bp, Klebsiella pneumoniae
aactctcctcccgcaggaagcgagaggagtgaaatattaggctgcaaccacgctgtcgatggccgctttcgcgtcagactgcgctttggccgcgacttccgggccgtaagcgataccttcggcgaacacaaagttcacgtcggtgatgccgatgaagccgaggaaggtggacaggtacggggtgaccaggtcggtcggagtatctttatggataccgccgcggctggtaacgacgaccgcgcgtttaccggttaccagaccttccggccctttctcggtgtagcggaaggtgacgccggcgcgagccaccaggtcgaaatagtttttcaactgcgtcgggatgttgaagttgtacatcggcgcagcgataacaatcacatcgttgcctttcagttcggcgatcagctcgtcggaaagggccagcgcttcctgctgacgcggagtcagcggcgcgtcgctcggacgcagggcgccaaccagttcgccatccagaaccgggatcggattggcggccaggtcacgcacggtgatctcatcgccagggtgtttttcctgccattgttcaacaaaatagtcggaaagctgaccagattgtga

SEQ ID NO: 6575 - DNA, 1047 bp, Klebsiella pneumoniae
ggtcgggatcctatggctaaacccattattacacttaacggattaaagatggtcatcatgttgggcatgctggtgatcatccttaccggcattcgctttgcggcggacataatcgtcccgtttatcctggcgctttttctggcggtgatcatcaatcctctggtccagctcctggtccgctgccgggtgccgcgcgtgctggcgatctcgctactgattggcctgattgttatgttagccattgtgctgctggcctcgctggggacctcgctcaacgagctggcgcgcaccctgccgcagtatcgcaattatctctatgagccgatgcaaaccatcgcgccctggctgcagcgtatgggattcaccgtttcggtggtcgagctcaataagtacatcgaccctaacgccgtaatgaccctggtcaccagcctgctcactcagctgtcgaacgccatgtcctccatttttctgctgctgctgacggtggtgtttatgctgctggaggtgccgcagcttcccgctaagctgcagcagttaatgtccagaccagtagaaggcatgggtgccatccagcgggccatcgacagcgtatcgcattatctggtgctgaaaactgcgataagcctgatcaccggcctggtggtctggggcatgctggtgcttctggatgtgcgcttcgcctttatgtgggggctactggccttcgcgcttaactatattcccaatatcggttccgtgctggcggccattccgccgatcctgcaggtgctggtattcggtggtctgtacgaggcgctggtagtgctggccggctacctgatcgtcaacctggtattcggcaatattctcgaacctcgtatcatggggcgcgggctgggcctctcgacgctggtggtattcctgtccttaatcttctggggatggttgctgggtccggttggcatgctgctctcggtgccgttgacgattatcgtcaaaattgccctcgagcagaccagcggcgggcagagtatcgctttcttattaagcgatgttagtaaacagtag

SEQ ID NO: 6576 - DNA, 441 bp, Klebsiella pneumoniae
cgaatttccccagcgtgccgcagacgccggcgaaccaggcgcccgcctccagcagccgatcgcgctggctgtgccacggagtatccggcagcgacagaccgaggatctgcgccagcgccaggccaaccgccggccctttctcttttagcgcgtccagagtgcccgcggcgccgccgaactgcagcgccagcagccgcggacgcacctcgcgcagccgctgctgccagcgcaggagcgcgtcgagggtgcccgccagcttcaggccaaaggtcaccggcagcgcgtgctgcatccaggtccgtcccggcatcacggtatcgcgataacgatccgcctggagagccagggccgccaacagctgctcaagcagagtctcagcggcatccagcgccccgcgcagctggagcaccagtccggtgtcgatggcgtcctggctggtag

SEQ ID NO: 6577 - DNA, 819 bp, Klebsiella pneumoniae
tttccgttaccggtcgccgcctgtgcgtgctatggtatgaaaacacaaaaagcgttgaggaacagtaagatgattatcatggtcaccggcgccaccgccggttttggtggaagtattactcgccgttttatcgctaacggtcataaagtgattgccaccggtcgtcgtgaagagcgcctgaagacgctgaaagacgagctgggcgataacctttatatcgcgcaacttgacgtccgcaaccgcgccgccattgagacgctgattgctgacctgccggccgagtggcaggctatcgatgtgctggtgaacaacgccggcctggcgcttggtctggagccggcgcaccgcgccagtgtggaagactgggaagatatgatcgacaccaataataaagggctggtgtacatgacccgcgccgtgctgccggggatggttgagcgcaatcgcggccatatcatcaatatcggctctacggcaggcagctggccttacgccggcggaaacgtctatggggcgaccaaagcctttgtccgtcagtttagcctcaatcttcgtaccgacctgcacggcaccgcggtgcgcgtgaccgacatcgagccgggtctggtgggcggcaccgagttttctaacgtccgctttaagggcgatgacgctaaagccgaaaaagcttacgaaaatacccaggcgctaacgccggaagatgtgaccgaggcggtctggtgggtcgccaccctgccgaaacatgtcaacatcaacaccctggagatgatgccggtgagtcagagctttgccggactcagcgttcaccgtcagggctaa

SEQ ID NO: 6578 - DNA, 765 bp, Klebsiella pneumoniae
ccgacatcgttaagcgggtcacattttgtgcgaacaacgaataacagtgcgattaccgcacatcactggagcgacctgatgattgataaaagcgtatcgacgctgagcgaggccatcgccgggatccacgatggggcgactattatgatcggcggctttggccccgccggccagccgacctttctgattgacgccctgattgaccagggcgctcgcgacctgaccatcataaataacaacgccggcaacggggaagtgggtctcgccgcgctgctcaaggcgggccgggtgagcaaaatgatctgctcctttccgcgccaggtggattcgcagattttcgatgatctctaccgtcgcggcaaagtggagctggagctggtgccgcagggcaacctcgcggcgcggatccaggcggccggcgccgggctgggggcggtgtttacccccaccggctacggcacgccgctggcggaaggcaaggagacacgggaaatcgacggtcgccactacgtgctggagtacccgatcaaagccgatttcgcgctgattaaagcccaccagggcgaccgctggggcaacctggtctatcgcaaggcggcgcgcaactttggcccgatcatggcgacagcggcgaaaaccaccatcgtagaggtctcgcagctggtggcgctgggcgacctcgacccggaaaacatcatcacccccggcattttcgtccagcgcgtcttctcgctggaaaacctgactgccgcacaacgcgcctga

SEQ ID NO: 6579 - DNA, 648 bp, Klebsiella pneumoniae
atgtcgagaccatcgatctgctctatcagcaccgcgtcgatcccgcggtaccggtggaagaggtggtgggcactatggccgatctggttaaagagggtaaaattcgccatatcggtctgtcggaagtatctgctcagacgttgcgccgggcctgcaaggtacatccgatcgctgccgtgcagacggaatattcgctatggagccgcgagccggaagcccggtattctccacacctgccgcgagctgggggtcggctttgtgccatacagcccgcttggccgcggcttcctgacggggacaattaccgatcccggcgttttgtcagcggatgatttccgccgccatctgccgcgcttccaggccgaaaccatgcgcaaaaaccagctgctgcttgagcgcctgcagcaggtggccacccgctatgacgcgacccttgcgcagattgcccttgcctgggtgatgagcaaaggcgaggatatcgtgcctatcccgggggcgaggaaaattgctcacctgcgcgacaatgccggcgccgcgaatattaccctcgcgccggaggacatcctcaccatcgaacatattttcactgccgacagcgtcactggcttacgctatacccagggcgactttgatttaatcgaaaaataa

SEQ ID NO: 6580 - DNA, 612 bp, Klebsiella pneumoniae
gtgatgatgccgttcccaaatcgcgacgccgtcgcgttaagcgcccgcaccctgggcgcgctgttctcttatgcgccgaatagcgcggaaattgcgccgctggtcgccgccttccaggacgggagctggcagcagcagtggcccttcccggtcgcagccccgctggcgtcagggtttgccgcatcggctgaagaaacgttgccggaagcctggcagcgcctgtttatcgggccatgggccctgccggcgccgccctggggctctgtctggctggataaagagtctgtgctgtttggcgattccacgctggctctgcgccagtggatgcgcgagaacggtatcgcgctggaggccgatggcaacgaaccggaagatcatttcggcaccgtgctactcctggcggcatggttgtgcgaaacggagcaggatgcgttgttcgctcagctgctggcctggcacctgctgccgtggtccgggcgtttcctgagcgtctttgtcgaccatgccgcccaccccttctatcaggcgctgggtcagctggcgcaggcgactctggcgcagtggcaggagaatctgccgatcgccgtggcgcaaaaaccgctctatcgttaa

SEQ ID NO: 6581 - DNA, 498 bp, Klebsiella pneumoniae
aatcagccgccaggtccaccgcgcagcgggttcccgccagcgcctgctgcacccgctctgcccccggcagatccggcagcgtcaggcgcggcgcggcgcgcaaccagacagaggcatcggcatcgcgctgcgccgggaaccagaccaccgacggcagcaccgtcgcgccgccggtcaagggggcaaactgctggcgctgctcaacgccgttttgcagcacgcacaccacggtgtcaggggaacacagggccgtcagccagggtgcgatggcctccgtctgggtggttttcaccgcgacaaagaccaggtcgaagggggcggctatcgccatcgggtcggtgtacaccgggccgggcaccacgatctcaccctcgtcagtgcgcagcaccagcgccgaatgggcggtacgcccgcagaccatcggcgccctccccctctcaaacagggcggcggcaatcgtggtgccgatggcgccgggaccaattagcgcaaccttag

SEQ ID NO: 6582 - DNA, 1107 bp, Klebsiella pneumoniae
ccttgccagcccgcggaaaatagcgaaagatggcaatattcgggcatcaacggtgccagtgcctgtcctgagggagccatgagtcaagacgtcaccgcgaagatgttaaagcccgattttgatagtgaagtttccggcctggtgcatggctatttgtttcatgaacagcgccccccgcagccgatcgcctctggcgaggtctgcgcccgctatcaggcgctcgccgatgacaaggcgtttatctggttacacctgaatcttaatcacgccaccgccgagaaatggttaaccagccactttccggtggccgattttttcttcgaggagatccgcagcggctcgcacaccacccgcattgagcgacagggggaaaatctgttcgctgtgcttaacgatgtgctgtttcgtccgcaggataccagcgcggaaaccgccacgctgtggctctactgtagccccaggctggtggtgacggcgcgcttcaaaccgttgcggtttatcgaatggatgctgccgcgcttgcagacgctcagggtgaacacgtctactgagctgctggcctttctgctggaggagcaggaggaggtgctggagcaggtcgtccgccaggccagccgccatgttgaccttattgaagagcgtcttctgagcaatcacgtgcagcgcaaccgggccgatctggcgcggctacggcggatgcttttacgcttccagcggctgctggcgccggagccggcggcgatgttccggctgcttaaccggccgccggcgtggatggatcgcgcggtggtgcaggcgtttcgtcagttcaccgaagagtttagcgtggtgcttaacgatctgtcgggcctgatcgaacgcatcagtctgctgcaggaggagattggcgcccgccagctggagcagagcaatcgcaccctctataccctgacggtgatcaccgtcctcgcgctgccgattaacatcgtcgccggtttcttcggcatgaacgtcggtgggatcccgctggcaagcaaccaccacgggtttatcctgctggtggtgattgtcgctgtctttaccctcggcgccggttatctggcgtttcgccggcgcgatgacctgtag

SEQ ID NO: 6583 - DNA, 576 bp, Klebsiella pneumoniae
acatctcggcccgctgctggcggagatgcagtatctgcagcgttcgcatcccggactgcagtggtaagtgaggtgactatgcaatgtcttgccgatatcgctcctgcagaggttcgcaccatctggggattattaagcgcgatcccggatccggaagtgccagtactcaccatcaccgaccttggtatggtgcgcagcgtcgcgcgccatggcgacggctgggtgattggctttaccccgacctattcgggctgtccggcgacggagcatctgctgggggagatccgcacggtcatgagcgagcatggctttcagccggtacatatcgtcctgcagctggatccgccgtggaccaccgactggatgagtcaggatgcccgcgagcgcctgcgccagtacggcatcagcccgccccaggggcacgcctgccatgcggatatgcccgctgaggtgagctgtccgcgctgcggcagcacccatacctcactgattagcgaattcggttccacggcctgcaaagcgctctatcgctgcgacagctgccgggaaccttttgattactttaaatgtatttga

SEQ ID NO: 6584 - DNA, 1707 bp, Klebsiella pneumoniae
caaaagcggccttttgctttgattacacggctttatgtatgccgcgctatcggcgataataatctttcactgaatctacccggggtcgtcatgaaggcttcagagcacccgcctcgcgttcgccaacgcgccttaccgttaaagctgagcaccgccgtgtccttgatgatcggcagcgtcatcggcgccgtgctgctgctggtgtatgccttgtggtatatgcagatcagcaacgccacccgcgacggtctgaaagagaccgcgctggcggtggcgcgcaccatggccgatatgccgcaggtgaagcgcggactggaggcgcccccgcagcagcagatcattcagccgctggcgcaggccattacccgccgcaacgacctgttgtacgctatcgtcaccgatatgcagggtattcgctattcgcatccggacagctcaatcatcggcaaaccgttcatcggccacgatattcagccgacgctgcaggggaaagagaatgtcgccatcaaccacggggtgctggccccggcgctacgggtgtttacgccggtgttcaacgaacggcatcagcaaatcggcgtggtggtggtcggcatttcactgagtaaagtggacgaacagatcgccaacagccgttgggacgtgctgctgaccatcctgttcagcgcgctggtctgcgcgctgggcacctggagcctggttcgcggcctgaagcgcgtgctgctggggctggagccgcacgaaatatccacccagtttcagcagcgtcaggccatgcttcacgccctcaaggagggggtggtagcggtcgatgcccatggcgaggtaaatctcatcaaccccgcggcggaagagatcctcttttccggcccagataagactctcgttcacagccccctgctcgacgatctgcagaccgtgctgcagagcggcgagccaatgttcgaccgcgaactggggtgcaatggtctgctgctgatcggcaatacagtgcccatccgcagccagggtgcggtggtcggcgccatctgtaccttccgcgataaaacggaggtcagccaattgctgcagcgactggacggcatgatgagctatgtggatgccctgcgcaccacctcccatgagtttatgaataaactgcacgtgatcctcggtctgctgaatatgaaaagctacggcaaactcgaggaatacgtgctgcagaccgcccaccgctaccaggcggacatcggcgacattcaacatcgcattaaatccccggtggtggccggcttcctgataagtaaaattcagcgcgccacagagtgcggctttaccctgacgctggcggaggagagcctggtgccggattgtccgaacgagaaacaggtcacggtgctggtgacggtgctgggcaaccttattgagaacgcgctggacgccatgtgcggccaggcggagggtgagatcggcctgctgctgcactaccaggacggctggctaagcggtgaagtgagcgacgatgggccggggatcccggagaacaacatcgacgctatctttaacaaaggcttctccaccaaaggcgagaatcgcggcgtcgggctgtttcttgctaaccagcagttgcgcgagctcggcggcaccctcgccgtcgaatcggaacccggcgtatttacccaattttttgttcatctcccctgggatagtaaaaggaaacctgcgtga

SEQ ID NO: 6585 - DNA, 1197 bp, Klebsiella pneumoniae
gcatgtaggcctggtaaggcgccagccgccaccgggccgaaacaggcgtcaagtcttcccccctgcttagccggccgccaggaccggcgggtgtcaggcgctctggttgtccagctgaagctgcccctcgcgccgctgcttcagcttccagaagccccacagcgcgataaaccacagcggagaagccaacagcgccagcagcgtgtccgggtcaaagatcatgatgaagatagcgaacgcgaagaacagcaggctcacccagctcatcaccaccccggcgggcatcttaaagatcgacccggcgtgcaggtccggacgctgacggcggtaaaccagataggccacgaggatcatcccccagctgaacaccaccataatcgccgccagggtcgagacgatggtgaacagggtcatcacgttcggcaccagaaacagcaacagcgtgccgatcagcatgcagaagcaggagaacaacaggctgcgcaccggaatgcgggtactgcgcgacaggatacgaaactgccagtgcgcatgcttctccaccgacaggccgtacagcatgcgggtgctggagaagaccccgctgttggccgaggacatcgccgaggtcagcgccacaaagttaatcaccgccgcggctgcaggcagcccggccttggcgaacagcgtcacgaaggggctggtctccgccgacacccccggccacgaggcgacagcgatgatcaccaccatcgacagcagatagaagataataatccgcagcggcagagcattgatcgccttgggcaaaatgcgctgcggatcgcgggtctccgccgtcatggtgcccagcagctcaatgccggtaaaggagaagatcgctatctggaagccggcgaaaaagccggtgatgccgtggggcataaaggccgtcgggtcggtgagatggctgagggaggccgtcacgccgtccggggaggtccagccggtggcaatcatccagccgccggtgccgatcagggcgataatggtgatcaccttgatcagggcgaaccagaactccgcctcgccaaacattttcaccgacagcaggttaagcaggaacaggatcgccagcatgctgagggccggcatccacgccgacagttccgggaaccagtactgcatatagctcccgcagaccaccacgtcggcgatacaggtcaccacccagcttag

SEQ ID NO: 6586 - DNA, 1227 bp, Klebsiella pneumoniae
taccggaggccatcaatgcctaaatataatatttatacaaagattgaatcgaatgtttcagcagttgaccttttttacgatctgaatgtttacagaactgatgccagtaataaaaaacatatactactgtcagtggcgcaacaaccagtaacatcaaattatcaaactcagtcccatgaaacgaatgacacagaggatgggttgtctgtaatctacataatggaaatgaacttatatcgcaagcacggaggtaagttgttttctgtgctttcctcgcctgcgaaaaagatgtacacacttggtgaaatggcatcagggcaagcatattctaaaaataagcgtgaaaatgtttgttattttgagacaaaggcgcagacaaaaccggttaatgataagggtgaggataatatacatactgtgcagattacctgtcagaaaagagcgtttattgcaaaagagtatcctgtaggtagtcctgatgatcccttcgataaaaataagatagaacatcagatcctttcgaggatgaatcgcagtagttatccaaatcaaggggatactagtttgtgtgggccagcatcatttttttattgcctgttgatggatagacctgatatttataaacaagcagttaatgagctttggttgtatgggaaaactaaaataggtgcgttaaatatagttccaagcaatagttgtcggcatcctatgggggctttctatgatgcttatggagaacgagtgaaggggatcgattggataaccctcgcttctttaagggactccgaaaattccattatgagttatgacgaaattgatgaccaggcttcagggataacattatggggagcgcttactgaatggtttgtaagtgctggttatcaaaaagagtttagtaatgtcgggctatcgcacgtaaatctgaaagaactaagtaccctcaatgagtatattagaaaaggttgtcgagttgttactttgatatcagctggtatacttgatggatttgactccactgtcacggctaagaatcattggattgtttgggatggacctataaccacacagtatggtgaggtcatttcattaacgactaaggaaaatgagttagttcaattgaaattattctcttggggtaaggtaaaaaatcagattaagaggcatcttgctctttcagatgtaatgggaagcatttttggaggggtggtgtttaaatcactagaatag

SEQ ID NO: 6587 - DNA, 588 bp, Klebsiella pneumoniae
gtggttaagttgatcggtaatccatttttgctttatcatcgtcacgtttcacatcaatatatcttcaataattattccttaaggaaaggaactgctatggctgatacgttccagaatgaagtccccagggcgcgcattaatctcaaattatctcttcataccggcggcgcgcaaaagaaggtcgaactgccgctgaagctgcttaccattggcgattttagtcatggtaaggaaaaccggcctttatcggaaagagaaaaaatcaacgtcaataaaaataattttaacagcgtactttcggaatttagcccggaagttaacctctcggtgccgaatacgctggccggcaatggcgaagaggagaacgtcagactgcgttttaccgacatcaaagattttgaaccggagcaggttgcccggcaaattccgcaactccgtgccatgctggcgatgcgtaatttattacgcgatctcaaatccaatctgctcgataacgccactttcagaaaagagcttgaggcaatcctgaaagatccggcgctgtcccagcaattacgcgacgaaatgagtgcgcttgccccgaaataa

SEQ ID NO: 6588 - DNA, 699 bp, Klebsiella pneumoniae
tcagacatcacgctggaggtggctatgtgcggacgttttgcgcaagcgcaaagccgggaggaatacctggcgcatctcgtggaagcggccgaacgagatattgcctgggacccggcgcctatcgggcgctataacgtcgcgcccgggacaaaagttttactcctcaatgaacgcgatgagcaactccatctcgatgccgtttactggggctatgcgccaggatggtgggataaaccgccgctgattaatgcccgggttgagactgcagcctccagcaggatgttcaagccgctgtgggagcacggacgggcgatctgcttcgccgacggctggtttgagtggaaaaaggaaggaaatacaaagcagccatactttatccagcgtaaggatggccagccaatttttatggccgcgattggtcggactccgttcgaacgtggggaccatgccgaaggattcttgatcgtgacggccgccgccgatcgcggtcttgtcgatattcatgaccgtcggccgttggtcctggcgcctgaagccgcccgggaatggatgaggcaggatgtcaccggcgcggaagcggcggagatagccagcgacggagccgtttccgccgacgattttacctggcacccggtaacgcgggcggtcggcaatgtgaaaaatcaggggcccgaattacttgcccctctcatcccatga

SEQ ID NO: 6589 - DNA, 2280 bp, Klebsiella pneumoniae
gatgaggtcacaatggcaaacggcttgaaattttctcctcgtaaaaccgcgctggcgctggccgtggcggtggtttgcgcctggcaatcaccggtcttcgctcacggtagcgaagcccacatggtaccgctggataaaacgctgcaggaattcggcgctgatgtgcagtgggatgactacgcgcaaatgttcaccctgataaaagacggcgcttacgtcaaagtaaagcccggcgccaaaacggcgatcgtcaacggtaaatcccttgacctaccggtgcctgtggtaatgaaggaaggtaaagcctgggtttccgatacctttatcaacgatgtcttccagtccggtctcgatcagaccttccaggtggaaaagcgcccgcacccgttaaactcgctctcagcggcggaaatcagtgaagcggtgaccattgtcaaagccgcgccggagtttcagccgaatacccgctttactgagatttccttacacgagccggacaaggcggcggtatgggcctttgccctgcagggaacgccggtcgatgctccccgcactgccgatgtggtgatgctcgatggcaaacacgtcattgaagccgtggttgatctgcaaaataaaaaaatcctctcctggacgccgatcaaaggcgcccacgggatggtgctgctcgatgacttcgttagcgtgcagaacatcatcaatgccagcagcgaattcgctgaggtgctgaaaaagcacggtattaccgatcctggcaaagtggtcaccaccccgctcaccgttggcttttttgatggcaaagatggcctgcagcaggatgcgcgtctgctgaaggtggtcagttatctggataccggcgacggcaactactgggcgcacccgattgaaaacctggtggcggtggtcgaccttgaagcgaagaaaatcatcaaaatcgaagaaggtccggtgatcccggtcccaatggagccccgtccgtatgatggtcgcgaccgcaacgccccggcggtgaaaccgctggagataaccgaaccggaaggcaaaaactacaccattaccggcgataccattcactggcagaactgggattttcatctgcgcctgaactcgcgcgtcgggccaatcctctcaacggtgacttacaacgataacggcacaaaacgccaggtgatgtatgaaggttccctgggcgggatgatcgtcccctacggcgacccggacgtcggctggtatttcaaagcctatctagactccggcgattatggcatgggcaccctgacctcgccgattgtacgcggtaaagatgcgccgtcaaatgcggtactgctggacgaaactatcgccgattacaccggcaaaccaaccactattccaggcgcggtcgccatattcgaacgctatgccgggcctgagtataagcacctggagatgggcaagcccaacgtcagcaccgaacgccgggagctggtggtgcgctggatcagcaccgtcggcaactacgactatatctttgactgggtgttccatgacaacggcaccatcggtatcgatgctggcgccaccggcattgaagcggtgaaaggcgtgctggcgaagaccatgcatgaccccagcgccaaagaggatacccgctacggaacgctgatcgaccataatattgtcggcaccactcaccagcacatctataacttccgcctcgacctagatgtggacggcgagaacaacaccctggtggcgatggatcctgaagtgaagccaaacaccgccggcggcccgcgcaccagtactatgcaggtgaatcagtacacaatcgatagcgagcaaaaagcggcgcagaaattcgacccgggcactatccgcctgctgagcaacaccagcaaagagaaccgcatgggcaacccggtctcataccagattatcccttacgccggcggcacgcacccggcggcgaccggcgccaaattcgccccggacgagtggatatatcatcgcctgagctttatggataaacagctgtgggtgacgcgctaccacccgacagagcgatatccggaagggaaatacccgaaccgttccgcccacgataccggcctgggccagtacgcgaaggatgatgagtcgctgactaaccacgatgacgtcgtgtggatcaccaccggcaccacccacgtggcgcgcgccgaagagtggccgatcatgccgaccgagtgggcgcacgcgctgctcaagccgtggaacttctttgacgaaacccctactctgggcgaaaagaaaaagtaa

SEQ ID NO: 6590 - DNA, 759 bp, Klebsiella pneumoniae
actttgcccaccgttgattatttctctcccgtatatttcatcgacaaaactgtggggttagtgatgtttaagcgtttctttattacaggtacagacacctctgtcgggaagacagtggtttcccgtgcgctgttgcaggcacttgctgccagaggcaaaagcgtggccgggtataagcctgtggcgaagggcagcaaagagacgccggacggtttacgtaacaaagatgcgctggtgttgcagagcgtctccacgctggcgttaccttatgaggctgtcaaccccatcgccttaagcgaagacgagagcagcgtggcgcatagctgcccgatcaactacggtctgctgtccgatggtttgcagcgtctggccgcgcaggtcgaacacgtggtggttgaaggcaccggcggctggcgcagcctgatgaacgacctgcggccgctctccgagtgggtggttcaggagcagctcccagtgctgatggtggtggggatccaggaggggtgcatcaaccatgcgctactgacagcccaggcgatcgccaatgacggtttaccgctgattggctgggtggccaatcggatcaaccccggtctggcgcactacgccgaaatcatcgatgtcctcagcaaaaagctgccggcgccgctgatcggcgagctgccttatctgccgcgcgccgaacagcgtgagctgagccgctacgtcgacttagacatgctcggcaacgtgatggcgatagatcgaatcccggcgtaa

SEQ ID NO: 6591 - DNA, 267 bp, Klebsiella pneumoniae
tgctggcccacacaaactagtatccccttgatttggataactactgcgattcatcctcgaaaggatctgatgttctatcttatttttatcgaagggatcatcaggactacctacaggatactcttttgcaataaacgctcttttctgacaggtaatctgcacagtatgtatattatcctcacccttatcattaaccggttttgtctgcgcctttgtctcaaaataacaaacattttcacgcttatttttagaatatgcttgccctga

SEQ ID NO: 6592 - DNA, 393 bp, Klebsiella pneumoniae
tatgcccggttatccgggcttttctattcaggagctgaaatgcaacttactctcgatacgttaaaagaaaccggtgcctttaccgggcgtcccgtggaaaaagaaattaagtggaaaggccgtgacgggaaagagcatatcgcaaccgtctatgtgcgcccgatgggctaccacaccactaaagctgaactgctggcgtataacgggaaatcggacccgattgctgagcgcattgcggcgcatatctgcgatcaggacggcgccccggtgtttaccgcggctgacattcttgggactgctaccccggatcgtggggcgctggacggtccgattgttatggccctcctggctgcaattcatgatgtaaacgaactgggaaagactacgagctaa

SEQ ID NO: 6593 - DNA, 435 bp, Klebsiella pneumoniae
tggagaagcaccatgagcaatgatccgtggcgcaacgcgcgcgtgatgtacgaaaaagatacctgcgccagaaagatggggatcgaacttatcgaaatggacgacggttttgcgcagatgagtatgaccgtctcggcggacatgcttaacggccatcaaacctgtcacggcggtcagctatttacgctcgccgataccgctttcgcttatgcctgtaacagccaggggctggcggcggtggcctcggcggcaagcattgattttcttcgtccggcgtttgccggcgaccggctggtcgccaccgccagagtcaaacagcagggcaagctgaccggcgtctacgacatcgaaattgttaatcaacagcaaaagattgtggccctgttccgcggcaaatcgcaccgcatcggcggcacaatcacgggagacgtgtaa

SEQ ID NO: 6594 - DNA, 621 bp, Klebsiella pneumoniae
accatgagcacgcaatatggattctttatcgactccgctcgctgtaccggatgcaaaacctgcgagctggcctgtaaggactacaagaacctgactccggaggtcagcttccgccggatctatgagtatgccggcggcgactggcaggaggacaacggcgtctggcagcagaacgtgtttgcctattacctctccatcgcctgtaaccactgcgaagatccggcctgcaccaaggtctgtccgagcggcgcgatgcataagcgcgaagacggttttgtggtggtcaacgaagaggtatgcattggctgccgctactgccatatggcctgcccgtacggcgccccgcagtataacgccgacaaaggccatatgaccaaatgcgatggctgtcacgagcgcgtcgccgaggggaaaaagccgatctgcgtcgagtcctgcccgctgcgggcgttggatttcgggccaattgccgaactgcgcgctaagcacggccagctggccgcggtagcgccgctgccgtcggcgcactttacccggccgagtatcgttatcaaacctaacgccaatgcccggccgtgtggcgataccaccggttacctggcgaacccgaaggaggtgtga

SEQ ID NO: 6595 - DNA, 198 bp, Klebsiella pneumoniae
actggtataaccgcgacgctattttttattttccacctgattttgctgttttttgttattttcatagtgagttgttcaggtgcaacccgcctgtttttagatgtttcttgttatttcaaaatggttacaaatcgacgccgctatgcctcccgacaggcggcgtttatgatagcgaaagcatcctctccgctcggctga

SEQ ID NO: 6596 - DNA, 957 bp, Klebsiella pneumoniae
tatgttgtaactaaggtggtaataatggccagctacgacctcgttgaacgtctgaataatacctttcgccagatcgagctggagctgcaggcgctccagcaggcgttaagtgactgccgtctgctggcgggccgggtatttgaactgccggcgatcggtaaggatgccgagcacgatccgctggccactattccggtggtgcagcacatcggcaagacggccctggcgcgcgccctgcgccactacagccatctgtttatccagcagcaatcggaaaaccgcagcagcaaggccgccgtacgcctgccgggggctatctgcctgcaggttaccgccgcggagcagcaggatctgctggcgcgtattcagcatatcaatgccctgaaggccaccttcgagaagatcgtcaccgtcgactccggcctgccccccaccgcccgttttgagtgggtacaccgtcatttgccggggttgatcaccctaagcgcctaccgcacgctgacgcccctcgtcgacccgagcaccatccgcttcggctgggccaataagcacgtcatcaagaatctgacccgcgaccaggtgttgatgatgctggagaaaagcctgcaagcgccgcgggcggtgccgccgtggacccgggagcagtggcagagcaaactggaaagggagtatcaggatatcgccgccctgccgcagcgggcgcggctgaaaataaaacgaccggtgaaagtccagccgatcgcccgcgtctggtacgccggcgagcagaaacaggtacagtacgcctgccccagcccgctgatcgccctgatgtccggcagccggggggtcagcgtaccggatattggcgagctgctgaactatgatgccgacaatgtgcagtatcgctacaaaccggaggcgcagtcgctgagattgcttatcccgcgcctgcacctctggctggctagcgaatag

SEQ ID NO: 6597 - DNA, 678 bp, Klebsiella pneumoniae
agtcaggtaacttcggcgatatccagttctttgcccgtgcccagcaggagtttcgtcatgactgagcaacaactgcgagaggaaatggtgcagattggcgcctcgttgtttagccgcggctatgccaccggctccgctggcaatctgtcgctgctgctgccggacggcaacctgctggcgacgccgaccggcgcctgcctcggcgaactgcaggctcagcggttgtcggtggtgacgctgcaaggggaatggatctccggcgacaaaccgtcgaaagaggtcacttttcaccgggcggtctatttgcacaacccggcctgcaaggcgatcgtccacttgcacagccactatctgaccgcgctctcctgcctgcagggactcgatccgcacaactgtatccgcccctttaccccctatgtggtgatgcgcgtcggcgacgtcccggtggttccctactaccggccgggcgatgaccgtattgcccaggcgctggccgggctggcgccccgctataacgcctttttactggccaaccacggaccggtggttactggctcatcgctgcgcgaagccaccaacaataccgaggaactggaagagaccgcacggctgatatttaccctcggcaaccgcgagatccgctacctgaccgctgacgaagtgaaagaactgagataa

SEQ ID NO: 6598 - DNA, 387 bp, Klebsiella pneumoniae
tcagcttcaacctccaccgctccggcggtttttttatgcccgcagttcgctgcgggccagggaaaatacatgagcacaacgattgagatgttgcgggcgcagtgtcggatcgatattgacgatgcaaccgaagatgaactgctgacgctgtatttcacagctgctcggcgtcgcgcagagaacttcattaatcgcaaactgcatgaagactctgtgcctgataccgatccagacgggttaaaaattgctgacgatatcctcctggcgctgatgcttcttgttgggcattggttcaacagcagggaagaagcttccgatgtaaataaaatgagcatccccttcggcttcacttcgttgcttgaaccctaccgatatatcccactttga

SEQ ID NO: 6599 - DNA, 387 bp, Klebsiella pneumoniae
agcctgaaaacacaggacttttgcatgatgaaatacgttgtacttttggcactctcactgttcacttctctctctggctgggctttttccctcgacaacgccgatattcgactcctctgtccgcagcgcgggcaaatcaaggtgatccttcatcgctatgaacatacccagcaatcctgggggcagcatcactttgaaaccggcggcggccacgttcgccaggggccgctgctggtgatcccgtttgccaacctcgatcagatgatttaccaccagaccaccggcgagtttgcttactggtatgccgaaacggaaaaactggtgcgctgtcggctgctgagtctgacgaccacctatccggtagacattccttattatcgtgagtag

SEQ ID NO: 6600 - DNA, 621 bp, Klebsiella pneumoniae
aaaaaggaaacacccatgagcaaagtattagttctgaaatccagtattctggcagggtactcacaatctggtcagctttccgactattttgttgaacaatggcaggaaaaacaccctggcgatgagatcaccgtgcgtgacctggccgccaatccgatcccggttctggatggcgaactggttggcgccctgcgtccgagcgacgcgccgctgactccgcgtcagcaggaagcgctggccctttccgacgagctgatcgccgaactgaaaggcaacgatgtgattgttatcgctgcgccgatgtacaacttcaacatcccgacgcagttgaaaaactatttcgacctggtggctcgcgccggcgtcaccttccgctacaccgagaaagggccggaaggtctggtaaccggtaaacgcgcggtcgtcgttaccagccgcggcggtatccataaagatactccgaccgacctggtcaccccgtacctgtccaccttcctcggcttcatcggcatcaccgacgtgaactttgtgttcgccgaaggtatcgcttacggcccggaagtcgcggccaaagcgcagtctgacgcgaaagcggccatcgacagcgtggttgcagcctaa

SEQ ID NO: 6601 - DNA, 327 bp, Klebsiella pneumoniae
tgtaaacgaactgggaaagactacgagctaaccggcgaggatgaattctggtgcgaactggtgatgaacggcatcggcggccgcaccatcgcagaggctcaggagcggatgagtcgcagggaatttctggtttggctcaagtaccgtgagaagtacggaccgctcaatatcatgatgcgtaccgagtggggggcttcgctggtggcttctgttctggctaacatcaataaggcaaaaaacacgccgccgttcaaggtaagtgactttgcaccgcacatcaacgaagcgccattatctctggaagaagctatgaaaagttggcattga

SEQ ID NO: 6602 - DNA, 2547 bp, Klebsiella pneumoniae
tggcgtttgacgaggggacaatatccgatgagtagcgtgaaatcgttgttgttcagccataaccaccacctgctttcggtgaagggatgtgaagccgggcttgatgtgctggccttcgagggcgatgaagccctgagccagccgttccgctaccgtattgaattcaccagcgcagaccatgccatcagcaaagagatgatgctgatgaaggcagcctccctgacgctgcaggcgccggtggctcagggcttcggcatcaatgttcagcaacccgtgcgggtgatccagggtgtggtgacggggtttgaacggctcagtacctccagggatgaaacgcactacgcgctgacgcttcagccgcgcctggcgctgcttaaccgctcgcaccagaacgccatttaccaggaccagtccgttccgcagattgtggaaaaaatcctccgcgagcgccacggcctgcgcggtcaggattttctgttctcgctgacaaaaacgtatccgcgacgcgagcaggtgatgcagtacggcgaggatgacctgcgctttatcacccggctgctgggtgaggtggggatctggtttcgctttaccaccgacacgcggctgcacatcgacgtcgctgagttctgcgacagtcagcagggctatgagaaggggctgacgttgccttcggtcccgccgtcagggcagcagtcggccggggtggacggggtgtgggagatggcatgccgccaccgcgtcgtggagcagcaggtcagtacccgcgactacaactaccgcgaggcgacggcggacatgaacgcgcaggtggatgtcacccgcggggagaccaccacctttggtgaggcttaccactggggagataactacctgaccgcggggaatgtccatgaccgccatccggcgccggagtccgggtcgttttacgcccggcttcgccatgagcgttatctgaacggccagacccggatgcaggccaccaccagctgcccgacgctctgcccgggacaggtgctgaaggtcaccggcggagaggaggtggccggggagtttgctgatggcgtgctcgtcacggcgatgcacagccacgcccggcgcgatgccgactttgcggtggagtttgccggcataccggacagcccggacgtcggctaccggcctgagcccggcgcgcgtccggtgatggccgggacgctgccggcccgcgtgaccagcacccgggaaaacgacacctacgggcatatcgacaaacacgggcgctaccgggtgaatatgctgtttgaccgggcgcgctgggaaaccgggttcgagagcctgtgggtccgccagtcgcggccgtatgccggagacacctacggtctgcacctgccgctgctggcggggacggaggtggcgattggctttgaggatggtaaccccgaccggccgtatatcgcgggcgtgctgcacgactcggcgcacggcgaccacgtcaccatccgcaatgacaaacgtaacgtcctgcgcaccccggccaacaacaaaatccgcctcgacgacgagcgcggaaaagagcatatcaagctctcgacggagtacggcggtaagagccagctgaatctggggcacctggtggacagtgacaggcggccgcgcggcgaaggctttgagctgagaaccgacagccggggcgctatccgggcacagaaagggatatttatcagcgcggacggacaggcgcaggcccgggggcaggtgctggatatggagccggcggtcagcaatctggccgaagcccgggagcagatgatgtccatctccggtgacgcgcagaaggcgaccgcgaacccggccgatctccaggcgcaaattaccctgctggagcagcagctgacagacctcaaaaaatcggtactgctggtcagcgcgccggaggggatagcgctgaccagcggggagcatctgcaggtctcagccgggcataacctgattgccacggccggaaagaatgcggatgtcagcgtggtgaaaaatctgttcatcggggtgggcagtgccctgagcgtgtttgttcgcaagcttgggatcaggctgatagcgaaccagggaccggtacagatgcaggcgcagaatgacctgatggcgttgcttgcccggaaggaaatcagcattgtcagcacggaagacagtatcgaaattattgcgaaaaaacgggtcacaataaacggcgggggaagctatatcacgctcaatgccagtggcattgaatcagcgacggcaggtgagtacagaacaagggccgggtattacgtcaggcgggaaaaagcgcagcataagcctgacattgcacctttagctaatgcgataaatgacggcagccataatattcgctacctgtgtacagatgataatgggatgccgatgctgaatacaccttacagggcctttctggctgatggctcggtattagagggtgtcagtgatggcgaggggtatacgaagttgtttacttctgcacaggtacaggatgttctgctgcatatgataccggaggccatcaatgcctaa

SEQ ID NO: 6603 - DNA, 237 bp, Klebsiella pneumoniae
ggcgccatgacagcagatcagattatcgaggggatcctcggcaaagaaggcggttatgtcgatcatccgtcggataaaggcgggccgacccgctggggcatcacgcaaaccaccgcccgtgcacatggctacaccggtgatatgcgaaacctgcccagggaaacagcaaagcaaatcctgctgagcgattactggaccggaccccggtttgaccaggtggcagctctatctacgtga

SEQ ID NO: 6604 - DNA, 294 bp, Klebsiella pneumoniae
acccgctcgacgcagttacacacctgcccggagttaatcacccgcgagtccactaccgctttcaccgccagctccagatccgcatcgtccattacaatggcaggcgctttgccgccgagctcgaggcacactttggtgatatttttcgccgcagcggccataattttttctcccgccgccacgctgccggtcatgctgaccatcgccaccttcggattgccggccagctcctggccaacggtttctccgcggccaagcacaaggttaaagacccctttcggcaacccaacctga

SEQ ID NO: 6605 - DNA, 3570 bp, Klebsiella pneumoniae
aatcgcccgacaaacacaatccccgcagatgattatctgcggggataccactcagaaagtgctatggagcacgcttattaccccgatagcttcaagacaggagatggatctgtgaagttacttttagcaccgaaaactacggaaggtcgctatctttcagtcgtattcattctctttttactcttggctgcaatgacatttatcgtctggaaacatcctgacatggccggacttgagggcgatagtcagcagcagaattactggcttattggtgggtgctgcattaccggatgtatctttatcatgttagttatgctcctctggacagctcgcagtgccggtaaaaaggagtttgaggcgctcctggatgtcactcgtggtgatgacaataagagaaaagatgagagtgaaaacatctctgtttctccagcagtggtgatgtgtgccaggattcgtgaccatctgcgaacccgaattggaattcactggcggcgcaaagtccgcctgcttttagtcaccggcgacgaggcggcaatcgaacaactggtgcctggtctgcgccagcagcgctggctggagggccagcgtaccgttctgatttacggcggcagtctgctctccgaacccgatagtcagcaatacgccgcgctgcgcaagctgcgccgtggccgtcctctggacgggattgtgcgggtgatgccgtcgtctctcaccctgacgccgctgataagcgagagcgacctgcacgggctggaaaaaatcagcgaactgctgggctatgccgccccggtctggttatggaaactgtgcgacagtgagtggccgcaggctgaccgcgcggtgcaggcggtaggggttagcttcccgttgcgcgctactgaggacgatgtcgcccgtcagcttgcgcaaatgctgcccacgctgcgggagcaggggatgcaccagatcgcggaggagacccgccacgacttcctgctgcgtctggggcagcagcttatcgacggggagatcgcacaatggcgccggcagctggcgccgtggctgaccgcctcgcggcagcggcttgcgctgcgaggcctgatgtttagcctgccagaacctcgcgccgtggatccgtatcaggaagctgatacctcgcctgcgggccagcctcatctcctgacgctgcccgcgacctggcaggggatcgtcgatgactgccgccgtttacgcgggcatcacgtgggaatggcgtgggagcggggcctggcgtgcggtctgctggcgatcctcggcctgtgggcggcgggattgctgctctcctttgccctcaattacagtcagattgcttcggtagcgggaaaagcccgcgacctggtggcccacccctccgtttctgactatcaactgacggccctccatgccctgcgcaatgaggccggccgtctcgtgcacgatgggcagaagggagcaccctggtatcggcgctttggtctggaccatcatcagcaactattaaacgccgtcctaccctggtacggtgtggcaaatcatcgcctgatacgtgacccggccaatgccgcgttgcagcaggcgctcaacgcgctggtcaactccgcccccaatagcgaccaacgagccaggctggcgaaaccgggctatgaccagctgaaagcctggctgatgatggctcgtccggataaagccgatggcgcatttttcgcgcagaccatgaaaacggtccagccgacgcgaatggggatctcgaccggtctgtggcaaagtctggcgccggatttgtgggccttttatctctccctgctgcccgagcggccagagtggaagatcatcccggatgcgcaacgggtgagtcagagccgtcaggttctgttgcagcagctaggtcgccgcaatgccgaaagcaccttatatgagaacatgctcaaatccgtgcgtcgtaattttgccgatgtgtcgctggaagacatgaccagtggcaccgacgcgcgccgcctgtttaccaccgatgaagtggtcccggggatgtttacccgccaggcatgggaaggcggcattcagcaggccattgataaggcagccagctcgcgccgggaggaaatcgactgggtgctgagcgattcgcgcaaaacggtgtcgacagacctgtcgccggaggcgctgaaagcgcgtctgacccgacgctacttcaccgatttcgccggcagctggctgaattttctcaacagtctgcgacttaatccggcgaccaatatcgccgatgttaccgaccagctcacgctgattagcgatgtccgccagtcgccgctgattgccctgatgaatacccttgcctggcaggggcaggcggggcaacaaagggaggggctgtcggacagccttattaaatcggccaaagatctggtgggcgggaaagacaagccggtcatcgaccagtcggccgccggcccgcaggggcctctggatgacacgttcggcccactgctccagctgatggggaaaaacacgggcagcaacgtcatgtcggccgatagcaccctgagcctgcaaacctatctgacccgtatcacccgcgtgcgcctgcgcctgcagcaggttgcgaatgcctccgatccgcaggagatgatgcagaccctggcgcagaccgtcttccaggggaaaagcgtcgacctgaccgacacgcaacagtacggtagcctgatttcggcaagccttggcgaagagtggagtggcttcggtaatactctgtttgtgcagccgctgactcaggcctgggaaaccgtgcttctgccgtcggcggccagtctgaatgacaaatggcgccgatcggtggtcgccaactggcacaccgcctttgacggacgctttccgtttgccgccagcaaaagcgacgcctccctgccgatgctggctgagtttgtgcgcaaagacagcgggcgaatcgaacgttttctcacgacggagctgaacggtgtcctgcataaagaaggcagtcagtgggtgccggataaggtcaacagtcacggcctggtctttaatccggcctttctgcgcgcgatcaaccagctaagccagctgtccgacattcttttcaccgacggcagccaggggatcagctttgagttacaggccaggcctgccccggaggttgtcgagacacagctgacgatagacggccaaaagctgcgctatttcaatcagatggccgactggcagactttccgctggccgggggagacgtataaacccggcactctgctgacctggaccaccgtcaatgcgggcacgcgtctgttcggtgactacagcggtacctggggctttattcgctggctggagcagggtaaacgccatccgctggatcgcagccagtggatgatgagcttctccgccccggatggccgcaccctgcagtgggtattgcgctcccagcttgggagcggcccgttggcgcttctggcgctgcgcggattgaccctgccggatcagattttcactgtcgatgcggctgagagcgcacagaccctgacgacggggttagggaatagtgacatggatgagatggaattatga

SEQ ID NO: 6606 - DNA, 906 bp, Klebsiella pneumoniae
ttatccacgacttcggcgccacgccgggcgtcgcccgtattcgtattgaacaggtttttgaggaggccgctcatgcgtaacgatcgcagctttatcgaactgcgcgctcgcgaacgcgcccacgccctgctggacgacggcagctaccgcgaactgctggatccgtttgacggtattatgtcgccgtggctcggcgcccagggcatcgtcccgcaatccgatgacggtatggtggtcgccaaaggcacgatcaacggccagcctgcggtggtgattgccatcgagggcaccttccagggcggcagtatgggcgaagtgtccggcgccaaaatggccgccgcgctggagctggcggcggaagataaccgcaacggtatcccgacgcaggcggtgctgtgcctcgaaaccggcggcgtacgtctgcaggaggccaacctcggtctggccgccatcgccgatattcacgccgcgattgtcgacctgcgccgctacaccccagtggtcggcatcatcgccggcaccgtcggctgctttggcggtatgtctatcgccgccgcgctgtgcagttaccttatcgtcactcgtgaagcccgtctcggtctcaacggcccgcaggttatcgagcaggaagccggcattgaagagtacgactcccgcaaccggccgtttatctggagcatgaccggcggcgaaattcgcgccgccagcggactggtcgacgcgctggttaacgatggcgttaacgccgttaaaaccgcaatgaatgaggcgatcgccaaaggcgtaccggtacagcaccgcagcgacaactatgacgattatctgcgtcgcttgagccagttcgacacccgccagcaggcggataccgcgcagattaaacagctttttgcccgggaggataaataa

SEQ ID NO: 6607 - DNA, 1425 bp, Klebsiella pneumoniae
atgatgacgacatccttagtcaacgtggcggtgatcggcagcggcaccatgggggccggcatcgccgaagtggctgccgccgccgggcatccggtgcgtatttttgatattaaccctaaggctgtagacctggcgatagagggtatcgccgggcgtctggcgtcacgcgttgcgcggggcaaactggcgtcagagcaggccgacgcgctgctggcgcgcctgcatccggcccacgatttagccgcacttgccgatgcagatttagtgatcgaagcggcctctgaacggctggaggtcaaaacggcgctgttcgcgcagctggcggcgatctgcgcgccgtcaacgctgttgaccagtaatacctcgtctatttcgattaccgctatcgccgccggggtcaaaaacccggagcgggtggccggactgcacttttttaatccggcgccggtgatgaagctggtcgaggtggtgagtggtcttgcgacctccacagaagtggtggagcagctgtgccagtgcgtaagcggctgggggaaacagccggtgcgctgccgctcaacgcccggttttatcgttaaccgcgtagcgcgtccgttctacgctgaggcctggcgcgcgctggaagagcaggtcgccgccccggaggttatcgatgccgctttgcgtgacggcggcggcttcccgatgggaccgctggcgctgactgacctgattggccaggacgtcaacttcgccgtgacctgttcggtgtttaacgccttctggcaggaccgccgctacctgccatcgctcctccagcaagagctggcgctggccgggcggctaggtaaaaagagcggccacggcgtctatcgctggcccgctgagacactgccggacgcggcgctgccgccggtaatgataggtgctgaatccgttaccgtcagaagtgacaacgtcactgaattagacgatgtcttgctgctggagactgaaggcgagaccgccctggcgctgagtattaagcatcaccgcccggtggtggtgtatgacctgtgcgccagcgatacggtggtgctggccgcagcggcaaccaacgcgcctgcggccactgataaggccgtgcattacttccagcagcagggcaagaaagtgctgcgtattgccgattatcccggcctgctggtgtggcgaacggtggcgatgctgattaacgaagcgctggatgcggtacaaaaaggcgtcgccagcccgcaggatgtcgataccgcgatgcgccttggcgtcaactatccgcatggcccgctggcatggggagaacgccttggctggcggcgggtgctgcaactgctggagaacctgcaacaccattatggcgaggagcgctatcgccccagttccctgctgcgccagaaggcgctgatggagaagcaccatgagcaatga

SEQ ID NO: 6608 - DNA, 1650 bp, Klebsiella pneumoniae
ccacttaagacaggctactcctggccaacgctgaccggcatcgcggcacgcaccgaccataataaccgccggcagtacgggagcaggcctgcccaacacaacaacgacaacagaggaatgcccatgagtatgtcatccataccgtcatcttcccccggcggaaagcgctatggctgggtagagaagatcggtaacaaggtcccgcacccgtttttgctgtttatctatctcatcgccgtgctgatcgctgccacggcaatcctctccgccctcaacgttggggtacaaaacccaactgacggttcgcgggtggtggtcaaaaacctgctcagcgtggaaggattgcactggtttttgccgaacgtgattaaaaacttcagcggtttcgcgccgctgggggcgatcctcgccctggtgctgggcgccggctttgccgagcgggtgggcctgttaccggcgttgatggtcaagatggcctcgcacgtcagcgcccgctatgccagctatatggtgctgtttatcgcctttttcagccatatctcttccgatgcggcgctggtgattatgccgccgctgggagcgctgatgtttcttgccgtcggtcggcatcctgtcgctggtctgctggcggcgatagccggcgtgggctgcggctttaccgccaatctactgattgtcaccaccgacgtgctgctctccgggatcagcaccgaggcggcaaagtccatcgatgcctctttgcacgtcagcgtgatcgacaactggtactttatggcgacctcggtgatcgttctgacgctcgtcggcggactgatcaccgataagctggtcgagccgcggctgggccagtggcaaggcagtcgtgatgaaaagctgcagacgctgacgcccggggagcggttcggcctgcgcatcgccggcgtggcgacgctggtattcgtggcggtcatcgccctgatggtggtccccgaaaacggtattcttcgcgatccggttcagcatacggtcatgccctcgccgtttatcaaaggcatcgtgccgctaattatctttttcttctttgtcgtgtcgctggcatacggcatcgccaccggcaaaattcgccgccaggccgacctgccgcagttgatgattgagccgatgaaagagatggccgggtttatcgtgatggtcttcccgctggcgcagttcgtggcgatgttcaactggagcaacatgggcaagtttatggccgtcggtctgacggacctgctggagagttcaggcatgaacggtgttccggcgtttgtcggccttgcgctgctgtcggcttttctgtgtatgtttatcgccagcggctcggccatctggtcgattctggcgccgatcttcgtgccaatgtttatgctgttgggctttcacccggcgtttgcgcagatcctgtttcgtatcgctgattcatcggtgctgccgctggcgccggtgtcaccgtttgtgccgttgtttctcggctttctacagcgctaccggccggatgcccgcctcggcacctactattcgctggtgctcccttacccgctgatttttctcgccgtctggctgctgttgctggtgggctggtatctggtgggactgccgatcggccctggcatctatccgcggctgtcttaa

SEQ ID NO: 6609 - DNA, 369 bp, Klebsiella pneumoniae
tcgttaaggaccgctgtgttagccactctcctcgttgcgctggtcgctattattcatctcgccatcctggtgctggagatgtttctctgggaaggctccgccgggcgccgggcctttaacctcagcgccgatttcgcccggcagacccgggtgctggcggccaaccagggcttgtataacggctttctggccgccggcctggcatgggggctgtggctgggggcgccgggggtgcaggtggttatctttttcctggcctgcgtgctggccgccgggattttcggcgcgctgaccgccagccgcaaaattctctatattcaggcgctgcccgcgctgctggcgctggttgccgtgctgacgcaagcgtag

SEQ ID NO: 6610 - DNA, 219 bp, Klebsiella pneumoniae
gcgacaaggactaacaccgctataaataaagaaatacccgttaacgtttttgtttttttcaaaatgattcgtcacttttttctggattatctgtattccagcaccaatgattttctcttgagtgaggaaggtgcgcgccaggtgttgtttctaaaacgcaaagaatattatctgccgtcaacgtctcagcaaatttcccatgttcataaaatagattaa

SEQ ID NO: 6611 - DNA, 1128 bp, Klebsiella pneumoniae
cggcgtggtgcaagcgtcgcgggcgtcagcacggcattccgacgccgctcagcgatatcatcgtgccgctgctggcggcggccagcgacggcccgggctgacccgggctggcgcgggtgcgagccactggaagcgggatctgctatgatcccgactttcgttgtctggagccagtcgatgttcaacgacgccattgtttatgaccgctacgggccgccggccgccgtgctgaccctgaaacgcctgccgctggcgccgctggcgggcggacgggtgcgggtcaggatgcgctttgccccggtgaatccttcggatctgatccccgtgaccggcgcctatcgccaccgcacccgactgccggccgtcgccggctatgaaggccttggcgaggtggtcgccgcgccatacggcagccggttggccgcgggccagcgggtgctgcccctgcgcgggggcggcacctggcagcggtttatcgatctggatgagacctggctggtgccggtgccgccggcggttgacgatctgctggccgcccgcgggtatatcaatccgctgaccgcgatgctgatgctcaagcgctggccggttgccggaagacacctcgtgctgaccgcggcatcatcctcctgcgccagtctgctgggacagtgggcgctggcgatgggcgcccgctcggtgagcgggattattcgctcgccgcagcatcgggcgcgcctggaacaggccgggatctatccgatcctcgataccgaccgggcgctgatggagaaggtcagccagcacagcgatctggtgtttgacgcggtgggcggcgaactggcgaatacgctgctgtcggtgctgtccgcatcgtcgaccctgatctcctatgggctgttatccgggcggccgctgacccagacgcgcggtagcgcgacggtgcgcaagtttcatctgcgggaggcgctgccgacactcagcgtggcggcgtggcgggcagcgttcgacgaaatctggcagcgcctgccgacgacctcccagccgccggcccagcgtatagcgttgaacgactggcgggcggcgattgccgccgccggccagccgggaagaggcggtaagatcctgctggatttcaccgccggttaa

SEQ ID NO: 6612 - DNA, 1215 bp, Klebsiella pneumoniae
tccccctccgctacggagggggcgctcgctaaggaagctccaatgtttgattttgccacccctatcgatcgccacggcacctggtgcacgcaatgggactatgtcgccgaccggtttggcgccgccgatctgctgccgttcactatttccgatatggatttcgccaccgcgccctgtattctcgacgccgtcagccagcggctggcccacggggtgttcggctacagccgctggcgcaacgaggcgtttctcggggcgattgcccactggtacgccagccgctttaacagcgacatcgatccgcaatctgtggtctacggaccgtcggttatctatatggtggcggaaaccatccgccagtggtcgaaagaaggcgacggcatcgtggtccacacccctgcctacgatgcgttctataacaccatcaccgctaaccggcggcggattgccccggtgccattgatcctgaaggataatcggtggcgctgcgatatggagcgcctggaggcggcgctggcggagccaaagaataccctgctgctgctgtgcagcccgcacaacccaacggggaaagtctggcgtcgcgaggagctggagaccatggcggccctgtgtcaaaaacatggcgtcagggtgattagcgacgaaattcatatggacatgacctggggcgaacaccgccatatcccgtggagcgaggtcgctcagggaccatgggcgctgttcacctccggttcgaagagcttcaatattccggcctttaccggggcctacggctttatccccgaagagaacgagcgcgacagctacctgcaggcgctaaagggtcgcgacgggctctcttccccttccgtgccggcgctggtcgcccatatcgccgcctaccgcgacggggctccctggctcgatgccctgcgcgactacctgcaggcgaatatgcgctatgtcgccgacacgctcaacaacgccttccccgcgctctgctggcagccgccggaggccacctacctggcatggatcgacctgcgcccgctcaacgttgacgatcgcgcgctacagcaggcgctgatcgccgaacagaaggtggcgattatgccgggttatacctatggtcctgagggcaacggctttctgcgtctcaacgtcggctgcccgcgcgagaagctggaacgcggtgtcgaaggactgattgccgccctgcgcagcctcagctga

SEQ ID NO: 6613 - DNA, 549 bp, Klebsiella pneumoniae
gtctgctatttctttcaatttcggcgaggaggaagaatgactgacgagatcgatagcgacgcaaacaatacgcatgaactaaccgctgaagtggctcgggcgctgatcgcgcgcggttggcgactgaccacggcggagtcctgcaccggagggaatctggcggcagcgctctgtgcccaggcggataccgcggcattttatgataccggcgtagtgaccttcagcgatgaagccaagcgcaacgtgctgcaggttcgcgcggaaaccctggcggtacacagcgccgtcagcgaagcctgcgttcaggagatgtcctctggtattctggcgctcgccggggccgatatcgctatcgccgtcagcggctacgccggaccggagggcggggaagatggtacccccgcaggcacggtatggtttgcctggaattttcgcggccagactgaaaccaaacggatgtgctttgccggcgactgtgagacggtggtggcgaaagcggtacgatatgccctggcggcgctgagcgaaaagcttgcccactggcagtga

SEQ ID NO: 6614 - DNA, 1311 bp, Klebsiella pneumoniae
aatccttgcgctggccaagtcgctgccagccgacctggtgatcatcgcttcgcaccgaccggatatcacaacttatctgctgggctccaacgccgccgcggtggttcgtcacgccgagtgctcggtactggtggtccgctaacgccgcagcccgccgcccggcgggctttttatttccgcatcagccgcccccgcctggctgctcgctgccgaaagtgccggaaagatgctgacattccgcccctgaatccgtaccatacacgccacggttgcctgtcaaacctcaataattgctacgcgtcagcgccacgttgttcagcggctggcagaatgcgtgctcttctgatgccacactatgaattgagccactattacatgctgcaaaaccaagaaatcagtaaaaaagaaaagtacaacatcgataagctgcagaaacgtctgcgccgcaacgtcggtgaggcgattgccgacttcaatatgattgaagagggcgaccgcattatggtttgtctttcaggcggcaaggacagctataccatgctggagatcctgcgcaatctgcagaaaagcgcgcccatctccttctcgctggtggcggtgaacctcgatcagaagcagccagggttcccggagcatattctgccggcgtatctggagcagctgggggttgaatacaagattgtcgaagagaacacctacggcatcgtcaaagagaagatcccggaaggaaaaaccacctgctcgctgtgctctcgcctgcgtcgcggcatcctctatcgtaccgccaccgagctcggggcgaccaagatcgccctcggccatcatcgcgacgatatcctgcagacgctgtttttgaatatgttctacggcggcaaaatgaaagggatgccgccgaagctgatgagcgacgacggcaaacacatcgtcatccgcccgctggcctactgccgggaaaaggacatcgagcgcttctcccaggccaaaggcttcccgattattccgtgcaacctgtgcggttcgcagccaaacctgcagcgccaggtgatcgccgatatgctccgcgactgggacaagcgttatcctgggcgcattgaaaccatgttcagcgcgatgcagaacgtggtgccttcgcacctgagcgacgtcaatctgtttgattttaaaggcatcacccacggctcagaggtggtggatggtggcgatctggcgtttgaccgggaagatattcccctgcagcccgccggctggcagccggaagaagaagacgcccgtctcgatgagctgcgtctgaacgtggtggaagtgaaataa

SEQ ID NO: 6615 - DNA, 444 bp, Klebsiella pneumoniae
atttttcgcgccatcccccgttctccgccgagcagttcactggcgcggttggccagcacctcgttcatattcatattgctttgggtgccggagccggtctgccagatagccagtgggaactcctgcgcgtgctttccggccagcacttcgtcagcggcggcgacgatcgccccggctttctccgccgtcaacagtccgagatcctggttaaccttcgccgccgcccgcttggtcagcgccagggcgtatatcagctccccgggcattttttcggtcgagatgcggaaatgctccagcgagcgctgggtctgggcgccccagagtttatcggccgggacctcgatggcgcccatcgagtctttttcactgcgatgcgttgtcattactttctccttggatgaaaagtgcgtcatagcgacaaagctcacctgcttaaaagactaa

SEQ ID NO: 6616 - DNA, 657 bp, Klebsiella pneumoniae
aacggacgcgctacgcggttaacgataaaaccgggcgttgagcggcagcgcaccggctgtttcccccagccgcttacgcactggcacagctgctccaccacttctgtggaggtcgcaagaccactcaccacctcgaccagcttcatcaccggcgccggattaaaaaagtgcagtccggccacccgctccgggtttttgaccccggcggcgatagcggtaatcgaaatagacgaggtattactggtcaacagcgttgacggcgcgcagatcgccgccagctgcgcgaacagcgccgttttgacctccagccgttcagaggccgcttcgatcactaaatctgcatcggcaagtgcggctaaatcgtgggccggatgcaggcgcgccagcagcgcgtcggcctgctctgacgccagtttgccccgcgcaacgcgtgacgccagacgcccggcgataccctctatcgccaggtctacagccttagggttaatatcaaaaatacgcaccggatgcccggcggcggcagccacttcggcgatgccggcccccatggtgccgctgccgatcaccgccacgttgactaaggatgtcgtcatcatctatttcccgctgaactgtggtggccgtttggccagaaacgcgctgaccccttcgcggtaa

SEQ ID NO: 6617 - DNA, 192 bp, Klebsiella pneumoniae
agtactggcgcgattgttattttttctaaaagccgtcccttcccggcgcggttattacgcgctccgggggacggcttccggcaggtttgcttctactacttacgtacgaacgtcttaccagctggcgcgcatgcgatcgcgaaccagttgcgagctgcggcggttttccgcgcccaggcggcacttcagtga

SEQ ID NO: 6618 - DNA, 279 bp, Klebsiella pneumoniae
aatcccggcgcagcatcgccaccgcccgacggatccgcgccgaatggctgtctacggcgcccagcgcccggatggccggcccatggacactctgcaacagccagtaatgcagctcccgccgcagaccttcccccagcaccgccagcgcccccggttgatcaaacagccttgccagccggtaagcggcatccgtcacatcggcgttcatcggttcgataccaacgcggggcgcctcatccggccctgacggcccggcctcctgcagctcgcgcaggatag

SEQ ID NO: 6619 - DNA, 984 bp, Klebsiella pneumoniae
ctgacggtagctgcagttgtaaggagaccctgtatggcgaagtatcagagcatgctggtagtaatcgatcctaaccaggacgaccagccggcgctaaggcgagcggtgtacctgcaccaacggattggtggacgcatcaaagcctttttgccgatctatgatttttcctatgaaatgaccaccctgctgtcgccggacgagcggacggcaatgcgccagggcgtcattgcccaacgaacggcctggatccgcgagcaggcgaaattctacctggaatcgggcgtgccgattgacgtgaaagtggtgtggcacaaccgccccttcgaagcgattattcaggaggtggtcagtgagaaacacgatctgctgctgaagatggcccaccagcacgacaaactggaggcggtgatctttaccccgacggactggcatctgctgcgtaaatgcccttgcccggtgtggatggtcaaagaccagccgtggccggaaggcggcaaagcgctggtcgccgtcaatctcgccagcgaagagaattatcacaacacccttaacgagaagctggttcgcgagacgctgtcgctggcggaagaagtcaaccacactgaagtgcacctgatcggtgcctacccggtgacgccgatcaatatcgcgatagaactgccggattttgatcccagcgtctacaacgacgcgatccgcggccagcatctgctggcgatgaaagcgctgcggcagaagtttggcatcgatgaaaaattcacccacgtcgaaaaaggactgcctgaagaggtgatcccggacctcgccgagcatctgcaggcggggatcgtggtgctgggaacggtcggacgtaccggcctgtcggcggcgttcctcggcaataccgcggaacaggttgtcgaccacctgcgctgtgacctgctggtgctgaaaccggaggcctaccagacgccggtggaactggacgacgacgacgacgattaa

SEQ ID NO: 6620 - DNA, 711 bp, Klebsiella pneumoniae
tgccattcagcaattaaggaaaataagatgaaaacacgttatcttggaaaagagaagtttcaggtttccgcattaggtctcggatgtatggggatgagttttgcctatggcggcgctgaaacgtcgcaggcgataaatacgatccatgccgccatggacatgggcgtgaccttcctggataccgccgaagtatatggtcctttcgataatgaagttctggtcggaaaagcgattaaaggttttcgcgataaggtgcagattgccaccaaatttggatttcgtattttgccgaccggccagggtctggagcggatggccggcgttgacagccgtccggcacatattcgcgaatcagtggaagggtcgctgaagcgactgaatgtcgagaccatcgatctgctctatcagcaccgcgtcgatcccgcggtaccggtggaagaggtggtgggcactatggccgatctggttaaagagggtaaaattcgccatatcggtctgtcggaagtatctgctcagacgttgcgccgggcctgcaaggtacatccgatcgctgccgtgcagacggaatattcgctatggagccgcgagccggaagcccggtattctccacacctgccgcgagctgggggtcggctttgtgccatacagcccgcttggccgcggcttcctgacggggacaattaccgatcccggcgttttgtcagcggatga

SEQ ID NO: 6621 - DNA, 1272 bp, Klebsiella pneumoniae
tggggatcagcccgggtagatgccgcggtctttacgcgccatcaggatgcgctcgcaggccacgatataggcggcggtgcgcagcgtacactctttctcggcggctttatcccagacgtgcacgatagcgtcggtcataatgcggtccatcttggcgttgatctcctcttcactccagaagaagctggccatgtcctgtacccactcaaagtagctgacggtcaccccgccggcgttgcagataacgtccggcaccacgatcacgccgcgctcggccagcacgtcgtccgcttccggataggttgggccgttggccccttccagcaccagtttgcaggtcagcttctcagcgcgctcgcgggtgatttgcccttccagcgccgccgggatcaggatgtccatcggggtggtccagaaggcgtctttatcgatctcctgggcgcccgggaaaccggcaatctgctttttctccgcctgccaggcggtgagggcggccatatcgattccgccttcgttatacagggtcgcggtatgatcctgaataaccacgatacgagcgccgacgccagcgaacaggcgggccgcttcgctaccgacgttaccaaagccctgcagcgccactttggcgccttcaatttcgataccggcgcgacgggcaacttcccggccggtgacaaacactccgcgtccggtggctttttcacgaccgagggagccgccgaggtggatcggtttgccggtgaccacgccggtgatggtggtgccatggttcatggagtaggtgtccatcatccatgccatcactttgccattggtgccgacgtccggcgccggaatatctttctgcggcccgataataatgccgatttcgctggtgtagcggcgggtcagacgctccagttcaccttccgacaaggagaaggggtcgacgcggatgccgcctttggccccgccgtaaggaatattgaccgcggcgcacttaatggtcatccaggcagaaagtgccatgacttcgttaagatcgacatccggatggtagcgaacaccacctttacccggtccgcgcgacagattgtgctgaacgcgatagccctcgaagtggcggatggtgccgtcgtccatttgcacaggaatgtcgacgatcagcgcgcgtttcggatggcgcagggtttccacccagtaggcaagatcgccgagataaggcgcgacgcggtcgatctggcgcaggtaggtggtccatggagatgtactactttcagatgcgtaagataa

SEQ ID NO: 6622 - DNA, 621 bp, Klebsiella pneumoniae
accatgtcagcaacgccgcgtccccatgatctagtttggttaaaccacgccagcgccctggaagatattgccgagccgtgggtggctcagcagtggcgagccgcgctgccggtactggtgaggcgcgacgttgacgaccaggcccgcgtcccggttggggtgcggggcatgaagcgcgagcagcgcgccgccggctgggtacaggcgcgcaatatcgtgcgcagcgtcaccccggagatgcttgttgatcgtgaggtcttactccattcgccttttgtctctcagccgccggtccagggggctatcgccctcaccttacaccgctggccctggggctggggcgtcaccggcagtaccggctacgcgctggcaaccgagatcccggtgctgcatgcggccagcgatctggatctgctgatccgcgcgccacagccgctggaccgcgaggcgctgctggaatggcagacccgggtggcccaactcccatgccgcgctgatacccaggtcgaaacgccgtacggcgccttcgcccttaatgaatggctgcgcgacgggcgcgcgctgctgaaaacgtcccgcggcgcgcgcttaaccgcgacgccgtggcacagggaggaataa

SEQ ID NO: 6623 - DNA, 591 bp, Klebsiella pneumoniae
ctggcgacagccgctggaggagagcccatgaaccttgatgacaaatccctgtttcttgacgccatggaagatgtccagcctctgaaacgtaacaatgacgtgcactggcatcccgggcgtaacagccgggccccgcaacgcgtcgataccctgcagctggataattttctcaccaccggctatctcgatatcgtgccgctcgccacgccgctggagtttaagcgagaagggctgcagagcggcgtgctggataagctgcggcgggggaaatacagccagcaggcgagcctctccctgctgcgccagccggtggaacagtgccggcagatgctcttcgcctttatggtacaggcgcagaaagaggggttacgcaatgtgctgatcgttcacggcaaaggccgcgacgaccagtcccacgccaatattatccgcagctatctggcgcgctggctggaagagctgccggaggtgcaggccttctgcgccgcgcttccgcatcatggcggcagcggcgcctgctatgttgcgctgcgtaaatcggcgcaggcgaagcaggagacctgggagcagcacgccaagcgcagtcgttag

SEQ ID NO: 6624 - DNA, 1674 bp, Klebsiella pneumoniae
tcagccaaagcagtaagtgagagtacaatgtcgaataaaccgtttgtttaccaggatccttttccgctcaaaaaggatgacaccgagtattatctcctcagcagtgattacgtctccgtcgccgaattcgccggccaggaagtgctaaaagttgaccctcaggcgctgacccttctggcgcagcatgctttccacgacgcctcctttatgcttcgccctgcgcatcagcagcaggtggcggatatccttaacgatccggaagccagcgaaaacgataaatacgtcgcgctgcagttcctgcgcaactcggatatcgccgccaaaggtattctgcccacctgccaggacaccggcaccgcgatcatcatgggtaaaaaaggccagcgcgtgtggaccggcggcggcgatgaagccgccctggcgcagggggtgtacaacacctatatccaggacaacctgcgctactcgcagaacgcgccgctggatatgtataaagaggttaacactggcaccaacctgccggcgcagatcgatctctatgctaccgatggcgatgagtacaaattcctctgcatcgccaagggcggcggctcggcgaacaaaacctacctgtaccaggaaaccaaagcgctgatcaccccggcgaagctgaaaaattacctcgtcgagaagatgcgcaccctcggtactgccgcctgtccaccgtaccatatcgccttcgtgatcggcggtacctcggcggaagcgacgctgaagaccgtgaagctggcgtccaccaaatactacgatggcctgccgaccgaaggtaacgagcacggccaggcgttccgcgacgtgcagctggagcaggagctgctgctggaggcgcagaaccttggtctcggcgcgcagttcggcgggaaatactttgcccacgatatccgcgtgatccgtctgccgcgtcacggcgcttcctgcccggtagggatgggggtttcctgttccgccgaccgcaacatcaaagccaagattaaccgcgacggcatctggatcgagaagctggagagcaacccggggaaatatatccctgagcatctgcgccaggccggggaaggcgaagcggtgaaggtaaatcttaaccagccgatgagcgagatcctggcgcagctgtcgcagtatccggtgtccacccgcctgtcgctgagcgggactatcatcgttgcccgcgatatcgcccacgctaagctgaaggagcttatcgacaacggcgaggcgctgccgcagtacgtcaaagatcacccgatctactacgcaggtccggccaagacgccggacggttacgcctccggctctctggggccgaccaccgcaggccgcatggactcttacgttgatctgctgcagtcccatggggcgagcaagatcatgctggcgaaaggcaaccgcagccagcaggtcaccgacgcctgccacaaacacggcggcttctacctcggcagcatcggcggcccggcggcagtgctggcccagcagagcatcaagagcctcgagtgcgtggcctatccggagctgggtatggaggctatctggaaaattgaagtggaggatttcccggcctttatcctcgttgatgataaaggcaatgacttcttccagcagatccagacctcgcagtgcgcccgctgcgtgaagtaa

SEQ ID NO: 6625 - DNA, 1470 bp, Klebsiella pneumoniae
ctttccctggcagcggggggtgtgatggaatccatttttcagtttgtggacgaggtggttgaggcacaacgcgacacttactgcgccatcgccgacgacatctgggaccacccggagacccgctttgaggagttctggtcagcccaacggctggccgacgccctggaggcggaaggttttcagctcacccgcgatgccggcgggatcccgaatgcctttatcgccagcgtcggtgagggccaaccggtcattgccctgctcggcgaatttgacgccctggcgggactcagccagcaggcccacagcgcggaaccgacgcccttgacaccgggagccaacggccacggctgtgggcacaatctgctcggcaccgcggcattcgccgcggcggtcgccgccaaaggctggctgcagcagcacggcgacagcggcactctgcgcttctacggttgtcccggcgaggaaggcggttcgggaaaaacctttatggtgcgcgaagggttgtttgatgatgtcgatgcggcgctgacctggcatccggaagcctgggccgggatgttcagcacccgcaccctcgccaacattcaggcggcatggcgatttaccggcaccgcggcccacgccgctaattcgccgcacctgggccggagcgcgctggatgccgtcaccctgatgaccaccggcagcaatttcctcaatgaacatatcatcgagaaggcgcgcgtccattacgccattaccgataccggcggcgtctcgcccaacgtggtgcaggcgcaggcggaagtgctgtatttgatccgcgcgccggagatggccgacgctgagcaaatcttcgcccgcatagagaagattgcccagggggccgcgctgatgaccgagacccaggtcagctgccgctttgaaaaagcctgctccagctatctacccaaccgcacgcttgaggcggcgatgtatcaggcggtctgtcattacggtacccccgcctggagcgacgaggaacgcgcttttgccgcggcgatccgcgccaccctcagcgccaacgatattaacaacagcctgaacaatattgccggcaccagtggcgaggaaggcaaaacgttcgctcgtcgccaccgcgacaccttgctgattgatgaggtggcgccctgggcggccacggataacgtcctcgccggatccaccgacgtcggcgatgttagctggaaagcgccggtggcccagtgcttcagcccgtgcttcgcggtgggtaccccgctgcacagctggcagctggtgagccagggcagaacctccattgcccataaagggatgttgctggcggggaaagtcctcgcggcgaccgccatccgtttattcagcgacagcgccctgctggcggccagccagcaagagctcaggcaggtactggccgaacgcccctatcgtagcccgatcccggcggaggtgagtccgtccgttttacgataa

SEQ ID NO: 6626 - DNA, 693 bp, Klebsiella pneumoniae
ccatcaatggccgcagaatcgcaactgaatccgacgcaacccgtcaatcagcaaatttatcgcatcctccgccgggatatcgttcactgcctgatcccgcctggtacaccgctgtcggagaaagaagtctccgtgcgttttgcggtgtctcgtcagccggtgcgcgaagccttcattaagctggcggaaaacggacttatccagattcgtccccagcgcggtagctacgtcaataaaatctcattgtcgcaggtgcgtaatggttgcttcgtccgccaggcgattgagtgcgcggtggttcgccgtgccgccggcatgattaacgaagagcaactttatcagctggaacagaatcttcaccagcagcgtattgccgttgatcggcagcagttaaacgactttttcctgctcgatgatgaatttcaccagaagctgtcgattattgccgactgtcagctggcctgggagacggtggaaaatattaaagccgccatcgatcgcgtccgctatatgagtctggaccatgtcacctctccggagatgcttctgcgacagcatcatgagattttcaccgcgcttgaaaaacgcgatgccgaggcggtagaaaaagccatgagtatccatttgcatgaaatcagcgaatccgtactgctgattcgccaggagaaccgcgactggtttagtgaagaataa

SEQ ID NO: 6627 - DNA, 195 bp, Klebsiella pneumoniae
ttccggatggcgccattggtccccgaaccatcaccgcgcttaagggatacctttccgcccgcggggaaagagggtgaacaggttctgttgcgtgcgctgaactgcagccagggtgccagatacctcgaactggcggagggccgcgaagccaacgaggattttctctacggctgggttaaggagcgtgtcctgtga

SEQ ID NO: 6628 - DNA, 378 bp, Klebsiella pneumoniae
ttaagtccggcacccagaaaaaagcgtcttccaagcaggaggtggcccatgcagcagtttgagtggatccacgccgcctggctggcaatcgccattgtgctggaaattattgccaacgtctttttgaagttttccgacggcttccgccgcaagatctacggcatcctgtccctggcggcagtattgggcgcgttcagcgccctgtcgcaggcggttaaagggatcgatctctcggtcgcctatgcgctgtggggcggcttcggtatcgcggcgaccatcgccgccggctgggtgctgtttggtcagcgtctgaataacaaaggctgggcgggggttatcctgctggtagccggcatggtgttaattaaactcgcctga

SEQ ID NO: 6629 - DNA, 447 bp, Klebsiella pneumoniae
aaacctacggccaaaagccgcaacctgaggggtaaaattatggcagagaaattatccgctcactgtcactgcggtgcggtggcgtttaccgtggagctcagcgacggcttcaacaccgttcgacgctgtaactgctcatattgtcgcatgcgtggggcggtcgcggtctcttcgccgcgttcaggaatagaggtggtacgcggaggggataagctcacagagtatcgctttaatacaggggaagccgtgcactttttctgctcggtatgcgggatctacacctttcatcaacggcgatcaaacccacagcagtatggggtgaatgtggcctgcattgacggcgtttcgcctttcgatttcccttgcgtggaggtcaacgacggcgtgaatcatccaaaagatggcggcggaggcgtggtggggtatttacgctacgagaaaaagtaa

SEQ ID NO: 6630 - DNA, 1290 bp, Klebsiella pneumoniae
cggcgcgcggcgcggatcgccggcagattaccaaagacgatcagcagcgcctgcgtgagcggctgccgcccctggctcagatcgtgggttagctgcagcagcagttcaatcggcgcggtctcattgccatgcacgccggcggagaggatcgtcgcctggcgccacggcgccgtcggcagcagctgtaaaatgccctcgcccagccagcgggcctcaatgcccgccggaaaggtccacgcctgcaggcggcagtgcagtaaatcgttaaccaggtgctccatctgccgctccttaacgctgaaaatcatagaccgcgcccaggcgcaggatctgcgtcagctcatccagcgcctgataaacctcgcgcagcagctgcgggtccgccagatcgcgggcatgcagccggtcgcgatagtgtttttccacccatgccgtcagctgctgataacgttcgtcgttcatcaggctatgggcgttgaccgccttgcgctccgcctcattgagcaccacccgcagccgcagacaggccgggccgccgccgttgcgcatgctttcccgcaggtcaaagaccgccacttcatcgatcggcgatgcgctatcggcggcgagatcgctgagatagcgccagacgttttcccgctggcggcactcctccggcaccacgatcagcatcttgccgtctggtttgctcagcagctggctgttgaacaggtaagaggccacggcgtcgtcgagcgaaacccgctcgtccggcacttccacgctggtgaacgggatatccagactgtcgcttttagcccgcagcgtggccagcactgtcgcctgatcgacaaacgcctgctgatggtggaacagcacatggcgattgctgaccgcgatgacgtcgttatgaaacacgccgcgatcgatagcctgcggcgcctgctgggcaaacaccgtgtagcgcggatccagctgatgcaggcgggccaccgcttcgctggcctcgagggtctgccgcgccggatacttcaccggggcgataccgccgctggcgcgtcgaccatagacgaaaaactgcaccccctgccggccatattcccggcagaagcggttatggttggccgccccttcatcgccgaggtcgccatgctgcggcagcgccgcatggtgggcaaagtagcgcggatcggcgaacgtggcgccaaggatcgccgaggtggtgggtgcctcctgcatacggtgcagcttattgttcaggttggcgacggtgaaatggactttgccatcggcgctgtccgccgacggtga

SEQ ID NO: 6631 - DNA, 1275 bp, Klebsiella pneumoniae
ggaggtcaggccataatcgctgtcattggccatcgccagcgcctcatcgagggtcgaaaaggccaccaccggcagcaccggaccgaaggtttcctcatggataatgtccatctcctgacgtacatccagcagcagggtcggcggataaaaatagcctttgccctccagcggctgaccgcccagcgccacccgcgccccctgcgccaccgccttcgccactttgcccgccacctggtcccgcgccgccgcgttgatcagcggccccatcgcgatgtcatcccgtgtcgccgggtcgccaaactggacggccttcatcgcctcaccgaggcggttgacgaagcggtcgtatattccctgctgaacatagacccgctcgacgcagttacacacctgcccggagttaatcacccgcgagtccactaccgctttcaccgccagctccagatccgcatcgtccattacaatggcaggcgctttgccgccgagctcgaggcacactttggtgatatttttcgccgcagcggccataattttttctcccgccgccacgctgccggtcatgctgaccatcgccaccttcggattgccggccagctcctggccaacggtttctccgcggccaagcacaaggttaaagacccctttcggcaacccaacctgatggacaatctcggcaaaggcgatggcattattgggcgtaaattcgctgggcttaatgacgatggtatttccagtgatcagggccggcgccagcttgcgggcgataagaaagaatgggaagttccacggcaggatcccggtggtcacccccagcgcgcgtttaaagacaaggatattctcccccgggcgatcgctctgcacgatctcaccttcgtaacggcgcgcccattctgccatatagtcgagataatccgcggtgaacgcaacctccaccgccgccagctgctggatcttgccgccttcagcgacaatcagcccggcgatctcgtcggcacgctggcggataccggcggcaattttgcgcagccagcccgcacgctcaatggccggcagcgcttcccagccgggctgggcgcgctcggcggcgtcaatcgccagccgcgcctctttggcagtcccgtccgggatccgcgacagcagcgcttcggtcgccgggttaagcacgtcgatccagccgtcgccgcgaccggaaacgaactggccatcaatatacatcgggtgttgaacgggtgctgtcatggctactcctgtggtgcatttgtatttaacaggtga

SEQ ID NO: 6632 - DNA, 318 bp, Klebsiella pneumoniae
acaatccatttgactagtaatcatctctcgctgaatactgtatattcaaccagcacaaaggtgattatcatgcgtgtagaaatcagcattgccaaagagaaagccgcgaaaatgccaaaggggtcaatggaggccttgaaagacgaaatgacccgtcgaatcagcaagcaatatgacgacgttgaagtgatcgtgaaaacggccagtaatgatggactgagcgttttgtgggcgactgataaagaaatcgccaaagaatttgtagagaccactctaaaagacgcttgggagacggctgacgactggtttgtgcgttga

SEQ ID NO: 6633 - DNA, 963 bp, Klebsiella pneumoniae
tttatgacttatgtgattattcatgctcttgccccgattttcgttatcatgctgctgggcttctgggccggtaaggccgggatggtagataacaaaaacgtctcgctgcttaatatttttgtaatggattttgccttacccgccacgctgtttagcgccacggtacaaacgccgtgggccgggatcgtcgcccagtcgccgctggtgctggtgttgaccggcgcgatgtggatcacctatgccgcgatctacttcctcgccaccagcgtgttcaaacgcacgccgcaggatgccgcggtgctgaccctcaccgtcgccctgccaaactatgccgcgctaggtctgccgatcctcggcagcgtgctgggtgaaggcgcgtcaacctcgctgtcggtggcggtctctatcgcctgcggctcggtactgatgaccccgttctgcctgctgattctggagcgtgaaaaagcccgcgccgcgggtgaaaacagcggttctacgctggcaatgctgccggtgctgatgtggcgttcggtgaaaaaaccaatcgtctggggcccgctgcttggggtggtgctttccgcgatcggcattaaaatgccggacctgctgctggcgtcgatcaaaccgctgggcctggccgccaccgccgccgcgctgttcctcaccggggtgatcctgtcggcgcgaaaactgcagctcaatgcgctgatcgccacctccaccatcgtgaaactgctggtacagccgtttattgcctggggtctggtgatgttacttgggctgcacggttccattgccattaccgcgatcctgatgattgccctggccgcaggcttctttggcgtggtcttcggcaaccgcttcggcgtccagtctccggatgctgaagccgtgctgctgttgagctcggttctgtgtatcctgtcgctaccgctgtttatctctttgacttcaggactgtaa

SEQ ID NO: 6634 - DNA, 279 bp, Klebsiella pneumoniae
catagttgttacgatcgctcccgcggcgtaagaacatccgcgctcagcatgcaagatgagtatggcctgaccctaaaggagggcgaggctgatatgtacaaacattcaaccaaccgtgatgtccgctacgcggaacgcgagcttcactttgtgattccctccactgtacagggaattacacatttggctatctttttctcatcctcaatgcaaaaagacgctaacaggcctctcattccctcctcagacactggcgctgcgtcttattttacctgttaa

SEQ ID NO: 6635 - DNA, 1506 bp, Klebsiella pneumoniae
cgtcgcggttataccagttcaaagcgcgccataacgcccagtttgccagcgataaacttgccaattgtaaccttcaaccctaagttgcttaacaattacacaaccttttcacatcaggttgcaccctgctcgtacagagtgacacctgacctatctaccgtggcgggagaacgtttcgtaatgagcaatccacaagacaacactgcatccattctgcagaaaaacaagaaggtactgatcgcgagcctgacaggcagcgccatcgaatggttcgattattttctctatggcaccgccgccgcgctggtgttcaacaaaatcttctttccgatggtcgacccggttatcggcctgatcctctcctggctctccttctcgctgacgttttttatccgccccatcggcggcgtgattttcgcccatatcggcgatcgcatcggccgcaagaagacgctggtgctgaccctgtcgctgatggggagcgccacggtggcgatcggcctgctgcccacctacgagatggtgggcctctgggcgccggccctgctgattactctgcgcattattcagggcatgggtatcggcggcgaatggggcggcgcgctgctgctggcctatgaatacgcgccggaaaagcggaaaggctttttcggcagcattccccaggccggggtgaccatcggcatgttgatggcgacatttatcgtctcgctgatgacgctgttcgatgaggcgcagtttctcgcctggggctggcgcataccgttcctgctcagctccgtcctcgtttttctcggcctgtggatccgcaaagatatcgacgaaacgcccgcctttaagcaggtgaaaaaatccggccaggtggcgaaggccccgctgcgcgatacgctcaagcaccactggcgggaagtgctgatcgccgccggcctgaaagtggtggagaccgcccccttctatatcttctccacctttgtggtcagctacgccaccaccaccctgagctatcagaagtcgcaggcgctggaatccgtgaccctgggcgcgctggtggctaccgtgatgatcccgctgatggggctgctgtcagacaaggtgggtcggcaaaagatgtacaccctgagcgtggtgctgctggggctgtttatcgtcccgtggttcctgctgctcgacaccggcaccggctggggcatcatgctggcgacgatcgttgccttcggcatcctgtgggcgccggtaaccgcggtgctcggcaccctgtgctctgagattttcagcgccaatgtgcgctataccgggatcaccctcggctaccagctgggcgccgcgctggccgggggcaccgcgccgcttatcgccaccggtctgctggcgaaatatgacggtgactggcggccagtggccatttatctgggcattacggtggcgatttcgctcctggcgatattctgcgccagccggatgaagtccgcgctgggaacggccccctcccgggcggaaagcgcctga

SEQ ID NO: 6636 - DNA, 279 bp, Klebsiella pneumoniae
ttttgcattcttacgggctacttcgtcataagcggtacgaaaccgccgtacaaacatgggttcgccgtcgtcatccagaactccttcacacgtaatttcatctatcagcgggacgacaaacccaaaaagatttatcaggataaaaacgtgccagtccatcagctcgatcggcttgccggtcaaatgccccttcacgtggggaacaaagttatagaaatcgagaacgtgctgggcgcggccttcatcaaaataaacaccgcgcgccgggccgtgttctaa

SEQ ID NO: 6637 - DNA, 990 bp, Klebsiella pneumoniae
caattaatctattccgaacgcggtgttagctggaaattaacaatgaaaaccttgcccgatctgcaacaaatagaaatattaatactcatagtgaaacatggcagttttcgtcaggccgctaaagcgttaaacctttccccaccggcccttaccgtcgctattaatcatctggaagaaaagttaggcgtgcgcctgctaaatcgctcaacacgcagtttgtcattaaccgcagtgggtgaggaatttcttaataatataacgccggtggtcaatgattatcgccgggtggtggacagtctgaattatcaccgtctgactccggaaggcgtggtgaaagttaatttaccgcgcattgttattgacctgttttttcaagactattttatcgcctttaaaaacgcctgtcccaatgtgacgctcgaactgtatgccaccgatcggaaagtcaatattatcgagtccggttttgacgccggcattcgctattcgcaggatgtgcccaaagagatgattgccatcccctttggcgagaaactatcgctgatcccggtggccagcccggactatatacgcgaagccggagagcccgataccccgcagtcattagttaatttccgctgcattaaccgctgttttcctggtggtgagaagtaccgctgggagtttattggccccagcggcgagcttagcgaggtcgcggttaaaggcgatctggtcgtcgatgccgatagcgcaatgatccaggccgcggagagcggattaggcatcgcctttgtctatcagtcgctggtgacgcagcagctgagcgcgggcagcctggtccatttgttacccgactaccgctatcctgccgaccatttctgcgtctactacccaagccggaaacatattcccgcccccctgcgggcctttatcgcctgggtgatggcgcagaataaaaatatcctcggtcagcagaccgcacgacacggatcgcggccggaagattaa

SEQ ID NO: 6638 - DNA, 1278 bp, Klebsiella pneumoniae
ggcgggtactatttgccccctttggtcggtcatcgaccgttaatacctcctgagttcagaggcatttttatgacatggcaatccttcaaacaggcctggcttatccggttctggtctcctgtcccggcggtcattgccgcgggcattctctctacctactattttggcatcaccggcaccttctgggcggtgaccggcgaattcacccgctggggtggtcagctgctgcagctgctgggcgtccacagcgaacagtggggctattaccagctgatacatctcgaagggtcgccgctgacccgcatcgatggcaggatgatcatcggcatgttcggcggctgcctggccgccgcgctgtgggcgaataacgtcaaactgcgcttgccacgcagccggatccgcattgcgcaggccgtggcaggcggcatcatcgccgggttcggcgcacggctggcgatgggctgcaacctggcggccttcttcaccggcattccgcagttctccctgcacgcctggctgtttgccatcgccaccgccatcggctcctggtttggcgcccgcttcacgctgctgcccctttttcgcatcccggtaaaaatacaaaaggtgtccaccgcctcgccgttaacccaaaaaccgcagcaggcgcgccgccgtttccgccaggggatggtggtctttttcgccatgatcggctggggcctgctcaccgccgcagaccacccggcgctcggcctggcgatgctgtttggcattgcctttggcctgcttattgagcgcgcgcagatctgctttacctccgcctttcgcgatatgtggatcaccggccggacggtgatggcgaaggcgattatcttcggcatggcggcgagcgccatcggtatcttcagctatgtgcaattggggatggcgccgaaaattatgtgggccggtcctaatgcggcgattggcgggctactatttggctttggcatcgtgctggccggcggctgtgagaccggctggatgtaccgggcggtggagggccaggttcactactggtgggttgggctgggcaacgtcatcggctcaacgctgctcgcctggtgctgggacgatatcgccgccccgctcgccacccactggcagaaagtcaacctgctgaacgccttcggtccctttggcggactactggccacctatctactgctgctgatcgccctgctgctggtgatcgcctgggagagacattttttccgccgccaggcggcggtccggaccgtgaaggagagcgcatga

SEQ ID NO: 6639 - DNA, 3540 bp, Klebsiella pneumoniae
gggtgtcttcatatgattacgattgatggtaatggcgcggtcgcttccgtcgcgtttcgcaccagtgaagttatcgccatctacccgatcacgcccagttcaacgatggcggaacaggctgacgcctgggccggcaatgggctgaaaaacgtctggggcgatgttccccgcgtggtcgaaatgcagtcggaggcgggcgccattggcgccgtacatggcgcgctgcagaccggcgccctctccacctcctttacctcatcgcagggcctgctgctgatgatccccacgctgtacaaactggccggccagctgatgccgtttgtgctgcacgtcgccgcccgcactgtcgctacccatgcgttgtcgatcttcggcgaccattccgatgtcatggccgtccgccagaccgggtgcgccatgctgtgcgccagcagcgttcaggaagcgcaggatttcgcgctaatctcgcatatcgccaccctgcaaagccgggtgccgtttattcatttctttgatggtttccgtacttcgcacgaaatcaacaaaatcgccccgctggcggatgacaccattcgcgccctgctgccgcaggataagatcgctgagcatcgccagcgcgcgctcaacccggaacacccggtgatccgcggaacctcggccaaccccgacacttacttccagtcccgggaagctaccaatccgtggtacgacgcggtgtatgaccatgtcgagaaagcgatggacgatttcgctgccgccaccggccgtcagtacaaaccgtttgagttttacggccacccgcaggcagagcgcgtgatcgtcattatgggctcggccatcggcacctgcgaagaggtggtcgatgagttgctgagtcgcggcgagaaagtcggcgtgctaaaagtccgcctctatcgcccgttctccgccgcccacctgctggcggcgctgccggaaagcgcccgcgcggttgccgtactggatcgcaccaaagaacccggcgcgcttgccgaaccgctttacctcgacgtgatgaccgccctggcggaagcctttaaccgcggcgagcgcgagacgctaccgcgcactatcggcggccgctacggtctctcctccaaggagtttggtccggaatgcgtgctggcgatattcagtgaattgcaggccgcccagccgaagccgcgctttaccgtcgggatctatgatgacgtgaccaacctgtcgctgccgctgggcgaaaataccctgccggcagaggccaagctcgaggccctgttctacggcctcggcagcgacggcagcgtgtcagctaccaaaaacaacatcaaaatcatcggcaactcgaccccatggttctcccagggctattttgtctatgactcgaagaaagcgggcggcctcaccgtctcgcatctgcgggtcagcgaaaaaccgattcgttcatcgtatctgatttcgcaggctgatttcgtcggctgccaccagctgcagtttatcgataaataccagatggccgagcggctgaagcccggcggcattttcctgctcaacacgccgtacagcgccgatgaggtctggtcccgcctgccccaggaagtccaggccaccctgaatcagaaaaaagcgcgtttttacgtggtcaacgcggcaaagatcgcccgcgaatgcagcctcggggcgcgcattaataccgtgatgcagatggcctttttccatttaacccagatcctgccgggtgatagcgcgctggcggaactgcaggcagccatcgccaaaagctacagcagcaaaggtcaggagctggtggagcgcaactggcaggcgctggccctggcccgtgaatcactggcggaagtaccgctccagccggtgaacgccagcagtccgaaccgcccgccggtggtctccgacgccgcgccggatttcgtcaaaacggtcaccgccgcgatgctggccgggctcggcgatgcgctaccggtctctgccctgccgccggacggcacctggcccatgggcaccacccgctgggagaaacgcaacatcgccgaagagatccccatctggaaggaagcgctgtgtactcagtgcaaccactgcgtcgccgcctgcccgcactcggcgatccgcgccaaagtggtcgccccggaagagatggagaacgcccctgccagcctgcattcgctggatgtgaaatcccgcgatatgcgcgggcagaaatacgttctgcaggtcgccccggaagactgcaccggctgcaacctgtgcgtcgaagtgtgcccggcaaaagaccgccagaacccggagatcaaggccatcaatatgatgtcccgcctggagcatgtggaagaggagaaggtcaattacgagtacttcctcaacctgccggaaatcgaccgcagcaaacttgagcgcattgatattcgcacctcgcagctgatcagcccgctgtttgaatactccggcgcctgctcgggctgtggcgaaacgccgtatatcaaactgctgacccagctgtacggcgaccgaatgctgattgccaatgccaccggctgctcctccatttacggcggcaacctgccctcgacaccgtacactaccgacgccaacggccgcggcccggcgtgggccaactcgctgtttgaggataacgccgaattcgggctcggcttccgcttgaccgtcgaccagcatcgccagcgcgtgatgcgcctgctgagcgaattcgccgacaaactgccggcagagctgaacgcggcgctgcacgccgaggcgacgccggaagttcgccgcgaacaggtggcggccctgcgtcaggcgctggccggcgtggcgggagctgaagagctgctgaccgatgccgacgcgctggtggagaaatccgtctggctgatcggcggcgacgggtgggcttacgatatcggcttcggcggcctggaccatgtactgagcctgacggaaaacgtcaatattctggtgctggacacccagtgttactccaacaccggcgggcaggcgtcaaaagccaccccgctgggagcagtgactaagtttggcgagcacggcaaacgcaaggcgcgtaaagatctgggcgtcagcatgatgatgtacgggcatgtttatgtggcgcaaatttcgctgggcgcgcagctgaaccagacggtaaaagcgattcaggaagcggaagcctatccggggccatcgctgatcatcgcctatagcccttgcgaagagcatggctacgatctggcgctcagccacgaccagatgcgtcagctgaccgccaccggcttctggccgctctaccgcttcgacccgcgtcgggcagacgaaggcaagatcccgctggcgctagattcccgtccgccatcagacgcgctggccgagacgctgctgaatgagcaacgtttccgccgcctgaacgcccagcagccggaagtggcggagcagctatggaaagacgccgccgccgatctgcagaagcgctatgacttcctcgcccagctggctggcaaagcggagaaatcgccaagcgaaggttaa

SEQ ID NO: 6640 - DNA, 375 bp, Klebsiella pneumoniae
tgcaaatctcataaggacttaatcatgcccgcactaatcccccgagcatgtcgtaagcgtggatgcgcaggcacaacaaccgaccgctcaggctactgcgaaaagcaccgcaatgaaggctggcaacagcatcaacagggaaagagtcgccacgagcgtggctacggtagccaatgggatatcaggcgtgcgcgcatcctgaaacgagacaaccatttgtgccagaactgccttcgcagcgggcgggctgtcgcagcaaagacggttgaccacatcaaggccaaggctcatgggggtaccgatgacgattcgaacctcgaaagcctgtgttggccctgccatcgaacgaaaaccgggcgcgaacgcatcaaatga

SEQ ID NO: 6641 - DNA, 804 bp, Klebsiella pneumoniae
ataatgagtcagtacccaaaccgcgccgcgctgtggctgaacaaactggcgcccgacgcgccgctgatgagcggcctgtgcccttccgtccaggtggcagacggccagattaatggcgaaaacgtgcgttttatcgccgtggtcccggatgctaacaaccactacccgcgcgccgccggcggcgaagtcggcctgctggaaggctggacgctggcgaaagtggttaatgaaaccattgccgctgacgccgaccagccagtcaaacggccgatcgtcgccgtgatcgatgtgccaagccaggcctatggccgccgcgaagaagctttcggcattcaccaggcgctggccggggcggctggcgcttatgccaaagcccgtttggccggccacccggtaattggcctgatcgtcggcaaagcgatgtccggggcgtttctggcccacggctaccaggccaaccgcctgatcgcctttaacgatagcggcgtgctggtccacgcgatgggtaaagcgtcggcggcgcgcattaccctgcgtaccgtagaggcgctggagaaactggcggctaccattccgccaatggcctacgacgtcagcaactatgcgacgctcggcctgctctccgccctgctggatattaataatccggatgcccctgacgaccacgatctgtcgttggtcagcaacacgctgcgcgacgccatcgctgacgcgcgcaccgatacctcactgaagtgccgcctgggcgcggaaaaccgccgcagctcgcaactggttcgcgatcgcatgcgcgccagctggtaa

SEQ ID NO: 6642 - DNA, 300 bp, Klebsiella pneumoniae; identical to SEQ ID NO: 2144

SEQ ID NO: 6643 - DNA, 372 bp, Klebsiella pneumoniae
gggttaacccatcacttaaaggaaatcgtgatgaacatgacactgaacaaacgctggtgcctgaccgccattctggcgttaagcgctgtggtctacacctccagctcctatgccgccaccgaccggctggtgattgaatctggcgacagcgcgcagagccgtcagcaggcgtcgatggaaaaagagcaatggaacgacacccgcagcctgcgccagaaggtgaacaaacgggcggaaaaagagtgggataaagccgatgtcgctttcgacgcgcaggataactgccagaagagcgccaacgtcaatgcctattgggagccaaacaccctgcgctgtcttgaccgtcgcaccggccgcgcgatcaatccctga

SEQ ID NO: 6644 - DNA, 1497 bp, Klebsiella pneumoniae
ttcaccgcccagattaggcaaagattgccctccacagtagcgagaaagaccggaggtcggcaagcggcgcgtcgggaaaagcctttcgccttccccgacggagggctagtagcgcacgcagacggatttggtttcgcaccagccgtcgagccagtcagggccgaaatcgcggccggtaccagactgcttcatgccgccgaaaggcaggttggcgtcaatcagggtatggctgttgacccataccgttcccgcctgcagacggtcggtgtagttcagggcctgggtcagatcgcgggtccagacgctggcggtcagaccaaaatcgctgtcgttggccaggcgcagcgcctcctcgccatcggccactcgcaccaggttcaccaccgggccaaaaacctcctcacggctgagacgcagtccggcgtcggggtttaccaccagcgttggcggaatatagtaccctcccgcatctggtccggcgctgccgctgataagctctgccttctgctggcgagcctcttcgaggtaggccgccaccttgtcgcagtgggcccgggagaccaccgggttgatctgcgccgtctcctgcatccccggccccacctgcagcgatttcaccgcctgctcgaagccgctgaccagggtgtcaaacagcggcgcttcgatgtagatccgcgagctggcggcgcagacctgcccctgattgaggaagcttccggtcatcagcccctcaataacccactgggggtcggcgtctttgagcacaatcgccggattcttgccacccagctccagcgtcacgcgggtcaggcggtcggcagccacgcgggcaatctgtttcccggtcgccgtcgagccggtaaagctaaccttcgccacctgcggatgggcggtcagcgccgcgccgcagccggcgccgctgccggtgaccacgttgaacaccccgtcaggaatgcccgcctgggtcgccagctccgccacccgcagcagggtcagcggggtggtttccgagggtttgatgacgatcgaacagcccgccgccagggccggcatgaccttccacatgccgatcatcagcgggaaattccacgggacgatgcccgccaccaccccgaccggctcttttttggtccacgcctggtaacgcgccccttgcgggaacgggatcgaaacgtccagcgtccggccgctgatcttggtggtcagccccgcggtgtagcgcatccagttcagggtgcagccgacctcaaaggcgcgggagatggcaatggatttcccctgctcgagggtttccagttgcgccagctcttcgccgtgctgctccaccagatcggcaaaacgcagcaggatgcgttcacggtcagccggggtgcgcccggcccagcggcgatcgacaaaagcgcgccaggcggacatcaccgcccggtcgacatccgccgggctggcgtcggcggtggtggcaatcgcctgcccggtggccggatcccagacggttaa

SEQ ID NO: 6645 - DNA, 330 bp, Klebsiella pneumoniae
tatccagcccaagaattaagagcagtagcacaaagcatcataaacaaaaatgaattagttttaaacttcatcgtcaatcatctcttttgcttttttagtagctattttcctttctgcaattcctttatctgcaccatttatatttttagttactttcaaaataatgctgtcatcatcagatttcccaattttgccctcatccataattttgagaactttagacttaaaacaaactataaaaaaaccacctgtatcaatacagttatatgcattttctgtcactttctgagggtttcctatttttggtggttttttcttcataccggctga

SEQ ID NO: 6646 - DNA, 246 bp, Klebsiella pneumoniae
cagctaaaccagctgctccgcagaaagctcaggcggcgaaaaagcatcacaaagctgcggctaaaccggcagcccagaaagcgcaggcagcgaaaaaacaccacaaaaccactaaacaccaggccgctaaaccgactgcacagccggcagcataattcctcccggcgaaccaaccttcttaataatcggcgctgtttcagcgccgttttttctggagagcactatgctgcggcgctatcgttttga

SEQ ID NO: 6647 - DNA, 744 bp, Klebsiella pneumoniae
tcatcactacaatatcatgaggtgcggaatatgacagcgtttcacaacaaatcagtgctggttttaggcgggagtcggggaattggcgcggcgatcgtcaggcgttttgtcgccgatggcgcgtcggtggtgtttagctattccggttcgccggaagcggccgagcggctggcggcagagacaggcagcacggcggtgcaggcggacagcgccgatcgcgatgcggtgataagcctggtccgcgacagcggcccgctggacgtgttagtggtcaatgccgggatcgcgcttttcggtgacgctctcgagcaggacagcgatgccatcgatcgcctgttccgcatcaatattcatgccccctaccatgcctccgtcgaagcggcgcgccgcatgccggaaggcgggcgcattattgtcatcggctcggtcaatggcgatcgcatgccagtgccgggaatggcggcctatgcgctcagcaaatcggccctgcaggggctggcgcgcggcctggcgcgggattttggcccgcgcggcatcacggtcaacgtcgtccagcccggcccaattgataccgacgccaacccggagaacggcccgatgaaagagctgatgcacagctttatggccattaagcgccatggccgtccggaagaggtggcgggaatggtggcgtggctggccggtccggaggcatcgtttgtcactggcgccatgcacaccatcgacggagcgtttggcgcctga

SEQ ID NO: 6648 - DNA, 291 bp, Klebsiella pneumoniae
cccggagtacaagaaaaaaattcagccggtatgaagaaaaaaccaccaaaaataggaaaccctcagaaagtgacagaaaatgcatataactgtattgatacaggtggtttttttatagtttgttttaagtctaaagttctcaaaattatggatgagggcaaaattgggaaatctgatgatgacagcattattttgaaagtaactaaaaatataaatggtgcagataaaggaattgcagaaaggaaaatagctactaaaaaagcaaaagagatgattgacgatgaagtttaa

SEQ ID NO: 6649 - DNA, 1545 bp, Klebsiella pneumoniae
atcagctcacagaactgcgtcaatgtgctgccgaacagcggcttatccgcccgatatttaacaaaaaaatcacctgttaaatacaaatgcaccacaggagtagccatgacagcacccgttcaacacccgatgtatattgatggccagttcgtttccggtcgcggcgacggctggatcgacgtgcttaacccggcgaccgaagcgctgctgtcgcggatcccggacgggactgccaaagaggcgcggctggcgattgacgccgccgagcgcgcccagcccggctgggaagcgctgccggccattgagcgtgcgggctggctgcgcaaaattgccgccggtatccgccagcgtgccgacgagatcgccgggctgattgtcgctgaaggcggcaagatccagcagctggcggcggtggaggttgcgttcaccgcggattatctcgactatatggcagaatgggcgcgccgttacgaaggtgagatcgtgcagagcgatcgcccgggggagaatatccttgtctttaaacgcgcgctgggggtgaccaccgggatcctgccgtggaacttcccattctttcttatcgcccgcaagctggcgccggccctgatcactggaaataccatcgtcattaagcccagcgaatttacgcccaataatgccatcgcctttgccgagattgtccatcaggttgggttgccgaaaggggtctttaaccttgtgcttggccgcggagaaaccgttggccaggagctggccggcaatccgaaggtggcgatggtcagcatgaccggcagcgtggcggcgggagaaaaaattatggccgctgcggcgaaaaatatcaccaaagtgtgcctcgagctcggcggcaaagcgcctgccattgtaatggacgatgcggatctggagctggcggtgaaagcggtagtggactcgcgggtgattaactccgggcaggtgtgtaactgcgtcgagcgggtctatgttcagcagggaatatacgaccgcttcgtcaaccgcctcggtgaggcgatgaaggccgtccagtttggcgacccggcgacacgggatgacatcgcgatggggccgctgatcaacgcggcggcgcgggaccaggtggcgggcaaagtggcgaaggcggtggcgcagggggcgcgggtggcgctgggcggtcagccgctggagggcaaaggctatttttatccgccgaccctgctgctggatgtacgtcaggagatggacattatccatgaggaaaccttcggtccggtgctgccggtggtggccttttcgaccctcgatgaggcgctggcgatggccaatgacagcgattatggcctgacctcctcaatctatacccgcgatctgaacgtggcgatgaaagcgattaagggactgaagtttggcgaaacctatatcaaccgtgagaactttgaggcaatgcaggggttccacgccggctggcgtaagtcggggatcggcggggcagatggccgccacggcctgaatgagtacctgcagacccaggtggtctatctgcaggcctga

SEQ ID NO: 6650 - DNA, 231 bp, Klebsiella pneumoniae
tccgcatcacaaacgttgcggcggaatcgttactctgatgctaacgatcggccaccgcgcttaattgatgctcatagcctcgcgtcgcacactaatctccaccaggacaaacaaaacgatttgtcgaatcaggaggttattaatgaatgccgaacaaacgacggggcgggtctggaaccgtcgccgaacggaaaaacagcggcggctggccgaggcgaacatgccaggtaa

SEQ ID NO: 6651 - DNA, 324 bp, Klebsiella pneumoniae
aataatggtctactgacgtggaaggagcgtggtatttgggcaggtgaaaacaccgttttgcagctgttctatactgttagtcagacatcacgctggaggtggctatgtgcggacgttttgcgcaagcgcaaagccgggaggaatacctggcgcatctcgtggaagcggccgaacgagatattgcctgggacccggcgcctatcgggcgctataacgtcgcgcccgggacaaaagttttactcctcaatgaacgcgatgagcaactccatctcgatgccgtttactggggctatgcgccaggatggtgggataaaccgccgctga

SEQ ID NO: 6652 - DNA, 354 bp, Klebsiella pneumoniae
gcagtacaacagggtcggcgggaaaaatgcgccggccgcgctgagatccgcctctccaccgagcagtacttcgcagccagcggctatcagcttattgacgctctcctgtacgtcctgacgctgttcgctattaaccagggcccccatcttaacgccctcctgcgcagggtcaccgacggttactttatgcaggcgggagatcagtgcatcgctaaccgcattaatctgagccagtggcacaatgattctgcggatagcggtacatttttgcccggctttcgccgtcatctcgcggaccacttcccgaataaacagcgcgaattccggttgctccggcgtgacgtcttcacctaa

SEQ ID NO: 6653 - DNA, 348 bp, Klebsiella pneumoniae
tcgggcaaacaggcgcatggaggcgatttcgtacagggcatcttccatggcaccgtcgctcaggttgtaccaatgctgcatgcagtgaatacgcagcatggtctccagcggatagggccgtcggccattgcccgccttgggataaaacggctcgatgacttccaccatgttttgccatggcagaatctgctccatgcgggagaggaaaatctcttttcgggtctgacggcgcttagtgctgaattcactatcggcgaaggtgagttgatggctcatgatgtccctctgggatgcgctccggatgaatatgatgatctcatatcaggaacttgttcgcaccttccctag

SEQ ID NO: 6654 - DNA, 1314 bp, Klebsiella pneumoniae
gctatgccgcaacttgatgaatacctccgccagctggcgccctccatgacccaatggcgccgtgattttcacctgcacgctgaatccggctggctggagtttcgcaccgccagtaaggtcgcggatattcttgacgggctaggctatcagctggcgctaggccgcgacgtcatcgatgccgacagccggatggggctgccggacgaggagaccctggcccgggctttcgaacgcgcccgcgaacagggcgcgccggagcgctggctgccggcgtttgaaggcggtttcgccggcgtggtggccacgctcgacaccgggcggcccgggccaaccctggcctttcgcgtcgatatggatgccctcgatctcaacgaacagcatgacgatagccaccgcccccatcgcgatcatttcgcctcctgcaacgccggcatgatgcacgcctgcggccatgacggccataccgccatcgggctggggctggcgcatgtgctcaagcagtatgccgcccagctcaatggcgtcattaaactgattttccagcctgctgaagagggtacccgcggcgcccgcgcgatggtggccgccggcgtggttgatgacgtggattatttcacggcgatccatatcgggaccggcgtgccggcaggtaccgtcgtctgcggtggagacaactttatggccaccaccaaattcgacgtgcagttcagcggcgtggccgcccacgccggcggcaagcccgaggacgggcgcaacgcgctgctggccgccgcccaggccgcccttggcctgcacgccatcccgccgcacagcgccggcgcctcgcgggtcaacgtcggggtgatgcaggccggtaccgggcgcaacgtggtgccctcttccgcgctgttaaaagtggaaacccgcggcgaaagcgaagccattaatcagtacgtgttcgagcgggcgcagcacgtcgtcgccggggctgcggcgatgtacgaagcccgctacgaactgcgcatgatgggcgcggcgaccgccagcgcaccgtcgccggcgtgggtggactatctgcgcgaacaggccgcccgggtgcccggcgtgcaacaggcggtggatcgcatcgccgccccggcgggctcggaagacgccaccctgatgatggcccgggtccaggcgcgcggcggcctcgcctcgtacatgattttcggcactgaactcagcgccggtcaccacaacgaaaagtttgacttcgacgagagcgtgatggcgttgcgcgtcgaaaccttggcgcgcgtcgcgcttaactttccctggcagcggggggtgtga

SEQ ID NO: 6655 - DNA, 1458 bp, Klebsiella pneumoniae
tcttttaagcaggtgagctttgtcgctatgacgcacttttcatccaaggagaaagtaatgacaacgcatcgcagtgaaaaagactcgatgggcgccatcgaggtcccggccgataaactctggggcgcccagacccagcgctcgctggagcatttccgcatctcgaccgaaaaaatgcccggggagctgatatacgccctggcgctgaccaagcgggcggcggcgaaggttaaccaggatctcggactgttgacggcggagaaagccggggcgatcgtcgccgccgctgacgaagtgctggccggaaagcacgcgcaggagttcccactggctatctggcagaccggctccggcacccaaagcaatatgaatatgaacgaggtgctggccaaccgcgccagtgaactgctcggcggagaacgggggatggcgcgaaaaattcatcccaatgacgatgtgaataagagccaaagctcaaatgatgtattccccaccgccatgcacgtcgcggcgctgattgccctgcgggaaaaagtgatcccgtcgctgcaggcgctgcgggcgacgctcaatgaaaaagcggtggccttcagggatatcgtcaagatcggccgcacccatctgcaggacgccacgccgctcaccttaggccaggagatctccggctgggtggcgatgctggaccatagcctgaagcacattgaagccagtcagccgcatcttgccgagctggcgctgggcgggacggcggtaggaaccgggctgaatacccatccggaatatgccgtacgggtggcggccgagctggcgtcgctcagcggacagccatttgtcaccgcgccgaacaaattcgaagcgctggccactgtggatgccctggtccatgcccacggcgcgctgaaaggcctggcggcctcgctgatgaaaatcgctaacgatgtccgctggctggcctccggcccccgctgcggcattggtgaaatcgccatcccggaaaacgagccagggtcatcgattatgccgggcaaggttaacccaacccagtgcgaagctctgaccatggtctgctgccaggtgatgggcaacgacgtggcggtgaatatcggcggtgcttccggtaactttgagcttaacgtctatcgcccgatggtcatccacaacttcctgcagtcggtgcgtctgctggcggacggtatggcgagctttaacgagcactgtgcggtgggtattgaaccgaatcgcgagcggatcagtcagttgctcaatgagtcgctgatgctggttactgcgctgaatacccatatcggctacgacaaggcggcggaaatcgctaaaaaagcgcaccatgaggggctgactctcaaagcctcggcgctggcgctgggctacctgacggaagccgaattcgacagctgggtgcgcccggaagagatggtcggcagcctggctattcgctag

SEQ ID NO: 6656 - DNA, 210 bp, Klebsiella pneumoniae
ccgcctgagcataaaggcaagaagaccttccgttcgcctccatcgcatcgcctgcgcggcgaggggatgaagcgtgatactggccgtcatatgtcagccaggttactgttttatgaccagattattaaccttgccagcccgcggaaaatagcgaaagatggcaatattcgggcatcaacggtgccagtgcctgtcctgagggagccatga

SEQ ID NO: 6657 - DNA, 597 bp, Klebsiella pneumoniae
gcgaaagagcagagatttttacaatcagcaatttcaaagggttacaacatgctgattggctatgcacgggtctctacaggggatcaaaacctcgatttacagaaaaacgcgctgatccgcgcagaatgtgagctggtttttgaggatatggccagcgggaaaaatgcccggcggccaggattaaagcgagcgctgcggcgactccgagcgggtgatgtgctggtggtctggaagcttgatcggcttggccgcagcgtacgcgatctgattacgctcgtgtcggagctacaggcgcgcggggtgaatttccgcagcctgaccgacagcatcgataccagtacgccagcaggccgctttttcttccacgtcatgagcgccctggcggaaatggagcgcgagctgatcgtcgagcgaaccagagcgggtttagccgcagcgagggagcaggggagagtcggtggccgtcgccgggtaatgactgaagatgtggtggagcagtgccgcagaatgctggagaacggcgctacccggcagcaggtggctgatgtgacaggcgtggacgtgaaaacaatctacaagtacctcccggcgacttga

SEQ ID NO: 6658 - DNA, 1110 bp, Klebsiella pneumoniae
caatcggagcaccgctccatatattcggaacggtgctccgttaaatataacgcatttccatatgaggagaaagcgatgtcgacgcagatgatgaaggccgttcaacagcacgcctttggcgggccggaagtcctgagctatgaggatgcgcccatgccggtcctgcaggccggtgaagtactggtacaggtgcacgcggtgggcgtgaacccgccggacagctatctgcgcgatggctatcaacagctgccgccggagtggcggcccgaggtccgctttcccttgatcctcgggaccgatctctccggggtggtggtggcgcgggcggatgacgtccgagaggtggcggtcggcgacgaagtgtatgctatggcgcgttttcccgaaggggcggcagggggcagccgcgcttacgccgagtacgttagcgtgccggtcagcgacctcgctcgcaaacccctaaccctgagccatcagcaggctgccgtggtgccgatgtcgctcctgaccgcctggcagttcatgatcgatcccgggcatgaggtggcgaatccgctgcagccggggccgcatcggccggtgccgctggcgggtaaacgcgtcctggtcaacggcgcggcaggaggagtcggtcatttcgccgtgcagctggcgaagtggcagggcgccgaggtgattgccgtcgccgcgggccgccatgaagcctttttacgtcagctcggcgccgatagcgttatcgactatacaaccaccgcagtggaggagacggtgcgtgacctggacctggtcattgatgcgccgggcgggccggccagcggccgttttttgcgtaccctgcgacccggcggcgcgctgtacccgatctttccgctcggctttgccggggcggaagaggcgcgacagcgcggagtgacggtctccaccacccaggtacgctccagcggcgcgcagctcgcccggcttgccgacctgctggacgccgggatcatccgggttgcaattgacagcgttttcccccttgcgcaggcgcagatggcgcatgagcgagcagcgcaggggcatcttgagggcaaaatcgtgctgtcggtgatggactcgtcagccgggtaa

SEQ ID NO: 6659 - DNA, 1320 bp, Klebsiella pneumoniae
cagcgggggcatcagccagtgttcgctccagtcgctgaggccgatgcgaaaaagctgctgcgcgcgcgccgggacgaactctccggcgccaaacatcgccgaatgcaggttttccatcagcggctgcaggtcggtcatcagcgcttgcgcccgcggcgtcggcagcatgcctctggcgctgcggacgaacagcgggtcgtcaaacatctcgcgcagccgtttcagcgccccgctgatagccggctggccaagatggagcacctctgcggtgcgggtgacgctcccttcgcggtacagcaccatcaagactgtcaacagattcagatcgatacgactaaaatcattttcaatgattttgttcattatgataatcaatttgaatgtgggttatcccggcagcatagtgaatatcaccccgataaatcaaccagcgcaatgcgcgcggagggagtgatgcaaacttaccagacaggcgatagcctgattttcaaagtgccggagcgcgagatttccctgcagccggcagcgctctatccagaggcgttcccggtagcggaggcggaggccgttattcagccgattgcgctgtcaatccacagctgggtggtgcagaccccctacgatctgattgttatcgataccgccaccggcaatggtcgggagcgcggcggcaatccgctctatcatcaacttaacacgccgtatctggagaatctccgcgccgcaggagtgaacccggaggacgtgaccctggtgctactgactcacctgcataccgaccatgtcggatggaataccgtctggcaggacgatcgctgggtgccgctgtttcccaacgcccgctatctgtgctcggcaaaagagctgtcgcgggtgaaaaacagcgaacgctaccgggcgctgtggcttgacagcctgctgccggtgattgaggccggccagctggagaccgtcgatgtggcgacccggccgtgggtcggcggacggatcgactttattcccacccccggccacagtccggaccatgccgcgctggtcctcgccgccggagatgactacgcctgtttctccggcgatcttctgcattccccgatccagtttgcccatccgcagtggaattcagcgttctgcggcgatccccggcaggcggaagtctcgcgacgggagatgatggcgtggggggcaagccatcatgctcaatggttcaccgggcattttgccgggccttcctgcggctggctggagaaggataagcaaggtgactatcgctggcgagaggccgggaaacaggctgcagataaggggaacagtgatgaataa

SEQ ID NO: 6660 - DNA, 519 bp, Klebsiella pneumoniae
atggtaaataaattatggattttgttatcagggataataatggttgccatgccgtcggcgcaggccggggaattaagcctctattcgatgaataccggctcctatgtctatcatatgacgggtaaccacggacaatataacgaacatttcaataacaactttttctcggtggagcgcaagttttctcaggattcaaaatacagcgtgctggtcggaacgatgaaaaacagctttgacgatcgttgcctgaccctcggcgtgcgccgcgactggctgaaaaacgataccggctgggtactgaaaggggtgtatgcctataccggggaatttttctttgatgccttcagccactgtggggattccggcacctaccgcaccgccaaaaaaatcaccggcatcggtttttcgccctacctctatcatggcctgcaatataatttcaccgattatttcggtgtggaaggcggcattattgtgccggcgatctttgtgatgagtgttcagtggagctttcgctag

SEQ ID NO: 6661 - DNA, 471 bp, Klebsiella pneumoniae
aatgcgaataagttatttagtgaatggtttctgccgctatcggccaaagccgcacacagcgacacgataaggatcgaaatggaactgctggtcaggctgggtcatttttttgagcaagcgcgttctgacgccgactatgccaccttcgccaatgaactgcgtcggcatcaggtctcctactacatctattttgtttccaccggcaatatgaatttcgtaatggcaaacgacgaggtggtctcggtaaaaagcgcccgcgggctgctgcgcgttcgcgctgaggccagccattgtctgaccagggccgccgttatccgccactttgcccgggccattaactttgaacagtactgccgggatctcgccagcgccggggtgtttaagtggatcgtcgatcttgaagaggagacccggcactactggtcgaaggataatacgctgttatataaagagtgcctgatgcccccctga

SEQ ID NO: 6662 - DNA, 1233 bp, Klebsiella pneumoniae
ccatcctgtaatatgaggaaattaatgccatatacacttaaacatttgccagaacgctaccccagacctaagcctctgaaattttctcgttggcttgttgctctggttgtcatgctttcagtcagtattatcataatgcgtatatttgggcgttatgttgaaaatctgtacttctggagattagctttaggttttcctgttgctttgtggagtgtcttgctttcttctcgtctgcttgtttggtctttacaggatagcaaagcaaacgcttttgacaaacagcgagaacagtggattcttcgagaaacccgtaaggcacggcgtgcattacaagtgctgagtgcaacatttattaccggccactcatcagttgctcagaaagataccgctattgctatgcaaaacaacgacagcattattgtttcacaggtcggccgggatggtaatgaaagcgccagaatgagccaaatttcttccagcccgcaggattctatggaattcgtgataatgaatattttttcgcagatgattgcagacattccttttacacaaatccctgataaatgcccactagtagtagtttttgatgtaacaacatcgctgcctttggagaacattcgccattactgggatgaggcatggcaaaagaacaatatcacttttcctgttgaacacgttgaagggcgtggtcttagtgtaattgaccgctggttaaatgaacgtattaaagataaagcaatgttattgatcgttggcctccagattgatccggttgttactaacaatactgctgaagcggctgttgctctacttcttggcaaccgcctaacgcaagaggcgcttgaccccctcgcattactacaccggccagatgctgctccctcaggtgaacttagcgaagggatgaggatggccgcctggaacgtcccgctaaaagaaagtatggtgaaaaatttatggctcgctggaatgacaggtgagcaacgtgcagaagcgattggatgtcagaatgcacatcctgcgcagtgcgtaaaagatgaggctgtcatttcactcgatatatccatggggaatgctggagccgctgcaccctggctggctattgctgccgccactgaaatcgcccgacaaacacaatccccgcagatgattatctgcggggataccactcagaaagtgctatggagcacgcttattaccccgatagcttcaagacaggagatggatctgtga

SEQ ID NO: 6663 - DNA, 1317 bp, Klebsiella pneumoniae
atacgcggtaatgtaatgaaaaagctgttcgtgcagttctatcttctgctcttcgtctgctttctggtgatgaccatgctggtcggtctggtctataaatttaccgcggagcgcgccggacggcagtcgcttgacgatttgatgaaaagctcgctgtatctgatgcgcagcgagctgcgggagataccgccgcgcgactggagcaagacccttaaagagctggacctgaatttatcgtttgatctgcacatcgagccgatcagcaaatttaagctgtcggaaagctcgatgcagcacctgcgcgccggcgatatcgtcgccctcgacgatcagtacacctttattcagcgcattccccgcagccactatgtgctgtcggtgggcccggtgccctatctctattttctgcatgagatgcgcctgctggacgtggcgctaatggcgtttattgctatctctctggcctttccggtgtttatctggatgcgcccgcactggcaggacatgctgcgcattgagacggccgcccagcgctttggcgaaggtcacctcagcgagcgcattcacttcgacagtatgtccagcttcgagcggctcggggtggcctttaaccaaatggccgataacattaatgcgcttattgccagcaaaaagcagctgattgacggcatcgcccatgaactcaggacaccgctggtacgcctgcgctaccgtctggagatgagcgagaatctcaccgaggcggaatcgcaggcgctgaaccgcgatatcggtcagctggaggcgctgattgaagagctcctgacctacgcccgcctcgaccgcccgcagacggagctcagcctgacgactcccgattttcccgcctggatcagcgatcacgtcgaggatatccagatggttaacccacagcgcgaggtcgccctggcgacgctgacccacggtaactacggcgcgctggatatgcgactgatggagcgggtgctggataatttggtcaataacgccctgcgctacagcagccagcgggtggcggtcagcctgacgctgcagggttcgcgcgcttcgttgctggttgaggatgacggcccgggaatcgcccccgaggagcgcgagcgggtgtttgagccctttgtccgccttgaccccagccgggaccgggcgacaggaggctgcggcctcggcctggcgattgtccacagtatcgcccaggcgatgggcggcgaggtgcgctgcgaggccagccctctcggcggcgcccgcttctgctttagctggccggtctatcatcagctgcctgatttcacctctgcctga

SEQ ID NO: 6664 - DNA, 948 bp, Klebsiella pneumoniae
cccacattcaaattgattatcataatgaacaaaatcattgaaaatgattttagtcgtatcgatctgaatctgttgacagtcttgatggtgctgtaccgcgaagggagcgtcacccgcaccgcagaggtgctccatcttggccagccggctatcagcggggcgctgaaacggctgcgcgagatgtttgacgacccgctgttcgtccgcagcgccagaggcatgctgccgacgccgcgggcgcaagcgctgatgaccgacctgcagccgctgatggaaaacctgcattcggcgatgtttggcgccggagagttcgtcccggcgcgcgcgcagcagctttttcgcatcggcctcagcgactggagcgaacactggctgatgcccccgctgttacccgggctgatgcaggaggcgcccggagtctcactgcagtcgatagccgccgaccccttccaggttcgccagttgctggaggaggagcgcattgatgtcgcggtgtctgtcaacaaacagagccgcggggaggtggtcagcgagccggtgatgtccatgggagtcaccaccctgtggtcgccgcagcagatcccctgccgcgggccgctgtcggtgagcgactttgtcgcctgggaacatgtgatggtggcctatcgcgaaaccggccacggtgaaattgaccgccagctcgccagccagggactcgcgcggcgcgtgcgctttgccacgcagaatttctccacctttcccctgctgctgaccaccctgccgctgttcgccaccgtcccgcaggggctggcgcagcgctggcaggcgcagtatgcgctgcgcgcggacgctccgccggtagcgtatccggaatttacgctgtgcattttgcggcacaaacggcgggcgcaggatccggcgctgaattggctggtggcgaagttaaaacaggccatgcgcggtcaataa

SEQ ID NO: 6665 - DNA, 462 bp, Klebsiella pneumoniae
gctggcgccaagcgcacagcgatatctacgtcagaaattttcctgtttacgtctcgcgtaaacggtaatggattatattctcaagcaggagaagggatcatgttttattggattttattagctttagcaattattgctgaaattaccggcaccttgtctatgaaatgggcaagcgtgagcggcgggcacaccggctttattttaatgctggccatgattgccctgtcatatatttttcttgcctttgcggttaaaaagattgccctcggtgtggcctatgcgttgtgggaagggatcggtattttactgattaccctgttcagcgtgctgctgtttgatgagagtctgtccctgctgaaaatagccggcttgaccaccctggtgatagggatcgtcttaattaagtccggcacccagaaaaaagcgtcttccaagcaggaggtggcccatgcagcagtttga

SEQ ID NO: 6666 - DNA, 687 bp, Klebsiella pneumoniae
ctgccgcacaacgcgcctgaggagcccgacatgcaaaaactgacccgtgacgaaatggcccagcgcgtggcccgcgatattcccgaaggcgcttacgtcaacctcggcatcggcctgccgacccggattgccaattacctgcccgctgacaaagaggtgttcctgcacagcgaaaacggcctgctggggatggggccgaaaccgctgcctggcgaagaagatccggagctgatcaatgccggtaaagagtatgtcaccctcctgcaggggggctgctatttccaccacggcgactccttcgccatgatgcgcggcggccatctcgatatctgcgtgctgggggcctatcaggtctccgccagcggcgacctcgccaactggagcaccggtgcgccggatgcgatcccggccgttggcggggcgatggatctggccatcggcgcccgccaggtatttgtgatgatggaccacctgacccgtgacggcgagtgcaagctggtggcgcagtgcagctacccgctgaccggcgtcggctgcgtcagccggatctataccgacctggcggtgatcgacatcaccgaccgcggcccggtggtgcgggaaatctttaacggcctctcttttgaagagctgcagcgcatcactccggtggcgctgacctttcaacaactggcggaaagcgcgtaa

SEQ ID NO: 6667 - DNA, 1242 bp, Klebsiella pneumoniae
cctttcaacaactggcggaaagcgcgtaaggaacctatgatgaatcaggcatttatctgtgatgcggtgcgtacaccctttggccgtttcggcggtgccctggcgacgatgcgcgctgacgacctggcggcgctgccgctgaaagcgctgctggcgcggaacccgggactggatcccttgcgcattgacgatgtgatctttggctgcgccaaccaggccggggaagacaaccgcaacgtggcgcgaatggcgctgctgctggccggcctgccggagagcgtgcccgggagcaccatcaaccgcctgtgcggttccagccttgacgcgatcggcgtcgcggcgcgggcgattaaaagcggggagacgcagctgatgatcgccggtggggtggagagcatgtcccgcgcgccgtttgtgatggggaaagcggagagcgcctttagccgcagcatgcagatggaggataccaccatcggctggcgctttattaacccgcagatgaaagccctgtacggcgtgcattccatgccggagacggcggaaaacgtcgccgatgagtttgccatctcccgtgccgatcaggacgcgttcgccttacgcagtcagttgcgcaccgccgcggcgcaagaggcggggcgtttcgccgatgagctgatcgccgtccaggtgccgcagcgcaaaggcgagccgctgctgtttagccgcgatgagcacccgcgcagcacctcgctggaggcgctggctaaactgcgcggcgtggtgcgcgccgacggcagcgttaccgccggtaacgcctccggggttaacgacggcgcctgcgcgctgctgctggccagcgagacggcgctgtcggctaacgatcttcagccgctggcccgggtggtcggcgtggcgacggcgggcgttgcgccgcggatcatggggtttggcccggcgccggcggtgcgcaaggtgctggcgcagaccggcctgacattaggccagatggatgtcattgagctgaatgaagccttcgccgcgcaggcgctggcggtgacccgtgatttgggcttaccggacgatgccgcccacgtgaaccctaacggcggggcgattgcgctgggccacccgctcggcgcctccggcggccggctggcgatgaccgcggcttatcagctgaaacggaccggcggccgctacgccctgtgcaccatgtgcatcggcgtcggacaggggatcgccctgattattgaacgtgtttaa

SEQ ID NO: 6668 - DNA, 2436 bp, Klebsiella pneumoniae
atggctggcaagtccctcggtacgttaacaatcgacctgatcgctaaagtaggtggatttgttcagggcatggataaagccgaaagatcttctcagaagtggcgcgaccaggtaaaaaaagacgctaaagaggtaagttcttcaatcattgctgtgggggctgcagcggctaccgcagctgttggtattggtgctgctggtttagccattgtcaaaaatacagcacagcaggtaacagaggcagaccgctgggcaaaatctcttaaaatgtccacccaggatttgttatcttggcaatatgctgctgaacaagccggtttaaccggtgacaacatagccgatattttcaaagacattaatgataaggtcggcgatgcggtcctgaataaatcaggtgaggctgcccaggctctggatactttggggctttcagctcagaagctggctcagcaatccccagataagcagctgatggcaatcagtgaagcattacagaaaatacccactcaggccgggaaaaccaatattctcgaaagcctgggtaatgacctgtcaaaaatgctgccgttgttcgataacaacaacgagaagctgaaacagtttatccagctatcaaaagattttggtgtcgcaccaccgcaagaagatattgataaccttgttaaggttaatcagttctttcaggatatagagactagcgcccgcggtcttaaaatggaaattgcttcggggctggctaaagttgaccttacgccattgcaggatgggcttgatgacattcgtgacgtcttcaccgatcctgctgttcttcaggggctatcagacctggttggtgaagccataagccttgccggggttgtggggcgtattgctggtggcttgggggccattgctacttatacccgctctcgtataggtgctgtatcaggtaattataatgctgctgatgaaagtgatattgcacagcgcattgatttccttaacaaaagagggaatcaaagtaaggaacaaaaagacgaattagactttttaactaaacgtcttcaatttcttcgtgcgataaagtcaagcatgactccggagcaggtagatagaggagcgaaaggactcacgtctcttctttctgatcttggcattgatacgtctaaggataatgatttttcgttgggcaatggggagtctaaccagaaccagccaaaaattaaaccaaaaagtaatccgactgacaacgctttcaaaagtaggcttcttgatttacagaagcaggccgccctcattgaaacaaccggtaaaaaaactgcagaagtaaccgagctggagaagattaattttgatattaccagcggaaacctggaaaaattatcagaagggcagaaggaacaacttcgaactgcggctaaaatccttgattccaagaaggaagagttacggcttaatcaggaaaatgctaaagtagctgaatatgtttcagatctcgaaagacagaataagttagtccgccaagggtttgataaccaaatagttggccgttattctggtagtcgtgaacgttcacgcatgcaggataataatgatattcagcaagattttgcttctcgaaaggaagagcttttaaatcaatttcagtctggagatattgataaaagtctatacgataaaaagaaagaagcgcttcaaaactcgctgaatgaaaggctaagaattcaagaggaacactataagaagttagatgagttacaaagcgatggtgttgcaggtttcgtttctggaatatcagatcaagctgctgcatattcaaacctatatgcaaatatgcagcaagtaggtgcacaaacgttcagtagtctaactgatatggtaattaactgggcggaaaccggtaaattaaacgctcaggactttgcggcgacattcattcaatctgttggggctgcgttactgcaatatgcggctgctcaggtagcaatggcagcgttgagtgccttcactgcctggattggtgttccctatgtagggcccgtggtggcgtcaacccaagcaatagctgcggcagctgctgctggcgtgttcatgactgctatcggatcggcgcttcatggccaagctcatgacggaatcgactctgtgcccgaaacaggaacctggctcctgcagaaaggtgagcgcgttacgacagctaaaaccagcgccaaactggatgccactctggatcgagtagcaaatcagtcaacaggcggcggcgcgatttattcgccaaatatcaacattcccataaatggcaacccgtccgatgcgacggttgccctcgttcgcaaagctgctgctgaaggtgctgagcgcggctaccgaaaagctgtcaactcggtgactaccgggcagggtgatctacacagggcacttatggtgaaaaccaactcggggaggaaaattcgctga

SEQ ID NO: 6669 - DNA, 1542 bp, Klebsiella pneumoniae
tgtagaggcaaagcgataatctctttattcacctgtcacggaccgaacgccactatgactgaaaatacgccttatcagcagcttacccgtacctttcagcgcctgtcgcgcttttcgcatctcgccgccatcgccggctgggatatgttcgcgatgatgcccccgggcgggagcgtcgcccgcagcgaagcactggccgagctcggcgtgctgcagcatcagatcctgaccgataaaaaagtgggacaatggttacaggaagcccgccagcaggatcttaatgatgttgaacaggccaacctgcgggaaatgcagcgtcagtacgatcaggcggcgctgctgccggagagcctggtggaagcaaaatcgctggccggcagccgctgcgagcatgcctggcgcagccagcgtcccgccaatgactggacgggctttgccgacaacctacgcgaggtggtcagactgagccgtcaggaagcgcagatccgcgccgatgccaggggcggctcacgctacgacgcgctgctggatattttcgaaccggatatgaccagcgcgcggctggacagcctgttcgccgatctcaaatcgtggctaccttctctgcttagccaggcggtggagaagcaggcgaagcagacgctaatcgccccgcaggggcctttccccattgctgaaccacgggagctggggctgcaggcgatgcgtatccttggctttgacttcgacggcgggcgcctcgacatcagcgcccacccgttctgcggcggcgtaccccaggatgtgcgcatcaccacccgctacaacgaaaacgacctgctcagcgctctgttcggcgtgatccacgaaaccggccacgcccgctacgagcagaatctgcctcgcccgtgggtcgaccagcccgtaggactcgcccgctccaccgctatccacgagtcgcagagcctgttctttgaaatgcagctgggacgcagcgagcggtttcttaaccgcctgttaccggcggtgcgcgagcggtttggcgatcggccggcctttagccaggacaactttgtcgcctggaatcagcaggtgaaacccggctttattcgcgtcgatgccgatgaggtgagctacccggcgcatgtcatcctgcgttatgaaattgaacgtgcgctgatcgacggcgagattgaggtagatgatatcccgtcgctgtgggacgagaaaatgcagcactggctggggctgtcgaccaccggcaactatcgggatggttgcatgcaggatattcactggaccgacggcggattcggctatttcccttcctataccctgggcgcgatgtatgccgcgcagctgatggccgcggcccgccgcgcgctgccgacgttagatcgcgatattgaggaaggcgatttcagcgccctgttcgactggctgcggcagaatatctggcagcatggcagccgcttcaccacctcgcagttgattcagcaggccaccggtgaggatcttaatagccgctacttccgcgagcacctgaccactcgctacctgtaa

SEQ ID NO: 6670 - DNA, 1587 bp, Klebsiella pneumoniae
gtgcggggcaagtctgttaatggattaaccgggaaaatgctaatgtctgttaccacagaaaacgcccctgttcaggggcaaaccacgctgcaggaaaacagggcgggcgagggcgtttacgcctcgctgtttgaaaaaattaatctcaccccggcgtctcgcctcggggatatcaacgactttctggacgatgccgcgctctccgaggcgccggcggcggagcgtctcaccgcggcgatgcaggtgtttatggaacgcatccgtcagtccggccagcgggtggaaaagctcgacaaaacgctgatcgaccaccatatcgccgagctggatttccagataagccgtcagctggacgcggtgatgcaccatcaggagtttcagcaggtcgaatccctgtggcgcggcctcaaacagctggtggacaacaccgactatcggcagaacgtcaaaacggagatcctcgacgtcgccaaagacgatctgcgccaggactttgaggacgcgccggagcttatccagagcggcctctactggcacacctataccgcggagtatgacactcccggcggcgagccgatcggctcggtgatctcggcctatgagttcgacgccagcccgcaggatgtggcgctgctgcgcaatatctcccgcgtctctgcggccgcccatatgccgtttatcggcgccgtcggcccggccttcttcctgaaagagaccatggaagaggtggctgccattaaggatatcggcaactacttcgatcgtgcggaatatattcgctggaaggcgtttcgcgaaactgacgatgcccgctacatcggtctggtgatgccgcgcgtgctgggtcgtctgccgtacggtccggacaccgtgccggtgcgcagcttcaactatgtcgagcaggtgaaaggtccggaccacgaaaagtatctctggaccagcgcggcgttctccttcgcatccaatatggtgaagagctttgtcaataacggctggtgcgtgcaaattcgcggtccgcaggccggcggcgcggtgaaagatctgcccatccatctgtacgatctgggcaccggcaaccaggtgaaaattccttccgaggtgatgatcccggaaacgcgggagtttgagttcgccagcctgggctttatcccgctgtcgtactacaaaaatcgcgattacgcctgcttcttctcggccaactccgcgcagaaaccggcgctgtacgataccgccgacgccaccgccaacagccgtatcaacgcgcgtctgccttatatcttcctgctgtcgcgcatcgcgcactacctgaagatgatccagcgcgagaatatcggcaccaccaaggaccggcgtctgctggagctggagctgaacacctgggtgcggagcctggtgaccgaaatgaccgaccccggcgacgagctgcaggcctcccatccgctgcgcgatgccagcgtggtggtggaagatatcgaggataacccgggcttcttccgagtgaagctgtacgcggtgccgcacttccaggtcgaggggatggacgtcaatctgtcgctggttagccagatgccaaaggcgaaggcgtag

SEQ ID NO: 6671 - DNA, 915 bp, Klebsiella pneumoniae
gacgttttaaatatgaatatcgagttgcgtcatttgcgctactttgtcgccgtcgctgaggagctacattttggccgcgccgcggcgcgactgaacatctctcaacctccgctaagccagcagattcagatccttgagcagcagaccggcgctcgcctgtttgcccgtaccaaccgcagcgtcagcctgacggcggccggaaagcagtttctcgccgatagccgacaaatcctcgcccaggtggatgaggcggctgctcgcgccgcccgtctacaccatggcgaaacgggtgagctgcgcatcggctttacctcctcagccccttttattaaggccgtctccgaaacgctatcgatgtttcgccaacgccttccggatgtgcatattctcacccgcgagactaacacccgcgaacagatagtgcccctgagcgaaggggctctggatttggggctgctgcgcaatactcaactgccggacaccctggcgtgggagcgggttctgcgcgagccgctgttggcgatggtcccggcgaatcacccgctggcccgccagccctcggtcagcctggcggcgctggcgcgcgagcccttcgtctttttcgacccgcacgtcggcactggcctgtatgacgacatcctcggcttgctgcgccgctacggccacacgccgaagattgcccaggaggtgggggaggcaatgacgattattggtctggtggccgccggactgggggtatcgatcctcccggcctcctttcagcgcgtccagctcagtgaaatgcgctggctgccgatcgacgaacaggatgcggtatcggagatgtggctggtgtggtctaaacaccatgagcaaggggcactggcaaaacgctttcgtgaggcgctgctctcctggaaaagcgagcataattga

SEQ ID NO: 6672 - DNA, 1644 bp, Klebsiella pneumoniae
aacgcgttaaataagcgccctgtcgatactcagaaacgcaaaataaaaactaaagtaacttttgtaattaaagaaaccactgagcaagacgctggcgtaaacgttattttcaacaacttgcagatactcattatgaaagagaaaaagacaaccataccgcctgccggtgcagtcaagccaacgactgcgaataaaaaacctctcctgatgatggcgctgccgattatcgttgccgtgctgttattgttcgtcccggtccccgaaggcctgccgccgtacgcctggcactacttcgctatctttgtcggggtgatcgtcgggttgatttttgaaccgctgcccggcgccgttatcggtatcaccggcgtggtagttattgccctgtgcagccagtggctgctgttcagcccggatcagatggccgcgccaggcttcaaaatggctggcgcctcctttaagtgggcggtgagcggcttcggcaactccaccgtgtggcttatcttcggcgcgttcatgttcgccgccggctacgataaaacgcagttcggccgccgcctggcgctgattctggtgaaatatcttggccgtcgcagcctgacgctcggctacgccatcaccttcgcggatctgctgctggcgccgtttacgccatctaacaccgcacgcagcggggggactatctacccgattatcgctaacctgccgccgctgtacggttcaaagccaaacgatccgagcgcacgtaaaatcggttcctatctgatgtgggtagcgatcaccgccgcctgtattaccagctcgatgttcctgtcggctttggccccgaacctgctggccctggcgctggtcaaaagcattgttggcatcaatatctcctggggcacctggttcatcgccttcctgccgctgggtatcctgctgattctggccatgccgctgctggcctactggttctacccgccggaagtgaaagtcaataacgaagtgccactgtgggccgcgcgtgaactggaaaaactgggcaaactgtcgcgcaatgaaattctgctgctggtattcgtctgcttcgcgctgatgatgtggatcttcgccgccgactggatcgaaccggcgctggctgccctgctggttatcgtgctgatgctgtggaccggcgtgctctcctggagcgatatcaccaacaacaaagcggcatggaacacctttgtctggttcgccaccctggtggcactggccgacggcctctcctccaccggctttatcgcctggctgggtaaagagggcggcgcgctgatgagcggcatctccccggggatggcgaccatcgtcctgctgctggcgttctacctgctgcactatctgtttgccagcaccaccgcgcacaccaccgcgctgctgccggccatgctgaccattgcctcgactatcccgggaatgaatatggaagtgtttgtcctgctgatggtcacctcgctgggcgtgatggggatcatcaccccgtacggtactggcccaagcccaatctactacggcagcggctacctgccgaccaaagattactggcgcctcggcaccatctttggcgccatcttcctggccgccctgctgctgattggctatccgtggatgtccatgatgttctga

SEQ ID NO: 6673 - DNA, 360 bp, Klebsiella pneumoniae
cccttttcaaacacacagcttcccgatcttccatcggaggcggtaactatggctaaacgtatgcaagacaaagagagcattgccgggatgtcctggctggttctgctgatcattgcttgctggggtggacttgtccgctacctgatagatgtgaagcagagcaaggcaacatggagcttgatcaatgctcttgcccaaatggtggtttcagggtttaccggcgttattgctggcctggtgagcattgaaagcggactgagcatttacatgatactggccacttccggaattagcggggcaatgggttctgttgctttgacctatttctgggaacgcattaccggagttaaggcgccatga

SEQ ID NO: 6674 - DNA, 1281 bp, Klebsiella pneumoniae
tcaacagcaaaagattgtggccctgttccgcggcaaatcgcaccgcatcggcggcacaatcacgggagacgtgtaatgcgcgacgcctttatttgtgacgggatccgtacgccgattggccgctacggcggcgcgctggccagtgtgcgcgccgacgacctggcggcaatcccgctgcgtgagctcctgagtcgtaatcccgggctcgacccggcagcaattgatgatgtgattttcggctgtgcgaatcaggccggggaagataaccgcaacgtggcgcacatggcgacgttgttggccggttacccgcataccgtgccgggcaccacgattaaccgcctgtgcggatcgggtctggatgccatcggctttgccgccagggcgatcaaagccggcgatgccgatctgctgattgccggcggcgtggaatcgatgtcgcgtgcgcctttcgtgatgggaaaagccagcgcgccgtaccagcgtcaggcggaactctttgataccacgattggctggcgttttgtgaacccgctcatggcgcaacacttcggaactgacagcatgccggaaacggccgagaatgtagctgaattgttaaatatcagccgggccgatcaggacgctttcgcctggcgcagccagcagcgcgcggcgcaggcccagcgcgacggcattctggcgcaggagattgtgccggtgcagattgtcggccggaaaggggcggttagcgacgtgcgcgaggacgagcatccgcgcccggaaaccacgcttgagcagctggcgaaactgaaagcgccgttccgccagggcggcgtcattactgcgggcaatgcttcaggcgtcaacgatggcgccgcggcgctgatcatcgccagcgaacagcaggccgctatccaggggctcacgccgcgggcgcgtatcgtggcgatggcgacggcgggtgtcgaaccgcgcctgatgggactggggccggtaccggcggtgcgtaaagtgctggagcgggcgggactcaatattaacgatatggatctgattgagctgaatgaggccttcgccgcccaggcgctgggggtgctcagacagctcggcgtgccggacgatgcggcgcacgtgaatcccaacggcggcgccatcgcgttaggccatccgctgggcatgagcggcgcgcggttagcgctgagcgccagccttgagctgcaacgccggggcgggcgctatgcgctgtgtacgatgtgtattggcgtgggtcagggcattgccatgatcctcgagcgagtgtga

SEQ ID NO: 6675 - DNA, 441 bp, Klebsiella pneumoniae
attccggcaaagctgaagcgtccccggtgtcgctctcatctggctgccagccagctacccgcgtcaggccgctatgtcgggataaccacgtcgtccaggccgacgatgccagacttccgggcagcgagggcccgaggccccacagcacggccgcaggggtcagaggtggcaggtcggtattctcttccgtcaacacggcatggacgtgctgttcagaccagcccatcaggctgttcatcagcacctgctgctccagcgcggccgccccgccggcgcgtacccaggccggtacgaaacagggggcgcaggagggctgccagactttcaccgcttcacccggtatcgccgcctgccacaacaggtcgcgactcatcgcgctgcccacctgcccctgcagcgccagcggtacggcataccccgtctgctgacgcagctggctga

SEQ ID NO: 6676 - DNA, 444 bp, Klebsiella pneumoniae
tcaaagcaaaaggccgcttttgctacggcagactcctccagcgcgcgatacactgcggcttttcgccacaggcttaagggagacactatggaactggcttctctggtccgggatatcctccggcagcggcacgttgaacgtctggcgcagcatcgtgaacaggataatgaagcggaagcagagtgggagatcgcccgctggcggcatcgcagcggggtggtgatccagcgccgctatgagctcgagagcgcgcagcaggatagcgcatcctgcccggagtgctggattgactggcaggttatcgacgccgccggccaggaggtcaacccgatgcgcaaacagttttataacctttgccagcaatccttctggctggctatgcaggcgggtggtgaagatgagacctcagacagaattgctcagataaccgacaatcacccgtaa

SEQ ID NO: 6677 - DNA, 333 bp, Klebsiella pneumoniae; identical to SEQ ID NO: 1044

SEQ ID NO: 6678 - DNA, 519 bp, Klebsiella pneumoniae
ttcgggcccctgatttttcacattgccgaccgcccgcgttaccgggtgccaggtaaaatcgtcggcggaaacggctccgtcgctggctatctccgccgcttccgcgccggtgacatcctgcctcatccattcccgggcggcttcaggcgccaggaccaacggccgacggtcatgaatatcgacaagaccgcgatcggcggcggccgtcacgatcaagaatccttcggcatggtccccacgttcgaacggagtccgaccaatcgcggccataaaaattggctggccatccttacgctggataaagtatggctgctttgtatttccttcctttttccactcaaaccagccgtcggcgaagcagatcgcccgtccgtgctcccacagcggcttgaacatcctgctggaggctgcagtctcaacccgggcattaatcagcggcggtttatcccaccatcctggcgcatagccccagtaaacggcatcgagatggagttgctcatcgcgttcattgaggagtaa

SEQ ID NO: 6679 - DNA, 261 bp, Klebsiella pneumoniae
gaccagggaaacataaaccagtgcgcgaataccttttttagacataagccctccgaacgcaggggaaatagagttcaggctatcatcgccggtactacctctctatttactcaacggcagggcgacggtaacaacgttttcggtgagaaaatgtttcgcattgaaaataattacgagaggcgtaaagaagtgcgaattccggtgaagatctggtgggtaaaagtattatttttgggcattatgctgacaaaccaggaataa

SEQ ID NO: 6680 - DNA, 2646 bp, Klebsiella pneumoniae
ctgcccatgaagggtaaatataaagccgccatcgcgctggtgttagttctggtgttattgccgctaaccctgctgttgacgctaacccactgggtgccgacgctggcgggcatctggctgcccgtgggcacgcgtatctctttgcaggagagcccgcgcctgacgcggtcggccctgctgatccccgatctgcgttatctggtgggcgactgtgaaatcgcccgggtgaccgatgcccgtctctcgcgtcccagccgctggcggctgcatattggccagctggagatcaacagcgcctgcctgagcaaactgccggccagcgatccctctcccggttcaccgcgcacgcttgccgaatggcaatcgatgttgccctatagctggttaaccattgacaatctgcggctgtcgccgtgggagaaatggcaggggcggctggtaatgtcattaacgcctgcgcacaaagatatcggctttgccgggaaggaactgagtctgcaggcgcgcctgcgcggccaggcgctcaccgtcagccagttcagcgcccggctgactgacgatcagccgccggtgaagttggtggggaccttccatctgccgctggtgccggatggtctgccggtcgacggccagatgcagggcaccttcgaattcccgcagactgcggaatggatcgatgctgagctcgagtggcagcacaatcgcggccagctgctggtcaccccgcggggtgaggtagagcctattctggacctgccgtgggagatcaccccggagcggatcaccatcagcgacggccgctggcgcacccgttacgaggcgtatccgctgcgcgggcgggtggcgctgtcggtgggtaactggcagcagggcaccgaacagatgatcgtcagcggtcgcctgaatgttctcaccgaggggcatgccgggaagggcaatgcggtactgaatattggtccgggcaagctgagcatggataacagcgatctgccgctgcggctcaccggcgaggccaagctgggggagatgatactatacgcggcgctgccggctcagctcagcgggccgctgatcagcccgcagctggcttttcaccccggtgcgttgctgcgctcgcgcgggcgggtgatcgacgcgctgaatattgacgaaatccgctggccgctggccggggttaaggtcactcagcagggcgtcgatggccgcctgcaggcgatccttcgcgcccatgagcagcagatgggcgactttacgctgcatctggacggtcaggcgagcgattttctgcccgacagcggccgctggcagtggcgctactggggcgagggacattttaccccgatgcaggcgcgctgggatgtgaagggcagcggggagtggcgcgacaatgctattaccctgagcagcctttccaccggcttcgataagcttgagtacggcacaatgcgggtcagcaccccgcgtctgaccctcgagcagccgatccgctggctgcgcgatgctgagcatccgcggttgaccggcgcgctgtcgctggacgccgccaaaaccaccttctccggcggcagctatctcccggcctcaacgctgaaattcgctctcgacggtcgggacccgacgtggttccagttcaccggcgccctgcatgccgaggctatcggtccggtgcgtctgtccgggcgctgggatggcgaacggctgcgcggccaggcgtggtggccaaaacagtcgctaacggtgttccagccgctggtgccgccggactggaagatgaacctgcgcgaaggcagtctctacgcgcaggtggccttctcggcggcagccgggcagggatttgaggcgggcggccatggcgtcctgaagggcggcagcgcctggatgccggataaccagatcaacggcgtcgatttcgtcctgccgttccgcttcagcgacggtcactggcagctgggcatccgccgcccggtctccctgcgcattggcgaaatcgtcaaccaggtcaccgcgcgtaatctgacggcggacctgcagggtacctggccgtggagcgaggccaatccgctgcagctcagcgacgtcagcgtcgatctgttaggcgggaaactgacgctgctgcagctgcgtatgccgcagcgcgacccggcgttgatccgcctgcagcatatctccagcagcgaactgaccagcgccgtcaaggtgaaacagttcgccatgtccggcgcggtgagcggcgcgctgccgctgtggctggagaataatcaatggatcatccacgacggctggctgcgcaatgacggaccgatgaccctgcggctggataaagacaccgccgatgcgctggtggcggataacgtctccgccggggcggcgattaactggctgcgctatatggaaatctcccgctcgtggacgcagattaacctcgataatctgggcgtgttgacgcttaaggccagcatcaacggcaccagccgggtggacgggaaaagcagtaccgtgcatttaaactacgctcatgaagagaatattttcgacctgtggcgcagtttgcgcttcggcgacaatttacaggcgtggctcgagcagaatgctacgctgcccgtacggcgctgtacggacggtaagacatgtaaggaacctaaatga

SEQ ID NO: 6681 - DNA, 369 bp, Klebsiella pneumoniae
ttaaaaatgaatcactatctaagagcttttgtaatttctttctttctgactggatgtggcaatcaccttgtatttgagcctaataagttaccagatggatatatagatcaggaatattatgttccaatcaccatctctggaggtacaggaccagttgttgatctgagttatgaaattcacccatcaaattctggattgaaattagtattttctgaaaaaaaatattacacaaaatatgtatataataactttactatagaaggtaagcctcagttgcaagggattgtaacaattaatattaggggcggggttgttgctagtgcggggcaatattttgaaaaacaatatgagattaatattcagaaataa

SEQ ID NO: 6682 - DNA, 771 bp, Klebsiella pneumoniae
ttgacgatgaagtttaaaactaattcatttttgtttatgatgctttgtgctactgctcttaattcttgggctggatattacaacacaattgatatcgatggtgtaagcatccatttagataaggataaagctggatatgcaaatgttcacgatgatcaattaaatacggattactcatgcaaaatagaaaattggaatgattcattaatctctggtgctggagatatttctctaactagtgatcatttaggcgtgcttttagcatcaggaaataaatatcttgatgttaaggagcttatagattgcaaaggacagtcaattcgaattcattctattcattactttaataattcaatttcttctatcatagatgttaattttgaaaaaaaattagttctggcattagttgtgattgatgctcactttaggtcatatcaggcgatagtatctaagtttaatgggaataaaaaccttttgtcaggcaaaggtttttggagtaattcctcatctgagccagatcagaatagcttgttttaccctggtggttcaatatatctagggaaaatatctgtcaatggagaatatattgcgccaaacgatttggattgtgcggttgattcattcccaggtgtgtgggatatagcaagaaaaatgaaaattatattcccaagagataaagatgatgctgtaattgacagtaaatgccgacagcttttctcgggagagaaaacacttgatgaattggggggggagcttatcaatatgaaatga

SEQ ID NO: 6683 - DNA, 858 bp, Klebsiella pneumoniae
tcctctgtgaaagcgatgaatactttacaatcgactaactggcttcagtacggtataaaagacattaaacacctcaaacacgccaatatgcacgatccattgattccattcgaaccggtgttttccccccagggacccactttactcgtcgcggtacgtcagtctgaggtaatacgggagactccacgccaccatcacagctgtgggcagttaatcggtgccatacgtgggctacttacggtcgatggcggtgattgtcgctgggtggtaccggcaacacatgccgtctggataccgccaggtgttccgcacggcctgcgctcgcacggtccatattcaggatggagtgtttatgtttctgccaaagcctgtggcgagctacctgataagccatctgttctctcaatgacaaatctgctgcgtgaagcgataacgcgagcggctgcatggcaaggtgtagagcttactgcgtcccaaaaacgtttagctggcgttattcttgatgaaattggttcccttcccagggttaatcttgggcttccaatgccgcaagatagccgattgctcagaatcgcgcaggcgctgtcagcaaacccggacgacgggtgcaggttggaagaatgggcagcctgggccggcatgtcatcacgcacgctcacgcgacgattccgagccgaaacgggttttagcttcaatgaatggcgacagcggatacgcttactcagggctcttgagcttctggctgccggcaagccagtgacggcgatagcgctggatctgggatatgacaatgtgagtgccttcatagccttgttccgtcggatgttcggcactactccagggcggtataaaatttaa

SEQ ID NO: 6684 - DNA, 2154 bp, Klebsiella pneumoniae
gcaatgtcgaatcaggaatctcccggcggcgtcagccgacgcgcgctactaaaatctacagccctcggctccctggcgctggccgccggcgggctgaccctgccctttacgctgcgccgcgccgcggcggcggtacaacaggctacaggcgacacaacccgcattgtctggggcgcctgctcggttaactgcggcagccgctgcgccctgcggctgcacgtgcgtgatgatgaagtggtttacgtcgaaacggataacaccggcgacgaccgctacggcgaccatcaggtccgcgcctgcctgcgcgggcgttcgattcgccggcgcatcaatcatccggatcgccttaactatcccatgaagcgcgtcggcaagcgcggagaaggcaaatttgtccgcatcagctggcaggaggcgctggataccctcgccgaccgcctgaagagcgtggtagcgcagtatggcaacgaagccgtatacattaactactcttcagggatcgtcggcggcaacatcacccgttcgtcgccttccgcgtcgccggtagcgcgtttaatgaactgctacggcggctcgcttaaccagtacggtacctacagtactgcgcagattgcctgcgccatgccctacacctacggcagtaacgacggcaacagcacctcggatattgaaaacagcaagctggtagtgatgttcggcaacaatccggcggagacccggatgagcggcggcggcattacctggtatctggagcaggcccgcgagcgctctaacgcgcgaatgatcgtcatcgatccgcgctacaccgataccgccgccggtcgggaagatgagtggatccccattcgccccggcaccgacgccgcgctggtggccggtatcgcctgggtgttgattaacgaagatctggtggaccagcctttccttgataaatactgcgttggctacgacgagaaaacgctcccggccggggcgccggcgaacggtcactacaaagcctatatcctcggcgagggcgacgacgggatcgctaaaacgccgcagtgggcctcgcgtattaccggtatccccaccgatcgcatcattaagctggcgcgcgaaatcggcatgagcaagccggcctacatttgccagggctgggggccccagcgccaggcaaacggcgaactcaccgcccgggcgatcgccatgctgccgatcttaaccggcaacgtcggcatcaacggcggcaatagcggcgcccgcgaatcaacctacaccatcaccattgagcgcctgccggtgctggaaaacccggtgaagaccgccatctcctgctttacctggaccgacgccatcgcgcgcggtccagagatgaccgccagccgcgatggcgtacgcggaaaagagaagctggatgtgccgatcaagttcctgtggaactacgcgggcaacaccatcatcaaccagcactccgacatcaataagacccacgaaattctgcaggatgaaagcaagtgcgaaaccattgtggttatcgacaactttatgacctcgtcggcgaaatacgccgacctgctgctgcccgacctgatgaccgttgagcaggaggatatcattcctaacgattacgccggcaatatgggctatctgatttttattcagcccgccacctcagcgaagttcgaacgcaaaccgatttactggatcctaagcgaagtggcgaaacgactcggcgacgacgtgcatcaacgttttaccgagggacgtacccaggaacagtggctgcagtatctgtacgccaaaatggtggcgaaagatccggcgctgccggcctacgaggatctgaagcgaatgggcatctacaagcgcaaagacccgaacggccacttcgtcgcctatcgcgacttccggcacgatcctgaagcgcatccgctcaaaaccccgtccggcaaaattgaaatctactccagccgactcgcagagattgccgcccgctggcagctggagaaagacgaagttatcagcccgctgccggtctacgcctccacatttgaaggctgggacgatccgctgcgcagccagtatccgctgcagctgtttggtttccactataaagcgcgcacccattccagctacggcaacgttgatgtattacaagcggcctgtcgctag

SEQ ID NO: 6685 - DNA, 885 bp, Klebsiella pneumoniae
aggccagcgaaatcgttgcttcgcagccggaagatcgcggcgaattcttcgacccggcggaaagcaaagtctaccgtcatccgactttctataccgtgccggacggcatggaacatatgtgaggcggcgatgaataaccctaaccccgtagccacctacgccctgcggcttggcgacaatggtctggttctggcccagcgtttaggcgcctggtgcggacatgctcccgagctcgagatcgatcttgcgctggccaatatcggcctcgacctgctcggccaggcgcgcaattttttaagctatgccgccgagcttaacggctgcggcgacgaagatacgctggcttttggccgcgatgagcgccagtacagcaacctgctgctggtggagcagccaaacggcaattttgccgacactatcgcccgccagttctttatcgacgtctggcatgtcgccctgttcagccggctggtgaacagccgcgacgcgcagctggcggccattgccgctaaagggctgaaagaggtgcgttaccaccagcgctttagccgcggctggctggagcgtctgggtaacggcaccgaattatcaaatcgcaaaatgcagcaggcggtcgacaatctgtggcgcttcaccggcgaactgttcctggctgatgaagtggagctcagcctggttgagcagggcattgcggttgatccgcgtgaactgcaggccgaatggcaaagcgcggtacacacggcgcttctcgactccggcttacagatcccgcaggaagcggccttccgcagcggcggcaaacaggggctgcacagtgaacatctcggcccgctgctggcggagatgcagtatctgcagcgttcgcatcccggactgcagtggtaa

SEQ ID NO: 6686 - DNA, 204 bp, Klebsiella pneumoniae
cccctgaagaacagcaggatcggtgaagacgtcacgaatgtcatcaagcccatcctgcaatggcgtaaggtcaactttagccagccccgaagcaatttccattttaagaccgcgggcgctagtctctatatcctgaaagaactgattaaccttaacaaggttatcaatatcttcttgcggtggtgcgacaccaaaatcttttga

SEQ ID NO: 6687 - DNA, 1008 bp, Klebsiella pneumoniae
tcactggagaaaagtcttatgaaaatcgcggtttatagtacgaagcagtacgataaaaagtacctgcagcacgttaatgatgcatacggctttgaactggaattcttcgatttcctgctgacagcgaagactgccaaaaccgccaacggttgcgaagcggtatgtatcttcgtcaatgacgacggcagccgcccggtgctggaagagctgaaggcccacggggtgaaatatatcgccctgcgctgcgccgggtttaacaacgtcgaccttgaggcggcaaaggagcttggcctgcgcgtcgtgcgcgttccagcttactctccggaagcggtcgctgagcatgcgatcggtatgatgatgtcgctcaaccgccgcatccaccgcgcttaccagcgtacccgcgatgccaatttctccctcgaaggcctcaccggcttcaccatgtacggcaaaaccgccggggtgatcggcaccgggaaaattggcgtagcgatgttgcggatcctcaaaggcttcggcatgcgcctgctggcgttcgacccgtacccaagcgccgccgcgctggagctgggggtggaatatgttgacctcgccacgctgtacaaggaatcggacgtgatctccctgcactgtccgctgaccgacgaaaactaccacctgctcaatcgcgaagccttcgatcagatgaaagacggggtgatggtgatcaacaccagccgcggcgccctgatcgactctcaggcggccatcgacgccctgaagcaccagaaaattggcgcgctggggctggacgtttatgagaacgaacgcgatctgttctttgaagacaaatccaacgacgtgatccaggacgatgtcttccgccgcctctccgcctgccataacgtgctgtttaccggccaccaggcgttcctcaccgccgaggcgctgatcagcatttcggagaccactctgggtaacctgcagcaggtcgccaacggcgaaacctgtccgaacgccatcgtctaa

SEQ ID NO: 6688 - DNA, 864 bp, Klebsiella pneumoniae
tgctgcaggaagttatcaaaaaaagttctgaggccggctcagaagcgtcaggcggtgcattttctgcgggaggcttaccgtatcagtgtccgacggggatgcggactgctgatgcagagcagaaccgtttaccactggcagagccggcgggatgatcgggcgataaccctgcgtatccgggaaatagcggaaacccggatccgctacggttgcccgcgtattcatattcagctgcggcgggaaggctggcctgttaaccacaagaaaacacaccggatttactgtctggaaggcctcaacctgcgcaaaaagcgcccccgcaggcatgtcagtgcagcacatcgtcagcaacgtccggtcctgagcggagtcgatcagtgctggaatatggatttcgtgtcggataacccgtttaacggacgacgtttccgggcgctgactgtagtggataattttagtcgggagtgtgtggcgatccatgccggaaagtcgctgaaaggtgaggatgtggtcggtgtgatggaaaggttgcgggtgctgggcaagcgcctgccggtacgtattcagacagataacggcagcgagtttatctcgaaaagtctggataaatgggcgtatgagcacggtgttacaatggacttctcccgctccggaaaaccaacggataacccgtttattgaatcattgaacggcagtctgcgggatgaatgcctgaacattcactggtttctctcgctggaagatgcgcaggacaaactcgacaactggcgcagggaatataatcatgagagaacgcattcatcattaaatgacatgactccggctgaattcatccgaaatctccggaaagacgaagatctctga

SEQ ID NO: 6689 - DNA, 270 bp, Klebsiella pneumoniae
caaaccgctgaccccgccatttttgcatttgtgtcctcaatgcgccgggtacccgtgaccagatcaatattttgcgtggttcgcggagaaaatggctgcctgccgggagaggaaccacctgcgccgggcgacatggccgaggcagatcaagctttaggcgaaaatttgctagaaaatgttaatgaggcgcataaatacgtacttcccctctcgacgccgcccgccacgctgcctattattctggggtttgcttttttaagacgtttctga

SEQ ID NO: 6690 - DNA, 1230 bp, Klebsiella pneumoniae
atgttgtatgatgccggcaaggatagccgcttaaacattgagggattaatgatggcagtttacaagcttagtacacgaataagatctaatgttccaacagattctttgctttatgacctgtgtatttatcgtatggactctcgcaggaataaatattccctgatagatgtgaagcaacagccattttctggaacttttgaaacacaaactcacatgacaggaaatgtagatgagtcactctcgacaatttatattatggaaatgaatctttaccgcaaaaccatgttgcatacggtctgtgtgacccccgttccattcactaaaatgtacacacttgaagcctttgcatcaggcaacgcctggtcttcggaaaagcgagagaacctctgttattttgagacaaaagggacaatgaagcctgcaagcgagggtggggaaacaaaggagataagaattactattcctgaacgtccatttattgcgcgagagtatcccataggttcaccgcaagatccgtttaaaaaaaagaagatagaatcagaaattcagaacagattctataatctctcatatccttctcagtccggagcgagcgtgtgcggccctgctgcattcttttactgtctgcaacaagaccgtcctgatgtatatgcccaggccgccagggaactgtggcgatatggaaaaactaaaataggcgcactgacaatctcaccaggagagggatgtagacatccaacgggtatgttttttaccagtgatgggcagccaagaatattaggactagactggataacgcttgctggcctgagggattcagagaatgcagcgctgagcttcgatgctcttgattctccagtggcaggtatcaccatgtggcccacactagcggaatggtttgaaaaagcaggttatgaaatggtctttagtaatgtaggaatcactcaagctggtgtccaaggaatccgagatttgaataggtatgtagcgcaaggctttaaagtcgtcacattaataaatgacggactgctcgaaggcagtacaaataacacaacgttacctacacactgggttgtatgggatagttctgtaacacaagacgataatggatatgttaatttaaaattattttcttggggccgttcaacttactggataaaaaagggaaaagatgtgcgtttttttctcaacagattttttgggggaatggttttcaagccattgaagtga

SEQ ID NO: 6691 - DNA, 936 bp, Klebsiella pneumoniae
tgggataatgagcgccgggggggtaacgaaatggacaaactggatgccatgcaggtctatgttgcggtcgtggatacccacagcttcgcccgcgcggcggaggtgctcgggcagccgcgctccacggtatcgcgggtggtgaaggagctggaagcctggctcgggacgcagcttctccagcgcaccacccgcaagctcagcgtgacggcggagggtcgccggtattatgaggagtgtaaaaggctgctggccgagatggcggcgatggaagcctcctttcccgggcgctcggctcagcccgccgggcggttcaaggtagggatgccgcaatcccttgcccgccactgcattctgccgaggatcggcgagtttttgcagcagtatcccgatctggagctgatcctctgctcaagcgacaacgtggaagatattattcaggagggattcgactgcgtgatccgtaccggacggatcgaagattccaccaccctggtggcgcgtcctctggcccgctaccgctggatggtcctcgcctcgccggcctggctcgcggcccacggccggccgcagagcatcgacgaactgcaccagcatcgggcggtgggctaccttaatcaccgtaccgggcggaccatcgactggcttttctccctcgatgacggcgactgcgcgatccgcatgcgggagacgctggtggtcgacgatactgatgcctacattcaggccggcattcaggggctgggcctgatccgcgtcgccagctatctggcgcaaccttttctgcagagcggggcgctggtcgcctgtctggagcaggccgcttctgatctccccttgtcgctggtctatccgcaaaaccgctatctgccgccggcggtgcgcgcgttttatgactggagcaggcgcgttctgcaatccccgctcagcgaggcctga

SEQ ID NO: 6692 - DNA, 192 bp, Klebsiella pneumoniae
ctggcggatgagctttgcgacactggcgtgaacatggggcccagcgtcgccagtaagttctttcagcgctggctcactgccctgaatatgcgcggaaagctgtatcccgatctgattccggatggcgccattggtccccgaaccatcaccgcgcttaagggatacctttccgcccgcggggaaagagggtga

SEQ ID NO: 6693 - DNA, 651 bp, Klebsiella pneumoniae
tattgtagtgatgattacaatatgctgcggcaaaacaggctgtcaaggattaatatagtgaccactacaaaacaagggcgtactccgggacgtccccgccagtttgatgcggaacaggccattgaaacggcgcaacgcctcttccacgcgcgaggctacgacgcggtgagcgtggccgatctgacccaggctttcggcatcaatcccccgagcttttatgccgctttcggcagcaagctcgggctgtatacccgcgtcctgcagcgctacagccagaccggggccattcccatcgatgccctgctgcgagacgaccagccggtggcggcgtcgctcatcgccgtactgcaggaggcggctcgccgctatgtggccgatccggccgccgccggctgcctggtgctggagggggtacattgtcaggatgctgatgcccgggtggcggcaggcgaatggcatgctgcggcaagagccaaaatccagcagtatatcgcccgccatcgcccgcaggacgcgctgcgggtgactgactatatggatacgctgatgcttggcctgtcggcgaaagcgcgggaaggggatagtctgccgcgtcttctggagaccgtgcggctggcaggcctggcgctggagcgcatcctgccagcctga

SEQ ID NO: 6694 - DNA, 459 bp, Klebsiella pneumoniae
agctctaacgatattgacagacgacctatggacaatcgacagcttaccttctcccatcttttatacctcaccgcgcaccactggcggctggcggtcaatcgtcggctgaaaaatctcggcctcagccaggccagctgggtggcggtagcgtccatcgcccgccaccagcagccgctgtcgcaaagcgaactggcgcaggagctgggggtggagagcccgaccattgtgccgttgatccatcgtctggtcgccctcggactggttgagcgcatcaccaccgccagcgacaaacgtaagcgactgctggtggtcaccgacaaagggaaggccctctatgaacaggtcaaaacggtggctgacgatctgcgcgaagagatcctgacggcgattaccccacaggagcaggagcaaacccagcgggtgctggaaaagctgttgcgcgaagtggagaagaaataa

SEQ ID NO: 6695 - DNA, 567 bp, Klebsiella pneumoniae
ctggataacgaccagataaccaacaaccccaaactgacccgccttgtgcgggtttttcttttatggagacaaaacatgtctgtattaacgcaaggcacgcagttttttgtgctcaagtctggcgtggtcagcgaggttgaatgcatcaccagtttcaaccccggcgggaaccctgccgatcagattgaagatacctgtctgagtgaacgggattccagaacctacaaaaaggggcttaaaacgcctgcggccgcaaccgtcgggcttaacgctgatccgacgaacgccagccacattatgttgcatggcctcgctgaagcgaatgaccagacgccgttaacttttgcggttggctggtcagatggaaccagtgtcccgacagccgccgctcctggcgctgaggatgctgttgatggcctggtgctgccatcggatcgcacctggttcattttccagggttacgtttctgacttcccgtttgattttcagggtaacgctgttgtgacgacctccgccacgatccagcggtctggctcttccgtatgggtgcctaaggccgcagcgtaa

SEQ ID NO: 6696 - DNA, 201 bp, Klebsiella pneumoniae
cctatgaacgagcaactggtaaacgcgatgatagcagcgctgagagaacaaacagcagcacagcgagagcagacggaagcgataaaccgcctggctgagtctaacgtcgccctgtccgatgtgattatccagtcgcttgccggcgatctcgaagaggcgccagagcagcaaacctatctgagtgggaaacccagggggtga

SEQ ID NO: 6697 - DNA, 1758 bp, Klebsiella pneumoniae
tttatggacgatttaaccttgcgttattacgacgctgaaatgcgctacctgctggaagcgggtgaagagtttgcccgcgctcatcctgagcaggcggcaatgctcaatctcgacaaagcgggcgctcgcgacccctttgtcgagcgtctgtttgaaggttttgccttcctgatgggccgcatgcgcgagaaactcgatgacgatctgcctgagctgaccgaaggcgtggtcagtctgctgtggccacattatttacgtaccattccctcgatgtcggtcgtggagttcacccccgactggccggaaatgaaagagccgatgacgatggccaaaggctttgaagtgctttcccggccgatcggtgaaaagggcacgcgctgccggtacaccaccaccaaagcgatcgctctgcagccgttatccctggaacgcgtccagctggccaccgatacggatggccgttcggtgatcacgctgcgctttacctgcagccagctgacggactggcgccgggtcgatctcagtcatatcccgctgtactgcaacgccgatgcgccgctggcctgcgccatgcacgaggcctttaccctcaatgtggcccggatgtggctgcgcatgcccgatgaggtggacagaaggccgctggacgggtatttcagcgcgctgggatttggcgaggatgacggcctctggcctgaagatggccgcagttttcgcggttaccaactgctgctggagtattttaccttccgcgaaaagttcatgttcatcgatctgcgcgggctggagacggtggcttttccggccggactggcgtggtttgaaatcgacgtcgtgctggcggaacgctgggaacatgacttccgcttcagcgaaaagcagctgcgcctgcactgcgtgccagtgatcaacctgtttccgctggagtccgatccgctgaccatcaattccctgcagaccgaatacccgctgcgcccgatgcgcgtgcaggacggccacaccgaaatttacaccgtcgattccgtgatctcctcacaccagcaggtttacgcgccgttctcaagttttcgccacaaaggcggcatgatgcgtcatgacgctgcggactattactatcatacccgggtgcgccgtggcccctccgggctgtacaacacctggcttatcgtcggcggagaagcctttgataatcataccgtaccggaggatgaaagcctgtcgctgaccctcaccggaaccaacggccagctgccgcgtcgcgcgctgcagagcaccgtgctcgatacggtgatgaaaaccacttccgccagtattgcagtgcggaacctctgcgcgccgacgctgccgtgctatccccccgcccaggaccgttttcactggcgggtgctgagccatctgggcagcagttttctttccctgatggataacgcggaggtcctgcgcggcaccctggcgctgtatgaatggaccgacagcgagatgaatcgtcggcgtctggaagccatcctcgacgtgaagcaccgcgcaacagagcgctttgcacagggccatctggtgcgcggcgtgaagattgaagtcaccctcgacagtcacggctttgccggacgtggcgatatatgcctgtttggcgagatgcttagccgcttcttcgcgctctacaccgatatctacttgttcaaccgcctgattatcattctgcaaccaaccggagaacgactggaatgggaagagaagcacagccgccgcattcccggctga

SEQ ID NO: 6698 - DNA, 1338 bp, Klebsiella pneumoniae
tttacctgcgagtaccctacaatgataactactacaaaattagatccgattgaaaccgcatcgcgtgacgaactgcaggccctgcaaacccagcgcctgaaatggacgctcaagcatgcgtacgaaaatgtgccgatgtatcgccgcaaattcgacgccgccggcgtgcaccctgacgactttcgggaattaaacgatctgcaaaaattcccctgcaccaccaaacaggatctgcgcgacaactatcccttcgataccttcgcggtgccgatggagcaggtggtgcgcattcacgcctcttccggcaccaccggcaaaccgacggtggtgggatatacgcaaaacgatattgataactgggccaatattgtcgcccgttcgctacgcgcagccggtggttcagcaaaagataaaattcacgtcgcctacggctacggcctgtttaccggcggccttggcgcgcactacggcgcggaacgtttgggcgcgacggtgatcccgatgtccggcggacagaccgaaaaacaggcgcagctgatccgcgatttccagccggatatgatcatggtgacgccgtcctactgtctgaatctgattgaagagctggagcgccagatgggcggcgatgcccgcggctgttcattgcgggtcggcgtctttggcgctgagccgtggacgctggcgatgcgcgcggaaatcgagcgccggctggggatcaccgccctggatatttacggtttgtcggaagtcatgggaccgggcgtagcgatggagtgtctggaaaccgttgacggcccgactatctgggaagaccacttcttcccggaaatcgtcaacccggacgacggtacgccgctggaagatggcgagcatggtgagctgctgtttaccaccctgaccaaagaagcgctgccggtgatccgctatcgtacccgcgatctgacgcgcctgctgccgggaaccgcgcggaccatgcgccgcatggatcgcatcagcggacgcagcgacgatatgctgattatccgcggggttaacgtcttcccctcgcagctggaagaggagatcctcaagtttgaacacctggcgccgcactatcagttagaggtcaatcgccgcggtcatctggattcgctggcggtgcgcgttgagctgaaaaataacgggctggcgctgagtcatgaacaacgctgccagatttgccatcagttgcgtcaccgcattaagtcgatggtcgggatctccaccgatattactatcgtcaactgcggcagcattccgcgctcggaagggaaagcctgtcgggtattcgacctgcgaaaagcggtggttagcggttaa

SEQ ID NO: 6699 - DNA, 732 bp, Klebsiella pneumoniae
tgtgcaatagacatgaataaaatcgtttttgttgaggatgaccctgaggtaggcacgctgatcgccgcctatctcggcaagcatgatatggatgtggtggtcgagcctcgcggcgaccgcgctgaggaggtgatcgcgcgggagaaaccggatctggtgctgctggacattatgctgcccggcaaggacggaatgacgctctgtcgcgatctgcgcgggcaatggcaagggccgattgtcctgctgacttcgctcgacagcgatatgaaccatatcctctccctggagatgggcgccagcgattatattctgaaaaccaccccgccagcggtacttctcgcgcgactgcgtctgcatttgcgccagcatattgctccggcaggcgccggatccgcctcctcaacgctcacgccacataaaaccatctctttcggctcgctgaccattgacccggtcaaccgccaggtgctgcttggcggagaaaacgtcgccctgtcgaccgccgatttcgatctgctgtgggagttggccacccacgccgggcagattatggaccgcgacgcactgctgaaaaatttacgcggcgttacctatgacgggatggatcgcagcgtcgacgtggctatctcccgcctgcgcaaaaaactgctcgacaacgccacggagccctatcgtattaagaccgttcgcaacaaaggctacctgttcgcccctcacgcctgggataactaa

SEQ ID NO: 6700 - DNA, 249 bp, Klebsiella pneumoniae
gacatgtcagagatcactgcatccgagcaaatccgcctggatataatcaagaaagttaattatgacaccgcagcggccaagctggccattgactgggtaggcgacagctatctgaagtctgagctattcgctgactctttcgatcgtgttttcacggaaagtgagattgtctcgaagacccgtaaggccatccaggaagcgactgaggcgctggcgctgtttgataccatcgcagagcaggcgagctaa

SEQ ID NO: 6701 - DNA, 561 bp, Klebsiella pneumoniae
ttcgctggcctccggctgttcatccagcaactgcatcaggaggtcgcttccgaggttggcggtcatcagtatcactgtgttgcgaaagtcgatttcacgcccctcgccgtcgcgcattaccccccggtcgaagacctggtagaacaggttcatcacatcgcgatgggccttttccacctcatcgagcagcaccacgctgtaggggcgtttgcgcaccgcctcggtcaggatcccgccctggccgtagccgacgtagccgggcggagaacccttcagctggctgacggtgtgcggctcctggtactcggagagattgatggtgatcagcgctttctcgccgccgaacagcgcatcggccagggcgagcgccgtttccgttttgccggtgccgctcggcccgaccagcaggaacaccccttgcggaccgttctccggcgtcaggccggttttcgcggcgcgcaggcgccgggcaatagcgctcagggccgcctcctggccaaccacccgtttgccgagactctcttccagactcagcagctccgtctgctcatctttcattag

SEQ ID NO: 6702 - DNA, 474 bp, Klebsiella pneumoniae
tgctctccagaaaaaacggcgctgaaacagcgccgattattaagaaggttggttcgccgggaggaattatgctgccggctgtgcagtcggtttagcggcctggtgtttagtggttttgtggtgttttttcgctgcctgcgctttctgggctgccggtttagccgcagctttgtgatgctttttcgccgcctgagctttctgcggagcagctggtttagctgctacttttttgtgttttttagcggcctgggctttctgagcagcggctggtttagcttctgcttttttgtgttttttggcagcctgagctttctgctctgcggccggttttgccgcggctttgtggtgttttttgtgatgggtggtcttggcagccgtgctgtgggtggcagccggtgcctgagtggtgcttactgcgtcagcagcgaaagcggcggaagagagacccatagcagcggcaacgaccagagctaa

SEQ ID NO: 6703 - DNA, 1263 bp, Klebsiella pneumoniae
acgcttaaagaccaccacattctgcgctttccacacctcgagcaccggcatgccggcgatcgggctcttcggatcgtcctgcgccgccgggttgacggtatcgttggcgccgatcaccagcacggtgtcggtgtcgctgaaatcgtcgttgatctcatccatctccagcacgatgtcgtaaggcactttggcttccgccagcaggacgttcatatgccccgggaggcgcccggccaccggatgaataccaaagcgtactttgataccccgcgcccgcagcttctcggtaatttctgctaccggatactgcgcctgagccaccgccataccgtagcccggggtgatgatcaccgagtgcgagtttttcagcatctccgccgtctcttcggcactaatctcgcgatgctcgcccacttcttcatcgccgccgctggaggaaccatcggtgccgaagcccccggcgatcacgctgataaaggagcggttcatcgccttacacataatgtaagagaggatggcgccggaagagcccaccagcgcgccggtgacgatcagcaggtcattactcagcataaagcccgccgccgctgccgcccagcccgagtaggagttgagcatcgagaccaccaccggcatgtccgcaccgccgatagaggccaccaggtgccagccaaaggccagcgcgatcgcggtcatcaccagcaggcacaggacctgggtgccggtgctgtcagagcgaacaaaaatcaccatcaggatgaaggaaaccaccagcgccgccaggttcagcttatggcgattgggcagcatcagcggcctggaggaaattttgccgcgcagtttaccaaacgccaccaccgaaccggtgaaggtcaccgcgccgatgaagatcccgaggaacacttcggtcaaatgaatattgaccagaatttgctccataccggtttcatgctgcaggtagctgttgaaacccaccagcaccgctgccagccccacgaagctgtgcaggatagccaccagctccggcatctcggtcatctcgaccttcttcgccagacgaataccgatcgccccgccgatcaccatcgcaagaataatccagccgacgttgccggcgtccggccccaggatggtagcaatcagggcaatggccatcccggcgatgccgaaatagttgccctgctgcgacgtttcgtgtttcgacaggcccgccaggctgaaaataaacaggattgcagcaacaatgtatgcagccgttactaa

SEQ ID NO: 6704 - DNA, 1620 bp, Klebsiella pneumoniae
acagcgaaagatggcgaggaagattttgccgtcctggcgttgttgggcagaaaagtaaaccatcatcaaaaaccgatggaagggaaaactatgcgtattggtgtaccacaagaaaggctagcccaggagacccgggccgccgccacgccgaagaccgttgagcaattgctcaaactcggctttagcgtcgcggtagaaagcggcgccgggaagctggccagctttgacgatgaggcctttgccgaggcaggagctgaaatcgtgaccggcgaagaggtatggcagtctgatgtcatccttaaggtcaatgctccgaatgacgatgaaattgccctgctgaatccggggaccacgctgattagttttatctggccggcgcaaaacccgcagctgatggaaaaactggcggcccgtaatatcaacgtaatggcgatggattccgtgccgcgtatttcccgcgcccagtcgctggatgcgctcagctcaatggccaacatcgccgggtaccgcgctatcgttgaagcggcgcatgaatttggtcgattctttaccgggcagattacggcggcaggcaaggttccgcccgccaaggtgatggtcattggcgccggggtagccggtctggcggcgattggcgccgccaacagcctgggcgctattgttcgcgccttcgatacccgtccggaagtgaaggagcaggtgcagagtatgggcgccgagttcctcgagctggactttaaagaggaagcgggcagcggcgatggctacgccaaggtgatgtctgaggcctttattaaggctgaaatggcgctgttcgccgcgcaggcgaaagaggtcgatatcattgtcaccacggcgttaatcccgggcaaaccggcgccgaagctgatcacccgcgaaatggtcgactccatgaaatcgggcagcgtggtggtcgatctggcctcgcaaaacggcggcaactgtgagtacaccataccgggcgaagtggtgaccaccgccaacggcgtgaaaatcatcggttacaccgatcttcctggccgtctgccgacccagtcctcccagctctacggcaccaacctggtgaacctgctgaagctgctgtgcaaagagaaagacggcaatatcgttatcgatttcgatgacgtggtagtgcgcggcgtgaccgttgttcgtgaaggtgaaatcacctggccggcgccgccgattcaggtctccgctcagccgcaggccgcggcgaaaaaagtggaagcgccgaaagaagcggtgaaaccggcgtcgccgtggcgcaaatatgcgctgatggcgctggcgattattctcttcggctggctggccaacgtggcgccaaaagagttcctcggccatttcaccgtcttcgcgctggcctgcgtggtgggttactacgtggtgtggaacgtctcccatgcgctgcatacgccgctgatgtcggtgaccaatgccatttcgggcattatcgtggttggcgcgttgttgcagataggccacggcggctgggtcagcttcctgagctttatcgcggtgctgatcgccagcattaatattttcggtggttttaccgtgactcagcgcatgctgaaaatgtttcgcaaaggataa

SEQ ID NO: 6705 - DNA, 408 bp, Klebsiella pneumoniae
cgatctgaagagataccgccaggccgctacttgactgggtggacgggcagccgcgatgccccgctggcgccgatgatttatcccaccaccaagccccaaacgctccaccggatccaggcgcagtatgccgccaaggccagcagcgaacgggtggaccagctgtttgccgctcttgccgccgccctgaaggcgaaaggatttacccgctttattgtggccggaggggaaacgtcgagcattgtggcgcagaccctgggggttgaggcgttccatattgggccgaccatctcccctggcgtgccctgggtgcgtgacacccgccagccgctctccctggcgctgaagtcaggtaacttcggcgatatccagttctttgcccgtgcccagcaggagtttcgtcatgactga

SEQ ID NO: 6706 - DNA, 516 bp, Klebsiella pneumoniae
cttgcgggagaggcggtgtcgttaattatctcgctcatagagagcgcacaggaccactatccatgggtattgctgattgtttttctgcttaccttcactaaatcctgcgcattggtctcgctggcaatccccggcacctccggcctgctgctgctgggaacattcgcttccgccagcctcggacatttcctgttaatgtggtccagcgccagcctcggcgccatcggcggattctggctatcgtggcggctgggcattcgctaccgtcatcgcctcacccatctacgctggctgaccgccgagcgtctggcccgcagccgcctcttctttcagcgctatggcccgtgggctatctttttcagccgctttctctctccccttagggctacactgcccttcgttagcggcgccagcagtctgccgctgtggtcgtttcagctggctaacgtcagctccggtctgctgtggccgcttctgctgctcgcccccggcgctttcagcctcagtttgtggtga

SEQ ID NO: 6707 - DNA, 513 bp, Klebsiella pneumoniae
gaccggctggatgtaccgggcggtggagggccaggttcactactggtgggttgggctgggcaacgtcatcggctcaacgctgctcgcctggtgctgggacgatatcgccgccccgctcgccacccactggcagaaagtcaacctgctgaacgccttcggtccctttggcggactactggccacctatctactgctgctgatcgccctgctgctggtgatcgcctgggagagacattttttccgccgccaggcggcggtccggaccgtgaaggagagcgcatgaaaaacatcatccctgattatcgcctggatatggtcggcgaaccctgcccgtatccggcggtcgctaccctggaggcaatgccttccctgcaaaaaggcgagatcctcgaagtggtcagcgactgtccgcagtcgatcaataacattccgcttgatgcaaggaaccacggctacacggtgctggatattcaacaggatggcccaaccattcgctatttgatccagaagtag

SEQ ID NO: 6708 - DNA, 201 bp, Klebsiella pneumoniae
acccacacggagatcaccattcgtaaacgcgaaattcccctttccaaggcaaaccatcatttcgacggtcattcgcgttggatcatcaggattaaagcgcgtcactggctgtacgacataatctggatagatacggcaacggccaaacacttcgcggattgggtcgccaagtttcgcctggttcgctttggctgggtttaa

SEQ ID NO: 6709 - DNA, 582 bp, Klebsiella pneumoniae
cctgtacaggagagaaagatgtccgaacgaaaccccttttttagcgtcagtacgttgccttaccaggcgccgccgttcgatgtgattgacgacagccactatcgcccggcgtttgatgagggcgtccggcagcagcgggccgaaattcgcgctattatcgacaatccgcagccggccagtttcgccaacacgctcgaggcgctggagcagagtggtcagctgctggcgcgggtgacgcgggtctttttcgccatggctggcgcccataccaatccttatattcaatcactggatgaacaattttccgccgaactcgccgagctggggaatgacatctggcttaatgcggccttgtttcagcgcgtgaacagcgtctacgagcagcgcgacgcgctggcgctggacagcgagtcctatcgtctcctgaccctgacgtggcaacgttttgttcacgccgggggcgacgctggctcccgagcagcaggcggcgctgcgcacactgaacaccgaagcggctacgctgcaaagtcagttccagcagcgactgctgggagcggcaaaaagcggcggcctggtggttga

SEQ ID NO: 6710 - DNA, 963 bp, Klebsiella pneumoniae
ttcataaaggaaaaatataacaacagaatgaatcagatgagtaaactcgacgcctttattcaacaagcggtgacggcgatgcccatcagcggcacgtcattaattgcctcgctgtatggcgacgctttattacaacgcggtggggaagtgtggctgggcagcgtcgcggcgctgctggaaggattaggcttcggcgagcgcttcgtacgcaccgcgctgtttcgcctcaataaagaagagtggcttgatgttgtccgcatcggccggcgcagcttctatcgcctgagtgataaagggttgcgcctgacccggcgcgcggagcataaaatttatcgcgccagtgccccggaatgggacggtacctggctgctgctgctttcggaaggcctggagaaaaatgtgctcgccgacgttaaaaagcagctgctgtggcaggggtttggcgcgctggcgccgagcctgctggcctcgccgtcgcaaaagctggccgatgtccagtctctgctccacgaagcgggcgtcgccgaaaacgtcatctgttttgaagcccattcgccgctggcgctctccagagcggccctgcgcagccgggtggaggagtgctggcatctcaccgaacaaaatgagatgtacgaggcgtttatcgccttgttccgacctctactgccgctgctgcgcgattgcgacccgtcagagttgacgccggatcgctgtttccagatccaactgctccttatccatttctatcgccgggtggtgctcaaagacccgctgctgccggaagagctcctgccggcgcattgggcagggcaaaccgcccgccagctgtgtatcaatatttatcaacgcgtgagtcccggcgcgctggcgtttgtcagcgagaaaggtgagagctcggtgggcgagctcccggcgccgggtccgctctattatcagcgctttggcggtttgccgggcgcataa

SEQ ID NO: 6711 - DNA, 783 bp, Klebsiella pneumoniae
cgcgcgggggatagcatgagcgaccttctgatccaccgtcatggccgggcgcttcagttgacgctgaaccgcccgcaggccagcaacgcgctgaacaatgccttattaacccagattgccgaggcgctggaggcggcggcagttgatgacagcgtcggcgtctgcgttattcgcggtaacgcgcgttttttcgccgccggggctgacctcaatgaaatggcggaaaaagatcttcctgccaccctggatgatattcgcccacggttatgggggcgaattgatgcctttactaaaccgctcatcgcctcggtcaacggctacgccctcggcgccggctgcgagctggccctgctgtgcgacctgattgtcgccggggacaacgcccgctttggcctgccggaaattaccctcggcataatgccgggcgcgggcggcacccagcggctgatccgcagcgttggcaaggcgctggccagccggatggtgctgagcggcgagagtattgacgcccgccaggcgcagcaggccgggctggtcagcgatatccatccggcggcgttaaccgatgagtatgccctgaaactggcaaccaccattgcccgccattcgccgctggcgctacgggcggcaaaacagtcgctgcgcctggcgcaggaagtcagcctgcaggccggtctacaacaggagcgccagctgtttagcctgctgagcgccaccgaggaccgccgcgaaggcatcgacgccttcttacaaaaacgtaccccggaatttaaaggacgctaa

SEQ ID NO: 6712 - DNA, 408 bp, Klebsiella pneumoniae
agaccttcactcaacagcgatattaccagccatttcttcagcaaggccacaaagctctttcctgtcgctatcagacaagttgtcactgacaacggtaaggagttcctcggtaactttgataaaacgctacaggaagcctcgattaaacacatctggacctatccgtacacaccgaaaatgaatgcgacctgtgagcgatttaaccggacacttagagaacaatttattgaattcaatgaattgttgctttttgaggacctgaatttgtttaatcaaagaatggctgaatatctggtgctgtataacagcaaaaggccacataaatcactcgaactgatgacgccagtggactatattttacgtgagagtaaaaattgcaatatgtggtggacccatacagagtattga

SEQ ID NO: 6713 - DNA, 189 bp, Klebsiella pneumoniae
aaaaaatcactatctatccgcagattaacattgctttatcctgccccatggcgcaaagcaccgctggaaatttcagccaattgggaggaggatagaatgcagatcgatcgtaatgagaaagaggttgctgacgctgtggacgcggcaaccgtactaccggacaggagaagcgcatgtattacacgttag

SEQ ID NO: 6714 - DNA, 447 bp, Klebsiella pneumoniae
acaggaggttttatgagcagaatgattcttgtccctatcgatatctctgataaagaatttactgaacgcattatcagtcacgttgaatcggaagcgcggattgacgacgccgaggtgcatttcctcaccgtgatcccttctctgccctattatgcctcactgggaatggcctataccgctgagcttcccggcatggacgagctgcgtgagggttctgaaacgcaattgaaagagatcgcgaagcagttctccatcccggaagaccggatgcattttcacgtcgcggaaggatcgccaaaagataaaatccttgcgctggccaagtcgctgccagccgacctggtgatcatcgcttcgcaccgaccggatatcacaacttatctgctgggctccaacgccgccgcggtggttcgtcacgccgagtgctcggtactggtggtccgctaa

SEQ ID NO: 6715 - DNA, 1209 bp, Klebsiella pneumoniae
aatttactttgtttgaaacagggattgagaatgcaaaagctgattaacgccgtgcagaactatgcatggggaagccacaccgccttaactgaactgtatggcatcgccaacccggacaatctgccgatggcagagctgtggatgggggcgcatccgaagagcagctcgcagatcctggcggccgacggccagccgcgttcactgcgcgaggtgattgacgcggataaagccgctctgctcggcgacaaggttgccgcccgctttggtgaactgccgttcctgtttaaggtactgtgcgccgctcagccgctctcaattcaggtgcatcccaacaagcaggcctcggaagaaggtttcgcccgcgagaacgccgccggtatcccgctctccgccgccgagcgtaactacaaagatccgaaccacaaaccggagctggtttttgccctgacgccgttcctggcgatgaatgcatttcgcgagttcagcgagattgtcaccctgctgcagccggtggctagcgcgcatccggcaatcggcgccttcctgcagcagccggacgcgactcacctgagccagctgtttgccagcctgctaaatatgcagggtgaggaaaaggccaaggcgctgcaggtgctgcgcgacgtactggcccgtgaacaaggcgaaccgtggcagactatccgcctgatcgcggaattctatccggacgacagcggcctcttctccccgctgctgctgaacgtagtgaagctgaacccaggcgaagcgatgttcctgtttgctgaaacgccgcacgcctatctgcagggggtggcgctggaggtgatggccaactcggataacgtactgcgcgccggcctgacgccgaaatacattgatattcctgagctggttgctaacgtcaagttcgaggctaaaccggcgggtaagctgttgacccagccgcagcgtcacggcgcggaactcgacttcccgatcccggtggaagattttgccttctccctgcatgacctctccgccgaggccagcgatctggcccaggcaagcgcggcgatcgtgttctgcgtcgacggtgaagccgtactgcgcaaaggcgaccagagcctgaccctcaaaccgggcgagtcggccttcgtggccgccagtgaatcgccggtgcaggtcagcggccgcggccgcgtggcgcgcgttttcaataagctccagtaa

SEQ ID NO: 6716 - DNA, 393 bp, Klebsiella pneumoniae
ccgctaatttggcacaaactgcttaaattgcttatattgcatgcgttaattctggtctcaaatatattaatcagagttacttattcactgtatgaattgctttttcaaaaataccttttgcaggcgcgggtccttgaggagattgcgcctgagcgaaacctggggtggtcattgataaaaaggggcggggtagacccgccgctgcggagggtgaacagcaacggcgtacaacagaatcagttatcaggattgttggaaatgcttttccacaccattcccaggccgatcaacatcgacgcgaagagggcgaacagggtggttgagataaaaatgctggccatggcggtgcctcagaaagtgcgtatgcagatcattaggcacggtgtcggatga

SEQ ID NO: 6717 - DNA, 453 bp, Klebsiella pneumoniae
tatgtccgttgggcaggtggcccgggaagttgtaggggccaaagaccgccatcacgccgtgcggtttgtggcgcagcagcgctttaccgtccggcagcgtcgactcatgaaagcccgtccgctggtgataggcttcgatggagatcgcggccttgccgatcatcgcctgcacttcggtgcgggtctcccacagcggcttgctggtctcgcgggaaatcagggtcgccagcgcctctttatgcgtctccagcagcgcggcaaaacgctgtacgacgtcaatacgctcggccagcggccggtgcgaccagggataaaacgccgcgcgcgccgcggcgcaggccgcctggacgtcgtcagcccccgcgctggccgcctgccacagcagcgactgatcctccggggccagtttgctcatcgttgcgccgctgcctggcagccactgcccggctataa

SEQ ID NO: 6718 - DNA, 237 bp, Klebsiella pneumoniae
cgtacctcctgctcatcggtcaccgtccctcccggcgaactgggctggacgctgaagacgccgtcgaccccggccatcgccgaccgcattgccgcccggtcttcaaaggtacccacgaccagctcggctccccgcgccgccagcgcagcggcccccgcggagaaaggatccctgaccagcgcccgaacccgccagccgcggtgcagcagcgcccgcgccaccgagccgccctgctga

SEQ ID NO: 6719 - DNA, 1011 bp, Klebsiella pneumoniae
ccttgctcctgccgggttggcgctttcgccgcccggcttgccccttctaaggagagcccgatgtccgataaccgcgtctatagctactccgccgtgttgatgggctcgcccatcctgctcaaactctgttcccacgatgaggcgatggcctcccgcgttttccagcttatcaagcgctatgaagacctgctcaccgttaaccgcgccgagtcgcaggtgatggatatcaaccatgccgccgggcgtcatccggtcaccgtcagccgaccggtctttcagctgatccagtgcgccaaagccgccagcatggtgcgcgacagcgcctttaacctcgccatcggcccgctggtgaagctgtggcgaattggttttcacgggcacagcgtgcctgacgcggctgagatcagagcccgactggcgctgacccacccacaggaggtgatccttgatgaggcaacctgcagcgtgtttctccaacagccggggatggagctggatctcggggcgatcgccaaaggctatatcgctgaccgcgtgcgcgattttctccgtcagcagcaggtggagaaggcgctgatcaacctcggcggcaatgtgcataccctcggcgaatgggccattggcctgaaaaaaccatttgccgacgcgcaggcgctgatcggttccctgacggtcaacgggcaatcggtagtcacctccgggacctacgagcgctatttcgaacaggatggcaaacgctggcaccatattctcgacccgcgcagcggttatccgctggacaacgaactcgacagcgtgacggtcatttccgcggattctttagacggcgacatctggaccacgctgctgttcggcctcggcgtggagaagggctgcgcagcgctgcgtcagcggcaggatatcgacgcgattttcgttaccaaaaatcgcgacattattctctcatcgccgcagcggctgcgttttgcgccgctggacagcggctatcgggttattgactgtactgcttaa

SEQ ID NO: 6720 - DNA, 1050 bp, Klebsiella pneumoniae
cgcagatcctgcgcctgggcgcggtctatgattttcagcgttaaggagcggcagatggagcacctggttaacgatttactgcactgccgcctgcaggcgtggacctttccggcgggcattgaggcccgctggctgggcgagggcattttacagctgctgccgacggcgccgtggcgccaggcgacgatcctctccgccggcgtgcatggcaatgagaccgcgccgattgaactgctgctgcagctaacccacgatctgagccaggggcggcagccgctcacgcaggcgctgctgatcgtctttggtaatctgccggcgatccgcgccgcgcgccgctatctgcataacgacctgaatcgcctgttcggcggccgccatctggcggtcaccccgggaaatgagtcgcggcgggcttttgcgctggagcaggcggtgcaggctttttatcgcgccgccgatgcggcggggccggtcaatcgtggtcatctcgatatgcacaccgccattcgcggatcgctgtatcgccagtttgcgctgctcccggcccacgccggggatttttcgcccgatttctatcagctgctgcaggccagcgggatggacgccgtcgtgcgccataccgaagcgggcggcaccttcacccatttcacctgcgaaaagttcgccgcgcaaagcgccaccctggagctggggaaagtaatgccgttcggcgccaacgatctcagcctgttcgccgccgccgacgcggcgatccgggcctggatcgctgatgcgccgctgccgccgcgcgacaaagcgccggtggactacttcctggtcgaggagagcatcatcaagcgcgagggggaatttacgcttaatctcgcggcagacgttgaaaacttcaccgcgctcccggcagggtatgagatcgcccgccaggcagagaaacgttgggtggtgcaggcccgggccccctatatcctctttcccaacgccggggtcgccaccggccagcgcgccgggctgttgctccgcgccgctgcccttcgtctcccgcaaccagcctga

SEQ ID NO: 6721 - DNA, 732 bp, Klebsiella pneumoniae
aaggaaacctgcgtgataaatgttttaattgttgacgatgatgccatggtggccgaactgaatcgcctgtacgtggcaagggttcccggctttcgttgcagcgggagcgcttcgacgctcagtcaggcccaggagatgattaacgatccgcagcaggagatcgatctggtgctgctggatgtctacatgcagcaggacagcgggctcgatctcctgccgaccatccgcgagtcgggtcgcgccatcgacgttatcatgattacctcggcggcggatgccgccacggtacagaccgcgatgcattacggggtggtcgattacctgatcaaacccttccagtttccgcgctttgaagaggcgctcaccacctggcgggagaagcgcaagctaataaccggccagccctattacgaacaggccgatgtcgaccgcctgctgcacggcggcgcgccggaggccagcgacgcgcgcaagctgcctaaagggttaaccgcgcaaacgctgcgcacactctgccagtggattgacgcccatccggatgtcgaattctctaccgatgagctggcggcggcggtgaatatctcccgcgtttcctgccgcaaatatctgatttggctggcgcagatcaatattctctataccactatccactacggcgctaccgggcggccggtctatcgctaccgcctggtcgccgaacagtacagtttgcttaagcagtacagtcaataa

SEQ ID NO: 6722 - DNA, 294 bp, Klebsiella pneumoniae; identical to SEQ ID NO: 1080

SEQ ID NO: 6723 - DNA, 831 bp, Klebsiella pneumoniae
ccacgctgctggacccggcaacggcgaccggcagcgccgaacgctttgtgcgccaggtgctggcgcgttatcaggagcaacgtgatgaatcttgattatcaactcgacgggccggatgacgcgccggttatcgtcctctccaactcactgggcaccacccgggcgatgtggcagccgcagatcgaggcgttaaccgcccatttccgggtgctgcgctacgacacgcacggccacggtaaaacgacaaaaaatggcaaagtaaccctcgcccagttgggtgaggatgtgattgcgctgctcgatcacctgaatatcgaccgcgcctggttctgcgggatctcgatgggcggtttgaccggcctgtggctgggccgctttgcgtcggagcgttttcatggtctggcggtcgccaacaccgcggcgcgcattggcgatcaggctagctggctgtcgcgggcgcgggccgtacgtcaggaggggatggcggtggtggccgccggagcggcagaccgctggttcacccacgcgtttcgccagaaggcgccggaggtggtcgaggcgctttgtcaccagctgacccataccgatgctgaaggctatgccgcctgctgtgaggcgctggccgccgccgacctgcggggcgaagtggggcagatcccgctgccgacgctaatcatcgccggggaaagtgaccctgtcaccacggtcggtgacgctcatttcctgcagcagcagatccccgcctccgaggtggtggttctggcggcatcgcatctgtctaacattgaggcgccgaaaagctttacttcggcgctgctgagctttttctag

SEQ ID NO: 6724 - DNA, 660 bp, Klebsiella pneumoniae
acggcgtgctgggcgtgggtgagggcgagagtgaggacgatattcctcagacctttaccaccgagctgggtacctatacgggcctgcagcctgccacctttctacaaggaaaccgacgtgttacgtataagtttgactaaaaccgcctgtctgctgcccctgcttgcgctttgcctgagcggatgcggactcacccagcgcgtctcggagggaacaaagtctgccttcaacgccgttttttataagaaaattaatacgctgcatctggactttaccgcgcgcgaagcgctcaacaccgatgccagagagaatcactcgctctctgaaccggtggtggtgcgcatctatcagcttaaagatcgccagacctttgaccggctggtttaccagcagctgctggaggagggggatattctgctcgccgccgatctcctcgccagtcgcgatgtggtgatcggtcccggaggggacgccagtctgaatatgccgctggaagcggaggcgacgttcgtggcggttgtcggcctgttccgccatccggacacacaaagaaatacctggaagcaggtgctggcgcgtgaggaattggatccggacaagccgcgcattttcaccgccgaacacaaccagctacggctcaggcctgaagcggcgaagtaa

SEQ ID NO: 6725 - DNA, 504 bp, Klebsiella pneumoniae
gcttttgaatggatattcaggaggttaattatggcactcaaaaccttgtcagcactcccggtatttgctgattctctttttgccgatcgctttaatcgtattgaccgtcttttcagccagttaacgggcgatacgccggtgggcactttaccggcttatgatttacagaaagtcgacgacagcaatttcctgctcagcgtcagcgtgcctggctggaaagatgatgagctggaaatagaaaccgtaggggggaatctgcatatttccgggaaacgccaggaaaccgattcctcgacagacagcggtgaacgctggatttataaaggtatccgccgcgctaatttccagctcagtttctctcttcctgaacacgcccaaattaatcaggcgcagctggatagcggcatcttaaaaatagccatccaccaggaaatcccggagagcgaaaagccacgtaaaattgcgatcgagaatcaggggcgcgtgatagaacataaagtttga

SEQ ID NO: 6726 - DNA, 465 bp, Klebsiella pneumoniae
ttatgtgaatgttttggagtgaaaatgaacaaatttgcggcgcttctggcggcaggtatgctgctgtccggctgtgtctataacagtaaggtgtccaccggtgcggaacagctgcagcatcatcgtttcgtgctgaccagcgtcaacggccaggcggtcaacgccagcgaccggccgctggagctaagcttcggtgagaagatggctattaccggcaagatgtatgtatccggcaatatgtgcaacggctttagcggggaaggtaaagtgtcggacggcgagctgaaggtcaaatcgctggcgatgacccggatgctgtgccacgacgcccagctcaataccctggatgcgacgatcgacaagatgctgcgcgagggtgcgcaggtcgatctgacggaaaaccagttgacgctggcgaccgccgaccagacgctggtctataagctcgccgacctgatgcactag

SEQ ID NO: 6727 - DNA, 195 bp, Klebsiella pneumoniae
  unsure (174),(184),(185),(190): Identity of nucleotide at the above locations are unknown.
gtccagatgtgtttaatcgaggcttcctgtagcgttttatcaaagttaccgaggaactccttaccgttgtcagtgacaacttgtctgatagcgacaggaaagagctttgtggccttgctgaagaaatggctggtaatatcgctgttgagtgaaggtcttcaacggggttcaaanggcgtcattnnggggnttcag

SEQ ID NO: 6728 - DNA, 1167 bp, Klebsiella pneumoniae
ccgcttcttcgcgctctacaccgatatctacttgttcaaccgcctgattatcattctgcaaccaaccggagaacgactggaatgggaagagaagcacagccgccgcattcccggctgaccccacggctggaggccgacctgccgcggatcaatttttaccgcttctgccagcttctggaaaaacggcgtcccggccaaccgctgatggggggaaccagccatccggctgacgatccggtgcgtttttacccgcatccgggaatgggatttcccgccagcgaactgaaagccgtggaatacgatgaggccgatgacagcaggccgccggtcattcgcaccacctttatggggttgtacggtgtcgattcgccgctcccgacggcatatctcgatgatatcgcccagcacagggaagggcatgaagcgctgcagggcttactggatatcttcagccatcggatcatgacgcagttttaccgcatctggcggaaatactcctggcccgccacctttgagcccggcggcaccgatcgtctctcgcagtcgctactgggcctggcggggctaggcatccccggcacgacgcagcatatcgcctcgccggcgtcgcgctttctggcgctaaccggcgtgctgcgtcagccgggcaaaacccagcaggggatccaggcgctggtcaccctgctggccccggagaccaccgtcagggtgagcccgtacagcctgcgtccggtggcgatcagccagccgctggggttttacggcgatgacgacttcttcctggacggcaatacgccgctgggtgacgaagcgatggatgccagcagccagctcctcgttgcccttaccaccgacaatcccgcggaggcgcagggctggaagcctgacggcccgctgtttcgggactttctcatcctgctgcgggtatacctcggctggcgattccgggccaacatcaccctgaccgcgccgacccgactgctggctgtcccgccgctgggggacgagccgttctggctcggtatgaacggcgtgctgggcgtgggtgagggcgagagtgaggacgatattcctcagacctttaccaccgagctgggtacctatacgggcctgcagcctgccacctttctacaaggaaaccgacgtgttacgtataagtttgactaa

SEQ ID NO: 6729 - DNA, 423 bp, Klebsiella pneumoniae
agtattcatcgctttcacagaggactaaccatcaaaatgattactattactagggtattggatgacattatcaaccaccaacagataccactggatcggatactcagtcgctattttagtcccggttatcggcagcgtactgataacaagtgggaaggattagatggctttgctcagcatgcgcgtagactccgggaaattatcgccttcgctaaaattgagttacatgacgaacttcgtaacgggaatctttatgccacaaggcatcgcgttctgtgcaccaggcgcagcggagaagaggtggacatggaagtttatatgttcgctgaaatagatgattccgggcgcttcattcgtatcgaagaagccacgttaatgcttaaagggagagagagcgatagagatttaggcagcgtgaggtaa

SEQ ID NO: 6730 - DNA, 1299 bp, Klebsiella pneumoniae
ctaatgcatcgtcttcatccctaccctgatgtgcaggtgatgtttcgccgcctgctgatcgccaccctgattggccttctcgccgccctggcggtggcgctgtttcgccacgctatggtggtgctggaaacgctgttgctcagtaatgacagcgggagcctggtcaacgccgcacagtcgctgccggcgtggcgtcggctggttacccccgcgctgggcggcctgacggcgggaaccttactctggctctggcaacgacgcagcgtcgcgcgtccgcatgccgccaccgattatatggaagccctggagaccggcgacggctgtttcgatacgccggcaagcctggtgaaatcactggcgtcattgctggtcgtggtgaccggcagcgcgattggccgggaaggcgccatgatcctgctggccgcgctggcggcctcgctgtttgcccgtcgcttcacgccgcagagtgaatggaagctatgggtcgcctgcggcgcggctgccgggatggccagcgcctatcatgccccgctggccggcagcctgtttattgctgaaattctctttggtacgctgatgctggcctcgcttgggccggtggtgatctcggcggtgatcgccctgctgttgacgcagtttcttaatggcggcgccgcgccgctgtatcacgtcgtgttacagcagaacctcagcgccctgcactatggcttaatgctggcgactggcctgctggccgggctgtgcgggccgctgtttatctggctgatggactacagccaccgcgggttcgttaaactgaagctggcgccgccgtggcagctggcgctgggcgggctaattgtcggcggcttatcgctcatcaccccggcagtatggggcaacggctacagcgtagtgcaaagctatttgctgctgccgccgtccggtgcgctgctggcgggcgtatttatctgcaaactgctggcggtgctggccagcagcggctccggcgcgcctggcggggtctttaccccgacgctgtttgtcggcctggcgatgggcatgctgtttgcctgcttcagcaggctgtggctgccgggaagtgaagaaatggccatcatgatgggtctgaccggcatggcggcgtttctggccgccacgacccatgcgccgatcatgtcaaccctgatgatttgcgagatgaccgggcagtatatgctgctgcccggtctgctgataacctgcgtcgtgtcgtctgtgctgtcgcggacgttacgccgggattcgatctatcgccatcacgttgccgagcatgtctaa

SEQ ID NO: 6731 - DNA, 453 bp, Klebsiella pneumoniae
cttttaaatcgctgcagtgatcactatcatcagtaccacaataaccactgggatagggatatgaagaaaatagcgattatgttatttgcattattgttaactgcgtgcgcagcaaatccacctagccaagttcagttgcattcggctgattatggggtgttaccggataactatcagcagcagataaaggattggtggggaaggatgttaaaagacccatattctgctcattatacttttggtacaccagagaaagcatggtttaaggatggcattttagctgaatcaggtggggctatgcgatatggatggcttattccgataaccattaatgctaaaaactcctatggcggatatacaggtgctgaagcacatactattttttactcccatgggaaaatagactccgctgatgctcaggtgaatgcgggctatacgggaaaagttaaataa

SEQ ID NO: 6732 - DNA, 279 bp, Klebsiella pneumoniae
cgatcaggtcgattgttaacgtaccgagggacttgccagccatttaattttctccaggcaacaaaaaaccccgccgaagcgaggttttggtttgtttatatattggttaaattatttaacttttcccgtatagcccgcattcacctgagcatcagcggagtctattttcccatgggagtaaaaaatagtatgtgcttcagcacctgtatatccgccataggagtttttagcattaatggttatcggaataagccatccatatcgcatagccccacctga

SEQ ID NO: 6733 - DNA, 855 bp, Klebsiella pneumoniae
gatcatctccgaggcgatggcaaaaaagtggtgacgccatctgcccgcagggagatggcgaccaaggctgtggctcattacgccatttctatccgtctggcttgccaggtgttcaaggtgagcgagggttgctaccgttatcagcccgtgctggctgatgaaaaccaggagattgccgactggctactgcgcctcaccgccaaccagcgcaactggggtttcggactgtgcttcctgtacctgcgtaacgtcaaaggctttggctggaaccacaagcgggtctaccggatctatcgggcgctagagctcaatctgcggataaaacccaagaagcggctagtacgcgccaagccggagccgttggcagtccctgaccaaccgaatcactgttggtcgatggactttatgcatgaccagctcagcgatggtcgttcggtgcggttgtttaatgtgatcgatgacttcaatcgcgaagcactgtgcatcgaggtggatttttccttgcctgcctcgcgagtcaaacgggtgctggagcaggtcatcgagtggcggggcaaaccagccgcaatccgctgtgataatggtccggaatacatcagcgaagagctcaagcaatgggcgcagcagaagaggattgcgctgacgtatatccagccaggcaacccgcagcagaatgcctacatagagcgatttaaccgcactgtgcgttacgactggttgggccattacctgtttgagtcactgaatgagttacaggaatttgccacgaactggctgtgggtttataaccatgagcggcccaatatggcgctgggcggctacacgccgaaacagcgcttggcacaggccgcatga

SEQ ID NO: 6734 - DNA, 624 bp, Klebsiella pneumoniae
cccgccgtgctatctggcgatgcggttttaccttttgggagtatagttgactgccgtcagcgcgtggtatcgtgtgcctctcatgtacgatggtggatgacagaaacgatgttgaccttgctgcaggataaaatggataccccgctggggccgttgtgggtgctttgcgacgaacagtttaatttgcgcgccgtcgagtgggacgagcaccgcgatcggatggaaacgctgctcgacgttcactatcgccgggaaggctatcagcgcgtcgactgccgcaatcccggcggtctcagcagtaagctgagcgactattttgccggcgatttagccattatcgagactctgcctaccgccaccgccggcaccccttttcagcgccaggtctggcaggcgttacgcgatatcccttgtggccaggtgatgcactacggccaactggccgaggcgctcggtcgtcccggcgccgcgcgcgcggtgggcgccgccaatggcgccaatccggtgagtatcgtggtgccctgccatcgggtcatcgggcgcaacggcaccatgaccggctatgccggcggcgtacagcgtaaagagtggcttttgcgtcatgagggctatctgttgctttga

SEQ ID NO: 6735 - DNA, 1608 bp, Klebsiella pneumoniae
atcaggaaccgtgctatgacggcgaaaacagcaccaaaaatcaccttatgggaatttttccagcagctgggaaaaaccttcatgctgcccgtagcgttgctctcgttttgcgggatcatgttggggatcggcagctcgctaagcagtcacgatgttttgactctgctgccgtggctggatatgccgctgctgcaggccatctttatctggatgagcaaggtcggctcctttgccttcagcttcctgccggtcatgttttgtatcgccatcccgctgggtctggcgcgagagaacaaaggcgtcgccgccttcgccggcttcgttggctacgcggtcatgaacctggcggtcaacttctggctgaccgcgaagggtattctgcccaccaccgacgccgcgatcctgaaggccaacaatatccagaacattatcggcattccgtcaatcgataccgggatcctcggggcggtgatcgccgggattatcgtctggctgctgcatgaacgcttccataacattcgcctgccggacgccctggccttcttcggcggcacccgcttcgtgccgatcgtcaccaccgtggtgctggggctggttgggctggcgatcccgctggtgtggccagtcttcgctatggggatcaacgccctcgggaagatgatcaacagcgccggggattttgggccgatgatcttcggcaccggcgagagactgctgctgccgtttggcctgcaccatattctggtggcgctgatccgctttaccgaagccggcggcaccctcgacgtctgcggccacagcgtcagcggcgcgctgaccatcttccaggcgcagctgagctgtccgacgacccacggcttcgccgaaagcgccacccgtttcctgtcgcagggtaaaatgccggcattcctcggcggcctgccgggtgccgcgctggcgatgtaccactgcgcccgtccggaaaaccgacataaaattaaaggcctgctgatctccggggtcatcgcctgcgtggtcggcggcaccaccgagccgctggagttcttgttcttgtttgtcgcgccagtcctgtatgtcatccacgcgctgctgaccggtctcggctttaccatcatggcggtgctcggggtaaccatcggcaacaccgacggcaatatcatcgacttcgtggtgtttggcattctgcatggcctggcgaccaagtggtatctggtgccggtagtggcggctatctggttcgcggtctactatgccatcttccgcttcgccatcacccgcttcaatctgaaaacgccgggccgcgacatcgacactgccgccagcgtggagaaagccgtcgccggtaccatcggcaaatccgggtataacgtaccggcgattctggcggcgctcggcggcgcagagaacattgtttcgctggataactgcattacccgtctgcgcctgtcggtgcacgatatgagcaaagtggacgccgccgcgctgaaagcccatcgcgccatcggggtggtacagctcaaccagcataatctgcaggtggttattggcccgcaggtacagtcggtaaaagatgagatggccacgctgatgaataccgtgcaggcctga

SEQ ID NO: 6736 - DNA, 972 bp, Klebsiella pneumoniae
cgccgctgccgtcggcgcactttacccggccgagtatcgttatcaaacctaacgccaatgcccggccgtgtggcgataccaccggttacctggcgaacccgaaggaggtgtgagatgggaaacggatggcatgaatggccgctggtgctgtttacggtgctgggtcagtgcgtggtcggcgcgaccatcgtcagcggtcttggctggctggcgctgggggaccaacgggaagcccggcggcggctggtgcgcaatatgttttttatctggctgttgatgggcattggttttcttgcttcggtgatgcatctcggttcaccgctgcgcgcgtttaactcgctgaaccgcatcggcgcctcggcgctgagcaacgaaatcgccagcggcgctctgttcttcgccgtgggcggattctggtggctgctggcggtgctggaaaaaatgccggcgacgctgggtaaagtctggctggcgatcgccatgctgttagggctgctgtttgtcctcgcaatgacccgggtttaccaaatcaataccgtgccaacatggtacaatggctacaccaccagcgcgttctttctgacggtgctcctcagcgggccgctgtttgccgccctgctgctgcggctggcgaaagtcgactttaacggctggttttttgccggactgagcgtggccgcgctggtcatcagcgccgcagttatcattatgcaaagcgccgggctcagtacccttcacagctcggttcagcaggcggccaccctgctgccagattacggcaaactccaggcgctacgcctggtactgctggcgctgggcctcggctgctggctatgtccgctgatccgccgccagccgccgcgcgctacggggctgctgatcggcctgctgctggtcttgatcgccgaatgtattggccgcggcctgttttatggtctgcatatgaccgtcggtatggcggttgccggttaa

SEQ ID NO: 6737 - DNA, 402 bp, Klebsiella pneumoniae
cgtggtcgccgtgcgccgagtcgtgcagcacgcccgcgatatacggccggtcggggttaccatcctcaaagccaatcgccacctccgtccccgccagcagcggcaggtgcagaccgtaggtgtctccggcatacggccgcgactggcggacccacaggctctcgaacccggtttcccagcgcgcccggtcaaacagcatattcacccggtagcgcccgtgtttgtcgatatgcccgtaggtgtcgttttcccgggtgctggtcacgcgggccggcagcgtcccggccatcaccggacgcgcgccgggctcaggccggtagccgacgtccgggctgtccggtatgccggcaaactccaccgcaaagtcggcatcgcgccgggcgtggctgtgcatcgccgtga

SEQ ID NO: 6738 - DNA, 1866 bp, Klebsiella pneumoniae
gacggtcgccgcgttggcggtccacatcgacgaggcggagctgaaggcggagagcagctgcggcgccgcgtgggccgcctgccggataacctgctcatcgctgccctggaaacccacttcacgcagcagacgcagattcggccgcggctgcggcggcagaatgccctgcacgaagccgcggtcggccagggctttcattttatacagcccctgcagcgccgcctttttagggttagagagaccatcgcggttattttgcgaggcttcattgccgacggagagtccggcgtagtggtgcgtcgggccgaccaggccatcaaagtttgcttcaaaaccagacatatgtcctcacaggatccgttatcagaatggcaggcccggcgataccgtcgccggaagcgtcagcgtatcgctgaccagagaggccatcggccaggcacagtagtcggcggcgtaccacgctgccgcgcgatggttgccggaggcgcccaccccgccaaacggcgctttactcgatgcgccggtcagcggcttgttccagttgacgatcccggctcgcgcctcgtccgccagctgatcaaactgcgccgcatcgctggagatcagcccgacggccaggccatagcgggtctgattggcgaggcgaatcgcctccgggaagccgtcgtaacggataatcgtcagcagcgggccaaagtactcttcatccggcacctcaataccggtgacgtcgacgatccccggggtcagcaccgtggagcgcgggtcaggctggcgcatgcgcagcagcaccttgccgccgagcccctccagtttttgctgcgccgccagcatgttctgcgcagcgtcgagagagatcaccccgcccataaacggcgccggctgatcatcccacttgccggcgcggatctgcgcgctggcctctaccagccgctgcagcagcgcatccccctgctcgccgcgcggcacgatcagccggcgcgcgcaggtgcagcgctgccccgcagagataaacgccgactggataatcacatgcagcgccgcatcgatatcggccacgtcggcgacgatcagtgcgttgttgccgcccatctcgagggccagcatcttctccggctggccgccgaagtagcgatggaagtggaaaccggccgccgcgctgccggtgaacagcacgccgtcgatatcacgattttccagcagcgcctggccggtggcttttccgccctgcagcaggttgatcgccccgtcggggatgcccgcctgctgccacagctggacggtcatttcagcggtagccggcgtcagctcgctgggtttaaacacaatggtgttcccggcgatcagcgccggaatgatatgtccgttgggcaggtggcccgggaagttgtaggggccaaagaccgccatcacgccgtgcggtttgtggcgcagcagcgctttaccgtccggcagcgtcgactcatgaaagcccgtccgctggtgataggcttcgatggagatcgcggccttgccgatcatcgcctgcacttcggtgcgggtctcccacagcggcttgctggtctcgcgggaaatcagggtcgccagcgcctctttatgcgtctccagcagcgcggcaaaacgctgtacgacgtcaatacgctcggccagcggccggtgcgaccagggataaaacgccgcgcgcgccgcggcgcaggccgcctggacgtcgtcagcccccgcgctggccgcctgccacagcagcgactgatcctccggggccagtttgctcatcgttgcgccgctgcctggcagccactgcccggctataaactgtgcttttaccgccatgatctgttgtcctctggattcagggttaccgtataa

SEQ ID NO: 6739 - DNA, 840 bp, Klebsiella pneumoniae
tcttgccaacggctttgctactatccgggcggcattcgattttatttaataatgtctgataatggaatagcaaaatacataatggagtatgaaatgaagcatgttcacaagctggcctggataggcctgttcgtcaatattattatctgttttgtcgcgcgaaatttattacttgatgaaggacagctgaacttccatagtcgggcggacggcgtatggtcctggctggtgctggccctgtttattgccgtggtggttcaggcgatcagcataatgctgtcaggccgctacccttatctggccattgtgctggcgtttgttggcggtatcgtgatggtgcccgccagcgtgatctttatggtgggtagtctgttcagcttgcaaacgcggattaacgccggatttacgccctggcgatcaaccacggcagtgggcgaggctgataaccagcagctattaacctttaatgcctcaggcttttatccccaaggggcgctggcgctcatcgccgggatcattattttaatgattggcatggggataggcggagtatttattgccgccggtattgttgcgctgtgcaatggctatcgtctgcaaaatcgggtggtgattggcgtgagcggcgagtcgatgatatttacgccggggctctatgccgatacctacgttattcccttgcgggatgttgccgtagttgaacgcagcaataatgatgcgaaagtccggctgctgatccgttccagcggcagaagcttcacgttgcgtaaaaaactgctcgccggcgataaggttaatgacgccttcgccgccattctggcaaaactgactaccgtttaa

SEQ ID NO: 6740 - DNA, 261 bp, Klebsiella pneumoniae
gacacccgacggtttctggccgttgacgcctgcgggtacgcccgtatcactctccgggaggcctctatgtattacgcttcagagctgacagcccagtctatccctatctcgcccgagccgaacgatccggctcctttacccgatccacgaccgcgtccgcagccccagcccgatccgccgcctgacgaagagccgattaaattgtcgcatcaggcgcggagatctgcgaggatacgcgcctgcagattgtctgccttttaa

SEQ ID NO: 6741 - DNA, 435 bp, Klebsiella pneumoniae
cgcagcagacgttcagcaaagccgtccacaccctgcccgccctgctggagcagctgcggacagacccggatgacgccatgctgcgctatcgcgccgccttcgcccggggggatggcgtgtggtggccgatgggcgccacctggaatgcccgccaccagctgccgacccaggacattgccggctggctgcagaccgcgcgctgattttctctcacaggacagaatgacgatgaacaagttaattccactgatcgtattgagttgtctgctgcccctggcggcaaatgccagaaccatcaccgccaccggcgataccctggaccatgcggagagcaaaatccgccagcaagccgcccgcgagggcgcgactacctatcgcatcactgaagcgcgaatgggcaacaaagtgcatatcacggcgaaaatcgcggactaa

SEQ ID NO: 6742 - DNA, 237 bp, Klebsiella pneumoniae
cgctgtggacgcggcaaccgtactaccggacaggagaagcgcatgtattacacgttaggagataccactctccatttttatcgctatcagtgcaaattttacgtcgcccactgggaagggggtaacgtgatgagcgaaaaatttaaatcgtttatcgaacagatcactgagaagaccgggctggatgcgaaacgcgtcgagaccgccgcgcgcgattattttactaacgtggattaa

SEQ ID NO: 6743 - DNA, 1041 bp, Klebsiella pneumoniae
ccgggaggacggcctgtgatgctatttcgtcccgtacgggaaaacgatctcgacgacatcgtccgcctcgccgcgcgggcgggggtcggcatgacctccttaccgcatgacgtcgggcgtctggcggcccggatccggcgcagtatcgagaccttcgccggcgaactgccgcgcagccagcagggtttcctgtttgtgctggaggacaccgcgctggcgcgggtggtgggggtgagcgccattgaggtcgcagtgggcctggacgagccgttttacaattttcgcattcagaaaacggtgcgcgcctcgaaagcgctgggagtctataagccccaggagctgcttaatctcagctatgaccacaccgggcacagcgaactgtgtacgctgtttctcgacccggcgtatcagcgcaaccgcaatggtctgctgctctccaaggcgcgctttttatttatcgccgcctttcgcgagtggttctccccgcacctgtttgccgaactgcgcggctgcagcgatgagcagggacagtcgccgttctgggatgcgctgggccatcatttcttcgacatcccgttcgccgatgccgaccggctgaccggcaccggcatgaaaacctttattgccgaactgatgccggcgtacccgatctatatctctctgctgccggaagcggcccgcggggtcatcggtcaggtgcatcccaataccgccccggcgcgggcgatcctcgagaaagagggtttcagctggcgcggctcggtggatattttcgatgccggtccggtgctggaggcggacaccgatcagatccgcgccgtgcgcgacagccagcgcctgcctgtccggcagctgatgggcgacctgccggcgccgaccctcgtcgccaacggtcaattcgacaactttcgggcgctgctggtggcccacgaagagcaggtctcgcttgacagcgccgcgctggacgcgctgcaggtcagtgaaaccgaccgcgtttatacggtaaccctgaatccagaggacaacagatcatggcggtaa

SEQ ID NO: 6744 - DNA, 2730 bp, Klebsiella pneumoniae
ccttgtgcgcttggggttcctgttcgggaacagcgacgggcggtagcgtgtccggaacaaataagagaggatctcatggaaaatccagccagcctgttacgccgtcttaatccctgctgtgcccgcgcaatggagggggcggcctccctgtgccagacccgggcgcatgccgagatcctgcccgagcactggctgcttaagctgctggaacagggggaaggcgatctgacggtgctggcgcggcgctatgaatgggatatggatgcgctgtggcaggatctgctgagctggctggataaacagccgcgctcggtacgtcatcgtccccagctctctgatcataccctgaggctgatgcaggaggcctggctgattgcctcgctcagcggcgaaacgcagatccgcagtgttcacctattgatggcgctggttgaaaaacagaatctgatccagtgcgatggcctgtggccgctgttaacgctgggccagcgtcagctggaacgcctgcgccccttgctggatgcccagtccgacgaacgtccgccagcgcagcaggaagcggcgctggcgcagccccatggcggggacgtggaatttgtggggcgtcctgcgggcagcgaactgaatgcggatgggctcaatccggtgctgcagaacgcgctggacaaattcactctcgacgtcaccgccaaagccagagacggccagattgacccggtgttcggacgcgacaaggaaatccgccagatggtggatattctctcccgtcgacgtaaaaacaacccgatcctcgtcggtgagccgggcgtgggcaagaccgctctggtggaaggcctggcgctgcgcattgccgaaggcaacgtccccgacgcgctgaagccggtgtcggtgcgcacccttgacctcggtctgctgcaggccggcgccggggtcaaaggcgagttcgagcagcggctgaaaaatatcattgaggcggtacagcagtcgccttcgccggtgctgctgtttatcgacgaagcgcacacgatcatcggcgcgggtaatcaggcgggcggcgcggatgccgccaacctgctgaagccggcgctggcccggggcgaactgcggactatcgccgccaccacctggagtgaatacaagcagtacttcgagcgcgacgccgcgctggagcgccgctttcagatggtcaaggtggatgagccggacgacgacaccgcctgcctgatgctgcgcggcctgaagtcccgttatgccgaccaccacggcgtgcatatcacggatgatgcggtgcgcgccgccgtgacgctgtcacgacgctatctcaccggtcgccagctgccggacaaggcagtggatttactcgacaccgcttccgcccgcctgcgtatgagtttggataccgtgcctcagccgctgacccgcatgaaggcgcaactcaccgcgctggcaatggagaagcaggcgctgctggaagatattgcgctgggcaacagcgcccgcggcgatcggctggcggccattgagcaggaggagatccgccttattctggcgctggatacccttgaaactcagtatggtcaggagctgcagctgacggaagcgctgctcgcctgtcgccgcgatatctcccgccaggcggaaattagcgatctacaaaccgcgcttatcgccgtccagcagggcaatccgctgctcgggctggacgtcgacgtccgcaccgtggcgacggtgattgccgactggaccggcgtgccgctctcctcgctaatgaaagatgagcagacggagctgctgagtctggaagagagtctcggcaaacgggtggttggccaggaggcggccctgagcgctattgcccggcgcctgcgcgccgcgaaaaccggcctgacgccggagaacggtccgcaaggggtgttcctgctggtcgggccgagcggcaccggcaaaacggaaacggcgctcgccctggccgatgcgctgttcggcggcgagaaagcgctgatcaccatcaatctctccgagtaccaggagccgcacaccgtcagccagctgaagggttctccgcccggctacgtcggctacggccagggcgggatcctgaccgaggcggtgcgcaaacgcccctacagcgtggtgctgctcgatgaggtggaaaaggcccatcgcgatgtgatgaacctgttctaccaggtcttcgaccggggggtaatgcgcgacggcgaggggcgtgaaatcgactttcgcaacacagtgatactgatgaccgccaacctcggaagcgacctcctgatgcagttgctggatgaacagccggaggccagcgaatcagacctgcacgagctgctgagcccggtgctgcgcggccacttccagccggcgctgctggcccgcttccagacggtgatttaccgtccgctgccggcgggagcgctgcgcgccattgtcggcatgaagctcgggcaggtaagtcagcgtctggcttgccattacggaatcaccaccaccctcagcgagagcctgttcgacgcgctgaccgaggcctgcctgctgccggataccggcgcccgtaacgtcgacagtctgctcaatcagcagatcctgccggcgctgagtcagcagctattgagccatatggcggcggggcagaaaccgcgccaggtgacgctggggtatcacgaagaggaaggcgtcgtgatggcgtttgacgaggggacaatatccgatgagtag

SEQ ID NO: 6745 - DNA, 1515 bp, Klebsiella pneumoniae
aaccgaccgcgtttatacggtaaccctgaatccagaggacaacagatcatggcggtaaaagcacagtttatagccgggcagtggctgccaggcagcggcgcaacgatgagcaaactggccccggaggatcagtcgctgctgtggcaggcggccagcgcgggggctgacgacgtccaggcggcctgcgccgcggcgcgcgcggcgttttatccctggtcgcaccggccgctggccgagcgtattgacgtcgtacagcgttttgccgcgctgctggagacgcataaagaggcgctggcgaccctgatttcccgcgagaccagcaagccgctgtgggagacccgcaccgaagtgcaggcgatgatcggcaaggccgcgatctccatcgaagcctatcaccagcggacgggctttcatgagtcgacgctgccggacggtaaagcgctgctgcgccacaaaccgcacggcgtgatggcggtctttggcccctacaacttcccgggccacctgcccaacggacatatcattccggcgctgatcgccgggaacaccattgtgtttaaacccagcgagctgacgccggctaccgctgaaatgaccgtccagctgtggcagcaggcgggcatccccgacggggcgatcaacctgctgcagggcggaaaagccaccggccaggcgctgctggaaaatcgtgatatcgacggcgtgctgttcaccggcagcgcggcggccggtttccacttccatcgctacttcggcggccagccggagaagatgctggccctcgagatgggcggcaacaacgcactgatcgtcgccgacgtggccgatatcgatgcggcgctgcatgtgattatccagtcggcgtttatctctgcggggcagcgctgcacctgcgcgcgccggctgatcgtgccgcgcggcgagcagggggatgcgctgctgcagcggctggtagaggccagcgcgcagatccgcgccggcaagtgggatgatcagccggcgccgtttatgggcggggtgatctctctcgacgctgcgcagaacatgctggcggcgcagcaaaaactggaggggctcggcggcaaggtgctgctgcgcatgcgccagcctgacccgcgctccacggtgctgaccccggggatcgtcgacgtcaccggtattgaggtgccggatgaagagtactttggcccgctgctgacgattatccgttacgacggcttcccggaggcgattcgcctcgccaatcagacccgctatggcctggccgtcgggctgatctccagcgatgcggcgcagtttgatcagctggcggacgaggcgcgagccgggatcgtcaactggaacaagccgctgaccggcgcatcgagtaaagcgccgtttggcggggtgggcgcctccggcaaccatcgcgcggcagcgtggtacgccgccgactactgtgcctggccgatggcctctctggtcagcgatacgctgacgcttccggcgacggtatcgccgggcctgccattctga

SEQ ID NO: 6746 - DNA, 246 bp, Klebsiella pneumoniae
tctccgccgcggccgggctgttcgtcgatgccggcgtcgggccggttatcgccaactacgggatggaaaacctgcgctttattgagccggtcaaaccgggcgacaccattcaggttcgcctcacctgtaagcggaaaacggtcaaacgtcagcgcagcgccgatgagaaagccaccggcgtggtggaatgggcggtggagattttcaaccagcaccagcaggcggtggcgctgtattccattctga

SEQ ID NO: 6747 - DNA, 1752 bp, Klebsiella pneumoniae
cgatctgcgcgaagagatcctgacggcgattaccccacaggagcaggagcaaacccagcgggtgctggaaaagctgttgcgcgaagtggagaagaaataatgccccgtcgccaggataacccctacgccccgcatgactgggcgccgcatgaaaaaccggctctgctcggttcgccgtcgacgccgctgcacagtccggcgaaacgccttgcctacggcgtggtcggtctgctggtatgtctcaccggcgcgctgggcaacgcagtggtcaccgccaacctgcagctgctgcagggtaccttcgccgcctggtcgacagaaatcgcctggctgccggcggtatacgtgatgaccaacgtctccatcaacctgctgctggtgaaattccgccagcagtttggcctgcgcgctttcaccgaaggctttctggtgctctatgtgctggtcacctttttccacctcttcgtcaacgatctcagctcagcgatgatggttcgcgccgcccatggcatggtggccgcggcgctcagctcgctggggatctactaccaggtacaggcctggcctgctcggcatcgcctgaaagggctgactatcggcatcaccggctcgtcgctagccattcccctggcgcgcctcttttccaccgaactgctgcagaccgatgaatggcgcggtctctacttctttgagctgggcctggcgctggtgtcgctggcctgcgtcatcgcgctaaaactgccgccaagcgatcgtaaaaaagtgttcgaaaaaaaggatttcattaccttctttctgctggcgcccggcatggcgctggtgtgcgccgtgctgtcgctggggcggctcgagtggtggtttgaagcgccgtggatcggctgggcgctggcggcggcggtaatactgatcgtcgctgcgattaccttcgagcataaccgcagcaaccccctgctcaataccaaatggctctccagcggcagcatcgtgcgtctgggcctgattatgctgttgatccgcatcgtgttggcggagcagaacaccggggtcatcggctggctgcagtacgttggcctgcaaaacgaacagatgactaacctcgcgtggtcgattttcgccggtattctgtgcgggatcattgccagctgtctgacgctcaacccgcagaagctctactggccgaccgccaccgcgctggcgctgatcatgatagcctcgctgctcgacagccagtccaacgccctcacccgtccggaacaattaatgttcagccagtttttactcggcttcggcagcgccttctttctggccccggcgatgctcgccgggattggcggcgtgtttgccgacccgcgcaacctggtcagcttctcggtgctgttcggcatgagccagaacattggcgggctgctcggctcggcgatcctcggcaccttccagacctggcgtgagaaattccactccagccagctggcggaccagataaccaccctgaacccgctgatcgtcgagcggctgcagcagtacagccagatgtatcagagccagattggcgacagtacgctgctcaacgttcaggccaccaccctgctgcaaaacgccgcgacgttgcaggccaatattctcgcctggaatgatacctatctgctgacggcggcgatctccgcagggacactagtgtgggttttctggcgcttaattcgcttacgactgactgcccgtatcgcgttgcaacgcgctaccggcagcaaataa

SEQ ID NO: 6748 - DNA, 984 bp, Klebsiella pneumoniae
atggctgcgcgacgggcgcgcgctgctgaaaacgtcccgcggcgcgcgcttaaccgcgacgccgtggcacagggaggaataatgaagattttatttacctttcccggccagggcggccagcgccccggcatgctggcggcgctccccgatcgcgaagcgatcctcacccaggcgcgcgccgtgctggggaatgaagtcgctactctcgatagcgccgacgcgctacaacacacccgtgcggtccagctctgtctgctgatcgccggggtagcctgggcgcgcgagctacagcgtcagggcgtggatccgcagatggtcagcggcctgtccatcggcgcgtttccggccgcggtgattgccggcgcgctcgatttcgccagcgccttgcggctggtggccctgcgcggggacttaatggaacaggcgtatcctgaaggttacggactgacggcgattatgggcctgacccgcccgcgggttgaggcgctgatgcagggccacgaggtttatctcgccaacctgaacgccgaaacgcagttcgtgattgcgggccgtgatgaggcaatggccgaggtggcgcagctggcgctgcgggctggcgccagtaaagcccagcggctggcggtcagtgtcccgtcgcactgcgcgctgctggataaacccgccgctgagctggcgaaagcttttgccggcgccagcttaaggcgcccacggtgcgcctatttaagcggctcgacggcgcgcgtgctatgggatccgcagcggatcgccgacgatctggcgatgaacatggcgcgcccggtccactggcaggaggcgatggtcgccgccgatgagcgcgatgcgcgcttagccattgagatgccccccggcggggtactcacctgcctgacccgccaggcgggctggcacggggagaccattgcgctggagcgcagcggcctggacgtcgcgcgccatctggcgcagcggcttagcgattaa

SEQ ID NO: 6749 - DNA, 2469 bp, Klebsiella pneumoniae
atcaaacagcggcggaaaaaccgcgttcagctggtcatgctgatagatcgggacggcattcgcctgatgggtgagcgaaaaggtcagcaggctaccagccaggcgcgccagctccgggtagaggcgttccggcgggctttgccggtaacgcagaaagtaccccagcaccggttcggcgctgttcagcgcattcagcaaccagaacagagagacatcggctacggcaaaatcagccatccgttcattgctttcgcgacgcatggccatcaggcgcgtcagacgagcccggagctggacgagcagctgttcaagctgcgtcgccagccagcggctgccctggatctgcagcagcggcgggagaaacgtctcgtcgataagccaggccccctgcgagtcccgctgcaggcgaacaagcggacaggtcaggtaatcgctgttgtcctggtgggcgaagcggagggtcagctccggctgtatgacggcaatctgccgggtatcatccccgaactggttgcggacatcgcgccagcgctggcggaagcgcaccggcctttcggccacctcctccggcttcagacagttgccgccattcgcctgcatcaggggcagcgccagcacgatcaccgccacgccggacgcgccgtccagcgacagcgcggacggcagcgcatcggcattgtccgtatcaatcatcgtgccatcctggaaccggacctgcagcctgtgagcctgcaggcggcccagtttgagcatctctggttcgaaggtcgcctcaaccactccccaggggtggttaagacccatccgggcaatcacttccgcagtccaggctgtatacgcagcctgctgttgaaaatgctgaggcgacaccataatgccccggccccacaacggacgttccgttttcatcatcgtccgaacctacgccttcgcctttggcatctggctaaccagcgacagattgacgtccatcccctcgacctggaagtgcggcaccgcgtacagcttcactcggaagaagcccgggttatcctcgatatcttccaccaccacgctggcatcgcgcagcggatgggaggcctgcagctcgtcgccggggtcggtcatttcggtcaccaggctccgcacccaggtgttcagctccagctccagcagacgccggtccttggtggtgccgatattctcgcgctggatcatcttcaggtagtgcgcgatgcgcgacagcaggaagatataaggcagacgcgcgttgatacggctgttggcggtggcgtcggcggtatcgtacagcgccggtttctgcgcggagttggccgagaagaagcaggcgtaatcgcgatttttgtagtacgacagcgggataaagcccaggctggcgaactcaaactcccgcgtttccgggatcatcacctcggaaggaattttcacctggttgccggtgcccagatcgtacagatggatgggcagatctttcaccgcgccgccggcctgcggaccgcgaatttgcacgcaccagccgttattgacaaagctcttcaccatattggatgcgaaggagaacgccgcgctggtccagagatacttttcgtggtccggacctttcacctgctcgacatagttgaagctgcgcaccggcacggtgtccggaccgtacggcagacgacccagcacgcgcggcatcaccagaccgatgtagcgggcatcgtcagtttcgcgaaacgccttccagcgaatatattccgcacgatcgaagtagttgccgatatccttaatggcagccacctcttccatggtctctttcaggaagaaggccgggccgacggcgccgataaacggcatatgggcggccgcagagacgcgggagatattgcgcagcagcgccacatcctgcgggctggcgtcgaactcataggccgagatcaccgagccgatcggctcgccgccgggagtgtcatactccgcggtataggtgtgccagtagaggccgctctggataagctccggcgcgtcctcaaagtcctggcgcagatcgtctttggcgacgtcgaggatctccgttttgacgttctgccgatagtcggtgttgtccaccagctgtttgaggccgcgccacagggattcgacctgctgaaactcctgatggtgcatcaccgcgtccagctgacggcttatctggaaatccagctcggcgatatggtggtcgatcagcgttttgtcgagcttttccacccgctggccggactgacggatgcgttccataaacacctgcatcgccgcggtgagacgctccgccgccggcgcctcggagagcgcggcatcgtccagaaagtcgttgatatccccgaggcgagacgccggggtgagattaattttttcaaacagcgaggcgtaaacgccctcgcccgccctgttttcctgcagcgtggtttgcccctgaacaggggcgttttctgtggtaacagacattag

SEQ ID NO: 6750 - DNA, 675 bp, Klebsiella pneumoniae
atggggaagcgtcatatgcaacaacagtggtcggcagtagacaattatttgattaaggccttaattcccggcgatcctgtgctcgatcgggtactggaaaacaaccatcgtgccgggctcccggcacacgatgtcgccgccaatcagggtcagtttctcgccctgctggtacggctaacccaggctaagcggatactggagatcggcaccctcggcggctatagcaccatctggatggcgcgcgagcttcctgcagacggccaactcctcaccctggaggccgacgcgcatcatgcccaggtggcgcgggagaatctgcagctggcgggcgttgaccagcgggtcacgctacgggagggacccgcgctacagtccctggaggcgcttggcgaatgtcccgctttcgacctgatcttcatcgatgccgataagccgaataacccccattatctgcgctgggcgctacgttattcccgcccaggaaccttaattattggcgataacgtggtacgcgacggcgaagtggtcaacccacagagcgccgacgagcgcgttcagggcgtgcgtcagttcattgagatgatgggcgccgagccgcggttgacggcaacggcgctgcaaaccgtgggcactaaaggctgggacggctttactctggcgtgggtaaacgcttaa

SEQ ID NO: 6751 - DNA, 1284 bp, Klebsiella pneumoniae
gggagacggcgcgcgctggccgtctcctataccgataagttacggctgcggggcggcgtcgtcctgctgaggagcggcgtcatcctgctgcggctggccttcctgcggcgcgctgtccggcagcgaaggcgcttccagaccaaacatcgcggcaaagtcttgcagcggcattttctgtccgttcagcgtcacctggccgttcgcgtactgcagactgctgctgatggcgttatcttccatggtggtaatgcggaacatctggcccatcgccgccaggcctttgacctgctgatcggcaagcttggcggcatcggccggctgatagccttccagaccggcgatcttagtcataaactccgtcgccatatccaccgggatcaccactttgccgtccagggactgcaccacgcgatccaggctgtccgccagggtctgcggcggagcggtcacctgggccggatctttcagcagaaccgagaggttgagggtgctttcgcctttggcattgcgccagctcagcggagagatggtcaccgacgggttgcctttgagcaggatcggcagcgcattgaacagcgtttcggtgagggcctgctgatacagctccggattctgcgccagctccggtttcgccagcagcgcctgagactgcgcgctgtactgctgactgaactggtgccacgcctgaccgtcgacgttatccactttcagcgtgagtttgccgctgcccatatcctgcccctgcagcttgaggctgttgacggtgtagttcacctggctgttcacgcctttgccgtcctgggtcagcgtcgagccgccgtccagcgccatgccgtcgatcagcgccagctctttgccttcgacgctgatggccagtttatcgagggtcattttttgctggccgatacgttcgttgaagctggccagctcggtggcgccgtcggtggtcaggttgacgaagcgcagctgtaccttctgattatattcattgagcgcatcgatctgcccgctgccggcctggcccttcaggctgatgtttttgccgtcgcggtcggcgtcgagctggaactgaccgccgctgaaggtgactttctcatcgcctttagcgtagtcgagggcgttaaggacgatagccgactggctgtcgccgctgtaggcaatgcgcgtatcgacggtaaagggggtgtcgcctttggctatctcgaacagcgcctggctggcgtcgtttttcaccagcgtggtgtggacggaagccattgccggcgccagattaaaggcttttaa

SEQ ID NO: 6752 - DNA, 186 bp, Klebsiella pneumoniae
atgaagaagctgttactggccatggcggcgtcgatgctgctcgccggctgtacgccgcgcatcgaaatcgcggcgtcgaaagagcccatcaccatcaatatgaatgtcaaaattgagcatgagatccatatcaaggtcgataaggatgtggaaaacctgctcaaatcccgcagcgatttgttctga

SEQ ID NO: 6753 - DNA, 441 bp, Klebsiella pneumoniae
ttgaggaagcttccggtcatcagcccctcaataacccactgggggtcggcgtctttgagcacaatcgccggattcttgccacccagctccagcgtcacgcgggtcaggcggtcggcagccacgcgggcaatctgtttcccggtcgccgtcgagccggtaaagctaaccttcgccacctgcggatgggcggtcagcgccgcgccgcagccggcgccgctgccggtgaccacgttgaacaccccgtcaggaatgcccgcctgggtcgccagctccgccacccgcagcagggtcagcggggtggtttccgagggtttgatgacgatcgaacagcccgccgccagggccggcatgaccttccacatgccgatcatcagcgggaaattccacgggacgatgcccgccaccaccccgaccggctcttttttggtccacgcctggtaa

SEQ ID NO: 6754 - DNA, 411 bp, Klebsiella pneumoniae
gctttttctagggggaacgccatggaagataaacagcgctatcaggacgggatggcggtacggcgcaaagtattgggcgacgcccacgtcgaccgtacgctgcagcatctgacgccgttgaatgatgagtttcaggactttattacccgctatgcctggggcgagacctggacgcgtccggggctcgatcaccatacccgcagcatgatcactattgccatgctgatcgctctcaatcgcgaggcggagctgaagatgcatcttcgcgcgtcgtttaacaacggggtgacccgcgatgagctgaaagagctgatcatgcactctgcgctgtactgcgggctgccggcggccaatgccacgatgcatctggcgcagcaggtgtttgacgacatcgacgccgcgcagggttga

SEQ ID NO: 6755 - DNA, 912 bp, Klebsiella pneumoniae
gatcctttcaggcaagttttaaagcctgagtatgcgctatttcccggcaaaagggagcgaacggagagaaatgggcaaaaaataacaaggattgggcaacccggcccggtgagcctcccctattgtaaggactccacacaccagagaggaccgaacatgactaagattgcacttattaccggcgccaaccgcggccttggccgtcagaccgcactggatatcgcccgccagggtggggatgtcatcgtcacctaccgcggcagtctcgaacaggcggaagcggtggtcgccgacatccgcgccctgggccgcaaggccatcgccctgccgctggatatggcgcaaaccgccagcttcccggccttcgccgacagcctcggcagcgcgctggccagcgtctgggggcgggccactttcgaccacctgatcaataacgcagggcacggcgaattcgccccgctggccgaaacgcgcgaagcgcagttcgacgggctgtttaacgtccacgttaaaggggtatttttcctcgtacaaaccctgctgccgctgctggcagacggcgggcggatcgttaacttttcctccgggctgacccgcgtatcctatcctggcttctccgcctacgccgccgccaaagcggctgtggagatgctgagcgtgtacatggcccgcgagctgggcgggcgcggcatcaccgtcaataccatcgcccccggcgctatcgccaccgattttggcggtgggctggtgcgggacgacgcagaggtaaacgcgcagtttgccgccatgacggcgctgggacgggtgggcgttcccgaggatattgggccgatgatcgccagcctgctacgcgacgataaccgctgggtgaccgcccagcggatcgaggtgtcgggcggacaaaccatctga

SEQ ID NO: 6756 - DNA, 426 bp, Klebsiella pneumoniae
cgtacttccagggtctccgttactcccgataggttccttatgctcaacattgacaaatacctgactgtccgctggcagatgggcggccgcacttttcctgttctcgactgctacggcattgtacatgaggtccgccgggacctggggctgcctgaatggcccgcgtttgaggctgtgattaaagagcgtggcagcactgaaatgggggaagtctgcgagagttttacgcgtgacctgactccctgcaagccgtgcaacggtgcggttgccgcctgctatatgggaaatatgatcggccaccttggtgttgtcgtcgaaatggagggagcgctttacgttattgaatgtaatccccggcgcaacgtaaccattcttcccctggcgcgttttgaacgccagtttctgaaagtggagtattaccagtga

SEQ ID NO: 6757 - DNA, 2781 bp, Klebsiella pneumoniae
cttatgaccagtaacgaacgtattttgcagccatttactttaccaaatggtaccgagctgaaaaaccgtttgctcatggcgccaatgaccacctgcaccggttatttcgatggtactgtcaccagcgagctggtggagtactaccgcgcgcgcgccggaagcatcggtaccattattgtcgagtgctgctttattgatgactacggtctggccttcccgggcgcgatcggcattgataatgatgaaaaaattgccggcctggcgaaaatcgctgaggcgatcaaagccgagggttcaaaagcgattctgcagatctaccacggcggccgtatggtcgacccgcagctgatcggggggcgccagccggtggcgccgagcgctattgccgcgccgcgtgagggcgccgccatgccgcgggcgctgagcggagaagaagtggaagggatgatcgccaagtttggcgacggcgttcgtcgcgccattctcgccggtttcgacggggtcgaaattcacggcgccaacacctatctcattcagcagttctattcgccgaactccaaccagcgcgatgacgagtggggcggtagccgcgacaaccgcgcccgtttcccactggcggtgctggatattacccacaaaatggcccgccagtacgccgacgatgcctttatcatcggctatcgcttctcgccggaggagatggaggtcccggggatccgctttgacgacaccatgtatctgctggaaaagctggccgcccgcggtgtcgactatctgcacttctcggtgggtgccaccctgcgtccgtctatcgtcgataccagcgatccgacgccgctgatcgagaaatactgcgcgatgcgctctgacatcctcgcccaggtgccggtgatgggcgtcggcggggtggtgaacgccgctgatgccgagcagggcctcgatcatggttatgacctgatcgccgtgggccgcgcctgcatcgcctatccggactgggcgtcacgtatcgccgccggcgaagagctggagctgtttatcgacagcacccagcgtgaagcgctgcacattccggaaccgctatggcgtttctcgctggtggaagcgatgatccgcgacatgagcatgggcgacgccaaatttaaaccggggatgtttgttgagaccgtccatgatgacgccaatgagctggtgatcaacgtcagcctcgaaaatgaccatattgccgatatcgaactggcggcgagcccggtccagactgtggaattcaccaccagcttcgaagagatccgcgaacgtattctcaccgccaataccccgcacgtcgatgccatttccggggccaccagccagagcgaggcggtgaaaaaagcggtcgccaaagcgatgctgaaatcgagtaaagcgctggcggcggaagagggcggcaatgacgccgcgccgaaaagctatgatgtggtggtagtcggcagcggcggcgccggtctggcggcagccattcaggcccacgacgaaggggccagcgtgctgatcgttgaaaaaatgccaaccatcggcgggaacaccatcaaggcttccgccgggatgaacgccgcagaaacccgcttccagcgcgtgaaaggtatcgaagacagtaaggagttgttctatcaggaaaccctgaagggcggccacaacaaaaacaacccgcagctgctgcgccgtttcgttgaaaacgcgccgcaagccattgagtggctggcggaccggggcattatgctcaacgacattaccaccaccggtgggatgagcattgaccgtacccaccgcccgcgcgacgggtcagcggtcggcggctatctgattagcggcctggtgcgcaacatcaccaaacgcggtattgacgtcctgctggatacctcggtggaagagatcctgatgcgcggggatgaggttagcggtgtacgtctgatcaacgacgaaaaagaagtcattgaagtacagaccaaaagcatcgtagtggccaccggcggcttcagcgctaacagcgcgatggtcgtgaagtatcgtcctgaccttgaaggcttcgtcaccactaaccacaaaggggctaccgggagcggtatcgcgttgctggaacgcatcggcgccggcaccgtggacatgggcgaaattcagattcacccgaccgtcgagcagcagacctcgtatctgatttccgaatcgattcgcggcggcggcgctattctcgttaaccagcaggggaaccgcttcttcaacgagatggagacccgcgataaagtctcggcggcgattatcgctctgccggaacactatgcttacatcgtcttcgacgagcatgtgcgggcgaaaaacaaagctgccgacgagtacatcgccaaaggcttcgtcaccagcgccagctcaccgcgggaactggcggagaaactggggatggattaccatgccttcctcgccaccctcgagtgctataacggggcggtggaaaaacagcatgatgaacagtttggccggaccaccgcgctacgcgcgccgattaacgaaggcccgttccacgccattcgcatcgcccccggcgtgcaccacaccatgggcggcgtgaccattaataccgatggcgaagtgctgaatgtggcgcagcagccgattcgcggcgcctacgccgccggtgaagtggtgggcgggatccacggcggcaaccgtatcggcggtaacgcggtggcggatatcatcatcttcggtaccctcgcgggccatcaggcggcgaaacgtgccagaggataa

SEQ ID NO: 6758 - DNA, 303 bp, Klebsiella pneumoniae
gccagcgccagccgttgtgttccctccggtatcccggaaaatgccactccggttgcactcccatacgccagcgtaacgttagcagttattgccggactgcctccgctggacgcggtgccggaggtaaatacaggactgtcgccaaaaacggctaccggtagcgatgatgaggtaatgtttcctccgagccaggggcttgatgcctcagcaatcagcacaacaccgccgctatcctgcgccagtaatcctgacccggtaaggccatcgtttatcaccgccagcaggccgggcatattcacatag

SEQ ID NO: 6759 - DNA, 1290 bp, Klebsiella pneumoniae
gcgccagccaggaagctgatgccgacgttaaacgcgccatgctggccgccagcgccgagcactggctggtggcggaccataccaaactcaaccgctgcgaaccgtggcgggtggccggactcagcgacattcaccatctttttcttgatcgtccctgggctgagctgggggatgaccccgccctctctgtacatattgctgacgcttaacaacgtggagaacctgatgagtaacaacacgataaatatcgccctgattggctacggattcgtcggtaagaccttccacgcgccgcttatccgttcggtgccggggctgaacctggcgttcgtcgcttcccgcgatgaagagaaggtcaaacgcgacctgccggacgtcacggtgatcgcctccccggaagctgcggtccagcatccggacgttgacctggtggtcatcgcctcccctaacgccacgcacgccccgctggcccgcctggcgctgaacgccggcaaacatgtggtggtggataagccctttaccctcgatatgcaggaggcccgggagctgatcgccctggcggaggagaaacagcgtctgctttccgtcttccataaccgccgctgggacagcgactatctcgggatccgtcaggtgattgagcaaggcaccctcggcgcggtgaaacacttcgagtcgcatttcgaccgcttccgcccggaagtccgcgtccgctggcgcgagcagaacgtcccgggcagcggcttgtggttcgacctggggccgcacctgatcgaccaggcgctgcagctatttggtttgccgcagtcggtgcaaggtaacatagccaccctgcgcgacggcgcggagatcaacgactgggcgcatgtggtattaaactacccggcgcataaagtgatcctgcactgcagcatgctggtcgcgggcggctcgtcgcgcttcaccgtgcacggcgataaaggtagcgttatcaaagcgcgggccgaccaacaggagagccagctgctggcgggcgtggtaccgggcagcgccgactggggccaggatgacgacccgctggttatctatgatgcctcgctgcaggcccacgcgcaggctaccccgcagggcgatcagcgccagtactatatgctgatccgcgatgcgctgaagggccagatcgccaatccggtgccgccggtggaagcgctggcggtgatggccgttctggaagcggcggtgcgctctgctgaaagtggtatggtgcaaactctggacctgtccgacgacgagcgcaacacgctgcactaa

SEQ ID NO: 6760 - DNA, 768 bp, Klebsiella pneumoniae
ggcctgagcagacatatgatccctgagaagcgaattattcgacgcattcagtctggcggttgtgcaatccattgtcaggattgcagcattagccagctctgcatcccctttactctgaacgagcatgaacttgatcagctggataatattatcgagcggaaaaagcctatccagaaaggtcaaaccttgttcaaagccggtgatgagctgaagtcgttgtacgctattcgctccgggaccatcaaaagttataccatcaccgagcaaggtgatgagcagatcactggcttccatctggcgggcgacctggtgggctttgacgccatcggcaccggtctgcacccgagctttgcgcaggcgctggaaacctcaatggtctgcgagatccccttcgaaacccttgacgatctttccggaaaaatgcccaatctgcgtcagcagatgatgcgcctgatgagcggtgagattaaaggcgaccaggatatgatcctgttgctttccaaaaagaatgccgaagagcgcctggccgcgtttatctataacctttctcgtcgtttcgcccagcgcggcttctcaccacgtgagttccggctgaccatgacccgcggcgatattggcaactatctcggcctcaccgtcgaaaccatcagccgtctgctgggccgttttcagaaaagcggcatgctggcggtgaaaggcaaatatatcactattgaaaacagcgatctgctggcccagctggccgggcaggcgcgcaacgtcgcttaa

SEQ ID NO: 6761 - DNA, 966 bp, Klebsiella pneumoniae
atttgtaaaagaaaattaaaccaggagtgtggaagggctatgaaagacgatattaaccaggagatcaccttccgcaagctgtcggtctttatgatgtttatggcgaaaggtaatatcgccagaaccgccgaagcgatgaaactcagcagcgtcagcgttcaccgcgcgctgcataccctggaagagggggtgggctgcccgctgtttgtccataaagggcgcaacctgctgccgctgcaggcggcgtggacgctgcttgaatactgccaggatgtgataagtctgatgaaccgcgggctcgaggcgacgcgcaaggttgcaggcgtcggtcagaggcggttgcgcatcggtaccctctattctctgaccctggaaaccgttccgcgcatcattatggggatgaagctgcgtcgcccggagctggagctggacctgacgatgggttcaaatcagatgctgctggatatgctggaagacgatgccctcgatgccatcctgatcgccaccaacgaaggggagttcaataataccgctttcgacgtggtgccgctgtttgaggacgatatttttctcgccgccccggcgaccgaacggctggatgcctcacggctcgccgatctgcgcgattacgccgaccgcaagtttgtttcgctggcggaggggttcgccacctatgccggattccgggaagcattccacatcgccggcttcgagccggagatcgtcacccgggtgaatgatattttctcgatgattagcctggtgcaggctggcgtcggttttgccctgctgccggggcggatgaagaaagtgtatgagaaggatgtacagctgctaaagctggcggaaccctaccagatgcgccagctgatctctatcgtctattcgcaccatcgcgaacgcgatgccgacctgctggcgctggcggcggaaggacggatgtacgcccgcagtattaatcgctaa

SEQ ID NO: 6762 - DNA, 1785 bp, Klebsiella pneumoniae
catcttggaaggcctgttgagagcgtgcgggcggtagctgacggtaccgtcatttcactccgcaaaagctcagacaagcgcgacctagcaccattcaacatcaacgccgataaacctaatacaaaggggagtaatgatggttatgtgctcataaagcatgaaaccgagatcggtagcggtgatgaaggaaaagtggctttctattccttatacatacatctgaagtcgctggctgaaactgttaaagccggtgataaagtttaccgtaaggatcctttaggccttccaggcatggttgatggagtgaatgctttccatttccagattttctgcgatgatgacaacatcagcaagctaacgggcaggaaaacaggagagctggatatttcgaagaatggccgcaccgatgcggtttatggtgatattcacttttatctgccaccgcagacaaagttttatgacaaagctcctgcagataacagcatttctaccaccggactttctgaactctataccagcaatgtgcctctgtatgccagcatgactctggcccaaggcaagtgcacgatggttactcgtcagaaaaatacgcagactgacggaaaatatgatctgctgggtgaaccactggttaatgcagatggtgatgactacgaatacaatctctataaaaccgcgatgcggaattataaggagagcccaagtgccgggtttgaattacttcgctttgggcgagtgatcaacacggaccatgaaacactggtaccggcagacgcaccattatggatgacagtcaattacccgggtggtaaaggggtgatcaaccttgctgattccagtattaaaaagtttagtgacgctgatttccctcactggacgggctggcagatggtagatgacgatagtgacagcaacagccagtgtaattcagctattatcaagaaacttcacgaagttggtgacttcgataaccagtgcgggaagctaatatgtcatttcccgtttgaatgggaaaaaagtacgatcgacatccgtttttcgtggctgaaaacgggaaaggaagagcatgaaccgatgacggaagccgattatgcaaagtttaaatcccatgcggaagcactatgctttgattctggagcgttgagttctgaccggttgtggcattttgagccaaaatcatttattcgacatttcaggaaatgtagttggctcgactctgaagtaattgaaaaagtaatgatggcgaatgctagtaaaaaaaataaaaatgcacttgaaggtattaaaaatattacattagagtactatgcggacataaatacaatcatgcgaaagtataacttatctgatgcaaatagaatttgtcattttttagggcagggtgcagttgaatcaggttatttattgtccatgcaagaagctagccagcaacaaattattgttgatggtgttcagcaaggtggtgtgattgttgaagcatcaacatttaatgaaactactaagctaggtcattggtacggagctcttaaagccgagaaggataactatttctccgggaaaaaatacaattcccgtggagggtatatcacaggatcctatagctggattaacggtaactgtggagatgtagatgcacaaaaattcagaggtagagggtttaaaatgctaactggacttaacacatattcaagctactgggtatatcgaggttggttgtcaaaaaatgattttgataaatattggtgggatgacccggagtacaagaaaaaaattcagccggtatga

SEQ ID NO: 6763 - DNA, 378 bp, Klebsiella pneumoniae
ggcctgggaagagggcgaatgggtgcgcgaagccgcgctggcccatgcgcaaaaacagcaggcccgcagcgcggcatgacgagagacaacatgagcaaagtttactggccgttatatgaagtgttcgttcgcagcaaacaggggttatcccatcgtcacgtcggcagtctgcacgctgccgatgatcaaatggcgctggagaatgcccgcgatgcctacacccgccgcagcgaaggctgctcaatttgggtggtgaaggccagcgaaatcgttgcttcgcagccggaagatcgcggcgaattcttcgacccggcggaaagcaaagtctaccgtcatccgactttctataccgtgccggacggcatggaacatatgtga

SEQ ID NO: 6764 - DNA, 1299 bp, Klebsiella pneumoniae
ataacactgagaaacaggactcttatggaaaagttatcttacgcatctgaaagtagtacatctccatggaccacctacctgcgccagatcgaccgcgtcgcgccttatctcggcgatcttgcctactgggtggaaaccctgcgccatccgaaacgcgcgctgatcgtcgacattcctgtgcaaatggacgacggcaccatccgccacttcgagggctatcgcgttcagcacaatctgtcgcgcggaccgggtaaaggtggtgttcgctaccatccggatgtcgatcttaacgaagtcatggcactttctgcctggatgaccattaagtgcgccgcggtcaatattccttacggcggggccaaaggcggcatccgcgtcgaccccttctccttgtcggaaggtgaactggagcgtctgacccgccgctacaccagcgaaatcggcattattatcgggccgcagaaagatattccggcgccggacgtcggcaccaatggcaaagtgatggcatggatgatggacacctactccatgaaccatggcaccaccatcaccggcgtggtcaccggcaaaccgatccacctcggcggctccctcggtcgtgaaaaagccaccggacgcggagtgtttgtcaccggccgggaagttgcccgtcgcgccggtatcgaaattgaaggcgccaaagtggcgctgcagggctttggtaacgtcggtagcgaagcggcccgcctgttcgctggcgtcggcgctcgtatcgtggttattcaggatcataccgcgaccctgtataacgaaggcggaatcgatatggccgccctcaccgcctggcaggcggagaaaaagcagattgccggtttcccgggcgcccaggagatcgataaagacgccttctggaccaccccgatggacatcctgatcccggcggcgctggaagggcaaatcacccgcgagcgcgctgagaagctgacctgcaaactggtgctggaaggggccaacggcccaacctatccggaagcggacgacgtgctggccgagcgcggcgtgatcgtggtgccggacgttatctgcaacgccggcggggtgaccgtcagctactttgagtgggtacaggacatggccagcttcttctggagtgaagaggagatcaacgccaagatggaccgcattatgaccgacgctatcgtgcacgtctgggataaagccgccgagaaagagtgtacgctgcgcaccgccgcctatatcgtggcctgcgagcgcatcctgatggcgcgtaaagaccgcggcatctacccgggctga

SEQ ID NO: 6765 - DNA, 408 bp, Klebsiella pneumoniae
ttgccatcgagggcaccttccagggcggcagtatgggcgaagtgtccggcgccaaaatggccgccgcgctggagctggcggcggaagataaccgcaacggtatcccgacgcaggcggtgctgtgcctcgaaaccggcggcgtacgtctgcaggaggccaacctcggtctggccgccatcgccgatattcacgccgcgattgtcgacctgcgccgctacaccccagtggtcggcatcatcgccggcaccgtcggctgctttggcggtatgtctatcgccgccgcgctgtgcagttaccttatcgtcactcgtgaagcccgtctcggtctcaacggcccgcaggttatcgagcaggaagccggcattgaagagtacgactcccgcaaccggccgtttatctggagcatga

SEQ ID NO: 6766 - DNA, 2064 bp, Klebsiella pneumoniae
cacatttggagatttgcgatgcagcagttagccagctacttatccggcgcctggcagaccggccggggccgcgcccgtactatccatcacgccatcaccggcgcggcgctttgggaggtgaccagtgaaggcctggatatggcgcaggcgcgccgcttcgcgattgagcgcggtggtaaagccctgcaggcgatgacctttattgaacgcagcgcgatgctgaaagcggtggcgaaacacctgctggagcagaaagaccagttctacgccatctccgcgcaaaccggcgccactcgcgccgacagttgggtggatattgaaggcggtatcggtacccttttcacctatgccgggctcggtagtcgagaattaccggacgatatcctgtggccggaagacgagctcatcccgctctccaaacagggcggttttgccgcgcgtcatgtgctaacctcgaaatcaggcgtcgccgtccatatcaacgccttcaacttcccctgctggggaatgctggaaaaactggcgcccacgtggcttgccggtatgccggcgatcattaaaccggccaccgctaccgcccagctcacccaggcaatggtgaaagcgattgtcgacagcggcctggtgccggagggcgccatcagcctgatttgcggcggcgcgggcgatctgctcgaccatctcgatagccaggacgtggtgacctttaccggctcggccgccaccggccagcagctacggacgcaccctaacctggtggccaaatctattccctttaccatggaagctgattcgctcaactgctgcgtattaggtgaagacgtcacgccggagcaaccggaattcgcgctgtttattcgggaagtggtccgcgagatgacggcgaaagccgggcaaaaatgtaccgctatccgcagaatcattgtgccactggctcagattaatgcggttagcgatgcactgatctcccgcctgcataaagtaaccgtcggtgaccctgcgcaggagggcgttaagatgggggccctggttaatagcgaacagcgtcaggacgtacaggagagcgtcaataagctgatagccgctggctgcgaagtactgctcggtggagaggcggatctcagcgcggccggcgcatttttcccgccgaccctgttgtactgctcacagccggatgaaacgccggcggttcacgccattgaagcttttggtccggtggcgacgctgatgccgtatcgcgaccgccagcatgcgctgacgctggcgcgcgccggcggcggcagtctggcggggacgctggtcaccgccagcggcgagctggcgcgcgagtttatcctcggcgccgcccgcgcccatggccgtattcagatactgaacgaggcgtcctcggtcgagtcaaccggccacggttcgccgctgccgcagctggtgcacggcggccccggccgcgctggcggcggagaagagcttggcgggctgcgttcggtgaaacactatatgcagcgtaccgcgattcagggcagcccaacgatgctggcgaccatcggtcaacagtgggtgcgcggcgcccaggtgagcgaagaccgtattcacccgttccgcaaatatttcgaagagattcagcctggcgacagcttattaaccccgcgccgaaccctgaccgaagcggatatcgttaacttcgcctgcctgagcggcgatcatttctacgcgcacatggacaaaatcgccgccgccgagtcgatttttggcgagcgggtggtccacggctatttcctgatctccgccgcggccgggctgttcgtcgatgccggcgtcgggccggttatcgccaactacgggatggaaaacctgcgctttattgagccggtcaaaccgggcgacaccattcaggttcgcctcacctgtaagcggaaaacggtcaaacgtcagcgcagcgccgatgagaaagccaccggcgtggtggaatgggcggtggagattttcaaccagcaccagcaggcggtggcgctgtattccattctgaccctggtggcgcgtcaacagggagatttcccggcgtga

SEQ ID NO: 6767 - DNA, 294 bp, Klebsiella pneumoniae
aagccttggagccaatctactctcgaaagaggatggaagaacaaggtgataaaaaaatttaatactggaggtgatgtgaagtattattatgttttagcattgttacttggttacagctcatgtgtactggcagaagagtgtatggataactcaaatatagattctctaagagaggttttcaaaaaaaataataagaagttgttgattgaaatgtcttcaaaagaaatgaggcgttatgttgaaagtgatttacttatcaaaaataaatacagtacacattgtcaatgtatctga

SEQ ID NO: 6768 - DNA, 1050 bp, Klebsiella pneumoniae
gcctggaggagtttcatcacatcgagtcgctttaccaaccggagaatatccatgagtaaacttgggattaatggatttggtcgtatcggacgtctggtgttacgtcgtttattagaagtcgacagcagcctggaagtggtagctatcaacgacctcacttcgccaaaggtgctggcctacctgttgaagcatgattcaaactacggccccttcccgtggagcgtcgactttaccgaagatgcgctgatcgtcaacggcaaaaccattacggtgtatgccgaaaaagaggcgcagcatattccatggcaggcggcaggcgccgaggtgattgtggagtgtaccgggttctacacctcggccgagaaatcgcaagcccatctccaggccggcgcgcgcaaagtgctgatttccgcccccgccggcgagatgaaaaccatcgtctacaacgtcaacgatgacaccctgaccccggatgacaccatcatctccgtggcctcctgcaccaccaactgcctggcgccgatggccaaagttctgcaggatgccttcggcatcaccgtaggcaccatgaccaccatccacgcctataccggcacccagtcgctggtggacgggccgcgcggaaaagatctgcgcgcctccagggcggcggcggaaaacgttatcccgcacactaccggcgcggcaaaagccattggcctggtgatcccttccctgagcggtaagctgaaaggccatgcccagcgcgtaccgaccaaaaccggctcagtgacggagctggtatcggtgctggagaaaaaggtgactgcggaggaggtcaatcaggcgatgaggcaggcggctgagggcaatgaatcctttggttacaccgaagaggagatcgtctcttccgatatcatcggcagccatttcggttcgatctacgatgctacccagctggagattgtggaggccggcggcgtacagctggtgaaaaccgtcgcctggtacgataacgaatacggctttgtcacccaactgatccgcgtgctggagaaatttgcccgctaa

SEQ ID NO: 6769 - DNA, 480 bp, Klebsiella pneumoniae
cgaatcattttgaaaaaaacaaaaacgttaacgggtatttctttatttatagcggtgttagtccttgtcgctcattttattccgataaggccagtcgttgttattataaataacactaacgaaactatattcgtatatgcaggtgagagtatatataatgtcgaacctgagcctgacgaagtcgcgcgtatagtacgatcaaagcctgaaattatagcacctggaaaaagagttaagattaaagcttcgtttacatctctgattaggaaagatgcagcgctcgacattggttggagggttggtggtcaatacgaatataacgctgcaggtagcggtggtcaaaattttattctttcttcaaaagagggcgtgtgctacgcatcgatttatataaaagatgatttttttaagggcgcgattaaaaatggttcaagcaataaatgtttaaaaaaaataaaggcatttaattataagtattaa

SEQ ID NO: 6770 - DNA, 435 bp, Klebsiella pneumoniae
aaacagtttggtttgttcgtgaacggtaagaaaacaataagttttgaacaatttttaactattaacagcaatcttgtttccatctcagatacatgggcagacttgtgggcgttaatttttcacacaggtttaagcgctggaaggctgctgagtattcgatatgatgatattgatgatggcttgatactgatacgaaaacagggtcacctgaaagagctacgtgttgaatcaacccctccagtggaggggatcattgctcgtagaagagaacgctatccagaagatgtttttttatttcagagccattctaaccgtgtgaagtaccaacgccggccggtcactataattgctttcaacgccgctttacgtcgcgccgctagatcattaccagacgttaacgtaagcagtagtagcgcgagaaacataccggactaa

SEQ ID NO: 6771 - DNA, 1392 bp, Klebsiella pneumoniae
cacatgtctggtggattagtaacggctgcatacattgttgctgcaatcctgtttattttcagcctggcgggcctgtcgaaacacgaaacgtcgcagcagggcaactatttcggcatcgccgggatggccattgccctgattgctaccatcctggggccggacgccggcaacgtcggctggattattcttgcgatggtgatcggcggggcgatcggtattcgtctggcgaagaaggtcgagatgaccgagatgccggagctggtggctatcctgcacagcttcgtggggctggcagcggtgctggtgggtttcaacagctacctgcagcatgaaaccggtatggagcaaattctggtcaatattcatttgaccgaagtgttcctcgggatcttcatcggcgcggtgaccttcaccggttcggtggtggcgtttggtaaactgcgcggcaaaatttcctccaggccgctgatgctgcccaatcgccataagctgaacctggcggcgctggtggtttccttcatcctgatggtgatttttgttcgctctgacagcaccggcacccaggtcctgtgcctgctggtgatgaccgcgatcgcgctggcctttggctggcacctggtggcctctatcggcggtgcggacatgccggtggtggtctcgatgctcaactcctactcgggctgggcggcagcggcggcgggctttatgctgagtaatgacctgctgatcgtcaccggcgcgctggtgggctcttccggcgccatcctctcttacattatgtgtaaggcgatgaaccgctcctttatcagcgtgatcgccgggggcttcggcaccgatggttcctccagcggcggcgatgaagaagtgggcgagcatcgcgagattagtgccgaagagacggcggagatgctgaaaaactcgcactcggtgatcatcaccccgggctacggtatggcggtggctcaggcgcagtatccggtagcagaaattaccgagaagctgcgggcgcggggtatcaaagtacgctttggtattcatccggtggccgggcgcctcccggggcatatgaacgtcctgctggcggaagccaaagtgccttacgacatcgtgctggagatggatgagatcaacgacgatttcagcgacaccgacaccgtgctggtgatcggcgccaacgataccgtcaacccggcggcgcaggacgatccgaagagcccgatcgccggcatgccggtgctcgaggtgtggaaagcgcagaatgtggtggtctttaagcgttcaatgaacaccggttacgccggcgtacagaacccgctgttctttaaagagaacactcatatgctgtttggcgatgctaaagccagcgtcgatgcgatcctgaaagcgctgtaa

SEQ ID NO: 6772 - DNA, 363 bp, Klebsiella pneumoniae
ccctgcgctggtggtgctggccgtactatcgcaatacgtacgccagccagcattgaaagaaaaggccgacgaactgaaggagcagcaatgagctttgaaattatcgcgggactggtggtcgtcatcctgggtgctattgctggcgcgttcggcattggtcatgctcgcggggccagtaaggcgaaagccaaagctgatcagcaacgtaccgaagagaacgccgctgctactgtcgccgcggcagaacgccgtgctgaagtcacgaaaggggccagcgatgtacaggaagacgttaagcgtatgggcgatgacgatgttgatcgggagttgcgcgaaaagtttacccgccccggtagtcgttga

SEQ ID NO: 6773 - DNA, 885 bp, Klebsiella pneumoniae
tcgaaatatggtgcgataatcgaacatcggttatctttagcgaaagaatgtgatcgatggcaaatatggggaacagaaatggacaagcatccagacgatttactgaccggcgacggcgatccgtttaaaggcgatcctaactttatggcctccctggcgcggggtctggaggtgattcaggcgttcacgccgcagcggcccctgctgtctatctcgcagatcagtcagaagaccggcatcccgcgcgccgcggtgcgccgctgcctgtataccttgagcaagctggggttcgtgtatgccgaagacggtaagaatttccagctgcggccgcggatcctggcgctgggccacgcctggctggcctcgacgccgctggcgcgttcggcgcagccggtgctgcggcatctgagcgaaatgctcaatgagtcctgctccatcgccaccctcgacggcgacgatatcctgtatatcgcccgcgcctccagctcgcggattatgaccatcgacctggatatcggcagtcgccttccggcgtgggcgacctcgatgggccgggtgctgctgagccatcagccggaggagaagctcaacgatatgctggcccgggtgaccatgatccgctataccccacagacggtggattcggtggcgaagctgcgcgccgaactgaaacgggtgcatcagcaggggtatgccctcaacgatcaggagctggagatggggctgcgctccctcgcggtcccgctgtttaacgctcaggggcaggtccaggcggcgctcaacgtcggggtgcatgcgggccagatgacggcccgcgagatgatcgagcgcgtgctgccggagctgcaaaaagccgcccgcgagctgacgctgcttctgcgctaa

SEQ ID NO: 6774 - DNA, 3972 bp, Klebsiella pneumoniae
cacagatgtggtactctaaggcaatacttcaaaagagattttcccggcagagctctgcccgataacgctatgacagaacaacaaaaaatcaccttcccccagctttatcaacagctcgacggcctgatgctgcgcgacaaaacgcgctttgcccgccgtctacacggcgtgaagaaggttaaaaatcctgaatcgcaacaggccattctgcaggagatggcgctggagataagccaggcagccggtaaagtcctgctgcgcgaagcggcgcgtccggccatcacctatccggaaaacctgccggttagccagaaaaaacaagagattctcgaggcggtgcgcgaccaccaggtggtgatcgtcgccggggagaccggttcgggtaaaaccacccagttgcccaaaatctgcatggagctggggcgcgggctgaaaggactcatcggccatacccagccgcgtcgcctggcggcgcggaccgtcgccaatcgtattgccgaagagctgcagagcgagccgggcggctgcatcggctataaagtccgcttcagcgaccacgtcagcgaaaacaccatggttaagctaatgaccgacggtatcctgctggcggagatccagcaggatcgtctgttgatgcagtacgacaccatcattatcgatgaggcgcacgagcgcagtctgaatattgactttctgctcggctatctgaaagagctcctgccgcgccgcccggacctgaaaatcatcattacctctgcgaccatcgacccggaacgtttctcaaagcatttcaataatgcgccgattatcgaagtctccgggcggacttacccggtggaagtgcgctatcggccgatagtggaagaggcggacgataccgagcgcgatcagttacaggcgatctttgatgcggttgacgaactggggcgcgaagggcccggcgatattctgatctttatgagcggtgagcgggaaattcgcgataccgccgatgcgctgaataagctggatctgcgccataccgaagtgctgccgctgtacgcccgcctgtccaacagcgagcagaaccgcgtcttccagccgcacagcgggcggcgcatcgtgctggcgaccaacgtggcggaaacctcgctgaccgtgccgggcattaagtacgttatcgatcccggtactgcgcgtatcagccgttacagctaccgcaccaaggtgcagcgcctgccgatcgagccggtttcccaggcgtccgccaaccagcgtaagggccgctgcggccgcgtttcggaagggatctgtattcgtctttattcagaagacgatttcctgtcgcgcccggaatttaccgacccggagattctgcgcaccaacctggcgtcggtcatcctgcagatgaccgccctgggcttaggcgatatcgccgccttcccgtttgtcgaagcgccggataagcgcaatatccaggacggcgtacgcctgctggaagagctgggcgccatcaccaccgatgcgcaggcaacggcttataagctaaccccgctgggccgccagctcagccagctaccggtggatccgcgtctggcgcgcatggtgctggaggcgcagaagcacggctgcgtgcgggaagcgatgatcatcacctccgcgctgtcgatccaggacccgcgcgagcggccgatggaccaacagcaggcctctgacgaaaaacatcgccgcttccacgataaagagtctgatttcctcgcttccgtcaatctgtggaactacctcggcgagcagcagaaggcgctgtcgtcgaatcagttccgccgccagtgccgggtcgattttcttaactatctgcgcgtgcgcgagtggcaggacatctacacccagctgcgccaggtggtgaaagagcttggcctgccgatcaacagtgagccggcggaatatcgcgagatccatactgcgttgctgaccggtctgctgtcgcacatcggcatgaaggatgccgataaacaggagtataccggcgcacgtaatgcgcggttctctattttcccaggttccggcctgtttaaaaagccgccgaagtggacgatggtggccgagctggtggagaccagccggctgtgggggcgtattgccgcccgcattgagccggagtgggtggagccggtagcgcagcacctgatcaagcgctcatacagtgagccgcactgggagcggtcgcagggcgcggtaatggcgacggaaaaggtcaccgtctacggcctgccgatcgtcgccgcgcgtaaggtcaactacagccagattgatccggcgctgtgtcgtgagctatttatccgccacgcgctggtagagggcgactggcagacgcggcacgccttcttccgcgataacctgaagctgcgcgcggaaatcgaagagctggagcataagtcgcgccgtcgcgacatcctggttgatgacgagacgatgttcgagttttacgaccagcgcattagccacgacgtcatctccgctcgccactttgataagtggtggaagcaggccagccgcgaaacgccagacttgctcaattttgaaaagagcatgctgattaaagagggggcggagcaggtcagtaaactggactacccgaatttctggcatcagggcaatcttaaactgcgtcttagctatcagtttgaacctggcgccgatgccgatggcgtaacggtgcatattccgctgccgctgctcaaccagttagaggaagccgggtttgaatggcagatccctggcctgcgtcgcgagctcattatcgcgctgataaaatcgctgccgaagccggtacggcgcaatttcgtcccggctcccaactatgcggaagcgtttcttggccgggcgacgccgcttgagctgccgctgctcgattcgctggagcgcgagctgcgtaagatgaccggcgtgaccatcgaccgcgaagcctggcagtgggatcaggtgcccgatcacctgaaaatcactttccgggtggtggatgataaaaacaagaagctgcaggaagggcgctcgctgcaggcgttgaaagacgccctgaagggcaaagtgcaggagacgctgtcggcggtcgctgatgacggtattgagcagagcgggctgcatatctggagctttggcaccctggcggaaagttacgaacagaagcgcggtaactataaggtgaaagcctggccggcgctggtggacgagcgcgacagcgtggccatcaagctgtttgataatccacaggaacagcagcaggccatgtggcgcggtctgcgtcgcctgctgctgctcaacatcccgtcgccgattaagtatctgcacgagaaactaccgaataaagccaagcttgggctctactttaacccgtacggcaaagtgctggatctgattgatgattgcatctcctgcggcgttgataagcttattgacgaagcgggcggtccggtgtggacggaagagggctttagtcagctgcacgataaagtgcgagccgagctcaacgacacggtggtggagatcgctaaacaggtcgagcagatcctcaccgcggtgttcaatatcaacaaacggctgaaaggccgggtggatatgaccatggcgctggggctgtcggatatcaaagcgcagatggcgggtctggtgtatcgcggctttgtcaccggcaacggtttccgccgtcttggcgatacgctgcgctatctgcaggcgattgaaaagcgtctggagaagatggctatcgatccgcaccgcgatcgggcgcagatgcttaaggtggagagcgtgcagcaggcgtggcagcagtggctgaataagctaccgccgaaccgccgtgaggacgacgatgtccgggagatccgctggatgatcgaggagctgcgggtcagcttcttcgcccagcagctgggcaccccgtatcctatctcggacaagcgagtgttgcaggcgatggagcaaattaccccatag

SEQ ID NO: 6775 - DNA, 501 bp, Klebsiella pneumoniae
acagggagtggcctaaacatgacagcgattaaccgcctttatgcgtcctccgggtcggaggtcatcattggtacgttgcagatcgatattggcggccagacgcattatttgtgtgaggggtatgaggacattacggcggtgaccgaggggggcgaaacagtaacgtttattgcctgtgccattgtcctttcccttcctgccagaaacgaagacgggacgcaggacctgaagtttatgctgtgcaacgtcgacggcgttgtatccacggctattcgcaaggtcattgatgccatatccactgccagcatcacattcaggaaatacatttccactgaccttaccgcgccagcggagccgccttacgtcatgccggttaaaggaggatcctggacgccgcttactgtaaacgtcactgccggatttaaaaatatgctcgattatgcctggccacgtgacagatacacgttgacgtacttccagggtctccgttactcccgatag

SEQ ID NO: 6776 - DNA, 1911 bp, Klebsiella pneumoniae
agtggcttcggtggcggcgatccagaacttcggcagctttgtgtttgcctctttcgcgccgatcgtgaccggctgggtagtggatacgactcactctttcaatctggcgctggtgatcgccgccggggtgacctttgccggggcgctgtgctacttctttatcgtcaaaactcgcatcgattagcaacgctcggcgattcgtcaacagcaggcccgcagggacgcgcggccgccatgttcttctcctcccgttacctgcgctatcctgtcactgcggcgattgcagccacgtgccccgtgctttatcaggtgagatcttcttgtatggtagttgacagaaatcaaagatgttataccaattgcgtgagatggttgaggcacaaaggcattctcctcgagagttctccccgagaatggttgatgggctacataacaacgagagtcatcatggaaaacaccctcttaaccgctaacgccacgctgccgacttacgatcgcagcgcactgatcccccgtatcgttcatcttggttttggcgcgtttcatcgcgctcatcaggctgtgtatgccgatatactggccagcgagcacggcagcgactggggctacaccgaagttaatctgattggcggcgagcagcagatcgccgatctccagcagcaggatctgctgtataccgtcgccgaaatgtccgccgacgcctggaccgcgcgcgtggttggtgtggtgaagcaggcgctgcacgccggggttgatggtctcgaagcggtgctggcggcgatgtgccagccacaggtggccattgtctccctgacgattactgagaaaggctattgccattcgccagccagcggcgaactgcagctcgatcacccgctgatcgccgccgatctgcataacccgcaccagccaaaatcggcggcgggggtagtggtggaggccttatctcgccgccgggcggccggcctgcctgcttttaccgtgatgtcctgcgataacatgccggaaaatggtcacgtgatgcgcaacgtcgtctgcgcctacgcccgggctttagacgaggatcttgccgcatggatagagcagaatgtcacctttccgtcgacgatggtggaccggattgtcccggcggtgactgccgaaaccctcgataaaattacccagctgaccggggtgcgcgacccggccggggtggcctgcgaacctttccgtcagtgggtgattgaggataactttgttgccggacgtccgcagtgggagaaagcgggagcggaactggtcgccgacgtggtgcctttcgaagagatgaagctgagaatgctcaatggtagccattcgttcctcgcttatctcggctatctggccggttatcagcatatcaacgactgtatgcaggacgataactaccgtcgcgcggcgctgtcgttgatgctggacgaacaggcatcaacgctgaaggtgcagggggtggatctgtcacgctatgccagtttgctgattgaccgttactgcaatccggcgctgaagcaccgcacctggcagatagccatggacggcagccagaagttgccccagcgcatgctggactccatacgctggcatctggtgcatcagcgtgattttacactgctggcgctgggcgtggcagggtggatgcgttacgttggcggcgttgacgatgcgggccaggcaatcgagatatgcgacccgttgttgccggttatccagcaagcggtggctgccagcgccgatggcgaagcgcgagtcaaagcgctgctgggtattgaggctattttcggcgtcgaactgccgcaggagtcacgctttgtcacggcggtgacccgcgcctacttagcgctgcagcggcagggggctaaagctaccgtcgccgcgtgggccgccgcgcaataa

SEQ ID NO: 6777 - DNA, 570 bp, Klebsiella pneumoniae
acgcctgccggttaccggaccaaccctctgcgtcatcccaggatgatggcgcttcactacacaatggagagtaattccatggcaattcctgtttatctttggctgaaagacgacggcggcgcggacattaaagggtctgtcgacgttcaggatcgtgaaggcagtatcgaagtggtggctcaggagcataacctgtacatcccgaccgataacaacaccggcaaactgaccggcacgcgtattcatacgccgttcctgttcaccaaggagatcgactcctccagcccctacctgtacaaggcggtgaccaccggccagaccctgaaatccgccgagttcaagtggtaccgaatcaacgatgccggccaggaagtggagtatttcaataccaaacttgagaacgtcaaggtggtaaaagtgaatcccctgatgcacgacatcaaaaaccccgcctacgagaagcacaaccatctggaacagattgagctgcgctacgagaagatcacctggacctataaagacggcaacatcattcactccgatagctggaacgaacgcgccaccgcgtaa

SEQ ID NO: 6778 - DNA, 711 bp, Klebsiella pneumoniae
actttttgcggtactacgaacgtgaatgagcctaaacgcggcaacgccgcgtccattgatattgatgcgctgctgccgaacacctggttcagggttatcagcctgcgcctcggcccgcagttccgcgatgagaaggggtacacgctatggcagcgctgtattgctgatgtcgagcgcgtgcaacatgagctgaaggcgagcgggcttgatgacgccagctgtcagcatattctcaccgcccagtgcgcgctgctcgatgaagccgtgaaagggcgcggcgtggaggatgaggcctgcctgcagtggtatgacattccgctgcaggggcacttcctcggcaccatggacgccggcgacaccctgtgcgagcggatgcgtgatgtattgcgtgaaccggcgcccaacctggccgtggtcacctgttttcagcgggtgatgctgctgggttttattggcagctttcgctccctccacgaccccgaacgcctgaagctggtcaacgcgctcggtgagcgtgttcctccttttcagtgcccggctaccgctcccgtactggtagagagtcgcgccggtctggggataagcggctggctggccccatggccggtacgtattggcctgagcgtggtggtggtactcgccctgtggtggggactcaaccactggctcgatcacctgctgctgaccttgttaccgggggaggtgaaatga

SEQ ID NO: 6779 - DNA, 1401 bp, Klebsiella pneumoniae
tacccgtgcggagaaacaaccatgatccgcccggtcgcccttgctatcgttctggcgctggtcggctgtcaatccgccgatgtgcagcgcgcgcagccgaccctgactattcctgccgcctggcgggccgacgttggcccggccagcccggtggagggcgtatggtggcgcaattttcatgacagtaccctcaatcagtatgtcgaccgggcgctgcgctataacagcgatgtgctgatcgcccgcgagcgggtgaatgagtatcaggcgcgcgcttacgccgccgacagcagcctgtttccgtcactggacgccagcctcaccggcacccgcgcccggacgcagtccgccgccaccggcctgccgatccacagcacactgtataagggcggcctgaccgccagctatgatgtcgatatctggggagcgaaccgcagcgcggccaacgccgccggggccagccttgaggcgcagaaagccgccgccgccgccgccaatttgagcgtcgccagctcggtggccgttggctacgtcacgctgctgtcgctggatgagcagctgcgggtgacccagcagacgctaacatcaagggaagacgcgtggcgcctggccaaacgtcagtttgaaaccgggtatacttcacgccttgagctgatgcaggcggattcggagctgcggtcaacgcgggcgcagatcccgccgctacagcaccagattgcgcagcaggaaaatgcgctcagcgtgctgctcggcgataaccctggcgcggtaaaacgcggcgagttcgcccagcttaccccgctgcgtctgccgtcgcagctgccgtccaccttgctcaaccgccgtccggacatcgctcaggccgagcgccagctggtggccgccgacgccacgctggcctcgtcgcaggcgcagctgctgccctctattaacctgaccgctaccggcagcctgcaggaccggacgctgccggatctgttggacaacccgctgcggctgtggagtcttggcggcagtattctggcgccgctgctaaaccgccaggcgttaaatgcccaggtggacgtctccatggcccagcgcaaccaggcgctctatagctatgagaaaacggtgcgcagcgcgttcaaagaggtcaatgacagcctggacgccatcagtcgctatggcgaacagttaaccgagcttcaggaacaagagaccgttgcccaggaaaccttacgtattgcacaaaaccgctaccgtaacggctactcttcttatctggatgtgcttgatgcccagcgaacgctgttctccacccagcttagcgtggtgcaggtgaagaacaacctgctgctggcgcagatcgatctgtaccgggcgctgggaggcggctggtctgactcatcagggagctaa

SEQ ID NO: 6780 - DNA, 465 bp, Klebsiella pneumoniae
ggtgctggcggctggcggttgcgccagtttcgccgggcgcgccgccctggcccgcctggacgcaatcatgctggcgctaaacgcctcgccgggaggcgccgccgatctccttgccgccaccctgtttctcgacagagttgccggctaacgcattcagaggatgttatggaacagattacattgtcatttcctgccagccgcgccctgagcggccgagcgctggcaggagtcgtgggttcaggcgatatggaagtactttataccgccgcacagagcgccacgctcaacgtacagatcaccacctcagtggataacagccaggcgcgctggcaggcgctgttcgacaggctgaacctgatcaacggcctgcccgccgggcagttgattatccacgacttcggcgccacgccgggcgtcgcccgtattcgtattgaacaggtttttgaggaggccgctcatgcgtaa

SEQ ID NO: 6781 - DNA, 1209 bp, Klebsiella pneumoniae
attatgtcaggcagtatgactcgcgaagattttgacgcttacctggttccctgttttgcccccgcgccgtttattccggtcagagcggcgggctcccgcgtctgggaccagcaggggaaagagtatatcgatatggcgggcggcatcgcagtgaacgccctgggccatgctcacccggcgctggctcaggccctgcaggatcaactggcgaaactgtggcatatcggcaatggctataccaacgagccggtgctgcagctggcaaaaaccctcgtgcagtcgacctttgccgacaaggtgtttttctgcaactccggcgccgaagccaacgaggcggcccttaagctggcgcggaaatatgcccacgataagtttggcggtgaaaaaagcgaaatcatcgccttcaaccacgccttccatggccgcacgctgttcaccgtctccgttggcggccagccgaaatattccagcgattatgctccgctgccgcagggcattacccatctgccctataacgatatcgaggcggtcaccgcggcgatctcctcgcgcacctgcgcggtgatcgtcgagccgattatcggcgaaggcggtgtgatcccggcggacccggcgttcctgcaggcgctgcgtaccctctgcgatcgccatcatgccactctgatattcgatgaggtgcagaccggcgccgggcgtaccggccatctctacgcctaccagcattacaacgtcgtcccggacattctcaccagcgccaaagggctggggggcggcttcccgatcggcgcgatgctggcgaaagaggcctgggcgcaggtcttccagccaggcacccatggcactaccttcggcggcaacccgctggcggcaaccgtcgctaacgccgtgctggcccatctcgatgcgccgctgctggcgggcgttggcgagcgccatgcgctgatcgttgaccagttgaatgcgatctctgcccgttacgatgcgtttagcgccgtgcgcggcaccggtctgctgatcggcgctgagctggcggggccgctgcgcggcaaggccaaaacgttgaccaacctggcggcggaagaggggctgatcgccctgattgccggcccggacgtgctgcgcttcgcgccggcgctcaatatcccgctggcggatattgcggaagccttcgtgcgccttgatcgcgccgttgcccgcttaacccgctaa

SEQ ID NO: 6782 - DNA, 240 bp, Klebsiella pneumoniae
gcggcaagaggtgatataatgttccggttcttacatcagacagaggatattatggataccgagttaaccccaacgcagatggccatcgaattcttacgccgcgaccccaccgtcatgaccccagcgcagtatctgaaaaaacttaaactgctggagctggagtttgctgacctgatggcgctctcctcgctggagctgaaagaagagatcgatctggcctggcgtctgggtatccactaa

SEQ ID NO: 6783 - DNA, 1377 bp, Klebsiella pneumoniae
  unsure (1219),(1262): Identity of nucleotide at the above locations are unknown.
aagaaactgggcctgagcgccctgaccgccctggtccttagctcaatgctcggcgctggcgtattcagtttgccgcaaaatatggctgccgtggccagcccctccgctctgctcattggctgggccatcaccggcgtcgggatcctgtttctcgctttcgccatgctgctgttgacccgtattcgtcccgacctcgacggcgggatcttcacctacgctcgcgaaggattcggcgaactgatcggcttctgctccgcctggggatactggctgtgcgcggtgatcgccaacgtctcctatctggttatcgtcttttcggcgctcagtttcttcaccgatacccctgagctgcgcctgtttggcgatggtaatacctggcagtctatcgttggcgcgtcggttctgctgtgggtcgtccactttctggtcctgcgcggtgtccagacggcagcggggattaacctggtggccaccctcgccaagcttctgccgctgggcgcctttgtcgcgctcgccgccctggcctttcagctggatacgttccgcctcgatttcagcggcctggcgctgggcgtgccggtatgggagcaggtcaaaaacaccatgctgatcaccctgtgggtgtttatcggcgtggagggggcggtagtcgtgtccgcgcgggcgcgacacaagcgcgacgttggccgcgcgacgctgctggcggtgctgtcggccctcgcggtgtatctgctggtcaccctgctgtcgctgggcgttgtgccgcgcagcgaactggccgaaatgcgcaacccgtcgatggcgggactgatggtcaggctgatggggtcatggggggagatcgtcattgccgccgggctgatcgtgtcagtgtgcggcgcttatctcagctggaccatcatggccgcggaggtgcctttcctcgccgccactcataaagccttcccgcgcctgtttgcccgtcagaatagcaacaacgccccctccgcctcattgtggttgaccaatatcagcgttcaggtatcgctggtgctgatctggctgaccggatcggactacggcacactgctgaccattgcctctgagatgattctcgtgccctatctgctggtcggcgcctttctgctgaaaatcgccactcgcccgctgcataaagcggtggctatcggcgcctgtatttatggcatatggttattatacgcgtcggggcctgtgcatntgctgttgtcggtggtactttacgctccgggtcttctggtctntttgtacgcccgacgtacacaccagcacgatcgttcgctcaaacgccgcgaagtggcgctaattggtttattgctggttgccgctgtgccggcaacgtggatgctggtggggtaa

SEQ ID NO: 6784 - DNA, 1074 bp, Klebsiella pneumoniae
agagcgccgggcgatggtcgccgcggtggccgggatcaccgatatcggccttggtgtggacgccaaacgcgtcgccgcgctgcgtcagagcggcaaagtggtctacccggaagatctcgggattcgccgcagcgatgccacccgctccctgctggccgccggcagcgtcgccgacctggtggagtggtccgacggactgtacaacccaccggcaaaattccggagctggtaatgaaaaatctctcccccctgcacgcagaaagccgcgtcagctggctggcgcataccgccagcgcctgtctgattgacgaagcccgcctgagcccgaaaccgggtctggtggatagccgcggcaacggcgcgcatcaggacctgaatctggcgctgatggagcgctccgcccgcagcctgcagccgacctttcacgcgctggccgagcaaagctggcgtcgcccggcggacatcgccctgcgcgaaaccgtcggccgccttggccgcgaaggcgaagcgcagatgatgctggcgacgggtggggttaacacccaccgcggcgctatctgggcgctaggcctgctggtcagcgcggtggcgatgttgggtggagagggtcagtcacaggcgatcgccgacgccgccgccgccctcgcccgcctgcccgacggcttcgcgccgaaaagctttagtaaagggcttcgcgccagccgccgctggcaggtgccaggcgcccgcgaggaagcgcagtgtggtttcccgcatatcacccgcctggcgctgccgcaactgcagcacagccgggcgcgaggcgccagtgagccgcaggcgcagcttgatgcgctgatggccatcatgacctcgctgagcgatacctgcgtgctgtcgcgcgccggtatggccgggctgcaggccatgcatcaaggcgcttgtgaggtgctggcggctggcggttgcgccagtttcgccgggcgcgccgccctggcccgcctggacgcaatcatgctggcgctaaacgcctcgccgggaggcgccgccgatctccttgccgccaccctgtttctcgacagagttgccggctaa

SEQ ID NO: 6785 - DNA, 630 bp, Klebsiella pneumoniae
tgcccacagggaagttatatgactaattttttgttcaatataaaaaatcactatttgcgagtcgctattgctgaactggttgatgaagcgatgaaggccgccgggcggccacactatcagttttctcaacaatgggatgcaggatcgatggcgcaagctgatgtgatattcacggaaatggtcgcgggggagtggtacttgtgccaggatctttttcagcatgccccggaacaatatacgctttttattttcccggacaatgaacacgctaccgtagatgagggtttaccgaattgtctgcagcatgcggtatttatgccgcctcacactcgcgttcagcggctgaaagatgagatagctaacgccattgagcgtccgctgctaccgcggcaagacccgccgttcaatcgtctgcggcgttgcattaattgcgcctgcaggtcggtcagcgacgcgcaaaccaaagtcatttacgcgttcagtattggcctgagcccgcatgaagtcgccgctgcgctaaatattagtcccaaaacgattcattcacataaaaagaatattatgagtaaatttaatttgaatagccgtcagcagtttaacaaccttgtgcaactgctcgccaaacgctga

SEQ ID NO: 6786 - DNA, 531 bp, Klebsiella pneumoniae
tctacacagggcacttatggtgaaaaccaactcggggaggaaaattcgctgatggcaatcaccacgacactttactaccccgctgatgttctccctgggccgttgaaagacggctttggaatgaagccgaaatccccggtaaaaatcaccgagctcgtaacggggcgtaaaagaatacgacgtggctatacctctgttcctacggaaacagatgtagcctggatttttactgacgcgcaggcccaggcttttgaggcatggtaccgggatgttctaaaagacggcagcgcctggtttaacatgccgctactgacgccagtgggccaaaaaaattacgtttgcaggtttaacgatatttatgaggggcctacgcctgaaggaggcttgtactggcggtattcagcatcccttgagttatgggaacggccgctgccggcggttggctggggagaatatccggagtggattgtggggagttcgttactcgatatagctctgaacagggagtggcctaaacatgacagcgattaa

SEQ ID NO: 6787 - DNA, 1119 bp, Klebsiella pneumoniae
tcgcgacggggttacgccttatgtttaacttactgtatttattgtggtttacaaaaggttttgcggagattatcacaaaaagagcaaacaaaatttgtggttttatttaaccaatatgtaaccttcaataaacaaagtgattcacataaatgtttttgttgtgaatatcggaatcataaaggtgatgacgtgacagaagaacaacgctttgaccagcgcatcgcgcaggaaacggccatcgaaccgcaggactggatgccggatgcctaccgtaagaccttgattcggcagataggccagcacgcgcactcggagatcgtcggcatgctgccggaaggcaactggatcatccgcgcgccgacgctgcgccgcaaagcgatcctgttggctaaggtacaggatgaggctggacacgggctgtatctctatagcgccgcggaaacccttggctgcgcccgggaagacctgtatcagaagatgctcgacgggcagatgaaatactcctccatttttaactacccgaccctcagctgggcggatatcggcgtgatcggctggctggtcgatggcgcggccatcgtcaaccaggtggcgctgtgccggacctcctacggcccctatgcccgggcgatggtcaaaatctgcaaagaagagagctttcaccagcgtcagggttttgaagcctgcatggcgctggcgcagggcaatgacgcgcagcggcagatgctgcaggacgctattaaccgcttctggtggccggcgctgatgatgttcggccccaacgatgacaactcgccgaacagcgcccgcagcatggcgtggaaaatcaaactgcactccaacgacgagctacgtcagcgtttcgtcgacaataccgtgccgcaggtagagatcctcggtatgactgtcccggacccggatttgcagtttgatgaagccagcgggcactaccgcttcggcgaaatcgactggcaggaatttaacgaggtgattagcggccgtggcatttgcaatcacgagcggttggccgccaagcgtaaggcctgggaagagggcgaatgggtgcgcgaagccgcgctggcccatgcgcaaaaacagcaggcccgcagcgcggcatga

SEQ ID NO: 6788 - DNA, 1053 bp, Klebsiella pneumoniae
tggcgtggggggcaagccatcatgctcaatggttcaccgggcattttgccgggccttcctgcggctggctggagaaggataagcaaggtgactatcgctggcgagaggccgggaaacaggctgcagataaggggaacagtgatgaataatgcgcaaaccgtgttggtttttggcgccaccggtcagcagggcggctcggtggcgcgggcgctgctgcaccgcggctggcgggttcgggcgctggtcagggatcctttctccgcgggggccgctgcgctggcggcgcggggagccgagctggtcgtgggtacctttgaagaccgggcggcaatgcggtcggcgatggccggggtcgacggcgtcttcagcgtccagcccagttcgccgggagggacggtgaccgatgagcaggaggtacgctacgggataaccatcgccgatctcgccgtcgagtgcggggtgaagcatctggtgtacagctccggcagcgcgacgggggagacgccgaccggcgtagcgcattatgacaccaaagcggaaattgaacggcatattcgccgcctgccgctggcggcgactatcgtgcggcccgccacctttatggagctgctggtgatgcctggttttggccttgatgaaggtcgttttcaattttttatgctgccggaggggagaatgcaggtgctggcggtggaggatatcggccatcttgtcgcggcggtttttgccgcgccggcgcggtttgccggcaagacgttcgagatcgccagcgacagcgtgaccggtcgtcagctggaggggttattctccgcggcggcgggacggccgatcccctattcgcgattttccgacgaggtgctggccgccagtccttttctgcacaagctgaccgggctggtggacgacgggcggctggccgggcacgccgacctcgacgccctgcgccagctgcacccgcagctgcacaccttcgccggctggctggcaggccccggccgtcccgccttcgagcgggcgctgaccagcggggctcgctgggcgtttgatcgttaa

SEQ ID NO: 6789 - DNA, 1137 bp, Klebsiella pneumoniae
aggaatttcttcatgaaaagaaaagtactggccctcgttattccggctttattagccgccggtgccgcgcatgcggcggaaatttataataaagacgggaataaattagatctctatggcaaggtagatggtctgcattatttctccagcgactcgaaaaaagacggcgatcaaacttatttacgttttggctttaaaggcgaaacccagatcaacgatatgcttaccggctatggccagtgggaatataacgttcaggccaacaacaccgagacctccagcgatcaggcgtggacccgtctggcattcgccggtatcaaagtgggcgattacggctccttcgactacggtcgtaactacggcgtgctgtacgacgttgaaggctggaccgatatgctgccggagttcggcggcgactcttacacctatgcggataactttatggcaggccgcgccaacggcgtcgcaacctaccgcaacagcgatttcttcggtctggtggagggtctgaacttcgccctgcagtatcagggtaaaaacgaaggccagaacgcgcaggatatcaacgtcggcaccaataaccgcagcagcgacagcgatgttcgcttcgacaatggcgatggtttcggcctctctacttcctacgacttcggcatgggcatcagcgcggcggcagcttacacctcgtctgaccgtactaacgatcagatgacccagaccaacgcgcgcggcgataaagcggaagcctggaccgccggcctgaagtacgacgccaacgatatctacctggcgaccatgtactctgaaacccgcaatatgaccccgtacggcaatgacggcgtggccaataaaacgcaaaacttcgaagtcaccgcgcagtatcagttcgacttcggcctgcgtccggccatctcctacctgcagtccaaaggcaaagatctgtacaataacggccgctatgccgataaagatctggtcaaatatatggacgttggcgcgacctattacttcaaccgtaatatgtccacctatgttgattacaaaatcaacctgctggatggtaacgacaaattctacgaagacaacggtatctctaccgataacatcgtcgccctgggcctggtttaccagttctga

SEQ ID NO: 6790 - DNA, 888 bp, Klebsiella pneumoniae
aaggatcttatgcgcgacgccctgttcgatctctgccgccggtttgccgatgctcatgtcgatagcagcggggtggcagttaccctggttcccggtattactctggtgcgggccctgcatcctggtgacctgcaggcggctatcgccaggccgctggtggccatgctgctccaggggcgtaagagcgtgaccaccggcctggccagctttgactatggtccgggcgaggcgatggtgattgccgcggatgttcccactaccagccagatcaccgaggccagtcagcgttttccctattacgcgctggtgctggagctggacctggctatcctgcgcgagctgcaggaggccgggccgtcagggccggatgaggcgccccgcgttggtatcgaaccgatgaacgccgatgtgacggatgccgcttaccggctggcaaggctgtttgatcaaccgggggcgctggcggtgctgggggaaggtctgcggcgggagctgcattactggctgttgcagagtgtccatgggccggccatccgggcgctgggcgccgtagacagccattcggcgcggatccgtcgggcggtggcgatgctgcgccgggattttatgcagccagtcagcgtcgacgcgctggccgacgccgccgggatgagcgtctctgtctttcaccgtcatttccgcgccatgaccacgctgtcgccgctgcagtttcagaagcagttacgcctgatccacgcccgccgcctgatgctggcggaagggatgagtattgcgcaggctgccggggaggtgggctatatcagcgtgtcgcagttcacccgggaatacgctcgcctgtatggcgcgccgccgggccgcgatcgtcgacgggaaaaaatgagcgcctga

SEQ ID NO: 6791 - DNA, 351 bp, Klebsiella pneumoniae
atacagcttatacagattgagcacggtaaagccatagtccatcgccaggcgtgcggcgcgggtggcgagaccttttccctggaagtcgggggagatgatgatctggaactcggcccggcggtgcacatggttgatttcaaccagttccaccagtccggctttatcgccattgcattcgatgacaaagcggcgctcgctttgatcgtgaatatgtttgtcgtacagatcggagagctcaacgaaggcctcgtacggctcttcaaaccagtagcgcatgacgctggcgttgttatcgagctggtggacgaagcgcaaatcttcgcgctcaagcgggcggagtttgacgtgtag

SEQ ID NO: 6792 - DNA, 1608 bp, Klebsiella pneumoniae
gatggaattatgagtattttacaaagtttggttgccgccagtcagttggatgaaagcgtactgcgccagcaggcccggtcacgtcaggcgcagtggcagtcctggcttgcgccaatcagtgacgcccaaccaaccggggacgatccgggctatgacgatgattttcagcgtatccgcgatgaggtcaataagatctccggtgtcgataccgaactgatttgccagttggctggacagttactggcaacaacaaaagatatccggattgttacctattactgctgggcccgtttgcaccaggacggggaagctggcttggccgatgggctggaggtgctggcaggcttgctgcaacgatatggtatgcagctttatccgcagcgcgaccgtagccgcaaagcagccctcgagtggctggcgggtactcgtatcttagacagtctttcactttttccagaagttgtgcgggaggacgcaaggcgtaccgtcggcgcgctgcttctcattgatgattgtctgacgacagaaccagaaacatcacggccagatctgcaagcactctggggtgctctggagtctcgtttgataaagggcgggggagtcgatgcggtggtgccgcagaacgtcggaaaccgggggctggctcaaaccgcttcacgcatggctgaatacgaagcgccggttctcagtaacatcacctccggtcaggatctgctggcccaggcgcgaaccctgacagcatatctgcgtgttcaacccgatggctggcttgccgcacatcggctaatgaaaagccttcgtcatgacaccttgacaatcatccctgcgcctgatgctgaaggaaaaacacgtatcgagcctcccagagcagatcagcgtgccatgctcaagcggctgtacctgcaacagagctggtcggagatactggaacaggcggacagtaccttctcacgtggcgctaaccacctctggcttgacctgcaatggtatatccatcaggcgctggtgaggtcgggtcaggatgtgctggccgatattataattgccgatctgaaaggattgctgcgccgtctcaccgggcttgaaacattagcttttaacgacggcacaccctttgccgatgaggtcacgctgaactggataaatcagagtgtcctcgacgatatgtccgtctggcaggatgagccagtatcggctgccagcggcgctgataacgacattctggcccttgaacctgaagcgctcgagaaggctgacactgacggtctcgatgctgcactccactggattcagacgcgcccgggcactgaatccactaaagaaaaatggctgttgcgcctgctgatggcccgcgtggccgaacaaaaggggaagaatgacctcgcgctctatcttctgcgagaactcgacgatgcggcgggatcaatcaccctcacgcagtggatcccagccctgttgttcgagattaaatcgcgacggctcaggctactgcgcatgaaagccacgcgcagcgagagtgaaaagttacgattgcagccggagatggatcaattgctggcaggtctgattgcgctcgatccagccagtagcgcggtgctttgcggctaa

SEQ ID NO: 6793 - DNA, 930 bp, Klebsiella pneumoniae
gcaacggttatcactaaaagcatggcatttcagattaaatttcatcaaattcgcgccttcgtcgaagtagcccgggaaggcagtatccgtggcgccagccgggcgctggcggtctcgcagccggcgctgaccaaagcgattaaagagctggaggaggggctttccgcccagctgttcgtccgccgcagccagggggtggcgttaaccgacaatggcgaaagtttttatcaacatgcgagcctgatccttgaggagctgcgggcggcgcaggatgaactgctgcagcgccagggggaacaggccgggcaaattaatattggccttggcgccagcgtcgcccggtcgctgatgccgtcggtgatctgccgctttcatcagcagcatccgcaggtgaaggtacggatcatggagggtcagctgctggcgatgattaatgagctgcgccagggggagctggatttcaccattaatacctattaccccgggccgtacgaccatgagttcagctttgagaaactgtttgagaaaccgttcgcggtgttcgcccgcgcgggccatccggcggcgcaggccacctcgctgggggagttgatggatcaccactggaccatgccgacgccgcgcggcagctacttcaagcagctgcaggaatgcttcgaacagctgggacgggagccaaaggtggggatcgtctgcgaaacgttctcatcctgcatcagcctggtggtgaaaagtgattttctcagcatcctgccggtggagctgggcaacgacccgctgatggccgacaaactggtgatgatccccatccgtgaagtgttacccaccgccacctattatctgatccagcggcgcgatacccggcagacgccgctcacggcgtcgttaatcaccctgttccgccgccagagccgacaattgtttccttaa

SEQ ID NO: 6794 - DNA, 354 bp, Klebsiella pneumoniae
ccagaacctatattgattctcctctcggataaaactactttgtgcgcaaccagtattgaccaggaggctaccatgctccagcacaaaatcagggaggcgttctgcgcctttatctctcgcaacccgaaagggtatcagtacctacgcaccagtgactttgtcaactctctgcgccggcgcggcatccacttatcagaggtggaagctaactcctggacagcgcgggaacaaacgtatttcgtcgataagacgcctgaccattgcgaaaacaggctgtggatgatggcagggatggggaggggctctgatggtgctagtcagggttgttggagactccaatccatagttttatga

SEQ ID NO: 6795 - DNA, 990 bp, Klebsiella pneumoniae
ttctttcatatacccgccatcgcgcccttgcctgaggcgacacaaatgcaacaatgcggaaacattgttattacaggagaagggcgaatgatgaccacggcagagggggggctggcatatcagcgctggctggcgacgatcaatcaggtctgcggccatttcgccgcccgaccgctgaaggagagtttccacggcgagattgacgcccgctacgccggcagcctcaaggtcagtaccgtcaccgccgccggcgtcaatctctaccgcacgcgcaatgagataaaacgcgataacgacgcctggttctataccgtgtttcagctcgccggcgaagccatcatcgaacaggacgatcgccaggtgacgctggcggcaggcgatatcacgttaatcgacgccgcccgcccatgctccatcgtctggcagcagacctcgcgtcaggcctcgctgctgctgccgcgccagcgggtggcgcccacaggggacatcactaccgcctgccggctggacaaatctctgccaatggtccagctcagccagcgactgctgctggaaagcatgggcggcacgacgctctccgccagcgagagcgaagccgcgctggaggcgatcgcctgcctgttgcgcccggtgctgcatcagcgcgatcctgccccttcccggcgggaaaagcagtttcagaagattattgcgttaatcgatgcgtccattcagtcggagcatctgcgtccggagtggctggccagcgagacgggcatgtcggtacgcagcctgtaccggctgtttgccgaccaggggctggtggtggcgcagtatattaagaaccggcggttggatctgtgtgcccaggcgttacagaacgtccatgacgatgaaaagctggcggggatcggctaccgctggggcttcagcgaccacagccatttctccaccgcctttaagcagcgctttggcgtcaccccgggggaataccgcaagcgctgtcgctaa

SEQ ID NO: 6796 - DNA, 999 bp, Klebsiella pneumoniae
ggagaacatatggcagcaaaaggtttttatctggtacagggagacagaacgacctgcggcggaagaatcactacaggcgcagaagatcacactctgtttgataaacctgttgcccgggagcaggacagcgtcacttgcggaaagcacgcagggctatacaagattgccggtggcatcgacaacgataccattcatggccggcgaatggccggaaccctcgacagctgtagtacttgcccctgtaaggcgaagtttattccatcaatgatgaatgatacttatgagaaaggaggtgaatgcataactactttattttcactcgatgggcttatggcatctttacaggaaccctataagaatcttcatccagaaaataagactgaacgacagtgtactcacacagatggggcgattaaagttgcagaatatatactaagtgaaataaaggcgaatgtcagaagcgatacggcagaaacaatacgatatttaatcgacgaagattttataataaaaagacttactgaatggaataaacttcccttttatgcaaggctggggccgccccctaaaacagatttacttgctgcaatggctatttggtatcagaccgtgaaaacaggttcaatctgggatcataaaccgaagatccgcgattttttttcatccgttgcagtagcacgaccacttcccaggaaaggaaaatcatcaaagtcttattatcataagtttaaacagcatgattatttttatgatgtttggtcaaacatacattatggttatgttggacgtagtgtcggtttttctgaagcaattctcttgaaagggtccacttgggaacaaaacatgacgccaggtgccatgggggatgataccatggatgacattactagggaaggtgcgaataagcaggtcatttcttcccaagctgactcgctgattaaaatttcgcggatctgggccgatttttttcccgcaaacacatcgaatcagcctatttag

SEQ ID NO: 6797 - DNA, 843 bp, Klebsiella pneumoniae
tcgttcaatatcgccaaccctccaggaaaataccttatgaacaagtcagttgcgcgcgggatcgctctcgccctgttgtcggccacctctttttatgccgccgccgacgctcatcttatccgcgtcggctttaaccccgggccgtataaagaacaatttgagaaaggcgtcgcgccctatttattgagtaaagggtataaaatcgaatataaggatttcagcgacggtattcaggtgaatgacgcggtagcccgcggcgatatcgaagcgaatattatgcagcatccggtatatctgaaagcaattaatgagcggctggggatcgataacgtgggcattgtgcaggtccccacgccgccgatggggctgtatggtgggaaactgaccaccctggggaccccggcggcgggcaccgtcgtgtcggtaccaaaccaggcgtcaaatgaatatcgcgcggtactggtgctggagagccttggctgggtgaaaattaaaccagacagcgatccggccactttttcgcagcgtaacatcgtagataatccttacaaaattgtcctaaaagagatggataatgcccagcaggttcgcgctctgccggacgtcgactatggcctgattcagggcaattttgccgtctccagcggtatgtccctgacctcggccttaaagctggaagcagccaccagccattttattaatgtcgtgaccgtcgccggtaaaaatcagaaggcgcagtttgccaaagatattatcgatggctaccactcggccgagttcaaaaaatatattctcagccatccgcagtatgatggttacctgctgcctgactatttaaaatga

SEQ ID NO: 6798 - DNA, 1653 bp, Klebsiella pneumoniae
cttattgatattgctgtttttcgtaggccgggtaaggcgaaagccgccgcccggcagaaaggcgctcaccctaacgaaatcaggtttgtcatcgaccagcgccgccccgaagggcggcgtgggttacttcacgcagcgggcgcactgcgaggtctggatctgctggaagaagtcattgcctttatcatcaacgaggataaaggccgggaaatcctccacttcaattttccagatagcctccatacccagctccggataggccacgcactcgaggctcttgatgctctgctgggccagcactgccgccgggccgccgatgctgccgaggtagaagccgccgtgtttgtggcaggcgtcggtgacctgctggctgcggttgcctttcgccagcatgatcttgctcgccccatgggactgcagcagatcaacgtaagagtccatgcggcctgcggtggtcggccccagagagccggaggcgtaaccgtccggcgtcttggccggacctgcgtagtagatcgggtgatctttgacgtactgcggcagcgcctcgccgttgtcgataagctccttcagcttagcgtgggcgatatcgcgggcaacgatgatagtcccgctcagcgacaggcgggtggacaccggatactgcgacagctgcgccaggatctcgctcatcggctggttaagatttaccttcaccgcttcgccttccccggcctggcgcagatgctcagggatatatttccccgggttgctctccagcttctcgatccagatgccgtcgcggttaatcttggctttgatgttgcggtcggcggaacaggaaacccccatccctaccgggcaggaagcgccgtgacgcggcagacggatcacgcggatatcgtgggcaaagtatttcccgccgaactgcgcgccgagaccaaggttctgcgcctccagcagcagctcctgctccagctgcacgtcgcggaacgcctggccgtgctcgttaccttcggtcggcaggccatcgtagtatttggtggacgccagcttcacggtcttcagcgtcgcttccgccgaggtaccgccgatcacgaaggcgatatggtacggtggacaggcggcagtaccgagggtgcgcatcttctcgacgaggtaatttttcagcttcgccggggtgatcagcgctttggtttcctggtacaggtaggttttgttcgccgagccgccgcccttggcgatgcagaggaatttgtactcatcgccatcggtagcatagagatcgatctgcgccggcaggttggtgccagtgttaacctctttatacatatccagcggcgcgttctgcgagtagcgcaggttgtcctggatataggtgttgtacaccccctgcgccagggcggcttcatcgccgccgccggtccacacgcgctggccttttttacccatgatgatcgcggtgccggtgtcctggcaggtgggcagaatacctttggcggcgatatccgagttgcgcaggaactgcagcgcgacgtatttatcgttttcgctggcttccggatcgttaaggatatccgccacctgctgctgatgcgcagggcgaagcataaaggaggcgtcgtggaaagcatgctgcgccagaagggtcagcgcctgagggtcaacttttag

SEQ ID NO: 6799 - DNA, 204 bp, Klebsiella pneumoniae
ttttattgtattttttgttgtttccttgtcattgtttatgttaacaaaagtatcctaattgttatcacgcatttgtattatgtaaatgctatttattattttaataatacaatagaggtagcgatgttattgctggggttaaatagttttataactaacgtaattggtttagtaattaaaaaacgcgctatattattggcatga

SEQ ID NO: 6800 - DNA, 1509 bp, Klebsiella pneumoniae
ggaaagggtatgtccacctcacagatagcgctgcttgccagcgtccagcagtttttagaccgtcagcatggcctgtatatcgacggcgccccctgcgccgcgcagagcgaaaaccggttaaccgtctgggatccggccaccgggcaggcgattgccaccaccgccgacgccagcccggcggatgtcgaccgggcggtgatgtccgcctggcgcgcttttgtcgatcgccgctgggccgggcgcaccccggctgaccgtgaacgcatcctgctgcgttttgccgatctggtggagcagcacggcgaagagctggcgcaactggaaaccctcgagcaggggaaatccattgccatctcccgcgcctttgaggtcggctgcaccctgaactggatgcgctacaccgcggggctgaccaccaagatcagcggccggacgctggacgtttcgatcccgttcccgcaaggggcgcgttaccaggcgtggaccaaaaaagagccggtcggggtggtggcgggcatcgtcccgtggaatttcccgctgatgatcggcatgtggaaggtcatgccggccctggcggcgggctgttcgatcgtcatcaaaccctcggaaaccaccccgctgaccctgctgcgggtggcggagctggcgacccaggcgggcattcctgacggggtgttcaacgtggtcaccggcagcggcgccggctgcggcgcggcgctgaccgcccatccgcaggtggcgaaggttagctttaccggctcgacggcgaccgggaaacagattgcccgcgtggctgccgaccgcctgacccgcgtgacgctggagctgggtggcaagaatccggcgattgtgctcaaagacgccgacccccagtgggttattgaggggctgatgaccggaagcttcctcaatcaggggcaggtctgcgccgccagctcgcggatctacatcgaagcgccgctgtttgacaccctggtcagcggcttcgagcaggcggtgaaatcgctgcaggtggggccggggatgcaggagacggcgcagatcaacccggtggtctcccgggcccactgcgacaaggtggcggcctacctcgaagaggctcgccagcagaaggcagagcttatcagcggcagcgccggaccagatgcgggagggtactatattccgccaacgctggtggtaaaccccgacgccggactgcgtctcagccgtgaggaggtttttggcccggtggtgaacctggtgcgagtggccgatggcgaggaggcgctgcgcctggccaacgacagcgattttggtctgaccgccagcgtctggacccgcgatctgacccaggccctgaactacaccgaccgtctgcaggcgggaacggtatgggtcaacagccataccctgattgacgccaacctgcctttcggcggcatgaagcagtctggtaccggccgcgatttcggccctgactggctcgacggctggtgcgaaaccaaatccgtctgcgtgcgctactag

SEQ ID NO: 6801 - DNA, 663 bp, Klebsiella pneumoniae
acggccttcatcatctgcgtcgacatcgctttctcctcatatggaaatgcgttatatttaacggagcaccgttccgaatatatggagcggtgctccgattgtcaaggaacgccaatgagagctgatgccagaaaaaattatgacctgttgatcgaggtggcccgtgacgtctttgtggagcaaggcgctgaggcctcgctgcgcgatatcgcccgccgggcgggcgtcggaatgggaaccctctatcgccactttcccaaccgcgacagcctgctggaagccctgctccgcagccgctttgcggcgctaaccgcccgggctgagtcgcttctgctcgccgccgatcctgccgcggcgctgctggagtggctggccgagagcgtggcgtttacccatcagcatcgcgggatcatcgccccgctgatgagcgccatcgacgatcctgagtccgccctgcacagcgcctgtgttgccctgcgcgccgccggtacgtcgctgcttacccgcgcgcagcaggccgggctggcacggccagatctcagcggagaggagctgttcgatctgatcgccgcgcttgcctggctgcgggagcaaccgtcccatgccccgcgcgcagagcggattttagcggtgctggccgacgcgatcctgactgccggctag

SEQ ID NO: 6802 - DNA, 1734 bp, Klebsiella pneumoniae
ttgatgctcatagcctcgcgtcgcacactaatctccaccaggacaaacaaaacgatttgtcgaatcaggaggttattaatgaatgccgaacaaacgacggggcgggtctggaaccgtcgccgaacggaaaaacagcggcggctggccgaggcgaacatgccaggtaaggtcatcccgactgaccagttggtcagcgtactggaaaacctgctcgcccccggcgaccgggttgtgctggaaggcaacaaccagaaacaggccgatttcctctcgcgcatgctggcggaagttaatccgcaaaaaatccacgacctgcatatgattatgcccagcgtcgggcgcagcgagcatctggacctgtttgaaaaaggtattgcccgcaagctggatttctctttctccggcacccagagcctgcgtatctcgcagctgctggaagatggcctgctcgaaatcggcgccatccacacctatatcgaactctactcgcgcctgtacgtcgatctgtcgccaaacgtcgcgctgattgccggctataaagctgaccgcaaaggcaacctgtataccggaccgagtaccgaagataccccggcgctggtggaagccgccgccttccacgacggcattgtgatagcccaggtcaacgaactggtggacgacgaatgcgatctgccgcgcgtcgatattcccggctcgtggatcgattacgtggtggttgccgacaagccgttctttatcgaaccgctcttcacccgcgatccgcgcctgattaagcaagaacacatactgatggcgatgatggcgatcaagggcatctatgcggaacatcaggtgcagtcgcttaaccacggtatcggctttaataccgccgccatcgagttgctgttgccgacctatggcgagcagctcggcctgaaaggcaaaatctgtaaacactggaccctgaatccgcatccaaccttaatcccggccatcgagagcggctgggtggagagcgtgcactgcttcggcggcgaactggggatggaagagtacatccgcgcccgcccggatatcttctttaccggcccggatggctcgatgcgctctaaccgcgccttctgccagctggcgggccagtacgcggtagatatgttcattggttcaaccctgcaggtggatggtctggctaactcctcgaccgtcacccgcggccgtctttccggcttcggcggcgcgccgaacatgggccacgacccgcacggtcgccgccacgccaccccggcatggctcaatatgatcaccgagccggacccgatgcagcgcgggaaaaagctggtggtgcagatggtcgaaaccttccaggccggcgtgaaaccaaccttcgttgagacgctggatgcagttgaggtggcgaaaacctccggcatgccgctggcgccggtaatgatttatggtgatgacgtcacccacgtcctgaccgaagagggtatcgcctacctgtaccgtgcggagagccttgaagagcgccgggcgatggtcgccgcggtggccgggatcaccgatatcggccttggtgtggacgccaaacgcgtcgccgcgctgcgtcagagcggcaaagtggtctacccggaagatctcgggattcgccgcagcgatgccacccgctccctgctggccgccggcagcgtcgccgacctggtggagtggtccgacggactgtacaacccaccggcaaaattccggagctggtaa

SEQ ID NO: 6803 - DNA, 1248 bp, Klebsiella pneumoniae
ggaaaaatcatgaaactgcatgaaatgaagcaaaaacgtaacatcatcgccaaagatatgcgtgccctgcatgacaaaattggtgatacaccctggaccgatgagcagcgtactcagtggaacgctgcaaaatcggagcttgacgcccttgatgagcgtattgcacgcgaagaggaactgcgccgccaggatcaggactatatccacgaaaacgagccggaacagcgccagcagcagaatcgtgatccagcaaacccggaagcacaggctaacgaacgccgtgctgcggcgtttaatgcgtttttgcgccgtggtcttggcgagatgagcgctgaagaacgccaggctttaaaggagctgcgtgcacagggcacgacgccggatgaaaaagggggttacaccgtaccaacccagttccgcaataagatcgtcgaagcactgaaagattacggtggaattgccagtgtggcgcaaattctgaataccgccaacggccaggacattgactgggcaacctctgacggtaccactgaagaaggtgaactgctgggcgaaaacactgaaaccagtgaagaagacgtgtctttcggcggtgcaacgctgggggctaaaaaactgtcctctaaaatcattcgcgtatccaatgaactgctccaggacagcggcgtagatatcgaggcgttcctggccgcgcgtatcgccactcgcatcggacgtggtgaagcgaagtatctggtattagggaccggcaccggcaccccgctgcagcctaaagggctggctgcgtcggtaactggcaccaaaaataccgcagcagcgaccacctttacctggaaagagctgaacgccctgaagcactctgtcgacccggcataccgtaacggtccaaaggtgcgctgggcctttaacgatgcaacgttgcagctggtggaggaaatggaggatggacagggccgcccgctctggttaccgaacattatcggtggcgcacctgctactgttctgcaggtgccgtatgtcgttgaccaggctattcctgatatcgcggctggtgccaaatttgcctacttcggcgattttaaccgctttatcgttcgtcgcgtcacttacatgacgctgaaacggctggttgagcgttacgcagagtacgatcagactggcttcctggccttccaccgcttcgactgcgtactggaagataccggcgcgattaaggcgctggtgggtaaaccggcatctggcggctaa

SEQ ID NO: 6804 - DNA, 1026 bp, Klebsiella pneumoniae; identical to SEQ ID NO: 2203

SEQ ID NO: 6805 - DNA, 732 bp, Klebsiella pneumoniae
gagatacccatggctgaacaacagccccgcccgattctgatcacaggagcaggccgccgcatcggcctcgctctggcacaccattttctgcagcagcgccagccggtcatcgtcagctatcgtacgccctatccggcgattgacggcctgcgcgaagcgggcgcgctctgcctgcaggccgattttagcagcgatgacggcattctgaccttcgctgaagcggtcaaatcacacaccgacggtctgcgcgccatcatccataacgccagcgactggatggcggaaaagccgggcgtcccgctgagcaccgtcatcaaccgcatgatgcagatccacgtccacgccccctatctgctcaaccatgcgctggaggcgttgctgcgcggccacggccatgccgccagcgacattatccatatcaccgattacgtggtggagcgcgggagcgacaaacatatcgcctacgccgccagcaaagccgccctggataacatgacccgctccttcgctcgcaagctggcgccagaggttaaggtcaacgccatcgcgccgtcgctaatcatgtttaatgagggtgacgacgaggcctatcgtcagcaggcgctggataaatcgctgatgaaaatcgcccctggcgaaaaagagattagcgatctcatcgattacctgtttaccagccgctacgttaccggccgctcattcgctgtcgacggcggccgcccgctgcgctag

SEQ ID NO: 6806 - DNA, 678 bp, Klebsiella pneumoniae
aaatcacccatgtttgatcttattgataccgccatcaccggcgatcagttcctgctggcgctgcgtgacaccctgattatggtcgccgtctcgctgggctttggcgcgctgatcggcgtcccgctggggattgtgctggtggtttgccgtcccggcggcatcgtggccaacccggtggtgcatcaggcgctgaatccgctgattaacgtgctgcgctcgctgccgtttatcattttgctgattgtgatcctgccctttacccgactgctggtgggcaccactatcggcaccgcgggggccatcgtgccgctgatcgtttttgtcgccccctacattgcccggctggtggagagctcactgctggaggtggatgaggggatcctcgaagccgcggatgctatgggcgcgacccccctgcagacggtctggcattttatgctgccggaggcggcagcgtcgctgattctggcccttaccacggcgaccatcggcctgcttggtgcgaccgccatggcaggaacggtgggcggcgggggaatcggggatctggctattacctatggctatcagcgcttcgacgctttcgccaccctcactaccgccctggtgctgattgtgattgtccagcttatccagacgctgggcacccgactggctcgccgactgcgccgtgaataa

SEQ ID NO: 6807 - DNA, 1440 bp, Klebsiella pneumoniae
ggaaacaccatgactgaacatcaacatcaggcgtcacctgccgccggaggtgaaggcgcgtcacagcttaagcgcgggctcagcgcccgccatatccagatgattgccctcgggggcgccatcggcaccgggctgtttatgggggcggggcgcaacatcgccgtcgccggcacctcgatcctggttatctatgtgctggtcgggttctttacctatatggtgatgcgggcgatgggagagctgctgctcacccgccatgactaccgctcgtttgccgactttgtcggcgagtatctcgggccgcaggccagcttttacctcggctggacctactggctaagctgggtggtgacctgtatcgccgacgtggtggtctgcgggagctatatgcagtactggttcccggaactgtcggcgtggatgccggccctcagcatgctggcgatcctgttcctgcttaacctgctgtcggtgaaaatgtttggcgaggcggagttctggttcgccctgatcaaggtgatcaccattatcgccctgatcggcaccggcggctggatgattgccaccggctggacctccccggacggcgtgacggcctccctcagccatctcaccgacccgacggcctttatgccccacggcatcaccggctttttcgccggcttccagatagcgatcttctcctttaccggcattgagctgctgggcaccatgacggcggagacccgcgatccgcagcgcattttgcccaaggcgatcaatgctctgccgctgcggattattatcttctatctgctgtcgatggtggtgatcatcgctgtcgcctcgtggccgggggtgtcggcggagaccagccccttcgtgacgctgttcgccaaggccgggctgcctgcagccgcggcggtgattaactttgtggcgctgacctcggcgatgtcctcggccaacagcggggtcttctccagcacccgcatgctgtacggcctgtcggtggagaagcatgcgcactggcagtttcgtatcctgtcgcgcagtacccgcattccggtgcgcagcctgttgttctcctgcttctgcatgctgatcggcacgctgttgctgtttctggtgccgaacgtgatgaccctgttcaccatcgtctcgaccctggcggcgattatggtggtgttcagctgggggatgatcctcgtggcctatctggtttaccgccgtcagcgtccggacctgcacgccgggtcgatctttaagatgcccgccggggtggtgatgagctgggtgagcctgctgttcttcgcgttcgctatcttcatcatgatctttgacccggacacgctgctggcgctgttggcttctccgctgtggtttatcgcgctgtggggcttctggaagctgaagcagcggcgcgaggggcagcttcagctggacaaccagagcgcctga

SEQ ID NO: 6808 - DNA, 792 bp, Klebsiella pneumoniae
gataaaaccatgccaaaattcgctgcaaatttatccatgctgtttaccgaactgccgttcctggaacgctttgccgccgctgcccgggcgggatttgaagccgttgagtttctgtttccctatgagtatgccgccggggaaatcagacagcacctgcaggagaaccagctgcagctggtgctgttcaataccccacccggcgacgtcaacgccggagaatgggggctcgccgccattcccgggagaagcgcggaggcccgacgcgatattgagctggcgctggagtatgcctgccagctcggttgcccgcaggtgcatatcatggccggcgtggtgccgccgggagcggatcgcgcagactgcgaggccgtgcttatcgataatctgcgctacgccgcggagtgctttgcccgccacgacaagcggatactcatcgaagcgctgaatccgcagaccaaaccgggctatctctaccacagtcaatatcagacgctggcgatggtgaaacgggtcgacaggccgaacctggcggtgcagttagatctgtttcacgcgcagaaggtggacggcaatttaagccatcttattaccgaatatgccggccagtatcgccatattcagattgcctccctgcccgaccgtcatgaaccggatgagggcgaaataaactatccgtggctctatgcgctactggataaaaccggttatgacggctggatcggctgcgaatatatcccccggacagacacgctttccgggctggggtggttctcgccctaccggaaaaaataa

SEQ ID NO: 6809 - DNA, 1287 bp, Klebsiella pneumoniae
ggtcaggccatactcatcttgcatgctgagcgcggatgttcttacgccgcgggagcgatcgtaacaactatgctaaccaccctgatttaccgcagccaggttcatcctgaccgcccgcccgtcgatctcgacgctttagtccatcgcgccagcagtaaaaatttgccccttggcatcaccggcattctgctgtttaacggcctgcagtttttccaggtcctggaagggactgaggaggcacttgagtcgctgttcagcgaaatccaaagcgacccgcgtcatcgcgacgtagtggagctgatgcgcgattactcagcctaccgacgttttcacggcaccggaatgcgcatactggatctccggctgtttgaaaccgatggcgcgctggaggaaattctgcgctttagcacgtttggggtcaccgaaccggtcaacgaccggatgttccggctgcttagcgccttcattgccgacggcggccgctattgcctgcccgagccgctgcagccctctcgctggatgatgatgcccgcgtcaggtacggccgcgccgcagcacctgcccggtcaaccttgccagtttgctctgcaggctattgtcgagccggctaaaaagcgagtttcttccttcgaggctctgatccgcagcccaaccggcggctctcccgtggaaatgtttgccgccattgcggcggaggatcgctaccgttttgatcttgaaagcaaagcatatgcattcgctctcgccggccagctgccgctcgggaaacatcagctggcgattaacctgttgcccggatcgctgtatcaccaccctgacgccgtaggctggctgatggacagcctgctggcggccggcctcagaccggatcaggtactgatcgaggtcaccgagacagaggtgatcacctgctttgaccagttccgcaaggtgctcaaagccctgcgcgtcgcgggcatgaagctggccatcgacgactttggcgcaggttattccggcctgtcgttactgacccgttttcagcctgataaaatcaaagtggatgcggaactggtacgcgatatccatattagcggcaccaaacaggcgattgtcgcctcggtcgttcgctgctgcgaggatcttggcattacggtggtggctgaaggtgtcgaaaccctggaggagtggtgctggctgcagtcggtgggcattcgcctgtttcagggctttctcttttcccgaccctgccttaacggcatcggcgagatctgctggccggtagcgcgccaggcaatggacctgtaa

SEQ ID NO: 6810 - DNA, 606 bp, Klebsiella pneumoniae
ggaggttgcatgccgatatatcagattgatggactgacgccggtggtgccggaggagagttacgttcacccgaccgcggtgttgattggcgacgtgatcctcggcaaaggggtctatgttgggcccaacgccagcctgcgcggcgacttcgggcgcatcgtggtcaaagacggcgccaatattcaggataactgcgtgatgcatggcttccccggccaggatacggtggtggaagaggagggccatatcggccacggcgctattctgcacggctgcgtgattggccgcaacgcgctggtgggcatgagcgcggtgattatcgacggggcggtcattggcgaaaacagcattgtcggcgcttcggcctttgtcaaagccaacgccgagatgcccgccaaccatctgattatcggcagcccggcaaaagcgattcgcaccctgagcgaacaggagctggcgtggaaaaaacaaggtacccgtgaataccaggcgctggtggaacgctgtaagcagacgctgcaccaggtggagccattacgggaagtcgaagcagggcgtaagcggctggcgtttgatgaaaacctacggccaaaagccgcaacctga

SEQ ID NO: 6811 - DNA, 2829 bp, Klebsiella pneumoniae
caacccctaattaactcttttcgctcaaaccctcgtttgggcgaacaccgttttggagcaaaaaacatggcctttgatccgccgattggctcttcagcccctgaagtattattgataaacgcaaagaactttgattttgctatgaatgacattacaacagcgttctggaaagacaggttcggtcaggaaagaaaaacctggtatgggattgaatcatctttagaagtaatgcgggcagcacaactggcggcttttatttcccagttcaatcaacaggcgcaggagtttgacgcgcagataagcagccaggcctcacgatacgaggccgtgctgcaggaggcagggagaacagttttagggcgttatgaggatggcccctggacgctgacgaattacaaccagcttatttcctatggcggaactttctggaaactggcggcgtcggttgttatcggagacgggtataccacagcaggaaatacacccgtaagctggaacgctactgaccgggttaactttgttgatgtcgggcaggatcagcttcgtagtgaactgggtgcaatatttatgcccgcgccatcgggaaatgctgtgacagataccctacttctccaggctgctctgcgcgttggtggacagattatttataaccgccccggtgagtatctgtacaacacctatagtgtgattaaatcgggaacttcgctgcataccgcagcagggataaactggaaacaggtcgccggcaaatccaacccgttcatcgttaacgaagcgttttcagcgtcgcgttatgctgtaaccagcatgaccaaaaacgaagcggcgattaacagttatcttgatggcgctgacctgaagagcaaaaactacattaacgtggtgtgcgagaaccacctgtttattaaaggagactgggcggctttccacggggcgaaggagttcgcttatgacggtattatgcgtgtcatttccatcattgatgcaaatacgtttattgcagaaagccattcaatgccgaccgcaacaactgccactccggatgatgtgttctggcatgggatgtactgctttaaggccgaccataatattgaggtcgatatacaggggaggattgacggcaactggcgcaataactctacggcgtcgacaaccgattttgatgagcgcgtgaagtttatggggatggcgttctggggggtgcagcacctgaccgttcgcattaatgatgcgttcaacatccgcaaatatacagttctgtttgcaaatatccgtaacgcctacattccgcgtattaatttctataacttctcggatggcatccatttccagccgccctatgttggggtaagcatcggcacactggccggggcgaccggtgatgatatgctggcgctcacgaacggcgactatgaaacctatcagttgagccgcggacacggctacagtctttacgctgatcacctgatgccgcagaacgcacttacggccatgaaggtggtgggggcgacaaactatcgttactgggatattggcatcggtgctatttccgggtcaacgcggcttcatgttatcgctgcaattcgcgatctggctctgacctggacagatatcggccgcttttatatcggctcatgtacctgcgcttcgcagacaaaagatgacttttatctcaatactgaccggatggatttgttcgccattgataattataccgtgtgttcgcccgaaagcgggacacacagcattacgatgggtaaccgctacggtgttacaaccaatatcggcacaattaagctgcgtaatgtgcagtacaaggaaggcgtgcaccttaaatcgttctacatcgggactaactgtaatatcgggttgctggatatcgagttcgcaaacgccaccccactgaacggcgcactggctggcgttttgaccgcaccggctatgacctatgacggcgacgccggtgagtccgcaggcgggtttatcgatacgatcaggctttcagggaagtatgttttcccacaggctaacatcggccgcctggcatggctgcgttataaatggaatcgtatcttcctggataatctgtacgtcgaaaacggtgagcgtgttatccatgaaaacgagattacaggtaatgacggaaaaattttctgcaataacgttcacgtcagaaacacgcatgacttctgcaacacgtataacaaggtgcaggcatatcactcgtccacgctgctggaaacaaccgatatgccatactggttgcgtgatgcgtctgccgagcttcgcatttatggcgcagttaagaccctgaatgacaccggcgtctgtcgtgtcgaggcaggaaaatattacgcaaaaggactggacgtgcccgttaacctgactgatttcccgccagccggtaatcacggcgacgtggtattcaataccaacgctgcgggtaatgcagtgggccgttatcagtacaacagcgcaaacagtacatgggagcttcagaaccgcgagaacatcagccagtcgccttctgacacctcagcgacgatttataaccctgactggaatcgtggatttaactgggtccagacgctgacaaaggatgtgcaatttacaggcggcgctgcaaatcttgcgaagctcaatcgcggggataaagttcgtctgtacctgacacaggacgctacgggcggtcgggcagtgtcgttcagcaccgcctacaaattcccggttgcatgggtgaacggcggaactaccggacagcatacgattggcgagtttgtctacgacggtcagttcctggtgctggagcgggctaacgtctggtactga

SEQ ID NO: 6812 - DNA, 801 bp, Klebsiella pneumoniae
aggacgctaatcgtggaagctttcattctcagcgcagtggaacagggcgtcatgaccattaccctcaatcgcccggaccgcctcaacagttttaacgatctgatgcatcaccagctggcggaatgtctgaagcaggccgagcgcgatgatggcgtgcgctgcctgctgatcaccggcgccggccgcggtttttgcgccggccaggatttgaacgaccgcaatgtcgaccccagcggcccgccgccggatctcggcatgtcggtagaacgcttttacaacccgttagtgcgccgtctggcggcgctgccgaaaccggtcatctgcgcggttaacggcgtggccgccggcgcgggcgctaccctggcgctgggctgcgatatcgtgctggccgcgcgttcggccaaatttgtgatggcgttcagcaagctcggcctggtgccggactgcggcggcagctggttcctgccgcgggtggccggccgtgcgcgcgcgatggggctggcgctgctgggcgacagccttagcgcggaacaggccgcgcagtgggggattatctggcaactggtggacgattcagaactggcggataccagtctgcaactggcgcgccatctggcggcgcaaccgacgtttggtcttgggctgattaaaaaggcgctgctggcctctgaaaccaacagtctcgatgcgcagctggacctggagcgcgattatcagcgtctggccgggcgcagcgatgattaccgcgaaggggtcagcgcgtttctggccaaacggccaccacagttcagcgggaaatag

SEQ ID NO: 6813 - DNA, 1236 bp, Klebsiella pneumoniae
gggggaataatgctgcttgatgctctttttcgcagtgaaccactggaaaacccggctacgccgatcacgagtgagtcggcagaaacagataacgtgtttgcccaggacgtatttgtcagcccgcaaacggcgatgaagctggctgcggtgtatgcctgtatttacgttatctcttcgaatatcgctcagatgccactgcatgttatgcggaaaaccaataacaaggttgaagctgcccgcgatcaccctgtgttttacctggttcacgatgagccgaatatgtggcagaccagctataagtggcgtgagctaaaacagcgtcatattttgggctgggggaatggttacacctgggtgaagcgttcccgtcgtggtgaagtttccgggctggaatgctgcatgccctgggaaacgacactgcttaacacgggtggtcggtatacctatggcgtttacaacgaagagggggcgtttgccgtcaatcccgacgatatggtgcatatccgggcgctgggtaacaaccagaaaatggggcttagcccaattatgcagcatgccgagacgataggaatggggatgagtgggcaggcttataccagttcattcttcaacggtaatgcgcgacccgctggcattatttcggtgaaaagccagctgaatgaagaaagctgggggcgtttaaaaagcatgtggcaaaaagctacagctgctttgcgcagccaggagaataaaacaatgcttctcccggcagagctggattacaaagcgctcaccgtttccccggttgatgcccagatcattgatatgtcgaagctgaatcggtcgatgattgccgggatatttaatgtaccggcgcacatgattaacgatctcgaaaaagccactttctcaaatattacgcagcaggccattcagtttgtccgctacacgatcatgccgtgggtaacgaactgggaacaggaactcaatcgccgtctgttcacccgtgctgaactggccgccggatattacgtcaggtttaacctgacaggcctgctacgcgggaccccgcaggaacgtgctcagttctaccactttgcgatcactgatggctggatgagccgcaatgaagcgcgagccttcgaagacatgaatccggtagatggcttggatgaaatgctggtgagcgttaacgccgcgaaccccgcagacgattttaaggcacctaaaaccgacgaggaaaagcccaatgaatga

SEQ ID NO: 6814 - DNA, 270 bp, Klebsiella pneumoniae
ctggcttcaatgtgcttcaggctatggtccagcatcgccacccagccggagatctcctggcctaaggtgagcggcgtggcgtcctgcagatgggtgcggccgatcttgacgatatccctgaaggccaccgctttttcattgagcgtcgcccgcagcgcctgcagcgacgggatcactttttcccgcagggcaatcagcgccgcgacgtgcatggcggtggggaatacatcatttgagctttggctcttattcacatcgtcattgggatga

SEQ ID NO: 6815 - DNA, 1650 bp, Klebsiella pneumoniae
aaaataacaataattcttatctcaggtgcctcaatgaacaggatgagcatcgttatcctctgggcgctggcgctgctggtgctccagccggcgctggccgccgaaccgcgacagcagccaaccgcgcacgagcaggcacgcacggtcacgattttccaccaacctgtcgtcatgttgcaggccacctttggccagaccacgcctgaagagcgcgttttgcgcacccgcagcgccctgcgcgccttcaccgaagatgatattcgccagccgctgcgggtcgtgccggttatccgctatggtcagccaggcagactgtttctgatgaacggcaaaccggtgctgctgctgagccaggcggatctcgacgagggcgatgatttaaccctcgaccaggcagcccagcgggtgctggcgcgtatggaagcccagcgcaccagcctccaggaacagttcaacaaccgctatctgttcatctccgccggtaaagccctggccggggcgctgctgctggcgctgttttactacggcgccttccgcgcctggcggcgggtgcgacgctttttcctgctgcggatcctcgaaaaacgtagcgccataccgcagcactggcggcgctatctcggcaatattgaagttcgactctatgctgtgctggtcatccttctcggcatgctggcctgttatctctggctgagctgggccttcagcctgtttccctggacgcgggtgtggagcgaatcgctgggcgactggtcgctgggggtgatccgcgacctctctctgtcgattgtcgcctccctgccggggctgatgatcgtggtgcttattttccttctcacctggcttatcattcgcctggtgaaggtggttctcgaccaggtcgccgccggccgcattcaggttcccggcattcatccggagaccgttagcgccacccgtcggcttatctcggtggtcatctggttgtttgccctctccgccgcctacccgttccttcccggcgccaactctctcgccttcaaaggcattagcgtgttcttcggcctgatgctcaccctcgggtcaaccggagtgatgacccatgcgatgagcggcctggtgctgatctactctcgggcgctgcgcaaaggcgactggatccgcctcgccgataatgagggtcaggtcagcgagattggcgtactggcgaccaaaattctcacccgcgaaaattacatcgttaccgtcccgaacgcggtggtggtgagcgggaaaattattaatatcagcgccgaaagcgccgacggtggagtcaacctcaccaccagcgtcaccatcggctacgatacgccgtggcgtcaggtccatgcgctgctggagctggcggcgagacgcaccccggggatcgatcagcaaattgcgccggtggtgcgtaagctgggattgctcgactggtatacctcgtatgagctgcaggtgcgcttactccccacaaccaagctgccggatggccgcaacgcattgcatagcagcattattgatgtgtttaacgaattcggcgtgcagattatgtcgccgaactttgtgatgcagccaaaggcggcggtagtggtgccgcaggaagcctggtacgccgccccggccgtcgcgccgcaggagccggagaaataa

SEQ ID NO: 6816 - DNA, 1035 bp, Klebsiella pneumoniae
ctatttaaaatgaataacgcgatgatagaatttcgccacgtcagtaaaagcttttccaggaaaggacatccggttctggccttgcagcatattaatctcagcattgagcgaggcgatatttttggcattattggctacagcggggcaggaaaaagcaccttattacggctgattaatcgtctggaaacacctggcgagggcgaggtactgttaaacggcgagccgctacaggactgcagcggccagcgcctgcaggccatcaaaaaagatatcggcatgatctttcagaattttaatctgctgaattcgaaaaccgtttttcataacatcgccatcccgcttattttacaggggcgcgacaaggcctttatccaggcgcgggtggcggaactgctggcgttcgtcgatctgagcgacaaaatccacagctaccctaatgagctgtcgggcggacaaaagcagcgggtcggtattgcccgggcgctggccaccaacccgtcggtccttctgtgcgatgaagccacctcggcgctcgacccccacactacggtgcagatcttactgcttttgcaggagattaatcgtcggtatggcatcaccatcgtactgatcacccatgagatgtcggtgatccagaaaatctgtcacaaggtggcggtgatgcaggcgggccgtatcgttgaacagggggcggtttttgatctctttgctcagccgcagcatccggtcactgccagtttcgtgcagtcggtggtgcacgaccgcctgccgcagcgggtggcgtcgttcctgcagcgcgataacggcgcccgggctttacgcctcgaatttgtcggtgcgacggcgcagcagccgattattaaccacctgatccgcgagtatgctgtcgaggtgaatatcctgtttgccagcatgtctgaagttcagggccggattctgggatttatgattgtgcagctcctcggcgagcctgacgaaaccgaacgcgccatcacccatctggtcgatgcaggagtgaaaatcacccatgtttga

SEQ ID NO: 6817 - DNA, 2073 bp, Klebsiella pneumoniae
ccctttgaaattgctgattgtaaaaatctctgctctttcgctcaaaccctcgtttgggcgaagcctctttttggagcaaaaaacatggcctttaacccggagctggggagcacgtctcccgctgtgttgctcgataacgccgagcgcctggataagctggtcaatgggcccgccgcagatgttcccgaccgtggcggtgatcctctttattcatggcgccagattatggcggtgaatcaggcaaaacaggatcagctcgacgacatcattacttccctcgacaccgccagttttactttttccgacactactgccggactggcaggaaccaccgacgggcaatatttcagagtcccccagggtgaaggcgatgctgttggatttatttattataaaaacagtgccggagctgcagttgtggtggcctcacttgcttcagccgagatcacaaagttgctcgggaaagatgacagccagaaactggccgcctttactgatgatgacggcgccagcgcgttggcactggatgagaggggcgggatatttactgctgactcgccagaagacatccgtaaaacgattgggaaaaccggttatgaccgggctcctgccattctgaaaattacgtccgcagacaaggccgtacatggctttatggatgaattcggcggcgttcagttacccggcctgcaggggagcgttcaggagaatatcaaaaggctgaataagcgactttctgagcatctggaacggcgacgtgttcttgatgccagagagtgtgggcttgacccgttttcttccgaggacatgtggtatcccctgcagcgggcgacaaactggctgggggctaatggtggcggaacaatctatatccctgaaggggcttatcgaatttcccgccctgtcactccggtggctggagtgggttatatcggcgccgggaaaaagaaagctcgcctgctgccattcaaagcgaccgcaccgtttctgtatcggggtaatgaaacctatatcgataatctgctttttaccggctttaccattgacggggaaaatcagacgcttaatccggcatccggctatctgccagaaattaaggcgatatttatccagtactggtccaacagcatcattgacgatatggaaatcgttaatatcggggccacaggactcggtgttgatatgcattacaactgcttaatcacacgttgcattgtggaaaactgcggtcggctggccgaacaaggtgcactgggggcctctggtatcgggatcggaaccggattcctgaacagtgagccgctctatgtgtcgcaaaacctgtgcaggaacaataaaaactacgggattttttacgagccacaaagaggggtgggaaccgcacaggacatcatcactacggataatgtctgccttgggaattacgcggggattgctgactgtggtgttgaggggctgattgtctcgaataaccagatgcgcgggaatacgcatggtttcctgatgtaccctggcacaaacaacgggggtaagcctggccgccgcggccgtctgcagggcaacattatcagagggaacaccgagaacggcgtgacatctgtttgctccaaaaccgatccgctgttaggcgaatacgccttatccggcaatcatatttatgaaaacggaaaagacggtatcaatatgaattacagctatccgacggttaaaaacttgaataacgtcatcagtaataatgaaatataccgtaatggccgtcatggggtttcgcttgaaagtggcgatgtcgtaaatcttgatatcgtttataaccgtatttatgacaatggtcagacgacagccggtcacgctgttaatattcaggtccccatgtcccgctcttctgtatcgaataacaagctgcgtgatacccagtccacaccgacgcagcaatacccggtgtttgcgacaggggctttaactgacgtagacatttcctttaaccactgcgtcggtaacgcacagaacacgctgagtctgacgggagctaagacccgtgtcaccacattcattaatccggggatagatttatga

SEQ ID NO: 6818 - DNA, 963 bp, Klebsiella pneumoniae
ccgcttgaaatcaggaggttttaccagcgccagaccccaccgcgcgctgatgtggtatacggtttggcctgtttagaattattgtttactttcaaaaacttaaatctcctgctactgtcaatagacatcatagcctccccagagagtgatatgcgtagagacgttctgttattactgtgttcattttatctgttacctctgggcgcacatgccgatgatagcggactgagcgccaaagatattaagacgttgtttttcggtcacgatgaccgcaaagcggtgaatcgccccgaggagagtccgtgggacgcgattggccagttggaaaccgccagcggcaatctgtgtacggcgacgctcatctctccgcatctggcgctgaccgcgggccactgtctgttaacgcccccgcgcggcaagccggacaaagcggtcgccctgcgctttatttcccgcaagggcaactgggtctatgagatccacggcattgacgggcgagtcgatcccagcttaggcagacgcctgaaagccgatggcgacggctggattgtcccttccgctgcggcgccgttcgattttggcctgatcgtgctgcgctatgctccgtctggcattacgccgatcccgctctttccgggcagcaaggccgatctcaccgccgcgctgaaggcggcggaccgtaaagttacccagtctggctatcctgaagatcatctcgataatctttacagccaccaggattgcatcgtgacagggtgggcgcaaaccagcgtactgtcgcatcagtgtgacaccctgcctggcgacagcggctcgccgctgctgctgaaaacggaggacggctggcaggtgatcgccgtgcagagttcggcccccggcccgcaggatcgctggcgggcggacaatcgcgccattgcggtgactggctttcgcgataagctggaggcgcttgccggtgagtaa

SEQ ID NO: 6819 - DNA, 1362 bp, Klebsiella pneumoniae
ggagccagaatgagtttgttgaccccgatgctgcgcagcagtccgctaaccgactggttcagcgacgcgcagcgggtgcagggcatgctggattttgaagcggcgctggcgcaagcgcaggccgcctgcgggatggtgccgccggaagcggtcgggccaattgtggcggcctgccgccacgaggccatcgattttgccgcgctgggcgaggcggcggtgggagccggtaatctggccatcccactggtgaaacagctgacggcgcaggtaaaagcgcaagatcccgaggctgcgcgctacgttcactggggcgctaccagccaggacgccatcgacaccggactggtgctccagctgcgcggggcgctggatgccgctgagactctgcttgagcagctgttggcggccctggctctccaggcggatcgttatcgcgataccgtgatgccgggacggacctggatgcagcacgcgctgccggtgacctttggcctgaagctggcgggcaccctcgacgcgctcctgcgctggcagcagcggctgcgcgaggtgcgtccgcggctgctggcgctgcagttcggcggcgccgcgggcactctggacgcgctaaaagagaaagggccggcggttggcctggcgctggcgcagatcctcggtctgtcgctgccggatactccgtggcacagccagcgcgatcggctgctggaggcgggcgcctggttcgccggcgtctgcggcacgctggggaaattcgctaacgacttttccctgctgatgcagaccgaagtggctgaggtgggcgagccggtggcggaaggccgcggcggttcgtcaacgatgccgcataagcgcaatccggtggcctgcgcggcgatcctgaccgccgcccagcgtacgccggggctgatggcgacgctctacgccagccaactccagcagcatgagcgggcgctgggcggctggcaggcggagtgggagaccctgccggagctaattaccctggtgggcggggcgttggcgcaaagcgaggcgctggtgcgcgacatgcaggttttcccgcagaaaatgcgcgccgatctcgatatcacccatgggctgattatggctgaggcggtgactctggcgctggcggaattcattggcaaagccgaggcgcatcatcatatcgaggcgctgtgccgccaggcgctggaccgtcactgcccgctggtcgatctgctcgcggctgacccacaggtcagtcagtatctctctcgtgaacgcttaaccacgctgctggacccggcaacggcgaccggcagcgccgaacgctttgtgcgccaggtgctggcgcgttatcaggagcaacgtgatgaatcttga

SEQ ID NO: 6820 - DNA, 810 bp, Klebsiella pneumoniae
ggagacagaatggcagaacaatttcctccgctgtcggcagcgacgctggcggcggctaaccaggtcggcgcctggctggcgcaggacgatctggcgacgctgcccgcgctgccgcaggtggacgtggtagtgctggccggcaacgccgtgatcccaaccatcgacgccgcctgccgtctggcggcggcgcaggcggtcccgctgctgatcagcggcggcgtgggacattctacgggctatctctacgaggcggtgcgccaggatccccgttaccgtacgttgccggtggatggccgcccggaagcgcatgttctggccgacattgctcatgactactggcacatcccccattcgcggctggtggtggaggaccagtcaaccaactgcggtgagaacgcccgttttacccggaccacgctggagagccgggggctcgcccatcgtcgcgggatcgtcattcaggacccgactatgcagcggcgaaccatggctaccttcgcccgcgtctggcagggggcgacgacgccgccacagtggttgagctttcccggctgctcgccggtgctggagcagaccgatggccaactggggttcgcgggcggcggagcggggctctggccggtcacccgctacctggggctgctgctgggcgagctgccgcgcctgcaggatacccctgaagggtacggtccgcggggaaaagacttcatcagccatgtcaccttcccgccggagatcctcgacgcctggcgacagctgcgggaggacgcccagcttgccggggcgctgcaggcccgcaccctcggctga

SEQ ID NO: 6821 - DNA, 459 bp, Klebsiella pneumoniae
attaacggaatgatgatgataaagccgacttcaaaaaagaccggggtgccgagaataaaagccacgatggttaaggcggcaatggttcgttttgcacccagtacgccggtcaacgttttcgccagcgattcggcgccgccggacatttcaatcagcacccccagcattgagcccagaataataatgctggcgatgtggccaagcaggccgcccatgcctttttcaatggtggttataattttatctgccggaatgccggtggcgaatgccaccagcagactgacgatcaggagcgccacaaaaggatgtgctttcgctttgatcactaacaggagcaacagcactacgctggctaacgcaataagtaacagcgccgatgtcgacataggttcgcctcgggtattaacaggtgtacagagagttatttttttagaaaacggcgtttattttttccggtag

SEQ ID NO: 6822 - DNA, 255 bp, Klebsiella pneumoniae
tggctcatgatgtccctctgggatgcgctccggatgaatatgatgatctcatatcaggaacttgttcgcaccttccctagcatgaaaatagggtttaatctattttatgaacatgggaaatttgctgagacgttgacggcagataatattctttgcgttttagaaacaacacctggcgcgcaccttcctcactcaagagaaaatcattggtgctggaatacagataatccagaaaaaagtgacgaatcattttga

SEQ ID NO: 6823 - DNA, 1014 bp, Klebsiella pneumoniae
tcaaacgttttcagtcaacaacaacaccagtatatggtttgcgcaaggcaaaggattatttttatgaagcttaaaaacaccctcctggcgtctgctctcctgacaaccgccacgttgtctgcccatgcagcgaccgagttgaccccggagcaggcggctgcgctgaagccctacgatcgcgttgtcgtcaccggccggtttaatgccattggcgatgcggtacaggcagtatcgcgcaaagccgacaaagacggcgcggcctcattctatgttgtcgacacgtcggactacggcaatggcggcaactggcgcgtcacggctgacctttataaagaagacgcgccgaaagcggatgccccgaagaatcgcattatcaacggcgtgatggagttgccgaaagatcaggccgttgagctgatgccttacgacaccgtcaccgttcagggcttctatcgcagccagccggaagtcaacgacgccatcaccaaagcggcgaaagcaaaaggcgcctatgcgttctttatcgtccgccaggttgacgccaaccagggcggcaaccagcgcattaccgcttatatctacaaaaaagatgctgaaaaacgcgtgctgcagagcccggacgcgatcccggctgactctgaagctggccgcgcagcgctggccaaaggcggcgaagcggcgaagaacgtggaaattccgggcgttgccaccaccgccgcggtgggttcgggtaccggcgtcgggcgtttctttgagactcagtcttcgaaaggtggacgttacactgtcactctgccgaacggcactaaggtcgaagaagtgaacaaagtgactgcggcgcaaatggtgccgttcgataacatccagttcaccggcaactacggcaacatgaccgagatctcctatcagacggcgaaacgcgcggcgaagaaaggggcgaagtactaccacatcacccgccagtggcaggaacgcggcggcaacatcaccatcagcgccgatttgtacaaataa

SEQ ID NO: 6824 - DNA, 510 bp, Klebsiella pneumoniae
gagttttcgattatgccaggaccaccgaaaaccccgacacatctggctttagtgaaggggaacccatccaagcgcccgatcaataagaacgagccaaaacccccgtcaggggtccccccaataccgaaacatttcgataaacagggtaagtactggttcaagcgtattggtgaggaacttgatgccgtcggcgtgttgaccacgctggatgctaaagcgctggagttgttgatcgaagcctatgttgaataccggcatcactgcgacacgcttgaacgtgaaggttacacctatgccgtctacagcgaagatgattcagatgaaggaggggagcgggaaatcagaatgataaaaccgcaccctgcagcagtcatgaaggctgacgcgtggaaacggatcagagcgatgctgagcgaattcggcatgacacctgccagccgatcaaaggttggtgcaaaagtcccggcagaagccgacccactggaagaatttcttaaaaagcgcaaatga

SEQ ID NO: 6825 - DNA, 243 bp, Klebsiella pneumoniae
agtattgccttagagtaccacatctgtgtcattcgtgccttgttcaaaaaatctgaacataggattcgatatattgcgctatctctgtggcgcgattgtgaatacagtgtcaacaagcaccagggcattgacccgtcaatcacattaaaaaaaggaaacacccatgagcaaagtattagttctgaaatccagtattctggcagggtactcacaatctggtcagctttccgactattttgttga

SEQ ID NO: 6826 - DNA, 1293 bp, Klebsiella pneumoniae
ggaacaacgatggctatcgagactcttgccgcccggaccggggcgacgccgttacgcatccgtcgggtgcagaagatcaccctgacgatgctgtttatcgccggtatcgtcaactttcttgaccgctcttcgctgagcgtcgccggggaggcgatacgcgccgacctgggccttagcgccaccgagttcggggtgctgctctccgccttttcgctctcttacggcttcgcgcaactgccctccggtattttgttggatcgcctggggccacggattgtgctgggcgccgggctgattttctggtccgcaatgcaggccctgaccgggatggtcaattcgttctcgcattttattctgctgcgcattggcctcgggatcggcgaagcgccgtttatgccagccggcgtgaaatcgatcaacgactggtatgcgcaaagagagcgcggcacggcggtgggaatattcaactcctcgacggtgctgggccaggctatcgccccgccggccctggtcatcatgcagttggcctggggttggcgaacgatgtttgtggtgattggtttagccgggatcgtggtcggcctgtgctggtatgtgggctaccgtaaccgtcggcagtttaccctgcaggaggaggagcagcagtatctggccagtgaggaggcggcccgcccggcgctgaagtttagcgaatggctggctctgtttaaacggcggactacctgggggatgatcctcggcttttccggtgtgaactacaccggctggctgtatatcgcctggttacccggctatttgcaggcgcagcaggggttaagcctggcccgtaccggctgggtggcggcgatcccgtttcttgccgcggcggtggggatgtgggtcaacggcctggtggtcgatgccctggcgcgcagaggctacgatcaggcgaaaacccgcaaaacggcgattgttatcggtctggtgctgtcggcgctgggcaccttgctggtggtgcaatcgtccacgccagcccaggcggtggcttttatctccatggcgctgttttgcgttcattttgccgggacgtccgcctgggggctggtgcaggtaatggtggcggagcataaagtggcttcggtggcggcgatccagaacttcggcagctttgtgtttgcctctttcgcgccgatcgtgaccggctgggtagtggatacgactcactctttcaatctggcgctggtgatcgccgccggggtgacctttgccggggcgctgtgctacttctttatcgtcaaaactcgcatcgattag

SEQ ID NO: 6827 - DNA, 1353 bp, Klebsiella pneumoniae
gttcggacgatgatgaaaacggaacgtccgttgtggggccggggcattatggtgtcgcctcagcattttcaacagcaggctgcgtatacagcctggactgcggaagtgattgcccggatgggtcttaaccacccctggggagtggttgaggcgaccttcgaaccagagatgctcaaactgggccgcctgcaggctcacaggctgcaggtccggttccaggatggcacgatgattgatacggacaatgccgatgcgctgccgtccgcgctgtcgctggacggcgcgtccggcgtggcggtgatcgtgctggcgctgcccctgatgcaggcgaatggcggcaactgtctgaagccggaggaggtggccgaaaggccggtgcgcttccgccagcgctggcgcgatgtccgcaaccagttcggggatgatacccggcagattgccgtcatacagccggagctgaccctccgcttcgcccaccaggacaacagcgattacctgacctgtccgcttgttcgcctgcagcgggactcgcagggggcctggcttatcgacgagacgtttctcccgccgctgctgcagatccagggcagccgctggctggcgacgcagcttgaacagctgctcgtccagctccgggctcgtctgacgcgcctgatggccatgcgtcgcgaaagcaatgaacggatggctgattttgccgtagccgatgtctctctgttctggttgctgaatgcgctgaacagcgccgaaccggtgctggggtactttctgcgttaccggcaaagcccgccggaacgcctctacccggagctggcgcgcctggctggtagcctgctgaccttttcgctcacccatcaggcgaatgccgtcccgatctatcagcatgaccagctgaacgcggtttttccgccgctgtttgatttactgagcgacctgctggaggcgagcctgccatcgcgggtggtggcgattgcgctggagcatgatgtccggctgcacttctggcaggcgcgtctgcacgatgcccggctgcgggaaggggctgattactacctgtcggttcgttcgtcggtaccggtcgcccaactgcaggagcagtttccgcgccagtgcaaagtgggcagtccggatcatgtcaaagccatcgtcaactcctcgcggacaggggtgcccctcacgccattgcgtcatgtgccggcggcgatcccgctgcgtctggaaaatcagtatttcagcctcgatgtgtcccaccctctggcaacggaaatgctgcagagcggcacctgtatgttttacgtcccggggatgctcggtgagcctgaacttgaactttttgcggtactacgaacgtga

SEQ ID NO: 6828 - DNA, 984 bp, Klebsiella pneumoniae
gtggacgcgattaaaggctcggagttgcagataccggacgcgatcttcgcgtgggtgctcgacgggcaggggggcgttaagccgctcgccgatgacgatattatcgacaaagacaagccttgctggctgcatctcaactatacccatagcgacagcgccgactggctggcggccaccccgttgctgcccaataacgtacgcgatgccctggcgggggagagcacccggccgcgggtgacgcggatcggtgacggggcgctgatcaccctgcgctgtatcaacggcagtaccgatgagcggcccgaccagctggtggcgatgcgcctgtatatggatgagcggctgatcgtctccactcgtcagcgcaaagtgctggcgctggacgatgtgctgggcgacctgaaggaaggtaatggcccgacggacggcggcagctggttggtggaggtctgcgatgcgttgaccgatcatgccagcgagtttatcgaacaactgcacgatcgcattatcgacctggaagacgacctgctcgatcagcaggtgccgccgcgcggatttctcgcgctgctgcgtaagcagctgattgtgatgcgccgctatatggcgccgcagcgcgacgtttatgcccggctggccagcgagcggctgccgtggatgagtgacgatcagcggcggcgaatgcaggatatcgccgagcggctggggcgcggtctggatgagatcgacagctgtatcgcgcggacggcgatcatgagcgacgagatcgcccagattatgcaggagtcgctggcgcggcggacctataccatgtcattgatggcgatggtgtttctacccagcacctttttaaccggcctgttcggcgtcaacctcggcgggatccctggcaacagctggcatctggggtttagccttttctgcttgatgttagtcgttgtcatcggtggtgttgcgtggtggttacatcgcagtaaatggctgtaa

SEQ ID NO: 6829 - DNA, 1269 bp, Klebsiella pneumoniae
gacctgcagatgctccccgctggtcagcgctatcccctccggcgcgctgaccagcagtaccgattttttgaggtctgtcagctgctgctccagcagggtaatttgcgcctggagatcggccgggttcgcggtcgccttctgcgcgtcaccggagatggacatcatctgctcccgggcttcggccagattgctgaccgccggctccatatccagcacctgcccccgggcctgcgcctgtccgtccgcgctgataaatatccctttctgtgcccggatagcgccccggctgtcggttctcagctcaaagccttcgccgcgcggccgcctgtcactgtccaccaggtgccccagattcagctggctcttaccgccgtactccgtcgagagcttgatatgctcttttccgcgctcgtcgtcgaggcggattttgttgttggccggggtgcgcaggacgttacgtttgtcattgcggatggtgacgtggtcgccgtgcgccgagtcgtgcagcacgcccgcgatatacggccggtcggggttaccatcctcaaagccaatcgccacctccgtccccgccagcagcggcaggtgcagaccgtaggtgtctccggcatacggccgcgactggcggacccacaggctctcgaacccggtttcccagcgcgcccggtcaaacagcatattcacccggtagcgcccgtgtttgtcgatatgcccgtaggtgtcgttttcccgggtgctggtcacgcgggccggcagcgtcccggccatcaccggacgcgcgccgggctcaggccggtagccgacgtccgggctgtccggtatgccggcaaactccaccgcaaagtcggcatcgcgccgggcgtggctgtgcatcgccgtgacgagcacgccatcagcaaactccccggccacctcctctccgccggtgaccttcagcacctgtcccgggcagagcgtcgggcagctggtggtggcctgcatccgggtctggccgttcagataacgctcatggcgaagccgggcgtaaaacgacccggactccggcgccggatggcggtcatggacattccccgcggtcaggtagttatctccccagtggtaagcctcaccaaaggtggtggtctccccgcgggtgacatccacctgcgcgttcatgtccgccgtcgcctcgcggtagttgtagtcgcgggtactgacctgctgctccacgacgcggtggcggcatgccatctcccacaccccgtccaccccggccgactgctgccctga

SEQ ID NO: 6830 - DNA, 252 bp, Klebsiella pneumoniae
cgggcagagatcgcattcaactggtcaacgatcagcgcatggcgctcgccaacgcccgccagcagcggcgcatcgagatgggccagcacggcgttagcgacggttgccgccagcgggttgccgccgaaggtagtgccatgggtgcctggctggaagacctgcgcccaggcctctttcgccagcatcgcgccgatcgggaagccgccccccagccctttggcgctggtgagaatgtccgggacgacgttgtaa

SEQ ID NO: 6831 - DNA, 285 bp, Klebsiella pneumoniae
gaagtatggatcaatccgcttgacgcggaaaaacgcgggattaaaaacggcgatatggtgcgcgtttttaatcagcgcggcgaagtccgtcttccggcgaaagtgacgccacgcatcatgccgggggtctcggcgatgggccagggcgcctggcacgacgccaatatgaccggagatcggatcgaccatggcgcctgcatgaataccctgaccacccaccgcccgtcgccgctggcgaaggggaatccacagcataccaacctggtcgatatcgagaaggtttaa

SEQ ID NO: 6832 - DNA, 189 bp, Klebsiella pneumoniae
cgatcggttttagcagacgcagaatatgatcgaacgcaatgtctatacataactctatatttccctgatttactaaagataattagctgttatttttccgaacaatggctggtatttcaccgcaataatggcatagttaagttattgaaaaagaactttctctgcaaaaggagtacgggccatgtataa

SEQ ID NO: 6833 - DNA, 933 bp, Klebsiella pneumoniae
atggaggttgttatgagcagttcgctaaccgcgtcaatgcaggctcgtcgtcacccggagaccacccacatcgatcgcctcgccaccgccgatatgctggcgatgctgcatcaggatgataagcagatatcggaggcggtcggcgcctgtctgccggatatcgcccggctgattgatatcgccaccgcgacgataagccggggagggcgcctggtcattattggcgccggcgcttcgggccggacggccattgaggcggtcagcgactattcgccggaaggtaaacacgcgctggtggggctgattgccggtgggcagacgacggcgatggccgagcgggagactgcagcgaataattatgacctgggcgcctttgagctgcagtcgctggacttcagcaaccgcgatatgctgctggcgctgaccgtcagcggcaagacgccatgggtgtggggggcgatgcgccacgcctggtcgctgggcgccccgatagcggtcatcacccagcagccgaccagcgaggcggcgcagctggcggatatcattattgctccgcagaccgggccggaggcggtggcggggttagccaatccgaaggctcagttggcccagaggcagatcgtcaatatgctgacgaccggactcgccatccgtgacggtcgggtgtacagcaatttgcgggtggacgtgcaggctgacaattcgcactgggcggagcggcagatagcgattgtgatggcggccaccgattgcacgcgcagtgaagcaaaggccgccctggccagctgtcatcagcactgccgcaccgcgatcctgatgctgctcagcgggcttgacgcctggcacgcgcgggagctgctaaccaaacatcacgatcatctgcgtctcgccctgcgtgaagcccagcgtagcgctgtcactcccgcccagtaa

SEQ ID NO: 6834 - DNA, 984 bp, Klebsiella pneumoniae
ccgcgctctgttgttaaaattagcggaggacaagaatacaggatgtatgccgtactcatgaagcagatgctctatttgaaaatgctggcgtggctggaggataatatctattgtaacccggcgatcgatgacctggcgcagtatatgggctattcgcgtcggtttgtgtacgacgtgttttaccagtatggccagttacccatcgggcagtatattcgtctgcggcggttgaccatcgcagcggtcagtctgcgcttaacacggcaaccgatcgccgctattgcctggcagttaagctatgactcgccgcagaccttttcccgggagtttaagaagcgcttttcgctctcgccacgtgaataccgttgcgcggcgcactgggacacggcaaagctgttgaaaaagtttcacccggacggagagagcctacctctggctcgttttttttctctgccggaacaggtctattacggctatccgatgaagtatgaactgcgcctgtcggatttggtgttgcaaagcaccgctaagacgagcatcagacaaaaggttgaccgttttttcaccgctggcggaggctcgctttccgtactttccgactacgccgcggcgagcaaaaatgagcttaacgtcgaggttaacgcttttgtcggctgtcatgaggcgggaaagctgccccccgcgctggccatgaacagctcgctgaccacccggtcagggctttatgtcggggttgaattctacggcagctggtcacgttatgctcgtttatccagcgatctgtatatggagctgctgccatccctgggggtaagtcgtcgggacggctatgacattgaatgttttataacccgccatgcggaaggcgaagaggcaggggacaggcgctatcgcgtacgctattttatcccggtgacgctgtcggcagcgggtctgcggtctgagagcggtagtgggtcagggcctgtgccggggcgaagttaa

SEQ ID NO: 6835 - DNA, 204 bp, Klebsiella pneumoniae
agcagcgacttcggcccaaagggttgcgacatcgcgccaggtattaatcacggctcccgttgtcgtgttctgttctttgacgggttcctgcagggtgatcctgtgacgcaattttccggcctgcatatcaccccctgggtttcccactcagataggtttgctgctctggcgcctcttcgagatcgccggcaagcgactggataa

SEQ ID NO: 6836 - DNA, 567 bp, Klebsiella pneumoniae
cactgccatgttcagagggggctaacgatggctgatggcgtggaagtaaacctgaccggcctcgattccgtcctgggaaaactggatgccgtctcacaggtcactcgcgataaatccggtcgtgcagcgctgcgtaaagcggcgaacgtcatcagggacagagcacgcactaatgccgcgcgggttgatgatcctctcaccaaggaggctatctacaaaaacattgtggtcagcttcagcagcaaggcgtttcgcagaaccggcgatccaacgtttcgtgtcggggtgatgggcggcgcaaggcaatacgccaatacaaaggctaacgtccgaaaaggcagggcgggtcaaagttataacactgccggagataaaggtaatcccggcggggatacctggtactggcgtttccttgagctcgggaccgagcatgctgcagcgcagccgatacttcgccccgctgtaaatggagtcgatacggaagtgatcaacgtttttgctgtggagctggaaaagtccattgatcgcgctgtgcgacgggcggctaaaaaaggaactccggtatga

SEQ ID NO: 6837 - DNA, 1188 bp, Klebsiella pneumoniae
accgggaatgttatgcctgattttactgcttcgccgctggtggacgccctggaagagaatctgttcagcctgctggaaaaactggccgcggaggtcaacaccgaagcgctgccgctgatcgatctttccagcggcagtccggatcaacccaccccgccggaagtgatcgactcgctgcagagcgctattcatcgtcgtgaaaaccatggctacccgtcgttctggggcaaaccacaggtccgcgaggcgatcgcccggttctatcgccggcagtatgatgtggaactcgatccgcacagcgaagtcgccgtgtttcaggggtcgcatatcggtataggcggcatcccgcgggcgctgctcagccccgggcaatacctcatctccaccgatccctgctatccgatttaccgctcggcggcgctgcagtcccaggcggcgttttatggcctgccgctcagggcggagaaccatttcctgccggattttaacgatcttccccgggaagtcgctgacaaggccgggctggtggtgcttaactatccgcataatccaaccggcgccctcgccacgccggcgctgttcgccagcgcgctgcagtttgctcgtcgtcaccaggtgccgatcctccatgattttgcctatgcggccatcggcagcgcggccagcgatgcgccgctgagcctcttctcccagcccgacgccaaagcatggggagtggaaacctatactttttccaagacctttaatatggccggctggcgcttcggcttcgcggtcggcaacgcctcgattatccgggcgtttaaaaagctgcacacccatagctacagtacggtgtttggcgcgattcaggatgcggcgatcgccgcgctcaacctgccggccgaacggattgcgcagctaacggcggtctatcatcaacgtcgggagtgggttctgcgtcgactggctgcgctgcgctggccggcgcgtgacgcacaaggcactttcttcctctggctcggcgtaccgcccggctaccgttcgcaggagtttgcccgtctgctgctgcaggaagcgcatattctggtggcgccgggcactggttttggcgaagggggggaaggatttattcgcatcagcctgaccgcaggggacgaggcgctgagcaacgcgctggaccgtcttgcccggctggcgctgttttag

SEQ ID NO: 6838 - DNA, 228 bp, Klebsiella pneumoniae
acgcttttcgtcgtttcgccagcaggcagccccctcatctctggtaacaaaaatcattccctgccgtcacgggcaaaaaagaccgggaaaacattcacttttcccctctccggcccgcaggccctggcaaagcgcacagattgtcagttgaccaatcagggggacagggctaagcctggaggagtttcatcacatcgagtcgctttaccaaccggagaatatccatga

SEQ ID NO: 6839 - DNA, 591 bp, Klebsiella pneumoniae
tccctttccgttttgaccacaggaatctccatgaccgacgcgctacacgtcaaactccgcccgcttgagcgcgaagatttgcgcttcgtccaccagctcgataacaacgccagcgtcatgcgctactggtttgaagagccgtacgaggccttcgttgagctctccgatctgtacgacaaacatattcacgatcaaagcgagcgccgctttgtcatcgaatgcaatggcgataaagccggactggtggaactggttgaaatcaaccatgtgcaccgccgggccgagttccagatcatcatctcccccgacttccagggaaaaggtctcgccacccgcgccgcacgcctggcgatggactatggctttaccgtgctcaatctgtataagctgtatttaatcgttgataaagagaatgaaaaagcgatccatatttaccgtaagctcggctttatggtcgagggtgaactgatccatgagtttttcattaacggcgagtaccgcaacaccatccgcatgtgcctgttccagcaccagtatctggccgagcacaaaacgcccgggccgtccctgctgaagccgacggctcagtaa

SEQ ID NO: 6840 - DNA, 1752 bp, Klebsiella pneumoniae
atggcaaccgttgcagatggatttcgctacgccgagcgcgtggtatctggcgatatcgttgctggcgagctggtgcgtcttgcgtgccagcggttctttcatgatttagaacacggcccggcgcgcggtgtttattttgatgaaggccgcgcccagcacgttctcgatttctataactttgttccccacgtgaaggggcatttgaccggcaagccgatcgagctgatggactggcacgtttttatcctgataaatctttttgggtttgtcgtcccgctgatagatgaaattacgtgtgaaggagttctggatgacgacggcgaacccatgtttgtacggcggtttcgtaccgcttatgacgaagtagcccgtaagaatgcaaaatcaacgctttcatctggaatcggcctttatatggctggcgctgatggtgagggcggcgctgaggtttattccgctgcaaccacccgggatcaggcccgcattgtgtttgatgatgccaaacgcatgattaagctggccccgaaaactctggggcggttatttggcagcaataagctgaatattcaccaggagcggacaggctctaagtttgaacctgtagccagtgatgcgaacaacctcgacggtctgaatattcactgcgggattgttgatgagctccatgcgcataaaacccgagatgtctgggaagttctcgaaacggcaaccggcgcccgactacagtctcttatcttcgcgatcactactgcgggatttaataaagagggtatttgttacgagcagcgtgattatgccattaagttgctgaaaaattttgacaacccggaccctctatcaccgaaagatgatagctatttcgcactgatttataccctggatgagggtgacgatcctttcgacgaggcaaactggccgaaagcaaatcccggtctgggtgtttgtaagcgatgggatgatatgcgtcgcctggctaaaaaggcgaaagagcaggtggcagcgcgggtcggattttttaccaagcatctcaatatctgggtgcagggtgaaaaagcgtggatggatatgtcgcgctgggaaaaatgccgcgatacctgggatgactcaactacggccagctggtcaatgtggctcggcgttgatctttccaacaaaattgatatttcagccgcggttaaagtatggcttgccccaaatggtgatgtttacgcgcgttcccgattctggatacctgagggacggctggaagcctgcacaaaacagcaggcggaactttaccgtaaatggaatcaagcgggatatctggaatttactgatggggatgttattgaccatgccgtgattaaagaggaaacgatcgagtgggcacgcggtgaatcactgaatgaattcgcgtacgacccctggagtgccactcagtttgctttgtcggtagcagctgaaggaataccgattgttgaagtccctcagacggtgaaaaacctgtcagaagcgatgaaggaagtcgaggccaagatttacgccgggcgttttcatcacgacggtaatccggtaatgacctggatgatgtcaaacgtcaccgtcaaaccagacaaaaacgagaatattttccccaacaaggccaccccagaaaacaaaattgacggccctgtcgcgatgtttattgcgatgagtcgcctgcttgttaacggtggtggtgaagttgacttcctgtccactatcgaccctgacgaagaccttttacttctatga

SEQ ID NO: 6841 - DNA, 1632 bp, Klebsiella pneumoniae
cgtggcaacgttttgttcacgccgggggcgacgctggctcccgagcagcaggcggcgctgcgcacactgaacaccgaagcggctacgctgcaaagtcagttccagcagcgactgctgggagcggcaaaaagcggcggcctggtggttgattaccggcatcaactggctggcctgagcgatgaggagatagcggcggcggctgacgcagcgcgtgaaagagggcttagcgaccgctggttgctgacgctgaccaataccacccagcagccgcagctgcttgcgctgcgcgaccggcaaacgcgggagaatctcttcgccgccggctggacccgcaatcagcagggcgatgagcatgatacgcgtgacctggtactgcggctggcggcgatccgcgcgcagcaggctgagctgttgggagccgctgattacgccagctgggcgctgaccgatcaaatggcggcttccccggcggaggcattgggctttatgcgccggatagcgccggcggcgcgggcgcgggcggaacgagaactggcggacatccagcaggtgatcgacaacgaaggcgggggttttcgcgcgacggcatgggactggctttactacagcgagcaggtgcggcgggctgcctatgccattgacgacgcgcagctcaaaccctattttgccctcgagcgggtgctgcaagacggtgtattctggacggcctcgcagctctttggtctgcgctttgttgagcgcttcgatataccggtctatcacctggatgtgcgggtctgggagatcttcgatcacaacggcgaagggatggcgctgttttacggtgactactacgctcgtgactcaaagagcggcggcgcatggatggatgtgtttgtcgaacagtcgactctgcgcgcgcagcgcccggttatctacaatgtctgcaactacgtccgcccgcaggcagggcagagcgcgctgctgtcgtgggatgaggtgatcaccctgtttcatgagttcggccataccctgcatgggctgttcgccagccagcgctacgccagtctctcggggaccaatacgccgcgcgattttgtcgaatttccttcgcagatcttcgaacactgggccagccagccgcaggtgtttgcccactacgcgaagcactaccagtccggggagccgatgccgcaggcgctacgcgacaatatgttgcgtgcggcaaccttcaataaagggtacgacatgagcgagctgttggctgctgcgttactcgatatgcggtggcatagcctgtcgacctcggcattaccggaggaggtggacgcgtttgagcagctggtgcttcgggaagagaacctggatctggcggcggtccccccgcgctatcgcagcagctatttctcccatatcttcggcggcggctatgcggcaggctattacgcctatctgtggacccagatgctggccgacgacggctatcaatggttcgtggagcagggcggtttgacccgtgagaacggtcagcgtttccgtgaggcgattttatcacgcgggaacagcactgatttagctgaactgtatcgccagtggcgcggacacgatccgcagattgagccgatgctgaaaaatcgcgggttgagtgcgtag

SEQ ID NO: 6842 - DNA, 1431 bp, Klebsiella pneumoniae
tttcctcgcgtaataaaaaaggtaactgatatggctactctggtaaaaagcaccagtaaatttatggggcgtaaggccgtcgcagctgatgccccgctgcctgacaatgcgttaatgtatctggactttgaaaacggccagtttatccgcagaaccgcaaccggggcggtaattcgcagcaacagcataactgacgtgatgtcatttacccgcgccaccgtggcaacgtatttcggtgatgacggcctgctgaaatatgcagcagctggtgaacctgttattgaatatgaccagaatacgctcgcctgtctggggttccgtcccgaagtgcaggccactaaccgggttatcaacagccagaactttttagcggcgaactggagcaaaacggggatcgaggttaccgataatgatgccgtgtctcctgacgggaacaagacggccagcaaaatcatagaggccgcaggagcggctaatactgttcactctcttgccacgacggtcacttatgctgcggttgtcggccagccctacacattcagcatttttgcaaaggcaaacagcggatctgttatgcagattgcattgcctgcgggcgtcgtcgccagcgcgcagttcgctaattttgacctggtgaacgggaagatcacgcgctcctctccgctggtcatgcaggcgaatatggaaaagtgcccgaatggctggtaccgctgctcgctgacgatcaaccctgttaccgcgggcgaaccgggatttactgtctgccttaccggcggaaatacggcagctgaagcactcccggcctacagcgcaacaaccgtcgcatcgatttacatctggggcgcccaggcggaacgcgccgcaggctatacttcatacattccgacggcgggggccgaagcgagccgcgatgcggatatattaacgaccccgtccggttatacactgattgattctgcaaaaggcgcgttctttgtctcggtggtgcatcctcacagcctgaaattattatcgacggcgtatgcttcgctggcctgcgccgtcgttctggataatgcggtggaaggtgcccattaccgccttgcctggcgaggcagggacaacatgaacggacaggcggcatttgccgaactgaatgctgccggcgggacgacggtatccgtcaacctgccgccgttaatggcggtctcggattcagaacaggcagccttctgcatgttcagtaccggcgatttatccatgaaagcatttgatggtcaggtctggaattcggcatcgcccacgatcatgcctgctgcgctgtcgcgcatctgcctggggcgctcatatatcggcgcatcaaactggtttaacgggcatatcaaaaagttcgtttactgggctgataacatttctcagcctgaagccgagaaatacttttccgtcttgtaa

SEQ ID NO: 6843 - DNA, 249 bp, Klebsiella pneumoniae
tcatggccagtcagtgcttgcccgaggacgtccatcatgcaccaccatccggttaaatcttcccgaattatctccgtcgcctacgatgacgcctccgccacactggaaatctatttctatcaccagccgccattacaatataccggggtcccaccgcgtatttttcatgattttttacaggtggtgtcaaaaggccggtattatgacggggtgatcaaaggaaaatttcccgaacgcaagctacgttaa

SEQ ID NO: 6844 - DNA, 1146 bp, Klebsiella pneumoniae
agcagtctggtaccggccgcgatttcggccctgactggctcgacggctggtgcgaaaccaaatccgtctgcgtgcgctactagccctccgtcggggaaggcgaaaggcttttcccgacgcgccgcttgccgacctccggtctttctcgctactgtggagggcaatctttgcctaatctgggcggtgaatcatcaggaggtcttcggcatgacagcatttcctaaggttgcgctaattggtcccggcgccatcggcaccacgattgccgccgccctgtttgagagggggagggcgccgatggtctgcgggcgtaccgcccattcggcgctggtgctgcgcactgacgagggtgagatcgtggtgcccggcccggtgtacaccgacccgatggcgatagccgcccccttcgacctggtctttgtcgcggtgaaaaccacccagacggaggccatcgcaccctggctgacggccctgtgttcccctgacaccgtggtgtgcgtgctgcaaaacggcgttgagcagcgccagcagtttgcccccttgaccggcggcgcgacggtgctgccgtcggtggtctggttcccggcgcagcgcgatgccgatgcctctgtctggttgcgcgccgcgccgcgcctgacgctgccggatctgccgggggcagagcgggtgcagcaggcgctggcgggaacccgctgcgcggtggacctggcggctgattttaccaccgttgcctggcgcaaactgttgcagaacgcggttgccggtctgatggtgctgaccggacgacgcgccgggatgttcgcccgggaggacatcactgccctcgggctggcttatctgcgcgaatgcctgcaggtggcgcgggcggaaggggccgccctgagcgaaaacgtgccggaggagattatcgccggctttcatcgggcgcctgccgacttaagcacctctattctgatcgatcgcctcaatggccgaccgctggagtgggatattcgtaacggcgtggtgcaagcgtcgcgggcgtcagcacggcattccgacgccgctcagcgatatcatcgtgccgctgctggcggcggccagcgacggcccgggctgacccgggctggcgcgggtgcgagccactggaagcgggatctgctatga

SEQ ID NO: 6845 - DNA, 216 bp, Klebsiella pneumoniae
tttcaagcggttaataccagtgttctgcttgtgctatttccgcagaaagtggcgtcttgcgcaacaaaattcatgtatcagaacgtactgaattcggttaataatgcagcaattcatccgtgggattattcctggtttgtcagcataatgcccaaaaataatacttttacccaccagatcttcaccggaattcgcacttctttacgcctctcgtaa

SEQ ID NO: 6846 - DNA, 1995 bp, Klebsiella pneumoniae
cgcctgcaggtagctgtcgcgctcgttctcttcggggataaagccgtaggccccggtaaaggccggaatattgaagctcttcgaaccggaggtgaacagcgcccatggtccctgagcgacctcgctccacgggatatggcggtgttcgccccaggtcatgtccatatgaatttcgtcgctaatcaccctgacgccatgtttttgacacagggccgccatggtctccagctcctcgcgacgccagactttccccgttgggttgtgcgggctgcacagcagcagcagggtattctttggctccgccagcgccgcctccaggcgctccatatcgcagcgccaccgattatccttcaggatcaatggcaccggggcaatccgccgccggttagcggtgatggtgttatagaacgcatcgtaggcaggggtgtggaccacgatgccgtcgccttctttcgaccactggcggatggtttccgccaccatatagataaccgacggtccgtagaccacagattgcggatcgatgtcgctgttaaagcggctggcgtaccagtgggcaatcgccccgagaaacgcctcgttgcgccagcggctgtagccgaacaccccgtgggccagccgctggctgacggcgtcgagaatacagggcgcggtggcgaaatccatatcggaaatagtgaacggcagcagatcggcggcgccaaaccggtcggcgacatagtcccattgcgtgcaccaggtgccgtggcgatcgataggggtggcaaaatcaaacattggagcttccttagcgagcgccccctccgtagcggagggggactagtgggatcaggcctgcacggtattcatcagcgtggccatctcatcttttaccgactgtacctgcgggccaataaccacctgcagattatgctggttgagctgtaccaccccgatggcgcgatgggctttcagcgcggcggcgtccactttgctcatatcgtgcaccgacaggcgcagacgggtaatgcagttatccagcgaaacaatgttctctgcgccgccgagcgccgccagaatcgccggtacgttatacccggatttgccgatggtaccggcgacggctttctccacgctggcggcagtgtcgatgtcgcggcccggcgttttcagattgaagcgggtgatggcgaagcggaagatggcatagtagaccgcgaaccagatagccgccactaccggcaccagataccacttggtcgccaggccatgcagaatgccaaacaccacgaagtcgatgatattgccgtcggtgttgccgatggttaccccgagcaccgccatgatggtaaagccgagaccggtcagcagcgcgtggatgacatacaggactggcgcgacaaacaagaacaagaactccagcggctcggtggtgccgccgaccacgcaggcgatgaccccggagatcagcaggcctttaattttatgtcggttttccggacgggcgcagtggtacatcgccagcgcggcacccggcaggccgccgaggaatgccggcattttaccctgcgacaggaaacgggtggcgctttcggcgaagccgtgggtcgtcggacagctcagctgcgcctggaagatggtcagcgcgccgctgacgctgtggccgcagacgtcgagggtgccgccggcttcggtaaagcggatcagcgccaccagaatatggtgcaggccaaacggcagcagcagtctctcgccggtgccgaagatcatcggcccaaaatccccggcgctgttgatcatcttcccgagggcgttgatccccatagcgaagactggccacaccagcgggatcgccagcccaaccagccccagcaccacggtggtgacgatcggcacgaagcgggtgccgccgaagaaggccagggcgtccggcaggcgaatgttatggaagcgttcatgcagcagccagacgataatcccggcgatcaccgccccgaggatcccggtatcgattga

SEQ ID NO: 6847 - DNA, 1419 bp, Klebsiella pneumoniae
gtagcgcaggttatcttcggtataggtgttgtaaacgccctgcgccagagcggcttcatcgccgccgccggtccagacgcgctggccttttttccccataatgatggcggtgccggtatcctggcaggtcggcagcacgcccttggcggcaatttccgagttgcgcaggaattgcagggcgacatatttatcgttatcgctggcttccgggtcgagcaaaatcgagccgacctgttgctgatgggagacgcgcagcataaaggcggcgtcgtggaaggcctgctgagcgagcaaggtcagcgcctgcggctctactttcaggacctgctggccgtcaaattcggcgacggagacgtgctctttgctgagcagatagtattccgtatcgtcgtgcgccagcggaaacggatcctgataaacaaacggtttagtcgacatagtcacttactccataaagataaaaaccgccggggtagtcccggcggttatgaatcagaacatcatggacatccacggatagccaatcagcagcagggcggccaggaagatggcgccaaagatggtgccgaggcgccagtaatctttggtcggcaggtagccgctgccgtagtagattgggcttgggccagtaccgtacggggtgatgatccccatcacgcccagcgaggtgaccatcagcaggacaaacacttccatattcattcccgggatagtcgaggcaatggtcagcatggccggcagcagcgcggtggtgtgcgcggtggtgctggcaaacagatagtgcagcaggtagaacgccagcagcaggacgatggtcgccatccccggggagatgccgctcatcagcgcgccgccctctttacccagccaggcgataaagccggtggaggagaggccgtcggccagtgccaccagggtggcgaaccagacaaaggtgttccatgccgctttgttgttggtgatatcgctccaggagagcacgccggtccacagcatcagcacgataaccagcagggcagccagcgccggttcgatccagtcggcggcgaagatccacatcatcagcgcgaagcagacgaataccagcagcagaatttcattgcgcgacagtttgcccagtttttccagttcacgcgcggcccacagtggcacttcgttattgactttcacttccggcgggtagaaccagtaggccagcagcggcatggccagaatcagcaggatacccagcggcaggaaggcgatgaaccaggtgccccaggagatattgatgccaacaatgcttttgaccagcgccagggccagcaggttcggggccaaagccgacaggaacatcgagctggtaatacaggcggcggtgatcgctacccacatcagataggaaccgattttacgtgcgctcggatcgtttggctttga

SEQ ID NO: 6848 - DNA, 759 bp, Klebsiella pneumoniae
acaattgtatttgctaatatgatcggatgtacacaaaaggaatcgtctgtgaaaagattgtattggctgatcccggcagcgctgctgctgacggcatgcgaccgtaaaagcgccccggacgccttcaccccggaaatggcgagtttttccaatgagtttgagtttgatcccctgcgcgggccggtgaaagattttagccagacgctgctggatgaacacgatgtggtggtcaagaaggttagcgctcagctttcaagggaagggtgtttcgatctgctgaccctggaagatgtggagaacaaaaccggcgccacgctgctgctggacgccaactattacgtcgacgggcgcacccacgagaagcggctgcgcctgcagggcaagtgtcagctggcggagatgcctgccgccggggtgagttgggagacggatgataacggttttattatcagcgcacgcggcaaagagaccaccgccacctaccgctatgacagcgatggctatccgctgggaaaaaccaccaccgccaaagaggagcgatttaccgtcgcctcaacgccgtcaaaggatccgcgtaagaaattggactataccgccatcagcaccttcaacgatcgcacgctgggcacggtgcgtcagacctgcgactacgacgatcacgacaatccgctgagctgtgagctgcaggtgatcgatgaaagcgtccagccgccgctgacccgccactacaccattaaaaaccgtatcgattattactga

SEQ ID NO: 6849 - DNA, 336 bp, Klebsiella pneumoniae
caaatacaattgtttacaccagttctgctatgcttaaatctggataacatcgataaggagcgtaagatgaaactatccctctgcaccggcgctgcgctactgctgtgctccacggccgtactggcggctcccgactcctgtgaacgggtcaaaagcgacatccagcagaagatcatcaacaatggcgtaccggaaaccgccttcagcctggccattgtgccaaacgatcaggcagaccagcccggggttcaggtggtcggtcattgcgccaacgacaccttcaaaatcacctatacgcgtaacagcgacagtcccgccgaaaacgacgctcagtaa

SEQ ID NO: 6850 - DNA, 414 bp, Klebsiella pneumoniae
atgtcaaaattgagcatgagatccatatcaaggtcgataaggatgtggaaaacctgctcaaatcccgcagcgatttgttctgaggcgacgatgagaaaacgactgttaaccgcggcgctgacgctggctttactcagcgcgcccgcgctggcgttgaccctgagcgaagcgcgccagcagggacgagtgggggagacgctgaacggctatctcgcgccgctgcgtcaggataaagagacgctggcgctggtaaagcagattaacgccgcgcgcagcgaaagctaccagcagctggcggatgacaacaatctgccggtggatgaagtggcgaaaatggccgggcagaagctggtggcccgcgcgcagcccggggagtacgtccagggattgaacggccagtggctgcgcaaataa

SEQ ID NO: 6851 - DNA, 1422 bp, Klebsiella pneumoniae
acgccgttttctaaaaaaataactctctgtacacctgttaatacccgaggcgaacctatgtcgacatcggcgctgttacttattgcgttagccagcgtagtgctgttgctcctgttagtgatcaaagcgaaagcacatccttttgtggcgctcctgatcgtcagtctgctggtggcattcgccaccggcattccggcagataaaattataaccaccattgaaaaaggcatgggcggcctgcttggccacatcgccagcattattattctgggctcaatgctgggggtgctgattgaaatgtccggcggcgccgaatcgctggcgaaaacgttgaccggcgtactgggtgcaaaacgaaccattgccgccttaaccatcgtggcttttattctcggcaccccggtcttttttgaagtcggctttatcatcatcattccgttaatctacggcttcagcaaagtcgcccacgtgtcgccgctgaagtttggcctgccgatggccggcgtgatgttaaccgtccacgtggcgctgcctacccatcctggcgcagcggctgcggcaggcattctgcatagcgatgtcggttggctgatgctggcggggattggggtgtcggtggtcgtcggtatcgtgggctattttgtcgcccggtttatcaatcggcgccattatcatctgtcgattaacgtgctggagcagcaacaaacggcggaagtaccggatctctcggttaacgcgcagcagacccgtctgccgccgccgaatgcgctggttatcggtgggctgatcgtggtgcccatcatgctgattgtttccgggacgctgtgtcaggcgcttctgctgccggaaaacgcggttcgccagctgatgaccgtcattggtaccccgccggtcgccctgctgatctccctgggcctggccagctggacgctgggcatccgtcggcggatgagcctgaaaaagctgggcgaagtcaccggcagcgcgatcccctcgtcggcggacgtgatcctcgtcgccggcgccggcggcgcctttggcggcgtactggtcgcttccggcatcggtaatgccttagccgaggcgctggagacaatacatctgccgctgatgcccgccgcttttctgctatcgctggtgctcagagcctcgcagggttcggccaccgtggcgatcctcaccacctccggtctgctgtcgcaggcggttgtcggtctggagccgctgcagctggtgctggtgacgctggcgacctgcttcggctcgctcgggctgtcgcacgtcaacgacgccgggttctgggtcgtcacacgctatctcggactctcggtgccggatggactcaaaacctggaccgtcttgacaaccatcatgggggtgacgggctttctcatcacctggctgctgtggtttgcgctttga

SEQ ID NO: 6852 - DNA, 378 bp, Klebsiella pneumoniae
ccccacctttcaccgccaggacgcctcgcgccgcctggcggcttctctattctgccagcattaaacggtagtcagttttgccagaatggcggcgaaggcgtcattaaccttatcgccggcgagcagttttttacgcaacgtgaagcttctgccgctggaacggatcagcagccggactttcgcatcattattgctgcgttcaactacggcaacatcccgcaagggaataacgtaggtatcggcatagagccccggcgtaaatatcatcgactcgccgctcacgccaatcaccacccgattttgcagacgatagccattgcacagcgcaacaataccggcggcaataaatactccgcctatccccatgccaatcattaa

SEQ ID NO: 6853 - DNA, 240 bp, Klebsiella pneumoniae
tcattgctttcacccaggtttattgaggaggagaccatgaaaacctatgaccgtaatcgtaacgctattgctaccggcagcatggtaatgatcgccggtaacgggacgacgggcgtgattaaagctatccatggcgaggggaaaaccgctgagcagttgcgccgggcggactgcgttgaaatcgacggctgcgagggccgcttctgcccgttggatctgatccgtctcggcttccattaa

SEQ ID NO: 6854 - DNA, 3099 bp, Klebsiella pneumoniae
acgccagtttctgaaagtggagtattaccagtgacaatccgcctttacccgtcgcgtttgcctggcgaaccgctggagacgcatgaacaccgggatacgaccatacatgactggatgctccagcatgtcgataactaccgtaacgatatggtgcagcgtgttacgtttgaggtgaatggtaagccggtcccaccggcagaatggcctttatgctttatcagtgctgagagcgatgtaaaagtttacccgatccctggtgagggggtgacggcaactactatcgctgcctgggcagcggcggccatcgctgcagcctcggctgtgtatgtgctgatcaccatgtcgaacatggataaaggcggctattcatcctccagtggtctggggctggatttaaacccagccaaagcgaaccaggcgaaacttggcgacccaatccgcgaagtgtttggccgttgccgtatctatccagattatgtcgtacagccagtgacgcgctttaatcctgatgatccaacgcgaatgaccgtcgaaatgatggtttgccttggaaaggggaatttcgcgtttacgaatggtgatctccgtgtgggttcaacacctatttcagcattaggggactcgttcagttacaacgtttattcaccaggagcagatgtttcaggagatcggcgaagtgaaaactggttcaactcgacagaggtaggtggtacttccagcgggagtgggcttgatatggcccagacctcgccagattcgacagatatcaacgccgacagtatgaccgtttctggcgcatccgtgacgtttaacgggctggatgatggcaacgatgatgacgatgaaggcaatgcgttgcctgagtcgtgggttgagggggccattgttacgatcgtcgccccgatgaattttctggtttcaacctcgtcgggatatagcgttctcgccagtaactctctgggtgaaattaatccctatccgggtatgccggttaccctggaaattaacggcactgaatacgaactggttattgcaacttatacggcaaaacaggacgcgatacccggggtgggtggaaatgcggccagcctgaaagcaaatgcctccccatcaacatatgattactccggtaccggccagacttttacgatcacctggcaggggcatgagtacactatttccctcgttgcagactatgtgaatatgcccggcctgctggcggtgataaacgatggccttaccgggtcaggattactggcgcaggatagcggcggtgttgtgctgattgctgaggcatcaagcccctggctcggaggaaacattacctcatcatcgctaccggtagccgtttttggcgacagtcctgtatttacctccggcaccgcgtccagcggaggcagtccggcaataactgctaacgttacgctggcgtatgggagtgcaaccggagtggcattttccgggataccggagggaacacaacggctggcgctggctcaccgtggcaacgagtaccgcattgcggatgcggacggtacgaccgcaacggttcagcggctgattgagggagtggttgatccttcctggtctggcttctcaccccgcacgatgattgactatcaggctacagggatcagcgacaacaatacctggatgggaccgttccttgcctgcccggaatctgaagtggtggacgcatttgaagtgaatttttcatttccttccggtatttgcggatttgacagcaaaggtaaaaaacgcatcaggcattgtgagtgggaaatacagtaccgtgtttatggatctggctctggctggacgagcaggcagggggtttacgcgcttaaaaatatcaacgggttgggttttacagagcgttttgatctctcttctcctgggctggttgaggtgcgctgccgtcgccgcaatgagcagggtagcaataacgcgcgtgactcgatgtactggcaagcgttgcgtggtcgcttgttggctcggccaacatcctatgctggcgtcaccctgatgggggttacggttgagacggggggcaaattggcggctcagtctgaccggcgcgtaaacgttgtggccacgcgcatttatgactctggcgtagcccgtagtatctctggtgcgctttatcacgtcggccgttctcttggtatggaaatggatactgaggcaatagatgccctggagcagacttactggaccccgaacggcgagtatttcgattttgccacgggtgacagtatttctgcgctggaaatgcttcagaaaatcgctgcagccggaaagagttattttctgctaaatacccagtctgttgcatcagtgggtcgtgaaggcgttaaaccctggaccggggctatcacccctcacgagatggtatccgagatgcagaccgatttcgtcacggtgactgacgacgattacgatggtgttgacgtaacctatatcaacggatcgacctgggcagaagagacggtgcaatgccgtctgcctggcaacccaacgccgctgaaaatagaggcataccgggctgatggggtaggcaatcctgatcacgcataccagattggtatgcgccgactgagaaaataccagctgcagcgcatgacgcataaaacgacgacggaactggacgcgctctgttacaacgtcggggatcgtattgtgttgaccgatgatatccctggcagcaacaccatttcgtgtttgattgagtcgatggctactgctggtggggtgaccacattcgatgtgtcggagccgctggactggacttttgcaaatccacgcgtctatctgcgttatcaggatggaaaagcatcacggctgtttgaagcatcacccacaggcgacaactatcaggtatctgtcccgtatcaatctgagttcgccgatatcctgctggatgatccgataattgagcctccccggttaattttctgtagttctgagagcgacctgtatcacgccattgtgtccgagatagtgccacaggacgatggaacctgtgagataactgcccggcaataccgcgctgaattttatgactacgacgacgccacataccccggcgacgtcgcgtaa

SEQ ID NO: 6855 - DNA, 351 bp, Klebsiella pneumoniae
atacgtacttcccctctcgacgccgcccgccacgctgcctattattctggggtttgcttttttaagacgtttctgaggggagagagaatgcgagctgcgatgttagtaggatgtgcggcgctgttgctgtccgcgtgcagtagtgaacccgttcagcaggccacggcggcgcacgtcacgccgggaatgcgggcggcgatgagcgacgccggtcaggccaactgcgccatgataggcggctcgttatcggtggctcgtcagctcgatggttcggcgattggcatgtgcgcgctgccgaacggcaaacgctgcagcgagcaggcgctggcgggcggcagctgcggctactaa

SEQ ID NO: 6856 - DNA, 1164 bp, Klebsiella pneumoniae
ttagcgaattcggttccacggcctgcaaagcgctctatcgctgcgacagctgccgggaaccttttgattactttaaatgtatttgaggttgccatgacgacgttctattcgcttaaggtggcgagagtcgagccggaaacccgcgatgcggtgaccatcacttttgcgatcccgcaagccctgcaggcggaatactgttttcgcccgggccagcatctgacgctaaaagcccgtctgggcggcgaagaactgcgccgctgttactccatttgtcacagccgcacgccaggcgaaattagcgtcgcggtcaaagccatcgacggcggacgcttctcgcgctacgcccagcacgatatccagcagggtatggagctggaggtgatggtgccgcaggggcatttcggttatcaaccgcaggccgaacggcagggagaatatctggcgattgccgccggctccgggatcacgccgatgatggcgatcattagcgcgacgctggcgaccgagccgcaaagccgctttacgctgatctacggcaaccgcagcagccatagcatgatgttccgccaggcgctggccgatttaaaagaccgctatccgcagcgcctgcaggtgatccacctgtttagccaggagtcgatggacagcgatctgctccaggggcgcattgacggcgacaaactgcgccagctcgctgaccatctgctggatttcagccgtttcgacgaggcctttatctgcggtccggcggtgatgatggacgaggcggaagcgacgttacgtgaacttggcgtagcggagaaatcgattcatctcgaacgctttaataccccaggcggcaatgtgaagcgggccgctggagtgcaggcggaagggcgcacggtgaccatccgccaggacgggcgcgatcggcttatcgccctcagcgccgaagacgacagcatcctggatgccgcattgcgtcagggcgccgatctgccgttcgcctgtaagggcggggtatgcgccacctgtaaatgcaaagtgctacgcggtgaagtggcgatggccgccaattacagcctggaagcggatgagctggcggcgggctacgtgctgagctgccagtcgctgccgaccagcggcgatgtggtggtcgactttgacgcgcgggggatagcatga

SEQ ID NO: 6857 - DNA, 366 bp, Klebsiella pneumoniae
cttattgattcactgttaaggcatacgggcatggggctgttaatcaaagggctgctgggagcgctggtggtggtgctgattggcgtgctggcgaaaaccaaaaactacgctatcgctggcctggtcccgctgtttcccacctttgcgctcatcgcccattatattgtcgccagcgagcgggggatcgaagccctgcgcgcgaccatcgtattcggcatgtggtcgattcttccctattttatctatctgctgtcactgtggtatttcaccgggattatgcgcctgccgttggcgctggcaggcgcggtgggatgctgggggctgtgcgcctggctgttaatcctcggctggggccgtttccactag

SEQ ID NO: 6858 - DNA, 990 bp, Klebsiella pneumoniae
ccgtgtgaatcaggagtaagaaagatgacaacccaggctgtttctggtcgccgctatttcacaaaagcgtggctgatggagcaaaaatcgctgattgccctgctggtgctgatcgcggtggtatcgaccatgagccccaacttttttaccgtcaataacctgttcaatattctgcagcaaacctccgttaacgccattatggcggtagggatgacgctggtcatactgacctcggggatcgatctgtccgtcggctccctgctggcgctcaccggtgcggtggcagcgtcgatcgttggcattgaggttaatgcgctggtggcggtcgcggctgccctcgcattaggtgcggcgatcggcgcagtcaccggggtgattgtagcgagaggccgcgtgcaggccttcatcgccaccctggtgatgatgctgctgctgcgcggcgtaaccatggtgtacaccaacggcagcccgatcaataccggctttagcgataatgccgatctgttcggctggtttggcatcgggcgtccgctggggatcccgacgccggtatggatcatggcgattgtcttcctggcggcctggtacatgctgcaccatactcgcctgggccgttatatttatgccctgggcggtaatgaagcggcgacgcgtctgtccgggattagcgtcaataaagttaaaattatcgtttacgccttgtgcggaatgctggcttcgctggccgggatcatcgaagtggcgcgtctctcctccgcgcagccgacagcggggacgggctatgagctggacgccattgcggcggtggtgctcggcggcaccagcctcgctggtggcaaaggacgcattgtcggcacgctgattggtgcgctgatccttggcttcctgaataatggtcttaatcttttaggcgtttcttcctattaccagatgatcgttaaagcggtggtgattttgctggcggtactggtagataacaaaaagcagtaa

SEQ ID NO: 6859 - DNA, 498 bp, Klebsiella pneumoniae
tcgaagggatcggacctcgctttttgcccgtcgatcgaagacaaagtcatgcgctttgccgatcgcaaccagcatcagatcttcctcgagccggaaggactgacctcaaacgaaatttatccgaacggtatatccaccagcctaccgtttgatgtgcaaatgcaaatcgtccgctcgatgcaggggatggagaatgcgcggatcgtccgtccaggctacgctattgagtacgatttcttcgacccgcgcgatctgaagccaacgcttgagagcaaatttattcagggtctgttcttcgccggccaaatcaacggtacaaccggttatgaagaggcggcgggtcaggggctgttgcccggacttaaacccccccgcttttttgggaaaaagaaggctgggcgccgccgtccgaataagcttaccttggcgttgctgggagatgacctctggcccctggggtacaaaagaaccgtccccgattgttactttcccccctga

SEQ ID NO: 6860 - DNA, 303 bp, Klebsiella pneumoniae
aatccacggcccgggcttcaatccattttcataccgctttatgcgaggcagaccaccatgttttatcaggatccttttgacgtcattatcattggcgggggtcatgcaagcactgaggccgcaatggccgcagcgcgtatgggtcaacaaaaccctgcttttgacacacaatatcgacacgctggggcaaatgagttgcaacccggcgattggcggcattgggaaaggacacctggtaaaagaagtggatgcgctcggcggtttgatggccaaagcgatcgatcaggcgggtattcagtttag

SEQ ID NO: 6861 - DNA, 996 bp, Klebsiella pneumoniae
tgcttggctacgatgaaagatgtggcccgcatcgcgggcgtttccacatcgacggtgtcacacgtcatcaataaggaccgctttgtcagcgaggcgattaccgccaaagttgacgctgcgatcaaaagcctcaactacgccccctctgcgctggcgcgtagcctcaagctcaatcaaacccgtaccatcggcatgctgatcaccgccagtaccaatccgttttattcggagctggtgcggggcgtggagcgtagctgctttgagcggggttatagcctcgtgctctgcaataccgaaggtgatgagcagcgaatgaatcgtaatctggagacgctaatgcaaaaacgcgtcgatggattactcctgctgtgcacggagacccatcagccctccccggaaatcatgcagcgctatccgtcggtaccgacggttatgatggactgggccccctttgatggcgatagcgatctgattcaggataactcgctgctcggcggcgatatggcgacccagtatctgattgaccaggggcattcacgcattgcctgtattgccggcccgctggataaaaccccggcgcgcctgcgtcttgaaggctatcatgccgcgatggcgcgctgcggcctgccggttgccgaaggatacgtggtgaccagtgattttgagttcggcggcgggtttagcgcgatgcagcagctgctggcgttgccgcagcgtccgcaggcggtgtttgtcggtaacgatgcgatggcggttggcgcttatcaggcgttataccaggccgggctgcagattccgcaggatatggcgctggtgggctacgatgatattgagctggcacgttatatgacgccgccattgaccaccattcaccagccaaaggatgagctgggggaactggccatcgacgtactgatccatcgcatggccgatccgcagcaaaaacagcagcgcgttcagttaacgccggagctggtggttcgcggttccgcttag

SEQ ID NO: 6862 - DNA, 1872 bp, Klebsiella pneumoniae
tctatgagcactgataataaacaatcgttgccggcgttaacgctggcggccatcggcgtggtgtacggcgatatcggtaccagtccactgtataccctgcgcgaatgcctgtcaggtcagtttggctttggcgtagagcgcgatgccgtttttggctttttgtcgctgattttctggctgttaatctttaccgtatcgattaaatacatcaccttcgtgatgcgggcggataacgccggggaaggcgggatcttaacgctgatgtcgctggccggacgtaatacctcggccagaatgacctccgtgctggtgatcctcggccttatcggcggcagtttcttctatggcgaagtggtgattaccccggcgatttcggtaatgtcggcgatagaggggttagaaattatcgccccgcagctggatacctggattgtccctatctccattatcgtgctcaccctgctgtttgtgatccagaagcacgggactggcatggtcggcaagctgtttgcgccgattatgctgatctggttcctgttactggcggtgctgggcgcgcgaagcatttacgctaatccggaagttctgcaggcgctgaacccctactgggctgtgcacttcttcctgcaatacaagaccgtttcctttattgcgcttggcgcggtggtgctgtcgattaccggggtggaagcgctgtacgccgatatgggccacttcggcaaactgccgatccgcgttgcctggttctccgtcgtgctgccctcgttggtgctgaactattttggccagggcgcgctgctgctgaagcacccggaagcgattaaaaacccgttcttcctgctggcgcctgagtgggcgctgatcccgatgctgattatcgccacgctggcgacggttatcgcctcccaggcagtgatttccggggtcttctccctgacccgtcaggcagtgcgtctgggctatctgtcgccgatgcgcattatccatacctcggaaatggagtccgggcagatttacattccgttcattaactggctgctgtacgtttctgtggtcatcgttatcgtcagctttgagcattcgtctaacctggcggcggcgtatggtatcgccgtaacgggcaccatggtgctgacctccattctgtcggcgaccgtggcacgcaaaaactggcactggaacaagctgtttgtcggtctgatgctggtggccttcctgtgcattgatattccgctgttctcggcgaacctcgataagattgtctccggcggctggctaccgttgtccctggggatggtgatgtttacggtgatgacgacctggaagagcgagcgtttccgcctgctgcgccggatgcacgagcatggcaactcgctggaagcgatgatctcttcgctggagaagtcaccgccagtgcgtgtgccgggtactgcggtgtatatgtcccgcgccctgaacgtgatcccgtttgccctgctgcataacctgaagcacaacaaggtgctgcatgagcgagtgatcctcctgaccctgcgtaccgaagatgcgccttacgtgcataacgttcgccgggtgcagattgagcagctgtcaccgtccttctggcgggtggtggccagctacggctggcgggaaacgcctaacgttgaagaggtgttccaccgctgtggcctggaaggactcagctgccggatgatggagacctcgttctttatgtcgcatgagtcgctgattatcggtaaacggccatggtatctgcgcctgcgcggcaagctttatctgctgctgcagcgtaacgccctgcgggcgccggatcagtttgagatcccgccaaaccgggttatcgagctcggtacccaggtcgaaatctga

SEQ ID NO: 6863 - DNA, 1464 bp, Klebsiella pneumoniae
acaggcgaagcagccatgacgctcgatatgctgaatgtcatgctggcagtcagcgaagagggaatgatcgaggagatgctgctggcgctgttggcctctcctcagctggcggtgttctttgaaaaatttccccgcctgaaaaacatcatcgcggcggatattccgcgctggcgggaagccgttcgcgcccgcttaaaagaagttaacatcccgccggatctggacgccgaagtgcaaacctatcagcaggctcagctgctctctacctcgcagtttatcgtccagctcccgcaaattctcggcaaactgcaccagctccagtccccttttgccgcccaggcgcagaagctggtggatgacaatgccacctttaccccggcgctccatacgctgtttttacagcgctggcgactgagcctggtggtgcaagccaccagccttaaccagcagctgctggacgaggagcgcgaccagttgctcagtgaggtccaggaacgaatgacgctcagcggtcagctcgatccggtgctggcggaaaatgataccgccgccggacgcctgtgggatatgagcgccggggaactcaaacgaggcgactaccagctgatcgtgcgctatggcgattttcttaaccagcaaccggagctgctgcagctggcggaacagctggggcgttcaagggaagcgaaatccgtgccgaagaaagatgcgccgatggaaaccttccgcagcctggtacgcaagccggcaacggtgcctgaacaggtcgacggcctccagcagagcgacgacattctacgcctgctgccgccggagctggcgacgcttggcatcacggagctggagtttgaattttatcgcaagctggtggagaaacagctgctcacctaccggctacacggcgatgcctggcgcgagaaaattaccgaacgcccggtaacgcggcaggattttgatgagcaaccgcgcgggccgttcattgtctgcgtcgatacgtcaggatcgatgggcggttttaacgaacagtgcgctaaggccttttgtctggccctgatgcgcatcgcgctggccgataaccgtcgctgcttcattatgctgttctccagcgaagtggtgcattacgagttgaccagcgagagcggactggagcaggcgatccgtttcctgagccagcgttttcgcggcggcaccgatctggccagctgttttcgcgccattattgaacgtttgcaaaacccgcagtgggtggatgcggatgccgtggtgatctccgactttattgcccaacggttgccggatgaggtgattgctcaggtgggggagttacagcgtaagcatcagcaccgttttcacgcggtggcgatgtcggttcacggcaaacccggcatcatgcgcatcttcgatcatatctggcgctttgacaccgggctgcgtagccgcctgctgcgacgctggcggcgctaa

SEQ ID NO: 6864 - DNA, 1092 bp, Klebsiella pneumoniae
aacagatctctatataaagatcttctttttaatactcaggatcccggagtctttctcgaaagacgaaagttgagtagaatccacggcccgggcttcaatccattttcataccgctttatgcgaggcagaccaccatgttttatcaggatccttttgacgtcattatcattggcgggggtcatgcaagcactgaggccgcaatggccgcagcgcgtatgggtcaacaaaaccctgcttttgacacacaatatcgacacgctggggcaaatgagttgcaacccggcgattggcggcattgggaaaggacacctggtaaaagaagtggatgcgctcggcggtttgatggccaaagcgatcgatcaggcgggtattcagtttaggatactaaacgccagcaaaggaccggcagtgcgcgccacccgcgcccaggctgaccgcgtgctttatcgtcaggcagtacgtaccgcgctggagaaccagccgaacctgatgatcttccagcaggcggttgaagatctgattgtcgaaaacgatcgcgtcgtgggcgccgtcacccagatgggcctcaaattccgcgctaaagcggtagtgctgaccgtcgggaccttccttgacggcaaaatccatattggtctggacaactacagcggcggccgcgccggcgatccgccgtctatcccgctgtctcgtcgtctgcgtgaattgcctctgcgcgtaagtcgtctgaaaaccggtactccgccgcgtattgacgcgcgcaccatcgatttcagcgtgctggcgcagcagcatggcgataacccgatgccggtcttctcgttcatgggatccgcggatcagcatccgcgccaggtaccgtgctatatcacccacactaacgagaaaacccacgatgtgatccgcaataatctcgatcgcagtcctatgtacgccggagtgatcgaagggatcggacctcgctttttgcccgtcgatcgaagacaaagtcatgcgctttgccgatcgcaaccagcatcagatcttcctcgagccggaaggactgacctcaaacgaaatttatccgaacggtatatccaccagcctaccgtttga

SEQ ID NO: 6865 - DNA, 918 bp, Klebsiella pneumoniae
ctgagaactctacaggacatcttaactatgaatatgaaaaaactggcgaccctggtctctgctgttgcgctaagtgcgaccgttagcgcgaacgcgatggccaaagacaccatcgctctggttatctctaccctcaacaacccgttcttcgtgtcgctgaaagacggcgcgcaaaaagaagctgacaagctgggctacaacctggtggtgctggattcccagaacaacccggcgaaagagctggcgaacgtccaggatttaacggtgcgcggcaccaagctgctgctgatcaaccccaccgactctgatgccgtcggcaacgccgtgaagatggcgaaccaggcgaaaatcccggtcatcactctcgaccgtcaggcgacaaaaggcgatgttgtgagccatatcgcctctgacaacgtgcagggtgggaaaatggctggcgattacatcgcgaaaaaagtgggtgaaagtgcaaaagtcattgagctgcagggcattgccggaacttctgcggctcgcgagcgtggcgaaggctttaaacaggccgtggcggcgcacaaattcaacgtcctggccagccagccggccgatttcgaccgcaccaaaggcctgaacgtgatgcagaacctgctgaccgcacatcctgacgtccaggcagtgttcgcgcaaaatgatgaaatggcgctgggcgccctgcgcgcgctgcagaccgcaggcaagtccgatgtgatggtggttggatttgacggcactccggatggcgaaaaagcagtaaacagtggcaaactggcggcgaccgtcgcacagttgccggagcagatcggcgcgaaaggcgttgagactgctgataaggtactgaagggcgaaaaagtggaagctaactacccggttgagctgaagctggtcgttaagcagtaa

SEQ ID NO: 6866 - DNA, 729 bp, Klebsiella pneumoniae
agtagaggaaagaaaggaaccgcatttatgtctttaagcgcacagcaactggcggcacaaaagaacatctcctgggtactggccgaaaagctcgcccaaaaaatactgactggcgaatatcagccggaaagcattcttcccggcgaaatggagttgggggagcagttcggcgtcagccgtaccgccgtccgcgaagcggtgaagacgcttactgcaaaaggcatgctgctgccccgcccccgcattggcacccgggtgatgccgcgcagcagctggaatttccttgataaggaactgctatcctggtggctaacagaagataacttcgaagaggtggtaagccactttctcgtcatgcgcagcagcctggagccacaggcctgctttctcgccgccgccaacggcaccgccgggcaaaaagcgcagctcaatacattaatggaagagatgattgctctgaaacgccattttcagcgcgaacgctggatagaagtcgatatggcctggcatgaacatatctatgaaatgagcggtaatcctttcctcagctctttcgcctcgctgtttcattcggtctaccacacctacttcacgtcgattacgcaaaatgaagtggtgaagctcgatctccaccaggcgattgtcgatgccattcttaacagtgatgcgccgggggcgttgctcgcctgccaggcattgttgaacgccccacaccacgtaaatcaataa

SEQ ID NO: 6867 - DNA, 264 bp, Klebsiella pneumoniae
agaaatgtttgggaaactgccttgtgggagggggataactcctggaaacgggagcttaaaccggataacgccgaagaaccaaaggggggaccttgggccttatgccatataatgggcccaaagggattagctgtagggggggaacggtctcctaggcgacaaaccctactgggttggaaggggaccaccccccttgaacgggaacacggccaaactctcagggaggcgcgggcgggaaatttttcaaaggggccaaccctatga

SEQ ID NO: 6868 - DNA, 1056 bp, Klebsiella pneumoniae
ttattgtattgccgccctgttttgttgcttaatcaatggcaacaggacgcaggagtcataaaaatgaaaaccgcatatatcgcaaaacaacgccagatcagtttcgttaaatcccacttttcccgtcagctggaagagaagcttggcctgattgaagtccaggcgccaatcttaagccgcgtgggcgatgggacgcaggataacttgtccggctgcgagaaagcggttcaggtaaaagtgaaaacactgcccgacgcccagttcgaagtggttcattcgctggcgaagtggaagcgtcaaaccctgggacaacacgacttcagcgcgggcgaagggctgtacacgcacatgaaagcccttcgccccgatgaagaccgtctgacgcctatccattccgtctatgttgaccagtgggactgggagcgcgtgatgggggatgaagagcgtcacgtcggcaccctgaaggcaaccgtcgaggcgatctacgccgggatcaaagccaccgagctggcggtcagccaggagtttggcctgacgccgttcctgccggaacagatccattttgttcacagccaggagctgctgagccgctatccggagcttgatgccaaaggtcgtgagcgggctattgccaaagagctgggcgccgtcttcttaattggtatcggcggcaaactagctgatggcaagcgccacgacgtgcgtgcgccggattatgatgactggagtactgaggtttctgaaggttttgccggcctgaacggcgatatcctggtgtggaacccggtgctggaggatgcgttcgagatctcctcgatggggatccgcgttgacgccgaggcgctaaagcgccagctggcgctgaccggcgatgaagatcgcctgaaactggagtggcaccaggcgctgctgcgcggcgagatgccgcagactatcggcggcggcattggccagtctcgtttgacgatgctgttgctgcagcttgaccatatcggtcaggtgcagtgcggcgtatggccggcgcaggttcgcgaaagcgtttccgcgctgctgtaa

SEQ ID NO: 6869 - DNA, 498 bp, Klebsiella pneumoniae
atcccagctcgctcacagcgtacaatacgccactctgaacagttgagcgggcgatctatggcagacattacacttatcagcggcagcaccctgggcagtgcggaatatgtagcagagcatctggcggaaaagctggaagaagccggctatagcactgaaatccagcacggtccgctggtggacgatctgcaggcgcaagggatctggttaattatctcttccacccatggcgccggcgacattcccgacaacctggttcccttctatgacgcgctgcaggagaagcagaccgatctttccgccgtgcgctttggcgctatagggatcggcagccgcgaatacgacaccttttgcggcgcgatcgataaattagaagcggcgctgaaggcctgcggggcaaaacagatcggtgagacgctgaagatcaacgtccttgaacacgaaattccggaggatccagcggaaatctggctgggatcctggaaaaatttgctctga

SEQ ID NO: 6870 - DNA, 240 bp, Klebsiella pneumoniae
acgggaacacggccaaactctcagggaggcgcgggcgggaaatttttcaaaggggccaaccctatgaaactttttccgtgtgggaaaaaggcctccggttttaaagccattccagcggggggaagaggggggggtaaaacccccccgtgggatgcccccaataaaatccgtggttttatgccacatgcccgggtatctgggggggaggcgatatatatattcggggtaaaaccctccagg

SEQ ID NO: 6871 - DNA, 438 bp, Klebsiella pneumoniae
tggagcaaaagagaaaaaatgaaaaaaggcaccgtacttaacgctgatatttccgcggtcatttcccgcctgggccacaccgatacgctggtggtctgcgatgccggattaccggttccccgcagcagcacgcgcattgatatggcgctgactcagggcgtaccttcatttatgcaggtgctggaagtggtgacgacggaaatgcaggttgaagcggctgtcatcgcggaagagattaaaacccataatccgcagctccacgcgacgttgctcactcacctcgagcagctgcagcagcaccagggaaataccattgaaattcgttacaccagccatgagcagttcaaaaaacaaaccgcagacagtcaggcggtaattcgcagcggggagtgttccccgtttgcgaatatcattctctgtgccggcgtcacgttctga

SEQ ID NO: 6872 - DNA, 993 bp, Klebsiella pneumoniae
aaaaagaaaagcagggcaggcgccaccggatcccggtggcgcgctttcccgggaacagaaatgatgaaaactgcaggcaaacttgtcgtccttggcagtatcaatgccgatcacattcttaaccttgacgctttcccgacgccgggcgaaaccgtcacaggccaccattatcaggtggcgttcggtggaaaaggggccaaccaggcggtggccgccgggcgcagcggagcggatatcgcgtttatcgcctgcaccggcgatgacgatatcggtgaacgcatccgtcgtcagctggcgagcgataaaatcgacgtggcgcccgtgcgcgcggttgccggggaagcgaccggggtggcattaattttcgttaacgccgaaggtgagaatgtcatcggtattcatgccggcgccaatgcggcgctttccgtctcccaggttgaggcggaaaaagagcgtatcgccagcgcacaggcgttgttgatgcagctggagtcgccgctggagagcgtcatagcggcggcgaaaatcgcccatcaccatcacaccaccgtggtgctgaaccccgcgccagcgcgtgaactaccggatgaactgctggcgctggtggatattattacccctaacgaaaccgaagcggaaaagctgaccggtattcgcgttgagagtgacgaagatgcggcaaaagccgccgacgtgctgcatgccaaaggcattggtacggtgatgatcaccctcggcagccgcggcgtctggctcagtgccgaaggcgaaagccgccggatcccagggtttcgcgtacaggccattgatactatcgcggccggtgatacctttaacggcgcgctggtgaccgcgctgctggaagggaccgccctgccggaggcgattcgctttgcgcatgccgcagcggcgatcgccgtaacccgcaaaggcgctcagccgtccgtgccgtggcgcacagagatcgatgaatttttagcgcaacaggggtaa

SEQ ID NO: 6873 - DNA, 1410 bp, Klebsiella pneumoniae
caaggatttggcatgagcggaaaaaaagggcgcagcatggctggcctgccgtggatcgcggcgatggccttctttatgcaggcgctggatgccaccattcttaacaccgccctcccggctatcgcccacagtcttaatcgttctcccttagcgatgcagtcggccattatcagctatacgctgacggtggcgatgctgatcccggtcagcggctggctggccgatcgcttcggcacgcgccgggtctttatcatcgccgttagcctgttcaccctcggttccctcgcctgcgccctctccagttccttaacggaactggtcatttttcgcgtaattcaggggatcggtggggcgatgatgatgccggtggcgaggctggccctgctgcgtgcctacccccgcagcgaactgttgccggtcctgaactttgtcaccatgccgggattggtggggccgattctgggcccggtactcggcggggtatttgtgacgtgggccagctggcattggattttcctgataaacattccgatcggcgttattggcattctgtacgcccgtaaatacatgccaaatttcacaacgccgcgccgacgcttcgatataggcggttttctgttatttggcttaagtctggtgttattttccagcggtattgaactgtttggggaaaaaatcgtggcgacatggcaggcgctggccgtgattgccgtcagtctgttactgctcgtggcctatgtgcgtcacgcgcgtcgccatccgacgccgcttatctcgctctctttatttaagacccatacgttctcggtcggcattgccggcaacctcgccacgcggttgggtaccggctgcgtaccgtttctgatgccgctgatgctgcaggttggtttcggctatccggccattatcgccggctgtatgatcgcccccaccgctatcggctcgattattgcgaaatccaccgttacccaggtgctgcgctggtttggctatcgtaagaccctggtggggatcaccgtgtttattggccttatgatcgcccagttctcgctgcagtcgccagagatgccgctgtggatgcttcttctgccgctgttcgtgctggggatggcgatgtccacgcagtttaccgccatgaataccattaccctggccgatctgaccgatgataatgccagcagcggcaacagcctgctggccgtcacccagcagctttcaattagtctcggggtggccatcagcgctgcggtgctacgcttctatgaaggttttgataatgcaagcacggtacagcagtttcactacacctttataaccatgggcgtgataaccattatatcggcgctgatgtttatgctgttaagagcgaaggatggccgcaacctgattagcgagcggcataagcgctaa

SEQ ID NO: 6874 - DNA, 1578 bp, Klebsiella pneumoniae
ttcgcagcggggagtgttccccgtttgcgaatatcattctctgtgccggcgtcacgttctgaggtcgccgtcatggaagccttattgcaactgaaagggatcgacaaagcgttccctggcgtcaaggcgctctccggcgcggcgctgaatgtctatgccggccgggtgatggcgctggtaggggaaaatggcgccggcaagtccactatgatgaaggtgttgaccgggatctacacccgtgatgccggctctttgctgtggttaggcaaagagacgacctttaacggcccaaaatcctcccaggaagccgggatcggcattatccatcaggaactgaacctgatccctcagttgacgatcgccgagaacatcttccttggccgcgagttcgttaaccgttttggcaaaatcgactggaagcagatgtatgccgaagccgacaagctgttggcaaagctgaatctccgctttaccagccagaaactggtgggcgatctatcgattggcgatcagcaaatggtggagatcgccaaagtgctgagcttcgaatcgaaagtcatcattatggatgaaccgaccgatgcgctgaccgataccgaaaccgaatcgctgttccgcgtcatccgcgaactgaagtcgcaggggcgcggtatcgtctatatctctcaccgtatgaaagagatcttcgagatttgcgacgacgtgacggtctttcgtgacgggcagtttatcgccgagcgcgaggtctcgtcgctggatgaggaccgacttatcgagatgatggtcggccgtaagctggaagaccaatatccacaccttgataaggcgcccggcgcggtgcgcctgaaggtcgacaacctctgcggcccgggggtgaataacgtgacctttaccctgcgccagggggagatcctcggcgttgccgggctgatgggcgccgggcggaccgaactgatgaaagtgctgtacggcgcgctgccgcgcagcagcggttccgtgacgctcgatggccgcgaagtggtgacccgttcgccgcaggatggtctggcgaacggcattgtctatatctccgaagaccgtaagcgcgatggtctggttctcgggatgtcggtaaaagaaaacatgtccctgacggcgttgcgctatttcagccgggcgggcggtagtcttaagcataaagatgaacagcaggcggtgagtgatttcatccgcctgtttaacgtgaaaacgccgtccatggagcaggcgatcggcctgctctccggcggcaaccagcaaaaggtcgccatcgcccgcgggctgatgacccggccgaaggtgctgatcctcgatgaaccgacccgcggcgtcgacgtcggggcgaagaaagagatctaccagctcatcaaccagttcaaagccgacggcctgagcatcattctggtctcctccgagatgccggaagtgttgggcatgagcgatcgcatcatagtgatgcatgaagggcatctcggcggtgaattcacacgcgagcaggccacccaggaagtattgatggctgccgctgtgggcaagcttaaccgtgtgaatcaggagtaa

SEQ ID NO: 6875 - DNA, 468 bp, Klebsiella pneumoniae
gaaaaagatatggaaaattatcagatcgacaatctggaccgcggcattcttgatgcgctgatggccaacgcccgtaccgcctatgccgaactggccaaacagttcagcgtcagcccgggcaccattcacgtgcgcgtcgaaaagatgaagcaggcgggtatcataaccggcgcgcgcattgatgtcagccccaagcagctgggatacgacgtcggttgcttcatcggcattattttaaaaagcgccaaagactatccctccgccctcgcccgcctggaaagtctggaggaggtcaccgaggcttactacaccaccggccactacagcatctttattaaggtgatgtgtaaatccatcgatgctctgcagcaggtacttatcaacaagatccaaacaatcgatgaaattcagtccactgaaactctgatcgtgctgcagaacccgatcatgcgcaccatcaagccctga

SEQ ID NO: 6876 - DNA, 1695 bp, Klebsiella pneumoniae
aacaaatgtgtgcctagtcccttggcccacaaaaagcgcacagtatgcacgattatttgtgaaatcgtacccctaacagacaccatattaacctggctcaaaaaaaataaatcgattcttcaggctattaccgccccggctctaacatctatactcgtcccaataacgatacatgacaaagcacgcaactcaattatggctcaaacacatttactggctgaaagaatttcccggctcagcgcggcactcgaaaaaggactctttgaacgcagccacgcgatacgcctctgcctgctggcggcgctcagcggcgagagcgtttttttgcttggtccaccggggatcgccaaaagcctgattgcccgccgcctcaaattcgccttccaacaggcgcgcgcttttgaatacctgatgacccgcttctccaccccggaagaggtttttgggccactgtccattcaggcgctgaaagatgaaggccgttacgaacgtttaaccgctggctacctgccggaagcggaaatcgtgtttctcgatgaaatatggaaagcaggtccggctatcctcaacaccctactgacggcgattaacgaacgtcacttccgcaatggcgcgcatgaagagaaaatcccaatgcgcctgctggtggccgcgtcgaacgaactcccggaagccgacagcagcctggaagcgttgtatgaccgaatgctgatccgtctatggcttgataaagtgcaggataaaggtaatttccgttcgatgctggtcagccagcaggatgaaaacagcaatccagtgcccagcgcgctgcaggtgagcgacgaggaatttacccaatggcagcagcagatcggcaatattaaactgccggatgcggtgtttgagctgatattccagctccgccagcagctggacgccctgccaaatgccccctacgtctcggatcgccgctggaaaaaggctattcgcctgctgcaggccagcgccttcttcagcggccgcgacagcatcgcgccgattgaccttatcctgctgaaagattgtctgtggcacaatgtcgaaagtatgaacctgatgtcgcagcagctggaaacgctcatgacctgtcacgcctggcaacagcaggcgatgctgacgcggttgggggcgattgtgcagcgacgcattcagatccaacaacagcaaagcgacaaaacggcgctgaaggtcacccgccttggcgggatgtttagccgcaaaccgcactatgaactgccggcggagatccaggggaccaccctgacgctgctgctgcagcagccgctcaaacttcacgatatggaagtgatccacattacttttgaacgcgaggcgttagccaactggctggaaaagggcggcgagatccgcggtaagctcaacgggatcggctttgcccaactactcaatatggatgtcgacaccagccagcatctggtcgtccgcgatgtaagcctgcagggctcacgcctcgcgctgcccggcagcgcagcgcaggagaatatgccggcggaaattcgccagcagctggaagcgctggatgatgagtggcaccagcaacacaaccgcttcagcgagcagcaaaagtgcctgtttatcccggtcgaatggctgggaagaatcgaagccagcctgcaggacgtcggcgcgcagattaaacaggcgaagcagccatga

SEQ ID NO: 6877 - DNA, 513 bp, Klebsiella pneumoniae
atatcgagttcgaatgcctccgccagctcacgccaggtatgtgacccgcggccatcaatgctggcgcgctgcgggtcgtccagcgtgcgatggacttcgctttcgctgatctcattaattgccgccagcagggcatctacgttgacgtcaaggtcgtccccggtctggcctgttaattggtgcttcatcattaccccctcgctgagcgtcgctcaagcctctctaagtatagtcggtctaaaaaagcgccagtcacgtgccgcgacgctgcgagttgcgtggttttgttctacactggctgaaaatatagaggagatgattatgcaggtgaacgatcgtgtcacggtgaagaccgacggtggcccacgtcgatcaggggtagtgctggcgattgagtcgtttagtgaaggaacgatgtatctggtttcactggaagactatcctctggggatctggttttttaatgaaataggccacccggatgggattttcgtggaaaaagaggtctcgtaa

SEQ ID NO: 6878 - DNA, 639 bp, Klebsiella pneumoniae
tcgatatgctcgaagactgcgacgacgtgcaggaagtgtaccataacggcgagatctccgacgaggtcgcagccaccctgtgatgcagccgcatccacggttaaccggaggcgcgtgatggctattattctcggcattgacccggggtcgcgcgttaccggttatggcgtgatccgccaggttgggcggcagctgagctacctgggcagcggatgcatccgcaccaaagtggacgatctgccgtcgcggctgaagctgatctacgccggggtgacggagatcatcacccagttccagcccgactatttcgccattgagcaggtctttatggccaagaatgccgactcggcgttaaagctcgggcaggcgcgcggggtggcgatcgtcgcagcgaccaatcaggcgctgccggtgtttgaatacgccgcccgtcaggtcaagcagaccgttgtcgggattggcagcgccgaaaagagccaggtccagcatatggtgcgcaccttgctcaagctgcccgccaatccgcaggcggatgcggcggatgcgctggcgatcgccatcacccattgccatgtcagccagaatgccgctcagatcagcgagacccggctcaatctggcgcgggggcgcttacgataa

SEQ ID NO: 6879 - DNA, 1518 bp, Klebsiella pneumoniae
gccattagctcatggatacgttcgaccgctttttgctgttgctcgtggctcagcgaaggtaaacctgcaaacatcttttactcctgctacattgtggggcgtaattatttcacgccgtccccaactacgccagaggggcggcaacgttcaggatcgagaaagatgttgtcccccgcgattattaccctgccctggcgcccggatgcggccgaacactattttgcgccgttaagcgccctgccctgggcgatgctgctgcattccggctttgccgaccatccgcataaccgctttgatattctggtggctgccccgcgcgccacgctgctgacgcgcggtgaacagacgtgggtcgacgacggcgaaaccgttgttgtctcagcggaagatccgctgcagctcctgcagcagcagttggatcgtcagccgttcacgccgcaaccccatgacgatctgccgtttctcggcggcgcgctgggattattcggttacgacctgggccgtcgctttgagcgtctcccttcgcacgcgcaggccgatatcgcgctggcggatatggcggtggggatctatgactgggcgctgatcgtcgaccaccagcgccaacagatatcgctgctcagctatgacgacccgcagcagcgtctacagtggctggaggcgcaaacgccgacgccgggtgaaaccttcgccctgacctctgcctggcagtcaaatatgagccgccagcagtacggcgaaaaatttcgccaggtacaggcctatctgcacagcggcgactgctatcaggtcaacctcgcccagcgttttcaggccagctacgtcggtgatgaatggcaggccttccgccagctgaacgccgtcaaccgagccccctttagcgcctttattcgcctcgatgaaggggcgattttaagcctgtcgccggagcgctttatccagctgcgccagggggagatccagacgcggccgataaaaggcaccctgccgcggctcgattcgccgctggcagatgcgcagcaggctgagaagctggcgaattcgccgaaagatcgcgccgagaatttaatgattgtcgacctgatgcgcaacgacatcggccgcgtcgccgtcccgggcagcgtgcgggtccccgagctgttcgtggtggagccgttcccggcggtccatcatctggtcagcaccatcaccgcccgcctgccaatgacgctgcacgccagcgacctgctgcgcgccgcctttcccggcggctcgatcaccggcgcgccgaaagtgcgggcgatggagattatcgatgaactggagccccagcgacgcaatgcctggtgtgggagcattggctacctgagctattgcggcaatatggataccagcatcaccattcgcaccctgacggcatggcagggacagctgtactgctccgccggcggcggaattgtggcggatagcgaggaagcggcggaatatcaggaaacttttgataaagttaatcgtatcctgcagcaactggagaactag

SEQ ID NO: 6880 - DNA, 237 bp, Klebsiella pneumoniae
acgaggatatcgatgagcacaccagatttttccactgcagaaaataagcaggaactggcgcaggaagtctcctgcctgaaagcgatgattacgctgatgctgcaggcgatgggccaggcggatgcggggcgcgtgattattaaaatggaaaagcagattgcacagatggaagatgaggctcaggccgccgtattctccagcaccgttaagcagattaaacaagcctatcggcagtaa

SEQ ID NO: 6881 - DNA, 984 bp, Klebsiella pneumoniae
atgatgtcatcagtgactacgtccggggctacccgctcaacctttagctttgcccgcatctgggatcagtttggcatgctggtggtgtttgcggtgctgtttatcggctgtgtgatttttgtgcccaactttgcttcattcgtcaatatgaaagggctggggctggcgatctcgatgtccgggatggtggcctgcggcatgctgttttgcctggcctccggcgattttgacctgtcggtggcgtcggttatcgcctgcgccggggtcaccaccgcggtggtgattaatctcagcgaaagcctgtggctggggatcgccgcaggcctgttgctgggggcgcttagtggtctggttaacggctttgtcattgcgcgccttaagatcaacgcgctgatcaccacgctggccaccatgcagattgtccgcggcctggcctatattatctccgacggcaaagcggtggggatcgaagatgaacgtttcttcaccctcggctatgccaactggtttggtttgccggcgccgatctggctgaccgtcgcctgcctggtggttttcggattattactaaacaaaaccacctttggccgtaatacgctggctattggcggcaatgaagaggcggcgcgccttgccggcgtcccggtggtgcgcaccaagattattatctttgtgctctccggtctggtatcggccgcagcgggtatcattctggcgtcgcggatgaccagcggccagccgatgacctcgattggctatgagctgattgttatttcggcctgcgtgctgggcggagtgtcgctgaagggcgggatcggcaagatctcctacgtggtggccgggatcctgatcctcggaaccgtggaaaatgcgatgaacctgctgaatatctcgccattctcacaatacgtcgtgcgcggggtgatcctgctggcggcggtgatcttcgaccgctacaaacaaaaagccaaacgtgcggcctga

SEQ ID NO: 6882 - DNA, 6129 bp, Klebsiella pneumoniae
gacgtgccatcaggaggaagaatgatttctggcgcaccatctcaggattcgctgttaccagacaaccgccacgcggctgattaccaacaattacgcgagcggctcatacaggaactgaatttaacgccgcagcagttacatgaagagagcaacctgatccaggccggcctggattccataagattgatgagatggttacactggtttcgtaaaaatggctaccgccttacccttcgcgagctgtatgccgcccccacgctggcggcatggaaccagttaatgctcagccggtcgcctgagaacgcggaagaagaaacgccgcccgacgaatcatcctggccgaacatgaccgaaagtacccccttcccattgacgccagtacagcacgcctacctgacgggccgcatgccggggcagacgcttggcggcgtgggttgccacctgtatcaggagtttgaaggccattgtctgacggcgtcgcagctggagcaggccatcacgaccttgctgcaacgccacccaatgctgcatatcgcctttcgccccgacgggcagcaggtctggctaccgcaaccttactggaacggcgtcaccgttcatgatttacgccataacgacgctgaaagccgccaggcctatctggacgcactgcgccagcgcctgagccaccgtcttttacgcgtggaaatcggcgaaacgtttgattttcagctgacgctcttgccggacaatcgccaccgcctccatgtcaatattgacctgctgattatggatgcctccagctttacgcttttcttcgatgagcttaacgccctgctggccggagaatcgctgccggctatcgacacccgctatgatttccgctcgtatttgctgcaccagcagaagatcaatcaaccactgagagacgacgcgcgcgcttactggctggcgaaagcatcgacgcttccccccgcgcccgtcttgccgctggcctgcgaacccgccacgctacgtgaagtccgtaatacccgacgccgcatgattgtcccggcaacacgctggcacgcctttagcaaccgggccggcgagtatggcgtgacgccgacaatggcgctggcgacctgtttttctgccgtgctggctcgctggggcggcctgacgcgactgctgcttaacatcaccttattcgaccgccagccgctgcacccggcggttggcgcgatgcttgccgacttcaccaatattcttctgctggataccgcctgcgatggcgataccgtcagcaacctggcgcgtaaaaaccagctcacgtttacggaggactgggagcatcgccactggtccggcgtcgaattactccgtgaactcaaacgccagcagcgctacccccacggcgccccggtggtatttaccagcaatctggggcgttccctctacagcagccgcgcagaatcgccgttgggcgagccggaatggggcatctcgcaaacgccgcaggtctggatagatcatctggcgttcgagcatcacggcgaggtctggctacaatgggacagcaacgacgcgctgttccctccggcgttagtcgaaacattgttcgacgcctactgccagttgattaaccaactctgcgatgacgaaagcgcctggcaaaagccgttcgcagatatgatgcccgccagccagcgcgcgatacgcgaacgggtcaacgccaccggcgcccccattcccgaaggcttgctgcatgaaggcattttccgtatcgctctgcaacagccgcaggcgctggcggtaacggacatgcgttatcagtggaattatcatgagctgacagactatgcccgccgttgcgcgggcaggttaatcgagtgcggggttcagcccggcgataatgtggctatcacgatgtcgaaaggcgcaggacaacttgttgcggttctggccgtcctgctggccggggcggtttacgttccggtttcgctggatcagcctgccgcacggcgcgagaaaatctacgctgacgccagcgtccggctggtgctcatttgtcagcacgacgccagcgccgggtcagacgatattcccgtccttgcctggcagcaggccattgaggcggagccgatcgccaacccggtagtacgcgcccccacgcaaccggcctacattatctacacctccggctctaccggtacgccgaaaggggtagtcatttctcaccggggagcgcttaacacctgttgcgatatcaatacccgctatcaggttggcccgcatgacagggtgctggccctctccgccctacattttgatttatcggtttacgacatttttggcgtactgcgcgcgggcggcgcgctggtgatggtgatggaaaatcaacggcgcgatcctcacgcatggtgtgagctgatccagcgccatcaggtcacgctctggaacagcgtcccggcgctgttcgatatgctgctgacctggtgtgaaggtttcgccgacgccacgccggaaaacctgcgcgcagtgatgctttccggcgactggatcgggcttgacctccccgcccgttatcgggccttccggccacaaggacaatttatcgcgatgggcggcgccaccgaggcgtctatctggtctaacgcctgcgaaattcacgacgtccccgcccactggcgctccatcccttacggttttccgctaaccaaccaacgctaccgggtggtggatgaacagggccgggactgccctgactgggtgccgggtgaattatggattggcggcattggggtcgcggaaggctatttcaacgatcccctgcgtagcgagcagcaatttttgacgctcccggacgagcgctggtatcgcaccggcgatctcggctgctactggccagatggcacaatcgagttcctcggtcgtcgcgacaagcaggtcaaagtcggaggatatcgcatcgagctgggcgaaatcgaaagcgcgctcagccagctggcgggggtgaaacaagcaaccgttctggcgatcggcgaaaaagaaaaaacgctggcggcatacgttgttcctcaaggcgaggctttttgcattaccgatcatcggaacccggcactgccgcaggcgtggcacacgcttgcgggaacgttgccctgttgcgccatctcgccagagatctccgcagaacaggtagccgatttccttcagcatcgcctgctaaaactgaagccgggtcacaccgctggcgccgatcctctccccctgatgaactcactcgctatccagccgcgctggcaggccgtggtggaacgctggttagcatttctggtgacacaacggcgactgaagcccgctgctgaaggttatcaggtctgcgctggtgaagaacgcgaggatgagcacccgcacttcagcggacatgatttaacgttatcgcaaattcttcgcggtgcccgtaacgaactgtcgttactgaacgacgcgcagtggtcgccggaaagcctggcctttaaccatccggccagcgccccgtatattcaggaactggcgacaatttgccaacagcttgcacagcgcttacagcgcccgatacgcctgcttgaggtgggaacccgcactggccgcgccgcagaatcgctgttagcacagctcaacgccggacagattgagtatgtcgggcttgagcagagccaggagatgctgctgagcgcccggcagaggctcgccccctggcctggcgcccgtctgtccctctggaatgcagacacgcttgcgacgcacgctcactcggcggacattatctggcttaataacgccctgcatcgtctgctgccggaagatcccgggctccttgcgacattacaacagcttgccgttcccggcgcgctgctctacgtgatggagtttcgccagttaacgccgtccgccctgctcagcacgctcctgttaaccaatgggcagccggaggccttgctgcataacagcgccgactgggcggcattatttagcgcggccgccttcaactgtcagcatggcgatgaggtcgcggggttacaacgcttcctcgtacaatgtcctgacaggcaggtgcgccgcgatccccgtcaacttcaggccgccctcgctggacgtctgccggggtggatggtgccgcaacggatcgtcttcctcgacgccttaccgctgacggctaacgggaaaattgactaccaggcgctgaagcgtcgtcatacccctgaagcggaaaacccggccgaagcggatttaccccagggcgacattgaaaaacaggttgccgccctctggcagcaactcttatcaactggcaatgtcaccagagaaaccgacttcttccagcaaggcggcgatagcctgctggcgacccgtctgaccgggcaacttcatcaggcaggttatgaagcgcaattaagcgacctgtttaatcatccccggctggcggattttgccgccacactgcggaaaaccgacgtcccggtcgaacaaccattcgtccactcccctgaagatcgctaccagccctttgcgcttaccgacgtgcagcaggcttacctggtggggcgtcagccgggctttgccctgggcggcgtcggctcacatttctttgttgaatttgaaattgccgatctggacctcacccggctggagacggtctggaaccgattaatcgcccgccacgatatgctgcgcgccatcgtgcgtgatggacagcaacaggtgctcgaacagacgcccccctgggtgatacccgcacacaccctccatacgcctgaagaggcgttgcgggtgcgcgaaaaactggcgcatcaggtactcaaccccgaagtgtggccggtattcgatctccaggtcggatacgtggacgggatgcctgcccgcctgtggctgtgtctggataacctgttgcttgacggtctcagcatgcagatcctgctggcggagctggagcacggctaccgctacccgcaacagctgcttccgccgctgcccgtcaccttcagggattatctgcaacaaccctcgctacagtcgcccaatccagattctctggcatggtggcaggcgcagcttgatgatattcctccggcgcctgcgttgccgctgcgctgcttgcctcaggaggttgaaacaccgcgcttcgcccgcctgaacggcgcgctggacagcacgcgctggcatcggctgaaaaaacgggcggctgacgcccatctcaccccgtcggccgtactgttgtcggtgtggtcaacggttctctctgcatggagtgcacagcctgagttcacgcttaaccttacgcttttcgacaggcgaccgctgcacccgcaaatcaaccagattctgggcgatttcacctcgctgatgctgctgagctggcatcccggcgaaagctggctgcacagcgcgcagtcactacagcagcggctgagccagaacctcaaccaccgcgatgtgtcagccatccgcgtgatgcgtcaactggcgcaacagcaaaacgtgcctgccgttccgatgcccgtcgtctttaccagcgcgctgggctttgagcaggataacttcctcgcccggcgtaatctgctcaaaccggtctggggcatctcccagacgccgcaggtctggttcgatcaccagatttatgaatccgaaggcgaactgcgctttaactgggattttgtcgccgcgctgtttcctgccgggcaggtggagcgccagtttgaacagtattgcgcattgctaaaccgaatggccgaggatgaaagcggctggcaactgccgctcgccgcgctggtgcctcccgttaaacacgcagggcaatgcgcagagcgctcaccgcgcgtatgccctgagcaatctcagccacacattgcggcggacgagagcaccgtcagcctgatttgcgacgccttccgcgaggtggttggcgagtctgtcacgcccgcagaaaacttctttgaggcgggcgcaacgtcgctgaatctggtgcaactgcacgttttgttacaacgtcacgaattttccaccctgacgttgcttgacctcttcacccacccttctcctgctgccctggccgattatctggccggcgtcaccacggtggagaaaacaaaacgacctcgccctgttcgtcgtcgtcagcggcggatatag

SEQ ID NO: 6883 - DNA, 1542 bp, Klebsiella pneumoniae
taccgtaaatcgttaacgataataaaacctgccgtcgcaggtttttttatctaccctactggctggcgggtcgtctcctgccgctttgcacaggatcacactcttgatggcagtgacaacatgaataccgcgatctcttcccgcgatgaacgtgctttttcagcgccggcgctgctggtggccggtgccttttttatggagtttctcgacgggacggtgatcgccaccgccctgcccgatatggcgagggattttggcgtcaccgcggtcgaactgaatatcggcatcagcgcctatctgattacccttgcggtcctgatcccggccagcggctggatcgccgatcgcttcggcgcccgggctatttttactctcgccctggcgatctttacccttgcctcggtcttctgcggcctctccaccgaggtgcatatctttgtcgccatgcgtatccttcagggagtcggcggcgcgctgatggtccccgttggtcgccttgcggtgctacgcaccacgccgaaacaccagctgatcaaggccatcgccaccctgacctggccggcgctggtggcccccattatcggcccgcctttgggcggctttataacccgctacgccagctggcactggatattctttatcaatgtcccgctgggccttgccgccatcatcctttcgctgcgcattatccctgatattcgcgaaacggaacggcgctccttcgatctcaccggatttatcactacctcggtcgcgatggtcagtctggtgaccgcgatggagcggctcggcgatcgccagccgcagatctggccgacgctggctctcgccgcgcttggcttcggctgtctgttatattccattcgtcatttccgccgggcggcggcgcctatggttcgtctcgacgccctgcaggtgccgacgttccgggtgacaatgtacggcggctcgttgttccgggcctccatcagcgcggtgccttttctgctccccctgctgttccaggtgggattcggtatggatccttttcattccggcctgctggtgctggcggtgtttgtcggtaatttaaccattaaacccgccaccacaccgctcattcgctggctgggctttcgtcggctactgctgatcaatggcgcgttgaacgtctgttcgctgctggcttgcgcgctgcttacgccgcagacgccggtctgggccatcatgctgatcctttatctcggcggggtgtttcgctcaatccagtttaccggtgtaagcacgctggccttcgccgatgtccccgccgcgcagatgagtgatgctaatacgctgttcagtaccgcgtcgcagctggcggtagggctggggatcacgctcggggcgattggcattcgcctgggcgagcaggtcggcgactggctgcatcttactgaactaccggggatcagcttccgcctgtcgtttgtgtttatcgccttgatctgtctggtagggatgatcgacagcctgcatctggccaaaacggccggcagcagcgtgtcggagaagaagaaatag

SEQ ID NO: 6884 - DNA, 687 bp, Klebsiella pneumoniae
cagtgtttgtcacctgagaggaaaaccatggctaactggctacatcaactgcagtcgctgctcgggcagcagggtgcgtcaccgtccggcgagtcgtcaaaagggagcggcctgctgcccggcgccatcggtgggctggccggattgctggtggccagcaaatcgtcacgcaaattattggcgaaatatggcactagcgcgctgctggcaggcggcggggcggtggcgggcacggtgttatggaacaagtatcagcagaaaatgcgcgcgcagaatacgtccgcccaggcgcctgagacggcagcggcgccggcggaggtcgatccgcgtagcgtgcggctgatcacggccctggtatttgccgcgaaaagcgacggtcatattgatgaccacgagcgggcgaatattgaaactcagctgcgggcggccaatattgacgttcaggcccgggtgctaattgaccaggcgctagcccagccgctggatccgcagcgtctcgccgagggcatcatcgacccgcaggaggcgctggagatctactacgtcagctgcgcggtgattgatatcgaccattttatggagcgtagctaccttaatgcgctgggagacgccctggcgctgccgaaagatgtccgggccgatatagaacaggatatccagtcacaaaaacaagcgctaagcgtctaa

SEQ ID NO: 6885 - DNA, 918 bp, Klebsiella pneumoniae
ggaagtatgtctacccgtcagcttttaccgctcatcggggcgctgtttgcgctgtatatcatctggggctctacctatttcgctatcgccgtcggggtcgccagctggccgccgctaatgatggccggcattcgttttctcgctgccggcgtgctgttgctggggtggctactggccaccggccataagctaccggcgcgtcgtccgctgcttaacgctgcgctgatcggcgtgttgctgcttgcggttggcaacggcttcgtgacgctggctgaacatcagcacgttccgtcagggatcgcggcggtgatggtcgccaccgtaccgctgttcaccttatgcttcagccgctttttcggcatcgccacccgtaaactggagtggctgggcattgccattggccttgcgggtatcgtgatgctcaacagcggaggcaacctgaacggcaacccctggggcgcactgctgatcctgattggttccctaagctgggccttcggctcggtttacggttcgcgaatcgtactgccgaccggcatgatggcgggggcaatcgagatgctcgccgccgggatcgtcctgctggcggcctcatggctgagcggtgaaaccttaacccgcgtcccttcctggtccgggatcgccgccctggcctatctggccatctttggctcgctgatcgccattaacgcctacatgtttttaatccgcaatgtcacccctgcggtcgccaccagctacgcctatgttaatccggtggtcgcggtgctcctcggtactgggttcggcggcgagagcctgtcgctcattgagtggctggcgctggcggtgattattttcgccgtagtgctggtaacgctggggaaatatctcttccccgtccgcagcgaggctactccttgtaaggcgtcgaagtag

SEQ ID NO: 6886 - DNA, 792 bp, Klebsiella pneumoniae
cgctcgtcgtctgcttacgatactgaccgtcatcctggccctgtggctggtgctgggcttctggccgctgtccatcggcaaccaggtgatcttcagtctgtgcatcctgctggcgggcggcgcggcgctctggcgtcagcgtcgccgggcagtcagccgtcagcgatcggaaatcgtcctgccgcccgaggattttcagggggcagtggttctggtctgcggggataccgacggtctgtttcccgggcgttcggcgcacggcgaaacccgtcacggctggtatctacggggagacagcgcggagcagttgccgcggctggcgcagtacctggcggcggcgcgtccggcactggtatcgcaggtttccgtgctgctggcggtggtaccggagcaccacccctccggggagcatctggcgcagtcgctgcgcgactggcggcggagtatcgttcagtgccgaacctggctaaacggtctgccgccggtgtggagcgtgttctgggtgacgccgccaggcggccaggccgtggaaagccgctggtttaccgtcacgccggagaggcctggtctccaggtgcagcagaagggacaagcgccccaggcggttgccgggtggcagcgggagggcagccctgcctcacgcctgcatcagacgctgtggctggagagcattctgaccttggccgaaaacgctcttttccggccattccgcgcccggcaggcagaacttcctccgctgaacctgtgtgccgcgggcatctgccttacgccggtggcggcggtggcgaataa

SEQ ID NO: 6887 - DNA, 708 bp, Klebsiella pneumoniae
atcatgaatcccgatacctccgccgtcctgaagccccgccgcggccgtccacccaaggtcgatcgccagtttgacgatacgcgtcaggcgctgattcgctcaggccttgaagtgctgaccgaaacgggctatctcgcggcgggtattgatgcggtgatcaagaatatcgccgtgccaaaggggtcgttttatcattgctttaaaagcaaagaggcttttggcctcgccgtgcttgccgcctatggcgacttctttgcgcataaattagataaattcctgctggacgacgccgtgccgccgctggaacgaatggcggcctttgtgcgtcatgccggtcagggaatggagaaattccagtttcgccgcggctgcctggtgggcaacctgctgcaggaagccccgttgttacccgagacgtttccccaacggttgatggctatcctggcggcatgggagtcgcgcgtggcgcgctgcctgcgcgaagcgcaggcagccgaggccatcgccagcgacgcctcaccgcaggcgctggcccaggtgttctggatcggctgggaaggcgcggtgatgcgcgccaggctggtccagtctgccgcaccgcttaaccagtactgggatttttttgcgcacagtatgacaacaaaaacacctgcacaggacggcgctagcgccgataacccccttccgacgaggaatactctgtcatga

SEQ ID NO: 6888 - DNA, 819 bp, Klebsiella pneumoniae
aacggcgatccctttttaattcacttgccatgctatctgcgctatagcggctctggtatgatgagtgcaattgtaacgctgtgtaatggaaatcttactatggtcattaaggcgcagagccctgcgggtttcgcggaagagtacatcattgagagtatctggaataaccgcttccctcccggatcgattctccccgctgaacgcgagctttctgagctgatcggtgtcacccgcacaaccctgcgcgaagtattgcagcgtctggcccgtgacggctggctgaccattcagcatggtaagcccactaaagtgaataacttttgggaaacctccggcctgaatatcctcgaaacgctggcgcgcctcgatcacgacagcgtaccgcagctgattgataatctgctctccgtgcgcaccaacatttccacgatttttatccgcaccgcgtttcgccagcatccggataaagcgctggcggtcctggacagcgcccgggaggtggaggatcacgccgacgccttcgccgagcttgattataatattttccgtggtctggcgttcgcctccggcaacccgatctacggtctgatcctcaacggcatgaaggggttgtatacccgcatcggccgccactatttctccagcccggaagcgcgcagcctggcgctcggtttctatcatcagctggcgaaagtgtgtgaggctggcctgcatgaccaggtttacgagctggttcgtcgctacggccatgacagcggcgagatctggcaccggatgcagaaatcgctgcccggtgatttagccatgaatatgcgttaa

SEQ ID NO: 6889 - DNA, 1758 bp, Klebsiella pneumoniae
ggagaactccccatgacgagtactgatgcacgtcgtcccgctgttttgccctgttccctgcgcctggcgatcggcggcgctctgatcgccctgatgagcctgaacgctcaggcggaagacggcaaaaccgcgccgcccccctcgccggatattctgctgggcccgctgttcaatgatgtccagagcgcgaagctgtttgccgatcagaaaaccttcgccgacgctatccctaacagcgatccgctgatgatccttgccgattaccggatgcaaaaaaaccaggccagcttcgacctgcgccacttcgtcgaactgaacttcacgctgccgaaagagaacgacacctatgtgccgcccaaagggcaaactctgcgtcaacatatcgatggcctgtggccggtcctgacccgcagcaccgtcgaggtggaaaaatgggactcgctgctgccgctgcctaagccctacgtggtgcccggaggacgtttccgcgaagtctattactgggacagctatttcacgatgctgggtcttgccgaaagcggtcactgggataaagtcgaggatatggtcgccaacttcgccgcagaaattgacgcctggggccatatccccaacggcaaccgcacctattatctcagccgttcgcagccccccttcttctcctttatggtgagcctgctggcgacgcacgatggcgaccaggtgctgaaaacctaccagccgcagctggagaaagagtatcgctactggatggccggagcggacgcgctggctcccggcagcgccgacaaacgggcggtgcggatggcggacggcgcgctgctcaaccgctactgggacgataacgacaccccgcgtcccgagtcctggcttgacgacgtcaaaaccgccaaaagcaacccgaatcgtccggcaaccgagatctatcgcgacctgcgctccgccgccgcctccggctgggatttcagctcccgctggatggacaatccgcagcagctcgccaccattcgcaccacctcgattgtcccggtcgatctcaatgccctgatgttccatctggagaaaaccctcgcccgcgccagcaaggcatccggggacagcgctggcgctacgcagtacgatgcgctggctaacgcccgccagcaggccatcgagaaatacctgtggaatgataaagagggatggtacgccgactacgatctgaaaagccacaaggtgcgcaatcaactgaccgcggcggcgctgttcccgctgtacgtcaatgccgcgtcacgcgagcgggcgacgaaagtggccgccgccgccgagtcgcgcctgcttaaacccggcgggctgaccaccaccaccgtcaacagcggccagcagtgggacgcccccaacggctgggcgccgctgcagtgggtggcggtcgaggggctgcaaaactatggccagcagaagatcgccatggaggtcacctggcgcttcctgaccaacgtgcagcatacctatgacagtaagcaaaagctggtggagaagtatgacgtgagctcgaccggcaccggcggcggcggcggggaatatccgctgcaggacggctttggctggaccaacggcgtcaccctgaagatgttggatctgatctgcccgcaggagaaaccctgcgatgcgctgcccgctacccgtccggcgacaaccccttcaccgcaggacaaacctgttgcggcgcccgcggctaacgaccccgcccctgcggaaccgcaaaagaccggctcctga

SEQ ID NO: 6890 - DNA, 1026 bp, Klebsiella pneumoniae
ctcatctaccccattcggttctatttatacccgcattggtctaagccacagggagataaccaggtcatgacggagtcaccgcaaacgcaatctgaaatctctattcaccagttggtggtcgggaaacctgcaaacgatggcaatattcctgctcagtgtgaactgctgcgctgttcgttgcaggaaggtatggatattttgctctggaggggccattttgcgcggcctgagacgttgcagctacacgacgatctgggcaggattaacttctcgtgcatcctggaaggcacatcgcgctttgcgattcagggactccggcgccacaccgactgggagcttgcgcgcaatcgccattacattacccatacgccagactgtcgcggcagcgcctcctattgtggccgattcgagagcattaccctctccttcagccctgcaaccctcgcgctgtgggtgccggatattagcgcggacattaagaataagatcgactcccactgctgttgccagcagcagcgttgtaatgctgaaacccacttaacggctcaggccttgcgtcacgcgctgatgcgcatgcacggcggcttcagtcatgaacaaaagccgtcgacgctatggttgcaggggcaaagtctggtcatgctcagtctggtgctggatgaacatcgcgaagacgccagttgcctctcctgccacttcaacccgatggaacgccagaaactgctgcgggcgaaggatctgctgctggctgatctgacgcaagcgccgggcgtcgcggagctggccagagagtccggtctgagcgttctcaaaattaagcgaggcttccgcgttctgttcaacaacagcgtctatggcctgtttcaggctgaacgaatgcaggaagccagaagacgcctggccaacggcaatacctccgtcatgacggtggcggccgatctgggctatgccaacgccagccatttctctgccgccttccagaaacagtttggcgtaaccccttcgacctttaaacgcgtgatgtaa

SEQ ID NO: 6891 - DNA, 1278 bp, Klebsiella pneumoniae
tggagcgacccccatatgtcccttaccgacgcgaaaatccgcactctcaaaccttctgataaaccctttaaagtctccgattcccacggtctgtatctgctggtcaagccgggtggctcacgtcactggtatctcaagtaccgtattaacggtaaagaatcgcgcattgcgctgggtgcctatcctgccgtctccctctctgatgcgcgacagcagcgtgaaggtgtccgtaaaatgctggcgctgaatatcaacccggtacagcagcgggctgctgaacgtggctcacgaacaccggataaagtttttaaaaacgtggcgctggcgtggcataaaagtaaccggaaatggtcgcagaacaccgctgaccgtctgcttgccagcctgaacaatcacatctttccggtcattggcaacctgcctgtatcagaacttaaaccccgtcatttcattgacctgctgaaaaggatcgaggaaaaaggtctgctggaagttgcgtcccgcacgcggcagcacctgagtaacataatgcgccatgcggttcatcaggggttaatcgatacgaacccggcagcaaatcttggcggcgtgaccacacctcctgtcagacggcactatcctgccctgccactggagcggctgcctgaactgcttgaacgtattggggcatatcatcagggtcgtgaactgacgcggttgggcgtcctgctgatgctgcatgtgttcattcgctccagtgaactgcgtttcgcccgctggtcagagattgatttcacaaaccgagtctggacgatacccgcgacgcgagaacccattattggagtgcgttattccggccgcggggccaaaatgcgaatgtcgcatatcgtccccctctcagaacagtccatcgccattctgaaacagattaaggatatcaccggtaataatgaactgatcttccccggcgaccataacccgtataagccaatgtgtgaaaacacggtcaataaggcactgcgggtgatgggctacgacacgaaaaaggatatctgcggtcacggcttccgggcaatggcatgcagtgcgctgatggaatcgggtttatgggcaaaggacgcagtaaaacgccagatgagtcatcaggagcgcaataccgtgcgcatggcttatattcataaggcagagcacctagaagcccgcaaagcgatgatgcagtggtggtcggattatctggaagcatgccgagaatcttatgcaccgccttatacaattggtaaaaataagtttatcccatag

SEQ ID NO: 6892 - DNA, 1509 bp, Klebsiella pneumoniae
accgcacgccccggtgtcacgcgccggggcgtttgtgctaaactgcgcaccctttttttctgtggtgcgctgcccgtggctgaaaatactgtctatttccctgaagcgtttctcgctcaaatgcgcgcggcgatgccagcgcatctctctttcgacgactttatcgccgcctgtcagcgcccgctacgccgcagtattcgcgtcaatacgctgaagattagcgtcgatgatttcctctctctggttgccccctacggctggcagctcgcgccggtgccctggtgcgcagagggattctggatcgagcgagaggatgacgacgcgctgccgctgggcagtaccgccgaacatctcagcgggctgttctatattcaggaagccagttcgatgctgccggtcgccgccctgttcgccgataaccggcagcccgaacgggtgatggacgttgccgccgccccgggatcgaaaaccacccaaattgcagcccgaatgggcaacgcgggcggcattctcgccaatgaattctccgccagccgggtgaaggtgctgcatgccaacatcagccgctgcggcatcagcaacgtcgctctaacccacttcgacggccgggtttttggcgcggccttgcccgaaaccttcgatgccatcctgcttgacgccccctgctccggcgaaggggttgtacgtaaagacgccgacgcgctgaaaaactggtcgccggatagcaacctcgacatcgccgccactcagcgcgagcttatcgacagcgccttccatgctctgcgccctggcgggacgctggtgtattccacctgcaccctgaatcgtgaagaaaatcaatcggtcattgagtggctgctgtcccgctatccgcaggcggtggagatcctgccgctgggagagttgtttcccggcgcagccgacgccttaaccgcggaaggttttctgcacgtttttccgcaaatttacgattgcgaaggcttctttgtcgcgaggttgcgcaaaactgcggcgatcgatccgctcccggcgccaggctataaggtcggtaaattcccgtttacgccgctgaaggaccgggaggccgccgcggtaactgccgccgccagggctgttggcctggagtgggacgcaggccatacgctgtggcagcgggataaagagctgtggctgtttccgctggctttggagcccctgttcggcaaggtgcgcttttctcgcatcggcgtgcgcctggcggagctgcacaataaggggtaccgctggcagcatgaggcggttatcgcctttgccgcgccgcagcgcgccttcgagctgtcgcaggaggaagcggaagaatggtatcgcgggcgcgacgtctatccgcaaaccgcgcctgggcaggatgaaaccattgtgaccttccagggcgtcccgctgggcctggcgaagcgcgtcggctcccgactgaagaacagctatccgcgcgaactggtgcgcgatggaaaactttttgccggcaaggtgtga

SEQ ID NO: 6893 - DNA, 582 bp, Klebsiella pneumoniae
tattcatcgtttgctgatttcattgcacttaattcttttcacaataccgcttatcctcagggtcagcaattttgctctcttttgactatggatacaggacaccccatgagcatcacaatccgccaggccaccccggacgacgccaccgctatctacgacatgatttatgaactcgcggtctacgagaaagcccccgaagaggtagtgacgacgccagaggagatcagagagacgctgtttgccagcggcagcaaaaccgaagcgctgatctgcgaggtggcgggcaaagcggtgggctacgcggtgttcttcaccagctactccacctggcttggacgcaatggtatctatatggaggatctgtacgtcacccccgactatcgcgggatcggcgccggaaaagcgctgctgaaaaccatcgcgcaatatgctgtacaacgtcagtgcgggcgtctggagtggagcgtgctcgactggaaccagccggcgattgatttctatctgagcattggcgcgcagccgcaggatgaatgggtgcgttatcgcctcactggcgatgcgctgcgggcctttgcggagtaa

SEQ ID NO: 6894 - DNA, 585 bp, Klebsiella pneumoniae
aaaaatccacctgtggatatactggcaaaacgtcatccttctctgctaaagggggattatcctgcaggtgttatctggcaacaggcaaaagattattgtcagtggttaggtataaaatccggtaaaaaaattgatttgccgacagaggcacaatgggagtttgcagcaagatccagaggtcagtatcttccgtttgctactaacaatggtgagttttcaccaggaaaaaatgtcccaagccaggatgaactgaataaatacactgacgggatggggcttcccatttatccagtaggtaaatacccatcaaatcccttagggctgtatgatatgggattgagtggttcagaatggaccaatgactggtatgcagcagattattactccaactctccggtaaagaatcctcagggaccagagcaagggaccgagaaagtgttgcgtgggaatgttggcggcgacagacagtacgcattgactatgtttagacaatctgcttcaccactcccagaagaagttgatggtgactatgaaaaatatggtgttggtccgcagtatgttttccgttgcgtcatcaataaataa

SEQ ID NO: 6895 - DNA, 333 bp, Klebsiella pneumoniae
agtagccgaccagatgcagcggcacgtccgccccggcaaggcgggtcgcttcgcgtaccgccagacgcgtcgccgccagccaggtctcccagtcaaccgccgttaacgcccccggcgcggtgccatgtcccggcaaacgcggcaccaccgccacataaccccgctgctgccagagttgcgccagatagcgcacgctgtagggcgaatcggtcaggccatggaggagcaccacgctgccgcgcggcttgcccagcggcatcaacacaaaagaacggttccagtcctgctgaaactgccccggccagacccggctgtgacgataaaagcggttga

SEQ ID NO: 6896 - DNA, 9507 bp, Klebsiella pneumoniae
gaaacgggaccgattatggataacttgcgcttctcttctgcgccgacagcagattccattgatgcatcgatcgctcaacactacccggactgcgaacctgtcgcggttatcggctacgcctgccattttcctgaatcgccggatggcgaaacattctggcaaaatctgctggaaggtcgtgaatgcagccgacgctttacgcgcgaagagcttctggccgtcggtctggatgccgccatcattgacgatcctcattatgtcaatatcggtacggtgttagacaacgccgactgcttcgacgccaccctgtttggctattcgcgacaggaagcggagtcgatggacccgcagcagcgcctatttttgcaggcggtctggcatgcgctggaacatgccggttatgcccccggcgccgtcccccataagaccggcgttttcgcctcttcccggatgagtacctaccccggtcgcgaagcattgaacgtgacagaagtcgcgcaggtaaaaggtctgcaatctctgatgggcaatgataaagactatattgccacccgcgccgcgtacaaactcaacctgcacggcccggcgttatcggtacagaccgcctgctccagctcgctggttgccgtgcatctggcctgtgaaagcctgcgcgcaggcgaatccgatatggcggttgccggcggcgtggcgctctctttcccccagcaggcaggctaccgctaccagcccggaatgattttctctcctgatggtcactgtcgtccctttgacgcctcggctgagggcacctgggccggtaacggtctcggctgcgtggtgctgcgtcgcctgagagacgcgctgctgtcaggcgatccgattatctcggtgatcctctccagcgcggtcaacaacgacggcaacagaaaggtcggctataccgccccttccgtcgcagggcaacaggcagtcatcgaagaggcgttaatgctggcggccatcgacgacaggcaggtaggttacattgaaacccacggcaccggcacaccgctgggcgacgcgattgaaattgaagcgttacgcaacgtctatgcgcctcgcccgcaggatcagcgctgtgcgctcggttccgtgaaaagtaacatgggccatctggataccgcggcgggcattgccggactgctgaaaaccgttctggcagtcagtcgcgggcaaattcctccctttctgaattttcacacccccaacccggcgctgaaacttgaagagagcccctttaccataccggtgtcggcacaggcatggcaggacgaaatgcgctatgcgggcgtctcctcctttggtattggcggcaccaactgccatatgatcgtcgcctcgctgcccgacgcgctcaacgcgcgcctccccaatacggatagcggcagaaaaagtaccgcgctgctgctcagcgcagccagcgacagcgcgttgcggcggctggcgacggattatgccggggcgctgagagagaatgcggatgccagctctctggccttcacagccctgcacgcgcgccgtctcgatctccccttccgcctggcggcgccattaaaccgtgaaaccgccgaggcgctcagcgcctgggccggtgagaaatcgggggcgctggtttacagcggccacggcgccagcggcaagcaggtgtggctgtttaccggccagggctcgcactggcgcactatgggtcaaacgatgtaccagcactcaacggcgtttgccgacacgctggatcgctgtttttccgcctgtagcgaaatgctcacgccgtcactgcgcgaagcgatgtttaaccccgattcggcgcaactggacaatatggcctgggcgcagccggcgattgtcgcgtttgaaatcgcgatggcggcgcactggcgtgctgaaggactgaagccagacttcgccattgggcattccgtcggtgaatttgccgctgctgttgtctgcggacactatacgattgaacaggtcatgccactggtttgtcggcgcggcgcgctaatgcagcagtgcgcaagcggcgcgatggtggcggtatttgcagacgaagacacgctgatgccgctggctcgccagtttgagctggatctcgccgccaataacggtacgcaacatacggtattttccggaccggaagcccgtctcgcagtattttgcgccacgctctcgcagcatgacattaactatcgtcgcctgagcgtaaccggtgcggcgcactccgctttactggagccgatactcgatcggttccaggacgcctgcgcgggactgcacgcggagccggggcaaataccgattatttccacgctcaccgccgacgtcattgatgagtcaacgctcaaccaggcggattactggcgccgacacatgcgccagccggtgcgttttatccagagtattcaggtggcgcatcagctcggcgcccgcgtttttctggagatggggcccgatgcccagttggttgcttgcgggcagcgcgaataccgcgataacgcatactggatagccagcgcccggcgtaacaaagaggcgagcgatgtcctcaatcaggccctgctccagctttacgctgccggcgtcgccctaccgtgggccgacctgctggcgggcgatggacaacgtatcgctgcgccatgttatccgtttgatactgagcgttactggaaagagcgcgtctccccggcctgcgagcctgccgacgcagcgctgtctgccgggctggaggtggcgagtcgcgccgcgacagcgctcgatctccctcgcctggaagcgcttaaacagtgcgccacgcgactgcacgccatctacgtcgatcaactggtacaacgctgtaccggcgatgccattgagaacggcgtggacgccatgaccatcatgcgccgtggacgtctgctgccccgctaccagcagctactccagcgcctgctgaataactgcgtggtcgacggcgattaccgctgcaccgacgggcgatacgtccgcgcccgccccattgaacatcaacagcgggaatcactgctgacggaacttgccggttattgtgaaggttttcaggctattcccgacaccatcgcccgtgccggcgatcggttatatgaaatgatgagcggcgcggaagaaccggtggcgattatcttcccgcaaagcgcctccgacggcgtggaagtgctgtatcaggaattcagctttggccgctatttcaaccaaatcgccgccggggtattacgcggcattgtccagacgcgtcagccccgccagccgttgcgtattcttgaagttggcggcggaaccggcggcaccaccgcgtggctgctgccggaactcaacggcgttccggcactggagtaccatttcaccgatatctcggcgctgttcacccgtcgcgcccagcagaaattcgccgactatgattttgtgaagtatagcgagctggatctcgaaaaagaggcgcagtctcagggtttccaggcacagtcttacgatcttatcgtggcagcgaacgtgattcacgccacccgccatattggccgcacgctcgataatctgcgccccctgctcaagccgggcgggcgcctgctgatgcgcgaaatcacccagccaatgcgtctgtttgacttcgttttcggcccgctggttcttccgctacaggatctcgacgcccgcgaaggtgagttattcctcaccaccgctcagtggcaacaacagtgccgccacgccggattcagcaaagtggcgtggctaccgcaggatggcagcccgaccgccgggatgagcgaacatatcattctcgccacgctgcccggtcaggcggttagcgccgtaacattcaccgcgccatcagaacccgtgttggggcaggcgctgacggataacggtgattatctcgccgactggtctgattgcgcaggtcagcccgaacggtttaacgcccgctggcaggaggcctggcgtctgctttcacagcgtcatggcgacgctctgcctgtggaaccgccccccgtcgccgccccggagtggctggggaaggttcgcttaagctggcaaaacgaagccttttcccgcggtcagatgcgcgttgaagcccgtcatcctgctggcgagtggctgccgctatcgcccgccgcgcctcttcctgcgccgcagacgcattatcaatggcgctggacgcccctcaacgtcgccagcattgaccaaccgcttacctttagcttcagcgccggtacgcttgcgcgcagcgacgagctggcgcaatacggcatcattcacgatccgcacgcctcttcgcgactgatgattgttgaggagagcgaggatacgctggccttagcggagaaagtgatagcagcgctcaccgccagcgcagccggattgattgtggttactcgccgcgcgtggcgagtcgaggaaaatgaagcactctctgcatcccatcacgcgctatgggccttgcttcgagtcgcggccaacgaacagccggaacggttgcttgccgccatcgatctcgccgaaaacaccccgtgggaaacgctgcatcaagggttgagcgcagtctcactatcacagcgctggctcgccgcacggggtgacaccctttggctcccttcactggcgcccaatacgggatgcgccgctgaattaccggcaaacgtgtttaccggcgatagccgctggcatctggtgaccggagcgtttggcggattaggccgccttgccgtgaactggctcagagaaaaaggggcgcgacgcatcgccctgctggcgccgcgcgtggatgagtcatggctacgcgacgtggagggcgggcagacgcgcgtctgccgttgtgatgtgggcgatgccgggcaactggccacggttcttgacgatctggcggccaacggcggcattgccggagcgattcatgccgctggcgtattggctgacgcgcccttgcaggagcttgatgaccaccagctggctgccgttttcgcggtaaaagcgcaggcggcaagccagctgttgcaaaccctgcgcaaccacgacggacgctatcttattctctactcttccgctgccgccaccctcggcgcgccgggtcagagcgcccatgcgctggcctgcggctacctggacgggctggcccagcagttttccacccttgatgcgccgaaaacgctctctgtcgcctggggcgcatggggagaaagcggtcgggcggccacgccggaaatgctggcgacgctcgccagccgaggtatgggcgcgttaagcgatgccgaaggctgctggcacctggaacaggcggtgatgcgcggcgccccgtggcgactggcgatgcgcgtttttaccgacaaaatgcccccgttacaacaggctctgtttaacatcagcgccacagaaaaagccgcaacgccggtcattcctcctgctgatgacaacgcctttaacggcagcctgagcgatgaaacagcggtgatggcatggctgaaaaagcggattgcggttcagctaaggctgagcgatccggcgtcactgcatccaaaccaggatctgttgcaactcggcatggactcgctgctcttccttgaactcagtagcgatattcagcactacctgggcgtacgcatcaatgcggaacgggcgtggcaggatctgtctcctcatggactcacgcagcttatctgttctaagccagaggcgacgcctgccgcttcgcagccggaagtgttgcggcacgacgccgacgagcgttatgcgcccttccctttgacgcccattcagcacgcctactggctggggcgaacccacctcattggctatggcggcgtcgcctgtcacgtcctgtttgagtgggataaacgccacgatgagttcaatctcgccatactggagaaagcatggaaccagctcatcgcacgccacgatatgttgcgtatggtggttgatgccgacgggcagcagcgaatcctggcgacaacgccggagtatcacatcccgcgtgacgatctgcgcgcgctttccccggaagaacagcgcatcgcgctggaaaaacggcggcatgaactgagctatcgcgttttgcctgccgaccagtggcctctttttgagctggtggtcagcgaaatcgacgattgccattaccgtctgcatatgaacctcgaccttttgcagtttgatgtgcagagttttaaagtcatgatggacgacctggcgcaggtctggcgcggtgaaacgctggcgccgctcgctattaccttccgtgattatgtgatggctgaacaggcgcgccgacagacatcggcatggcacgatgcctgggattactggcaggaaaaactgccgcaactgcccttagcgccagagctgccggtggttgagacgcccccggaaacgccacacttcaccaccttcaaatcgacgatcggcaagacagaatggcaggccgtgaaacagcgctggcagcagcaaggcgtcacaccgtctgccgcgctgctcacgctgtttgccgccacccttgagcgctggagccgtaccacaacatttacgctgaacctgacgttcttcaatcgccagccgatccatccgcaaatcaaccagttgattggtgattttacctccgtcacgctggttgattttaacttctcagcgccggtgacgttgcaagagcagatgcaacagacccaacagcgcctctggcaaaacatggcgcacagtgaaatgaacggtgttgaggtgatccgtgagctgggccgcctgcgcggatcacaacgtcaaccgctgatgccggtagtgtttaccagtatgctggggatgacgctggaaggcatgactatcgatcaggcgatgagccatctgttcggcgaaccctgctatgtattcacgcaaacgccgcaggtctggctggatcatcaggtcatggagagcgacggcgagttgatgtttagctggtactgcatggacaacgtgctggaacccggcgctgccgaggcgatgtttaatgactattgcgccatcctgcaagccgtcatcgccgcccctgaaagcctgaagactctcgccagcggcatcgccgggcacattccccgccgacgctggccgctgaacgcgcaggcggactacgacctgcgggatattgagcaggcgacgctcgaataccccggcatccggcaggccagagcggaaataaccgaacagggcgcgttgacgctggatatcgtgatggccgacgatccgtcgccatcagcggcgatgcctgatgagcacgaacttacccaactggcgctgccgttgcctgagcaggcgcagcttgatgagctggaggcgacctggcgctggctggaggcgcgtgcgctacaggggatcgcggctacgctaaatcgtcacggcctgtttaccacgccggagatcgcccatcgctttagcgcaatagtacaggcgctgtccgcgcaagcgtctcaccagcgtctgctgcgccagtggctacagtgtctgacggaaagagagtggttaatccgcgaaggtgaaagctggcgctgccgcattccgctcagcgagattcctgagcctcaggaagcgtgcccgcaaagccaatggagccaggcgctggcgcagtatctggaaacctgcatcgcccggcacgacgccctcttctccgggcggtgttctccgctggaattgctgttcaacgagcagcatcgcgttaccgacgcgctgtatcgcgacaaccccgccagcgcctgtctgaatcgctataccgcgcagattgccgccttgtgcagcgcagaacggattctggagattggcgccggaaccgcagccactaccgcgccggtgctgaaggccacgcggaacacgcggcagtcgtaccacttcacggacgtctccgcgcagttcctcaatgacgccagagcccgtttccatgatgaatcgcaggtgtcttatgccttgttcgacatcaaccagccgctggatttcaccgcccacccggaggcgggttacgacctgatcgttgccgtcaatgtgctccacgacgccagccatgtcgtccagacgttgcgcagattaaaactgttgctgaaagccggcggacgtttgctgatcgttgaagcgacggagcgaaacagcgtattccagctggcgagcgtgggctttattgagggattaagcggataccgcgatttccgccgccgggatgagaaaccgatgctcacccgctccgcatggcaggaggttctcgttcaggccgggtttgcaaacgagctggcgtggcccgcgcaggaatcgtcgccgctgcgccagcatctgctggtggcgcgttcgcctggcgtaaatcgcccggataaaaaagccgtgagccgctatttacagcagcgctttggcaccggtctgcccattttacagatccggcaaagagaagcgttatttacgccgctgcatgccccgtctgatacgccgactgagccagccaaacccacgccagttgccggggggaatccggcgctggaaagacaggtggctgaactctggcaatcgctgctgtctcgccccgtggcaaggcatcacgactttttcgaactgggtggcgacagcctgatggcgacaaggatggtcgcgcagctaaaccggagagggattgctagggctaaccttcaggatctgttcagccattcgacgctgagcgacttctgcgcccatctacaggcggctacgtcaggagaggacaacccgatacccctttgccagggcgacggtgaggaaaccctgtttgtcttccacgcttcagacggcgatatcagcgcctggctgccgctcgctagcgcgttgaacaggcgcgttttcggcctgaaagcaaaatcgccgcagcgctttgccacgctcgaccagatgatcgatgagtatgtcgggtgcatccgtcgtcagcagcctcacggcccttatgtgctggcgggttggtcgtatggcgcgtttcttgcggcgggcgccgcacagcgcctgtacgccaaaggcgagcaggttcggatggtgttaatcgatcccgtgtgccgacaggatttctgttgcgaaaaccgggcggccctgctgcgcctgttagccgaaggacaaacgcctctggcactgcccgaacatttcgaccagcagacgcccgacagccagcttgccgactttatcagcctcgctaaaacggccggtatggtgtcgcaaaacctgacgctgcaagcggcagaaacgtggctcgacaacatcgcgcatctgctgcgtttactgactgagcatacgccgggcgaaagcgttccggtcccctgtctcatggtgtatgccgccgggagacccgcgcgctggacgccagcagaaaccgagtggcagggctggataaacaacgccgacgacgctgtgattgaagccagccactggcaaatcatgatggaagccccccacgttcaggcttgtgcgcaacacattacgcgctggctttgcgcaacctcaacgcaaccggagaacacgttatga

SEQ ID NO: 6897 - DNA, 609 bp, Klebsiella pneumoniae
tattttctgccgggccgctggcgtcggttcggttttcgtttacactgccatgatttagcatcttccagggaaatgattatgttgcaatatttaaaccagtgctcaaggggacgcggtgcctggctcctgatggcgttgaccgcttttattctcgaactcgttgcgctgtggttccagcatgtgatgctgctgcagccgtgtgtcatgtgtatttacgaacgctgcgcgctgttcggcatcatgggcgcggggctggtcggcgccatcgcccccaaaacgccgctgcgctatgtcgccatggtgatctggttgtacagcgcaatacgtggactgcagctggcgtgggagcatacgatgatccagctgcacccttcgccgttccagacctgtgatttcgccgcccgcttcccaacctggctgccgctggataaatggctgccgcaggttttcgtcgcgtccggcgactgttcagtgcgtcagtggcaatttctgtcgctggagatgccgcaatggctggtcggtatttttgctgcctatctgctggtcgccatcctggtgatcattgctcagcctttcaaagcgaaaaaacgcgatctgtttggccgttaa

SEQ ID NO: 6898 - DNA, 792 bp, Klebsiella pneumoniae
atgacgccgccgcgagggcggattgtgcgccagcatcgtgccggcggccaaaatgaggtactatcgccagccactccttcttcgggccgcctgatgtccaccattatcgatacctttgtcgcgccgccgtgtcgcgaacagatcaccctcttgtatcaggacgaacacctgctgctgatcaataagcccgccgggctgctgagcctgtcgggcaaagatccgcgcaacctcgactccgtgcatcatcggctggtacagcgctttccgggctgcaccctggtgcaccgcctggacttcggcacctccggcctgatggtgatcgcccgcaacaagggcattaacgccttgctgtgccagcagttcagccagcgcacggtggacaaggtctatacggcgctgctgtgcggccacctggcggaagacgaggggatagtggaggcggcaatcgccaaagatccggcccgtttcccgcgcatggcgctctgcgcccgccacggcaaaccggcgcgttcgcgctatcgggtcataaaccgcctgtatcaggcgcgagaaggcgaaagggcgctggcgttaacccgggtgacgctcaccccggagaccggacggacccatcagctgcgtattcactgccagctgctgggctatccgatccttggctgcgatctgtacggtggccgggagctgcccggcacggaacaggctccgcggctgatgctgcacgccagcgaactgcgctttgtccaccccgtcagccatgagccgatgcatatccagcaggcgagcccgttttga

SEQ ID NO: 6899 - DNA, 294 bp, Klebsiella pneumoniae
ccgaggtggccattaaccgtcttaacgcgctactggacgagccggtggaggatcccagtgagcaggccctgcgggccgatgccggcaatatgctgctcgagacctatcagcggcggcttcactataacgacaatgacgaggggcaggatgtcgggctggagctggctaagcgcgccaggctggagaaatatatgcaacgagaggtcattatcgcccagcgtcaggagctgttccggctgcgccgcgcccataacatcagcgatatcactttttatgaggtgctgcgggagatag

SEQ ID NO: 6900 - DNA, 273 bp, Klebsiella pneumoniae
attatggctttactcgacttttttctctcgcgaaaaaagaacacggctaatattgcgaaagaacgcctgcaaatcatcgtcgccgagcgccgccgcggagacgcggagccgcattacctgccgcagttacgcaaagatatcctggaagtgatctgtaaatacgtacagatcgacccggagatggtcagcgtgcagctggagcagcgggacggggatatatccattcttgagctgaacgtgaccctacccgaaacggaagagtcgaaatcctga

SEQ ID NO: 6901 - DNA, 360 bp, Klebsiella pneumoniae
ccatccaagtttcatacgcagggttaccatccaatcataacgacgcctcagcctgttctactttactgtagtaataagcatcgcatctacgctttgtcgcacactcattcgaaattggtggtcattatggtggtcttgacaggaagagcaacaaggtttagcttatttattagccagttattggcttgggcgatcccagtcagaggagccaaatttaaaaagcctgctttcgagcaggctttttgcttttcagcgccggtacttctgccggaaggcgaatggccaccctccggcgattgcggctttagcgtaaactctcttccttcagatctatctcccgcagcacctcataaaaagtga

SEQ ID NO: 6902 - DNA, 1779 bp, Klebsiella pneumoniae
atcagttggttgcaaaacaatgccggagctatggtgctaaagaaaaaaacgaagtccgccgccagtttcaccccgattcgcttcgggttactgtgtgtggccattctcggttgtctggggctgctgctggtccgcgtgggctggctacaaattatctcccccgataacctggtaaaacaagaagatatgcgctccctgcgcgaagaacccgtagcggttgagcgggggatgatcagcgaccgggaaggacggccgctggcggtgagcgttccggtcagtgctatctggatcgacccgcagaccactatggagaagggcggtgtgggctatgggccccgctggcaggcgatggccgaagcgctgcacctcaacctcggagagctggcccagcgggtacagagtcatccccacgctcgctttctctatctggcgcgtcagatcaatcccgagcaggcagagtggattgataaactgcatctgccgggcgtctacctgcgcgatgaatcgcgacggttctacccggcgggccacgtggctgccaatctgctgggctttaccaatgttgataatcagggcatcgaaggggtggagaaaagctttaacgcccagttgaccggtaaacccgggcgacgtctggtgcgtaaagataaacatggcaatgtcattgagaacattaccgaagtgccgccggttccggcgcataatctgcagctgagtattgatgaacgcctgcagacggtgacggaagacgccctcgacaacgccgtccgctggaacaaagcagagtccggggcggcggtattgatcaaaattgataccggcgagatcctggcgatggccagctatccggacttcaatccgaacaatcgcgatagcgcgacgctggatgattttcgcaaccgggccatcagcgacaccttcgagcccgggtcgacggtcaaaccgctggtgatcatgactgcgctacagcaggggattgtccagccagacagcgtggtggatacccatccgttcgtcctcgatggccatcgtattcgcgatgtgggctattatccggagctgagcctgaccgggatcctgcagaaatccagcgataccggcgtgtcccacctctcgctcgccatgccggtgcagcatctgatcgatacctataaagctttcggctttggcgaaccgacggggctggggttgaccggcgaaagcgccgggctgatgccgcatcgccgctactgggggcaactggatcgcgccaccttcgccttcggctatggtttgatggtcaccccgctccagctcgcccacgtctacgccaccatcggcggcttcggcattgcgcgaccactgtcgattacccgcatcgatccgccggtgatgggcacgcgggtgatgccggagagtattgtgcatagcgtggaacatatgatggagagcgtggcgctcccgggcgggggcggtaccaaagcggcggtacgcgactaccgggtggcggtaaaaaccggcacggcgaagaaaatcggcccggacggcaaatatatcgataagtatgtggcctataccgccggcgtggcgcccgccagtcgaccacagttcgcgctggtggtggtgatgaacgatccgagcaatggttcctattacggcggcgctgtgtccgcgccggtcttcagccagatcatgggcgatgtcctgcggctggagaacgtcatgccggacggcatgccgcaaggggcggagaatctgatcgtaatgcacgatagccacccacaggggccggcgctgtaa

SEQ ID NO: 6903 - DNA, 561 bp, Klebsiella pneumoniae
ttacccgtcactatgcaatttaatatccctacgttgcttactctgtttcgcgtcatcctgatcccgttttttgtgctggcgttttatctgccctttagctgggcgccgtttgcctgcgcgctgatcttctttgttgccgcggtaaccgactggtttgatggtttcctcgctcgtcgctggaatcagagcacccgttttggcgccttcctcgacccggttgccgataaagtcatggtggctatcgccatggtgctggttgccgaacactatcacacctggtgggtcacgttaccggcggcgaccatgattgcccgtgagatcattatctccgcgctgcgtgagtggatggcggagctggggaaacgcagcagcgtggcggtctcgtggattggcaaagtgaaaacgaccgcccagatgaccgccctggtatggatgctgtggcgtccttatccgtgggtggagtgggccgggatcgcgcttttcctcgtggcggcggtgctgacgctgtggtcgatgctgcagtatttgaacgcggcgcgcggcgatttgcttgatcagtga

SEQ ID NO: 6904 - DNA, 2355 bp, Klebsiella pneumoniae
gccggatccacaccgcggcggcgctggcctgactttttattctgtagagagacgatgttcatgaaagtagatatcgatacccaggatgtacgatacgccgacgcctggctgggctttcgcggtacggcgtggcaaacgcagatcgacgttcgcgactttattcagcataactacaccccttacgagggcgatgagtctttcctcgccgacgcgacgccagcgaccaccgccctctgggagcaggtgatggccgggatccgcgtcgagaacgccacccatgcgccggtggatttcgacaccaatgtcgccacctccatcaccgcccacgcggcgggctatatcaaccagccgctggaaaagatcgtcggcctgcaaacagaccagccgctgaagcgcgccctgcatccttttggcggcatcaagatgatcaaaagcgccttcgaggcctatggtcgcgaaatggatcctgactttgagtatcagtttacggcgctgcgtaagacccacaatcagggcgtttttgacgtctattccccggatatgctgcgctgccgcaaatccggggtgctgaccgggctaccggacggctatggccgcggacggatcatcggcgattaccgccgcgtggcgctgtacggcattcgctacctggtccgcgaacgtgagctgcagtttgccgacctgcagccggcccttgagcgcggcgaggcgctggaggccaccctgcgcctgcgcgaagagctggccgaacagcggcgcgcgctgctgcagatgcaggagatggcggcccgctacggctgcgatatctctcacccggcgcgcactgcccgggaggcggtgcagtggctctacttcgcctacctggcggcggtgaagtcgcagaacggcggcgccatgtcgctggggcgcacggccaccttcctcgacatctatatcgaacgcgatctgcgcgccggtttattgaatgaggagcaggcccaggagctcattgatcacttcatcatgaagatccgcatggtgcgtttcctgcgcaccccggaatttgattcgctgttctccggggatcccatctgggcgacggaggtgctgggcggcatggggctggatggtcgcaccctggtcagcaaaaccaccttccgctatctgcatactctgcacaccatgggcccggcgccggagccgaacctgaccgtgctctggtcgcaagcgctgccggcggcgtttaaaaaatatgccgcccgggtctctatcgccacctcgtcgctgcagtatgagaacgacgatctgatgcgcagcgattttcacagcgacgactacgccatcgcctgctgcgtcagcccgatggtgatcggcaagcagatgcagttcttcggcgcccgcgccaatctcgccaaaacgctgctctacgcgattaacggcggggtggatgagaaactgaagattcaggtggggccgaaaaccgcaccgttgcgcgatgaggtgctggactacggcaccgtgatggccagcctcgaccactttatggactggctggcggtgcagtacatcagcgcgctgaacatcatccattgcatgcatgataagtacagctacgaggcggcgctgatggccctgcacgaccgcgacgtctaccgcacgatggcctgcggcatcgccggcctgtcggtggcggcggattcgttgtcggcgataaagtacgcccgggtgaagccggtgcgcgatcaccacgggctggcggtggactttgtcattgaaggcgactatccgcagtacggcaacaacgacgatcgggttgatgccatcgcctgcgacctggtggagcgctttatgcgcaaaattcaggcgctccccacatggcgtcaggcggtgccgacccagtcgatcctgaccatcacctccaacgtggtatacggccagaaaaccggcaacaccccggacggacgtcgggcggggacgccgttcgctccgggggccaatccgatgcatggccgcgaccggaaaggggcggtggcgtcgctgacctcggtggcgaaactgccgtttacctacgccaaagatggcatctcgtataccttctccatcgtgccggcggcgctcggcaaagccccgtcagcgcaggaaaacaacctggtgggcctgctggacggctacttccaccacgaagagacggtggatgggggacagcatctcaacgttaatgtgctgaaccgggaaaagctgctcgatgcgatagaacacccggagcagtatccgaatctgacgatccgcgtctccggctatgcggtccgctttaacgcgctgacccgcgaacagcagcaggatgtgatctcccgaacgttcaccagccaactctga

SEQ ID NO: 6905 - DNA, 321 bp, Klebsiella pneumoniae
tatgagaggttcgaaatgataaacgaagatttattcattaagaatatacactcaaaaaatcaggacagaatatctgtagccatggtatatgacacgttatcaaaagaagcccacagaggttgtgggctgtattacgaaatatacgaaagctgttttatcggtcttttgcgcgatcatctttcagaacttaatgaagctgacgcaaatagattaagacgctatgccgagagtaaaggtacgaaaattgatgatgcgtcctacagtgaagcactggaagctgaaagggagtgcagggctgaaatataccgcgagcaaatgtaa

SEQ ID NO: 6906 - DNA, 186 bp, Klebsiella pneumoniae
tcagatacaacgcaggaaaatgcttaccacagcccggaagcccctttcccaggccggacaaggacagcggcgtcgcttttgtgccgggcggcggcgacaccttgcccggcctacgatccgtgcggcctgtcgttaatttatttaccgctgttgctgaaattttaccgccaggtcgaggatacttaa

SEQ ID NO: 6907 - DNA, 939 bp, Klebsiella pneumoniae
aatcagcaaacgatgaatattatgcatcctgtcctgcgccggattgacctcaacctgttgccggtctttgacgcggtatatcgctcccgctcggtacgcctggcggcggaagagctggcgatgagcacctcggcgctgagccatgcgctttcccggctgcgcagcgccctcaacgatccgctgttctaccgcgaaggccaccggatgtgccccagcgtctatgccagccagctggcgccctctatcgcttcggcgctgaagtttctcaaccaggagctgacgccgccggcggcgtttgtgccggccgccagcaccgactgcatgcagattgcgatcaccgatttcaccgcgttctgcgtctttccgacgctgatgcatcacctgcagcgtgaggcgcccgggctgcggtttgagctccgttatctgccccacagcccggcgctgaccgagctgctggcgggcgaggtcgacctggccctcgggttcaatacccctgacgagccagcccatcccgatcttgaggagattaactggctgcgggacgaatatgtggtcatcagccaggccaaccggacggcgctgaccctggacgcctaccttgcggcccgtcatctggtggtgaccccgtggaatgagcggcagggggtgctggactgtgagctggagcgacagggctattcgcggcaggtggcgatgaaaaccccctcgatgctgagcgcgccctttattattgagcagagcgacctgttgatggcgctgccccggcgggcggcggagacgatggcccgcgccgcccggctgaccattttcccgctgccgtttccggttccgccgtttgacgtcaagatttacgcccaccaacgcagcgggaaacgcgaggctacccgctggcttatctccctgttgcagacgctggtgggggagtccaccgcttcctga

SEQ ID NO: 6908 - DNA, 735 bp, Klebsiella pneumoniae
  unsure (258),(263): Identity of nucleotide at the above locations are unknown.
agcgctctgacccaaaggagatatacgatgaaaactcgctttcgtactcttattctggcttgcgtcattgcaagcccactggctcatgctggtattcccgtcgctgttgatgctgaccctatgcgggacgtgcagtgggcgcaggagttaaaacgctggatggaaacggccagacactaccagtcacaaatacaggcatataaagaccaactggcgacggccactggcgttcgtgatattgctgattttgttgaccangccanaggcctgaaagctgaacttgaaaagctgcgtaagcccggacaggcactgaatgacctgcttctctccggcggttcctccgggcagttcgatgcgttgtacgagaagtataaaattttcgacacctgcaacactgcgcaatcggggagttatgccaacgtatgcaagcagcaggtcatcaacaaggctatccagcttgagcaaaccgacgaggttcagaaccaggtaagccagaccctgggggaaataaacagtctctccaacagggtagcgttagccaaagattcgaaagaatctcaagaccttgcaaacagtattcagctaaaatctgtcatgctgaacacgcttaccacccaatgggaaatgagcgtgaaagcagcagagaagcgcgaaaatgcgctagaagcggagcgtgttaagcagtggaatcagcagcagttaaacgcgccaactgctgaccttaataatttatga

SEQ ID NO: 6909 - DNA, 873 bp, Klebsiella pneumoniae
gcgatgctgaccgggctctatattaccctgcgctttgggcactttatctccctgatgctggcttttggctgcgtgctgtatggcgcctggtgggcgccggtaccgctgagacgcgtgctgatgctgcgcttttatccactactgcgcccgctgctactgatcggcgcgatctctacgctggcgctgtatctcctgcagggaggaataatgggcgagggctggacggatgtctggcgacccgccgtctggctggcggtggccgggacccgctttggtggagtgtggatctggcagatcctactggcgtggatcgcactcgcggtagtgtggatccgtccccgtcacggcgcccgccagctggtggccctgctggcggcacagctgctgctttccgccggggtagggcacgccgctatgcacgatggtctcaccggcgtgctgcagcggacaaaccacgctgtgcatctcttctgcgtcgccagctggttcggcggtctgttgccctttatctattgcctgcgcctggcgcaggggcgctggcggccggccgcggtctataccatggcgcgcttttcacgttacgggcatctggccgtcgccggcacgattgccagcggagcgctcaatgcgctgttgatccagggaggattgattggcgcatcgccgtggggacgcatgttgttgatcaaatgtgcgctggtcgccgggatggtggtaattgcgttagtgaacaggtatgttctggtaccgcgcatgtcggcaagcggttcgcaggcggaaagcctgatcctgcgaaccacgcaggctgaaatagggctgggcgcgctggcgctgctggccgtcagtctgtttgccacctgggaaccttattga

SEQ ID NO: 6910 - DNA, 759 bp, Klebsiella pneumoniae
attactatgacaaaccttgtaacgctggaaaatgtctcggtggcctttggccaacgccgcgtgttgtctgacatctcgctggctctcacgccaggcaaaatcttaaccctgctgggccccaacggcgccggcaaatcgacccttgtgcgggtggttctcgggctggtagcaccgacagagggtgttatcaagcgtgacgcacgcctgcgcatcggctatgtgccgcagaaactgcatctggacgccacgctgccgctgaccgttagccgcttcctgcgtttgcgcccgggcacccgtaaagacgacatcctgccggcgctgaagcgcgtgcaggcggggcatctgatcgatgcgccgatgcaaaagctctccggcggcgaaacgcagcgcgtactgctggcccgcgccctgctcaaccgtccgcagctgctggtgctggatgaaccgacacagggtgttgacgtcaacggccaggtggcgctctacgatcttatcaaccagctgcgccatgaactggactgcgcggtgctaatggtatcccacgatctgcgtctggtgatggccaaaaccgacgaagttttgtgcctgaaccagcatatctgctgctctggcgcaccggaggtggtctccatgcacccggagtttatctccatgttcggcccgcgcggcgcggaacagctggggatataccgccaccaccataatcaccgccacgaccttcaggggcgaattgtactgcgtcggggaaacagccgctaa

SEQ ID NO: 6911 - DNA, 990 bp, Klebsiella pneumoniae
atacttgtgacaccaatctttttccttaacggaacgaattgttgtgtagaaggagataatattatgtcaaaaaaatatcagccattgcttataactcattatatgtcaacatgggtcactataacggaagcagttgagatcactaccaaagccataaaacaaaaaattactcctagcgatatttatcgtcatgccttgagtggcaacatcctactatcggtctatttccagtctcctgtgatacttaagaagatacaaacttttaatggaaaaataaaattcaggcagtttgagggagacctacttgataaactatgcatgcttgacagggacggttttatttatggtcaaaatttaagactctgtacagaagccagatatgtttgtcctgtgcaacaaattatagatacccccctgataggctatgaatatgttttgattcagcgcatactggcacgtgaacttaaattcccctccccaattgtgggggcaagaaaaactaaccatggtattatagtaagattttcagaggagctttttcaaattttcgaaacgatgagttggaaagaacgcgtagaaaaacaaatttccagactacctaaaaacacagcattagatgtcataaaaaaactaacagaagtgacgaccataaaatataatcacaatgggtgttttcctctttatacattaccgcctgatgcctgttttgttattcgccacaccgaagtcgaaagactaattaatttatacaaaaaaagggagagtcatcccatttcaccttcccgtatgacaacaccgttatcacgcctgttttggctggcctgcaagcacaatgatattatcagcccactgctgaatcatccctataagctcctttctatttttgaacaatgggcatcaggcgatggcatcggggaaaaactggacgctgaaacactgaaaaatgcgctgaagcgtggttcgccatcttcgacatccttatccggctaa

SEQ ID NO: 6912 - DNA, 312 bp, Klebsiella pneumoniae
gaatcatcgacttgtttcaaaacgtgttcgtgtcaaaatcacgccagggatcatacaaataatgaggcatcaatgcgattaatcattcgtactattatcttggtggctatcttatggattggcgtattattgagcggttatggggtgttattccacagtgaggaaaacgtcggcggtctgggtcttaagtgccaatacctcaccgcccgcggagtcagcaccgcactttatgttcattccgacagcggagtgatcggcgtcagcagttgccctttgctgcgtaaaagcacaaccgtggttgataacggctaa

SEQ ID NO: 6913 - DNA, 468 bp, Klebsiella pneumoniae
ctggcaacgacggacactccgatgagcgaacaacctttctggcaacaaaaaacactggatgacatgagcgacgcggagtgggaatcgctgtgtgacggctgcggccagtgctgcctgcacaagctgatggatgaagacactgacgagatctacttcaccaacgtcgcctgtcgtcagctcaatatcaaaacctgccagtgtcgtaactacgcgcgtcgctttgagtatgagccggactgcatcaagcttacccgcgaaaatctgccgaccttcgaatggctgccgccgacctgcgcctatcgcctgctcccggagggcaaatcgctgccggcctggcatccgctgctgaccggctcaaaagcggcgatgcatggcgaacgcatctctgttcgccatattgcggtgcccgagtccacggtggtcgactggcaggatcatatcctcaatctgcctgacagggcgcgttaa

SEQ ID NO: 6914 - DNA, 576 bp, Klebsiella pneumoniae
gaaaaaacgacttggtggcaaatgatcattgacgtcgaaaaactggtaaaacaactgggtaagccttatcatgaaatttacagtcacgggttgattccttataaaacaaagccttacggtcctattgatgaagatgaagatgaagatgaagatgaagatgaagatgaagatgaagatgaagatgaagctgaattagatatgaaacgagaaggaattcttttggttttcaccaataattctgagaaaaatcttactgaaattacattaaggttagaagataaaggcaaaacagactgggtattccccaatccgatgccatttggtatggaaccggtgatgacccaattgtgggttagagagcgctttgggttgcccatgatttatgctgatgtggaaatcatcatgactatttatatgggggtgaaagaggtctatgctctgcctgctcctcatcaatatatcgctgccgtgtttacctataacaaagatttatttgtagaaaccgtgactttttacccactggaacgggccaaagagattcaggcagtactggagaaaaaacgattagagagttaa

SEQ ID NO: 6915 - DNA, 213 bp, Klebsiella pneumoniae
gaaaaaaagacttggtggcaaatgaatattgacgtcgaaacattggtgaaacaattaggcaaaccataccaagcgatttttgaacaaggtttgattccttataaaactaagccttatgattctgttggcgatagcactgctagattagatatgaaacgtgagggaatatatctagcgtttattaatgatctggaaaaaaacttaaagaagtga

SEQ ID NO: 6916 - DNA, 246 bp, Klebsiella pneumoniae
cagggagagacctgccagcctactggcgtgacgttgcgacagacccgttgcctcacacatgacttccacagcttcccgcttctggtctgtcgtcagaactttcggttcagggccacctgcaacgcttctttatccatcatgacttctgcaagcaactccttgaggtgggcgttctcttcttcaaatgacttaagacgtttcacctcaggcatttccatgccatcaaacttcttgcgccaagtgtag

SEQ ID NO: 6917 - DNA, 189 bp, Klebsiella pneumoniae
aagatgtttgcaggtttaccttcgctgagccacgagcaacagcaaaaagcggtcgaacgtatccatgagctaatggctcaggggataagcagcggccaggcgattgccctggtggcggaagagctgcgcgcaacgcataccggcgagcagatcgtcgcgcgctttgaagatgaggaggaggacgagtaa

SEQ ID NO: 6918 - DNA, 192 bp, Klebsiella pneumoniae
gaaggccgtgctatcctggcgacattgcgtactgatgcggagagtggagtgaaaaaattacggtgggttttactgatagtcatcatagcaggctgcctgttgctgtggactcagatgcttaacgtaatgtgcgaccaggatgttcagtttttcagcggcatttgcactattaataaatttattccgtggtaa

SEQ ID NO: 6919 - DNA, 738 bp, Klebsiella pneumoniae
tgcgcgctcgcctcctccccgtcggttggcaagcccggccaattccattacgcttattgttttgctctggagcgagccatgctgcgcgtcattgataccgaaacctgcggcctgcaggggggcatcgttgaaatcgcctcggtcgatatagtcgacgggcaaattaccaatcccatgagccatctggtgcgtcccgatcggcccatcagcccgcaggcaatggctatccaccggatcacggaagagatggtcgccgataagccgtggattgaggagattattccgcactatcatggcagcccgtggtacgtcgcgcataacgccagcttcgatcgccgggtgttgccggagatgcacggcgagtggatctgtacgatgaagctggcccgacgcctgtggccgggaatcaaatacagcaatatggggttatataaatcacgtaagctgaacgtgactacgccgccgggactgcatcaccaccgggcgctgtatgactgctatatcaccgccgcgctgctgctggatatcatcaatgtttccggctggacccctgacgaaatggccgatatcaccggtcggccggcgctgctgactacttttaccttcggcaaataccggggtaaggccgtcgccgagattgctgaaaacgatccaggctatctgcgctggttattcaacaatctcgaccgcatgagccccgaactgcgcctgacgctcaggcattacctcggggaatag

SEQ ID NO: 6920 - DNA, 1044 bp, Klebsiella pneumoniae
ctttggctcgctggtggccgtgaaagccggggagcaggcatgatcgacttcagtaacttctatcagctgatcgccaaaagcccgctgtctcactggctggagacgctgcctgcccaggtagccgcctggcagcgcgatgccctgcacggcaagtttcgtgaatgggagcgcgccgtagaatttctgccggagttaacgccctggcgtctggatcttctgcacagcgtcaccgccgagagcgaaacgccgctcagcgaaggccatcagcggcggatcgaaaatctgcttaaaaacctgatgccgtggcgcaaaggcccttattcgctgtacggcatcaatatcgataccgaatggcgatccgactggaaatgggagcgcgttctgccgcacctgtccgatctcactggccggactatcctcgacgtaggctgcggcagcggctatcacatgtggcggatgatcggcgccggcgcacatctggcggtcggtatcgatcccacccagctgttcctgtgccagtttgaagcggtgcgtaagctgctcggtaacgaccagcgggcgcatttgctgccgctgggcatcgagcagctgccggcgctggaggccttcgacaccgtgttctcgatgggggtgctctaccaccgccgctcgccgctggaccatctgtggcagctgaaagatcagctggcgccagggggggagctggtgctggagacgctggtggttgaaggagatgaaaatacggtgctggttccgggcgaccgctatgcgcaaatgcgcaacgtctattttatcccctcggcggcggccctgaaaatgtggctggagaagtgcgggtttattgacgtgcgtatcgtcgacgcctgcgtcacctcgacagaggagcagcgacgcaccgaatggatgacgaccgaatcgctggccgatttcctcgacccacaggatcagcgcaaaacggtggaaggctatccggcgccattacgggctgtgatcattgccaccaaaccggaaacccagcagtcgctggcgaaaaaagcgagataa

SEQ ID NO: 6921 - DNA, 1029 bp, Klebsiella pneumoniae
aaaatgaccgctaagaatatttccctcgaccgctataaacagcgtttctttggcgactttctagagcttcccggcctgacggagatcgccgtcaatcgtccaggtgagctgtataccaaaatcaacggcgtatgggagcagcacgccgttcctttgtcctatgaggattgctacaactttgcccggtgcctggcaaagcaccacggcgacaatatcgaagatattaagccggggctgtcagccacgctggaatctggcgaacggtgccaggtgattgttcccccggcctgtgagcgcgatacggtgtctatcaccatccgtaagccatcgaaggtacaaatcccgcatcagtcatacatcgatgcgggattttataaccgggtaacaggcgaggaaaaaacggagacgcacgacgaggaattaattgcattgtacaatacaaaaaatattcctctgtttatggagaaatgcgtcgagtacggtaaaactctcgcggtcgccggggaaacaagcaccgggaaaaccacctatatgaaaatgttgatagggtatattcctgtacatcttcggatatcaaccattgaggacaacccggaaatcacgttctttatccataaaaactacgtccatcttttttatccgtcagaatcatcagatgaaaaaggttctatcgttaccccggcgagccttttacgctggaattaccgtatgaaccctgaccgcattttattaacagaggttcgcggtgcggaagcctgggacttccttaaaataacaggttccggccatgaagggagtatgacctccattcatgcaggatcagcgaaagaagctatagatgggtttattacccgttgctatgaaaatccacagtgcgcccagctcccctatacatttatgttacgtaaggttctggatagcctggacgtgattgtgagcattgatttagacggaaatgttcgccgtatgaatgacatctatttccgtccaattcatcgaaaccagtattttgaggaaatgaaagcatga

SEQ ID NO: 6922 - DNA, 210 bp, Klebsiella pneumoniae
tcttcgaccgctacaaacaaaaagccaaacgtgcggcctgaatttaaaccgaactttttagtttacagagtaattgccgccagcgcccgtttcgctggcggtaactatcaaaaatggcgaggttggtcacactgtctatacttacatggctcacatataattaacaaccagcttcggctggccatgataaggaggaaacagggtggataa

SEQ ID NO: 6923 - DNA, 654 bp, Klebsiella pneumoniae
tcccccgccgcgctgcgcggcatggtacagcagcccagcgcgatcgcgagtctggcgtcgtttctgccaatgcaggtatacttgccagatgtttcctcagtttcagacacgcagatgacaaaactcaccttacaagagcagatgctcaaagccggcctggtcagcagcaaaaaaatggctaaagtccagagaacggcgaaaaaatcccgcgttcaggcccgtgaggcccgggaagcggtggaagaaaataaaaaagcccagctggagcgtgataaacagcttagcgagcagcaaaagcaggcggtgctggcgaaagagtataaagcccaggtaaagcagctgatcgagatgaaccgcattacggtcgcccggggcgatatcggctttaactttaccgataataatctgatcaaaaaaatcatggtcgacaagcccacccagacccagctgatcaacggccgtctggcgattgcccgcctggcggtggataacaagcccgaaggtgaatatgcgattattccggcggtagtggctgagaaaattgcccagcgcgacgccagcagcatcgtgttgcacagcgccctgagtcaggatgagcaggatgaagacgatccgtacgccgactttaaggtgcccgacgatctgatgtggtaa

SEQ ID NO: 6924 - DNA, 1455 bp, Klebsiella pneumoniae
cacccacacgctaacgctccccccgttacatgtaaaggtcgcgcagccttcgccatcggtttcgacaatctcttcccggttaccgagaaaatcccgccagcgtttgttgccatagttttcgcccagcgtcagcgccttttcgccctcatcgccattggacatgatcaccacgcagcctggatcgtcgtcagtaccgctacgactaaaggcgatgcagttaggatgatcgaaccaaagggtttgcacgccatgggcaaaacgctgacgggcgtcgatcagctcgtggagttgttcgataacgggcatctcaatggcataggtctctccgtcgccgccggtatcctcataggaagcgccgaagagatcggcataaaagaccgagggcacgccattctcccgcagcaggatcagcgcataggcgaggggcttgaaccagggttcaaccggcgcctcgagggcctgcagcggctgcgtatcatgattggtgaccagagtgacggcatggaaagggtcggcttcgaccagcgtcccgctgaaaatctggctcatgtcataatcgcggccctggcgcgacgcttcatgaaatttcatctgcagtggggcatcaaacagcatcgttttgccctcgaccaggtcgatatactgctggagcttctccacttcatgggaccagtattccgctacaataaacagcggctgcggggccacctcctgaacatgctcgatccacgctttataaaaccaggcggggatatgcttgaccgcgtcaagacgaaaaccgtcgcagccggtctgctccattacccagcgcgcccagtatttgatctcctcggtcactgcatgattgcggaaatcgatattggcgcccatcagatagtcaaagttgccgagctcatcatcgacctgttcattccagccttcgccggtgtaatcgttgacgattttaaacacaccgtcttccgtcgggttctcgatgtggtcaatgccgctaaaacatttgtagtcccagacaaactgcgaatactgtccggcgcgcaccgggaaggtgtagcgcgtccatgcctcgcactcgatgatctcctcgtcaatttgcgtacgatcctgctcatcgacgcgctgaacgcgcagagcctctttttcatcagcgcccattttatggttgaccaccacatccagcagcacggcgatattgtgctccttcagggcgttgatcgccgccagcaactgcgctttgtcgccatatttggtggcgacagaccctttttgatcaaactcgccgaggtcaaagagatcgtaggtatcatagccgacggagtaaccgcccgaggcgcctttgtaggcgggtggcaaccagaccatattgatgccgatttcattcaggctgggcgccagcgcttcgacctcaggccacagctcgccgccggtggggtagtaccagtgaaaacattgcaataa

SEQ ID NO: 6925 - DNA, 327 bp, Klebsiella pneumoniae
ggtaagaacgctaagcgaccccagcataacgcgatgaggtcgtggcagattgttgaatgcctgagtgacagcgcgggctatctgttgcacgtattcacttcctcgttaatctcctttcaggcagctcgaatactgattcgccagttgggtgaggaattgcgggtaactcgttttacccagcgtaattcctgtccccagtggatccagggtccccatgcgcacagacgtgccccgggcaacagcttcgataaccgctggcctgaactgtggctcagcaaaaacgcaagtggctttctgctcaaccagttgtgttctgatttcgtgtaa

SEQ ID NO: 6926 - DNA, 1737 bp, Klebsiella pneumoniae
acattggacgccgctgcggtcattagtctgtttattctgggttctgttttagtaacctgcagtatcttattgagctccttttcttcgcgccttggcatcccgattctggtcatctttctggccatcgggatgctggcaggcattgacggcatcggcggcatccccttcgacaattaccccttcgcctatatggtgagtaacctggcgctggcggtgatcctgctggacggcgggatgcgcacccaggccagctcctttcgcgtcgcgctgtggcccgcgctgtcgctggcgacggttggggtgctgatcacctcggcgctgaccgggatgatggcggcctggttgttcaagctggatctgatcgaaggcctgctgatcggcgccattgtcggctccaccgacgccgcggcggtcttctcgctgctcggcggcaaggggctcaacgagcgcgtcggctcgacgctggagatagagtcaggcagtaacgacccgatggcggtcttcctgaccatcaccctgatcgaaatgatccagcagcaccaaaccggcctcagctggatgttcgccgtgcatatcattcagcagttcggcctcgggatcgccatcggcctcggcggcggctacctgctgctgcagatgattaaccgcatcgtgctgcccgccggcctctatccgctgctggcgctgagcggcgggatcatgatttttgccgtcaccacctccctcgacggtagcggtatcctcgccgtctatctctgcggctttctgctgggcaaccggccgatccgcaaccggcacggcatcctgcagaacttcgacggcctggcgtggctggcgcagatcgccatgttcctggtgctgggcctgctggtgacgccctccgacctgctgccgatcgctatcccggcgctgctgctgtcgatgtggatgatattcattgcccggcccctgtcggtgtttgccggcctgctgccgtttcgcggctttaacctgcgcgaacgggtgtttatcagctgggttggcctgcgcggcgcggtgcccattattctcgcggtgttcccgatgatggccggcctggacaacgcccgcctgttcttcaatgtcgccttcttcgtggtgctggtgtcgcttctgctgcagggcacttcgctgtcgtgggcggcgaaaaaagccaaagtggtggtgccgcccatcagctggcccatctcccgcgtcgggctggatattcacccggaaaacccgtgggagcagtttgtctaccagctgggggccgataagtggtgcatcggcgcggcgctgcgcgacttgcacatgccaccggagacgcggattgccgcgctgtttcgcaacaatgtcctgctgcaccccaccggcagcacccgcctgcgggaaggcgatatcctgtgcgttattggtcgggagcacgacctgccggcgctgggcaaaatgttcagccagtcgccgccggtggcgctcgatcagcgctttttcggcgacttcattcttgatgctgaggcccgcttcgccgatgtggcgcaaatctacggtctcgacggcggtgaggagttccgcgagcatcagcagtcgctcggggaagtggtgcagcagctgctgggcgcggcgccggtggtgggcgaccaggtggagttcgccgggatggtgtggacggtagctgaaaaagagaacgatcacgtgctgaaggttggggtgcgggtcgcggaagacgaggcggagtga

SEQ ID NO: 6927 - DNA, 849 bp, Klebsiella pneumoniae
cgccgttgcgctacagacggcacgttaatcagggagaagatgatgcgtaaaacgacaggaaccctgctagccacgctgctgctggccgccaccggcggcagcgcgttgtccgctgaggtcaccgtgatgatctccggcggcttcaaagcggcgctggaaaagctggccccggcgtgggaaaaacaaaccggcaaccacctcgtggtgatccctggcccgtcgatgggaaaaacgccgcaggcgatccctaaccgtctggcgcgcggcgaacacgcggacgtggtgatcatggtcggggacgcgctgaccagcctcgagaaagcgggccgtacgcaaccggattcgcgccgggagctggccgactcgccgatcggcgtggtggtgaaggcgggggcgccgctgccggctatccacaacgcagaccagctgcgggcgacgctgctggcggcgccatcggtcgcgtactccgacagcgccagcggacgctatgtcagctcgacgctgttccacaccctgggcattgatgacgcgatgcagagtaaagcgcagatggtggagcgcattccggtggcctcggaagtggccaagggacggtatgcgatcggttttcagcaggtgagcgaactgctgccggtgcccggcgtaaccttcgtcggcgaactgccggataacctgcagtacatcacccgctttgccggggcggtgaccatcagcgccgaccacccgcaggaaggcaaggcgctgctgacgtatctggcgtcaccggcggcgcaggagaccatccacgccaccggtatgcgaagcgtagccgccgccgcgccggtcagccagaaggatactgttcaataa

SEQ ID NO: 6928 - DNA, 1263 bp, Klebsiella pneumoniae
cgcaacggcgctacggcgatagaggtagcaagtggccagcaggccgcagatggcggcaaagctcatccagtagccgggagacgctttatcaccggtatactcaatcagcgccgtggaaatcaccggcgtgaagccgccaaacaccgcggtcgccaggctgtaggccagcgagaaacctgccacgcgcacttcggcgggcataatttcggtcagcgccgggatcatcgccccgttgtacatgccgtagataaacgacagccacagcagcacgctcagcatcatcaaaaagctcggggcgttcgccagcatggtcagcgcaggccaggcggtagccagcgccagcagggtcatggcgatcagcaccgatcggcggccaaagcggtcggacagcgccccgcccaccggcagccagaagaagttggaaatcgccaccagcagcgtgaccagcaggctgtcagaggcgctgagcatcagcacctttttaccaaaggtcggggcatagacggtgatcaggtagaacgcggtggtggtcatcgccaccatcatcatcccggcgataaccacctgccagttcgccagcagggtggcgaatacctggcgcatcgccagatgatggcggcgggcagtaaactcctgggtctcctccagcttacggcgcaggataaaaatgaacggaacaatcaggcagccgaaaaggaacggaatacgccagccccagtcgctgatagcgctcggctccagtaccgcgttgagggcaaagcccatcgcggctgccaccatgatggcaacctgctgactgcccgactgccagctggtgtaaaagcctttgcggcccgaggtggcgatctcggccagatagaccgacaccccgcccagctcggcgccggcggaaaagccctgcagcagacggccgatcagcaccagcagcggcgcccacaggccaatggtctgataagaggggatcagcacgatcaggaaggtgccggtggccatgatcgacagggtgacgatcagccccttgcgccgccccaccttgtcgatataggcgccaagtacgatagcgccgatggggcgcatcaaaaagccggcgccaaagaccgcgaaggtcatcatcagcgaggcgaattcactgctcgccggaaaaaaggtatgggcgatgtaggtggcataaaacccgaacaggaaaaagtcgaactgttcgagaaagttaccggacgtgacgcgcagaatggcgccgatccggtcacgggtactcatctgtga

SEQ ID NO: 6929 - DNA, 1074 bp, Klebsiella pneumoniae
cgaggtttagcactgatgctgttttcatatacctatgtgccacacaaaatggaaaagatgcaggcattcattgattttattttttatgaggtatggtgcaaagcgcgggtaagagggcctttttgtcttaaactgtttgaagctaacgcagaattgtatgaagtgatggaggatttttcttcctcggatacacaaggtgctgttttcttttataaccatgtagagaaaatttatggcttgttttcgtcactgactgaggtacaaatcgatcagtttaaacagtggtatcaagggaataatgatctggaaaaaatatgtgctaatgacccttcaatacaagttgtccgttattccgatattgccattcaccacaaagatatagcagaacaacttgctgttttctttaagggcttatactcacagtcactgcttgatctcgctgtactgcgtgccaagatcggtgatatacacgatcactatcaatcttttgcagcagtgaacaaggcgggtaaatgtcctttttgtggtattggagatataaagggtgggaaccatagcaagcgcgaggcctatgaccattatttgcccaaagctttatatccatttaattcgataaatttccataatcttgctccggcctgtcatgagtgcaatagcacatataagttatccaaagatcctattcagagcggcgctcttcgtcgtaaggccttcaatccatttgcctcagtggatcatgtaattcaattacagattactctacaacatgcaaatatcgatgcgcttgagcctgctgatattattatacagttcggtcccgatacgctggaggaggaactagaaacatggaaagacttgtacggtatagaagaacgttataaagccaaagtttgtgcagaaaatgacggtaaatactggcttactcaggtgctagatgagtggaaggaggagggggtgagtcctaccgaattcatgagaacattagcacgtcaagcgaaaaagaagccttatgctgaatgcaatttccttaaagaaccttttcttaaagcttgccatcgaataggtgttttttga

SEQ ID NO: 6930 - DNA, 933 bp, Klebsiella pneumoniae
aattgcatagcctttattgcgtttttgaggactggatcggtgttggcaaatctggaagtaaaatggctgtatgatgtgattgcccttgaggagtcgcgcagctttaccctggcggccaaagcccgcaacatctcacagtcttcgttcagtcgacgcatccagtcgctggaggcttccctcggattcagcatcttcgatcgtagcgccaaccctctgcagctgaccaaccgcgggaaaatttttgtcggctatgcgcgaaatatgctcgatgacatggattttcagatcagccgtattaaaggcttaaataacactacccagaaaataagaatcgacgccgccccttcgctgtcggtgttattactgccggagatcatcgccggttacaccgaccgtaaaaataagacttttcatgttgaatcgattaacgtcaacgacgccgtatttaacctgaaagagggaaaaagcgattttatcctctccttctataatgaagaattaatgaactatccgtttattaatcataaaatttttgattcttacctgcacctggtctccccctgcgacgaacatggccgcccgctgtttcatttacatcgcggcgtgctgccgctgatgaaatacgccaacgacagctatatggggcgccaggtgaaccaggtcatcgaccgtacgccggagatcaccttctcccttacgtttgtctcttccatgagcgagctgctcaagcgcatgatcctcaatggcgacggcgtgggctggctgccgcagtactccattcagcgcgagctggacgaaggccggctgacgatcctcgatgagagcctgtcgctgccgatcggcgcctggctctaccgctccggctcgcggcttaaccaggccgccgaacgtttctggcagcacattaaaacccgtaacgaactgcgggaataa

SEQ ID NO: 6931 - DNA, 891 bp, Klebsiella pneumoniae
tgcacgatagccacccacaggggccggcgctgtaacagtggtctgcaggggcgaatagcgctacactttcgccctttcagcaacaccggagccgtcatgtcatacagttgccccctttgtcacgcgccgctcagccgtagcgacaaccactattcctgcccgcagcggcaccagttcgatctggcgaaagaggggtacgtcaatctgctaccggtgcagttcaagcggtcgcgcgatcccggcgatagcgccgaaatgatgcaggcccggcgggcgttcctcgacgccggacattatcagccgctacgggatgctatcgctgagcggctgcgacattacgcccctacggatttactggatatcggctgtggcgaggggtattacacccacgcgtttgccgccatcgccagccgcagctgggggctggacgtgtcgaagccggcgatccgcgcggcggcaaaacgctacccgcaggtgaatttttgcgtggcctccagccagcgcctgccattttccgacgctagcttcgacgcggtagtgcgcatttacgcgccctgcaacgccgaagagctggcgcgggtggtgcgtcccggtggttgggtgatcaccgccacgccgggtccccgtcacctactggagctgaaagggctgatttacgatgaagttcgcctgcatgagctgaagacggaagcgatgccggggttccgcctggaggctcagcagcagctggcttatccgatgatcctgacgggaagtgaagcgcaggccctgctgcagatgacgccgttcgcatggcgggctaaagccgaagtgcacgccgcgctgcgtcagcagccgacctttggttgccagaccgattttatgatccactgctggcagcgcgaagcgtaa

SEQ ID NO: 6932 - DNA, 297 bp, Klebsiella pneumoniae
ccggcttcagcccggtgttggcgatgtcctgccactgcccggaaggcgacgcgccatacagcacgatgcctggacgaacccagtcaaaatgcgcttccggatgccagagggtcgccgccgagttggccagcgagcgcgggcaatccagcccctccgccgcctgttcgatacggcgcatcggctcgacaattccctgcgggttctccgcctccgcgaagtgcgacatcagcgtcatctcgccgacgttgcttatcgcccgcagctgctgccagacggtgtggacccgctcaggcataa

SEQ ID NO: 6933 - DNA, 558 bp, Klebsiella pneumoniae
tgtgatctggctggaaggtcgccgactaacgaacaggctcgcaaatcccgggatcggcccttgcgcagtcggggaaacaggagtaaagaatggaagaaagggttattccgcgtatctcaaggaggccagatgccttatacccatctgctggttgccgtcgcgccaacgccggagagtcaggtattaattaaaaaagcggtgtcgatagcccgccccgttaacgcgaaggtgagcttaatcactctcgctacggatccggagctgtataaccagttcgccgcaccgatgatggaaaatctgcgcgaagtgatgcaggaagagacgcgggagtttctcaatgagctggctcgccacgcggactacccaatagaaagaatgaccatcgcctgcggcgagctaggccatcatattaaggacttctgccggtcgcaccgtattgatctggtgatctgcggcaatcacaaccattccctcttctcacgcgccacctgctcggcgaaaagtatcgtcggcagctgcggcgttgatgtcctgttggtttcccttgaaaagggctaa

SEQ ID NO: 6934 - DNA, 474 bp, Klebsiella pneumoniae
aaaaagatggcagcgattataaacgaaaacgtttgcgtatgtctttacgcgcgtaacgcgcgtgagttgagtccgagagggaaatttgctatactgtataaaaatacagtgttgagaggctgcagtatggcggttgaaattaaatatgtggtgatccgcgaaggtgaggaaaaaatgtcttttgccagcaaaaaagaggccgacgcttacgacaaaatgctcgatctggcagaggtgctgaatgactggctggtggcatcgccgctggagatggatgacgtccagcgcgataccatggcgatgtggctggctgagcgtaaagaagcgctgcagcatatcctgcgagttggccgactgccggagcaagagacgcccgcacaggacgcctccgcgccgtcggctaccgccgagacttctccggcgggtgatgacgccgtgccggcggccaaagcgcgcaaagccaaggcagcctga

SEQ ID NO: 6935 - DNA, 441 bp, Klebsiella pneumoniae
aagcgggcggcaaaattagcgatattgcgccggacgtgcgggttatcgtggaggatctggtcggccatcgctacgaagagtgctggggcaacagcaaattgttcaaagatgctgcccctgcgcctgcgcagaccgtcgtttcccattaaagaagaaggccccgccggtatccggcgaggcctggtattaatgcgtttcttcctgtggagtaaacttcagctcaatcaacgcgatcgctttttgcaccgcgcgaagggtcaccggatcggcagaagccggatggctggcgaagtcgatagctttcagctgagtggtcattttttcacgcacttccaccggcgcaatgacgtcaatgacatcgaggatctgtttgataaccagctggcaggcaaccacatcggaaaccagctcgtcgtgttcggtaagatgttgagacattaa

SEQ ID NO: 6936 - DNA, 1005 bp, Klebsiella pneumoniae
gatacagaggccataatgcatattacctacgatcttccggtatctattgacgatattctcgaagcgaaacaacgcctcgcgggaaaaatatataaaacaggcatgccccgttcgaattattttagcgagcgctgccagggcgaaatatttcttaaattcgaaaatatgcagcgcacgggttcatttaaaattcgcggcgcctttaataaactgtgcggtttaaccgcggcggaaaaacgcaaaggggtggtggcctgctcagcgggcaaccacgcccagggcgtctcgctctcctgcgccatgctaggcattgacgggaaagtggtgatgccgaaaggggcgccgaaatcgaaagttgccgccacctgtgattattcggcggaagtggtgctacatggcgataactttaacgataccctcgccaaagccagcgatattgttgaacttgagggccgcatttttattcccccctatgacgacccgcaggttatcgccgggcaggggactattggactcgaaatattagaagatctgtatgacgtggataatgtcatcgtgcccattggcggcggcggcttaattgccggtatcgcaatcgcgattaaatccattaacccgacaatccgcattatcggcgtgcagtcggagaatgttcacggcatggccgcctcctggtatgccggggaaatcactagccatcgccacgccggcaccttagccgatggttgcgacgtcgcccgcccggggaaactgacctatgaaatcgcccgccagctggtggatgacatcgtcctggtgagtgaggatgacattcgccagagcatggtcgccttaattcagcgcaataaagtgatcaccgaaggggccggggcgttagcctgcgccgcgttattaagcggcaaactcgacagctatatccagaaccgcaaaacggtcagcctgatttccgggggcaatatcgatctctcccgggtatcgcaaattaccggttttgtggacgcttaa

SEQ ID NO: 6937 - DNA, 192 bp, Klebsiella pneumoniae
ggcactaatttaaggttcggcagagaagcggtattcaacgacaacgtgtttactcaggacttctttactgaaaatgccacacataaacagaactgtacctcgtttaacccgaaacgtgttatcacacactacgtaaataatggcaagccatttttaaacgtgtctcgatcgttcgcacaaattataaggtaa

SEQ ID NO: 6938 - DNA, 594 bp, Klebsiella pneumoniae
ggagtcaatttcatgcttccatccctgaatcatattatattaaccgttgctcttcaggcgctacgggaaggaaatattcatcactgcgaaactatgggattcacttacgatgaaatgaatttgctcggttgcttatcaataaacgatcttatcaccctcagtcaggcacctttaccgcttgtcgatattactatccgccatgatgtcctgcaaaaattactggcatcatcccacgaggaaaacaggcgtcaggaacaactgaacagagctgtcaggctggggggctcaatcgcactgatgaaccgttatttcggggttggctccagagaaacctgtgcacgccgccggttactcggtgtctccgttccaaacgggagaacacccattccggatgaagaaaccgatgctgcaatctggcatcagtggcaaaaatatcgggtcgaaaacattgattccccggaggcgctggacgccatgatgctggttacagaaaacctttcatcgtgtactgccccctcgctgaccgttgtctggaactgcatcacgcattgcgaaagaaagaacacggtaaggagaatacaacgtgccagatga

SEQ ID NO: 6939 - DNA, 252 bp, Klebsiella pneumoniae
ccggagttttatcttcctccggcaaagcctctgtcacctcacgctggagatcggcgaaaatcgtcttctcccgcgccagatactgggcaaaggtcgcctggtcgatctcttcggccgacatctcgttgccactccaggtatgccagcgatgcagggccgggccgcgctgggactcatagatccgcccggcgagaaagaccaccagcagcgccagtaccgcaatgctcccttttttcagcagtgagccgataa

SEQ ID NO: 6940 - DNA, 690 bp, Klebsiella pneumoniae
tcaggaaatttcatggaaaatcaacctaagttgaatagcagtaaagaagttatcgcctttctggccgaacgtttcccgcagtgctttagcgctgaaggtgaagcgcgccccctgaaaatcggaatttttcaggatctcgttgagcgagtgggtggtgagatgaatctcagcaagacccagcttcgcgctgcattacgtctctacacgtccagctggcgttatctgtacggcgtaaaagccggcgctattcgcgttgacctggatggcaatccgtgcggcgaactggaagagcagcacattgcccatgcgcgtcagcagctggaagaagcgaaagctcgcgttcaggcgcagcgcgcagcccagcaggcgaaaaaacgcgaagccgctgcggccgcaggtcagcaggatgaaggcgttcgccgtgagcgtaaaccgcgtcctcagcagccgcgtcgtaaagaaggcgctgaacagcgtaaaccgcgtcctgttgcggccaaagccccgcgtgaagagcgtcttactccggtatcggatgtttccgttctgaccgtcggccaggcgctgaaggtaaaagcaggcaataacgccatggacgccaccgttctggaaatcaccaaagatggcgttcgtgtacagctgacttctggtatgtcaatgattgtacgcgcagaacacctggtgttctga

SEQ ID NO: 6941 - DNA, 1794 bp, Klebsiella pneumoniae
  unsure (1615): Identity of nucleotide at the above locations are unknown.
gatttccattacacagcgttacaattgcactcatcataccagagccgctatagcgcagatagcatggcaagtgaattaaaaagggatcgccgtttcattttccgcttttactttgcgcttttccttatcttcacaaaccgccagcgcggcgcgaagaaagttgcttctcattttgctcaactggtactcttgccaatcgttatgcacaaaaccatgcactcattgacggggaaggattctgtcgtggaaatttcttatggccgcgcgctgtggcgcaattttcttggccagtcgccggactggtacaagctggcattaatcattttcttaatcgtaaatccgctggtgttcgccgtggcgccgtttgtcgccggctggctgctggtggtcgagtttatctttaccctcgccatggcgctgaagtgctatccgctgctgccggggggtctgctggctatcgaggcgctgctgatcggcatgaccagcccggcgcacgtgcgggaagagatcgccggcaatctggaagtgctgctcctgctgatgttcatggtggcgggtatctactttatgaaacagcttttgctgttcgtgtttacgcgcctgctgctggggatccgcagcaaaatgctgctatcgctggccttctgcctggcggccgccttcctctcggcctttctcgatgcgctgacggtggtggcggtagtgatcagcgtcgccgtcgggttctacggcatctatcaccgcgtcgcctcggcgcgcccggacgatagcgacctgctcgatgacagccatatcgagcagcactaccgtgaggtgctggagcagttccgcggctttctgcgcagcctgatgatgcacgccggcgtcgggaccgcgctcggcggcgtcatgaccatggtcggcgagccgcaaaacctgattatcgccaaagccgcgggctggcattttggcgagttctttcttcgcatggcgcccgtgaccctgccggtgatggtctgcggtctgttaacctgtctgctggtcgaaaagtatcgcctgtttggctacggcgaaccgctaccgccgacggtgcgcaaggtgctgcaggagtttgacgatcgcagccgcgcccagcgcagtcgtcaggagcgactgcggctgattgcccaggcgctcattggcgtttggctgatcgtggccctggcttttcacctggctgaggtcggcctgattggcctgtcggtgatcatcctcgccaccacctttaccggcgttaccgatgagcacgccattggcaaggcgttcaccgaggcgctgccctttaccgcgctgctgacggtcttcttctccatcgtcgcggttatcatcgatcagcagctgttcacgccggtgatcgagtttgtcctgcaggcctcgccgcacgcgcagctgtcgctgttttatctgttcaacggcctgctgtcgtccatttcggataacgtgtttgtcggcacggtctacatcaacgaagcgaaagcggcgctcgaacatggcgccatcagcctgccccagtttgagatgctggcggtagcgatcaacaccggcaccaacctgccctcggtggccaccccgaacggccaggcggcgtttctcttcntgctgacttccgccctggcgccgcttattaggctctcttatggccgtatggtgtggatggcgctgccatacaccattgtactgacgctggtcggcctgttatgcgtcgagttcaccctgatgccagtcaccgactggctgctggcgcacggctggctggtgacgcccagcctgccctga

SEQ ID NO: 6942 - DNA, 1050 bp, Klebsiella pneumoniae
atactttgttatttaacgtgttatctcacatcttcggtgggaatgaggcaacacggcaaggtatcggaagtgacggaaaagaagacggctgtctatgtggatgaccaacagcgcatcctgatccgccagctggcgcgcagctggctgtggcgcagcgagctgccgacctggctgctgattgtgacggtttacggcggctggtttgcctgcgtggcgggctggcggacgctgggactgtttccggccacgctgctgttgatctggtttaccgcctggtatatgtccttacagcatgagctgatccatgggcatcccacccggctggcatggtttaaccagctgttggggacgctgccgctggcggtctggtatccctatggcgtctaccgcgacagccacctggcgcaccatcgcaaccatctgctgacgcaccctgaggatgaccccgaatcgtactacgtaacggcggaaagctggcagcgcttctcagcctggcagcgccgccttatccacctgcgcaacaccttctgggggcgtctgctgctggcgccgatgatggatattattcacaccctgaacagcgcgctgcgggctttccgcgagggcgaccgccgcgctatcgccatgtggagtctgcatctgttgctgctgacgggcctgctgacctggatggcggcgcagggtttttctccgctgtggtttgtgctggcggtgagctacccggcgctggccctgaccaaagtacgctcttttctcgaacatcgcgccgcggatgacccgctggcccgctcggtgatcaacgaggccgggctcccctggcgggtgctgttcctcaatctcaactaccatgcggtgcatcatgatctgccaggggtcccctggtacgctttacgtcaactgtatctgcatcgccaggcggcgtatctgcagcgtaatcaggggttcctggtgcgcgggtacggcgagtggcgacgccattttagccgccgggcggtggcggtgaacgcccatccgggctttggcgagcaggcgggaggagaacatggctga

SEQ ID NO: 6943 - DNA, 1398 bp, Klebsiella pneumoniae
cggagtatctacgcaagtacttctgagcagggcgccccgctggcgaggcgccgaataaaactaacccggctttcgccgggttgcttgttacatacgctcgacggtttcgataccgagggtatcaagacccagcttgagggttttcgccgtgagcagcgccagcttcagacggctgttgcgggtctcttcgctttccgcgctgaggatcgggcagtgctcgtagaagccggagaacaggcccgccagatcgtagaggtaggcgcacatcacgtgcggcgtcccttcgcgagcgaccacggagagggtctcttcaaactgcagcaggcgcgcggccagctgagcttcgcgatcttcggcgatgaccaccggcgcgtcgatcatcgcgttttcgtcgatgccggctttgcggaacacggagagcacgcgggtataggcatactgcatatacggcgcggtgttgccttcgaacgccagcatattatcccagtcgaagacgtagtcggtggtgcggtttttcgacaggtcggcatatttaaccgcgccgatacccaccactttcgccagattttccagctcgtcagccgacatatccgggttcttctcggccaccaggcgacgggcgcgctccagcgcttcgtccagcagatccgccagcttcacggtaccgccggcgcgggttttaaacggcttgccgtctttccccagcatcataccgaacatatggtgctccagcggcacggagtccggcacgtagcctgccttgcgcacgatggtccacgcctgcatcaggtgctggtgctgacgagagtcgatgtagtagagcacgcggtcggcgtgcagcgtttcatagcgatacttcgcacaggcgatatcggtggtggtatagaggtagccgccatcctttttctggatgatgacgcccatcggttcgccttccttgtttttgtactcatcaaggaagaccacggtggcgccttcgctctcaaccgccagccctttggctttcagatcggcgacgatccccggcagcatcgggttgtacaggctctcacccatcacgtcatcgcgggtcagggtgacgttcaggcgatcgtaggtgatctggttctgcgacatggtgatgtcgaccagcttacgccacatctgcaggaagtactcatcaccgccctgcagcttaaccacgtagctgcgcgcgcgctcggcgaaggcttcgtcttcgtcatagtgctttttcgcttcgcgatagaaaccttcgaggtcggccagggccatttcgccggcgttttcctgctgctgtttttccagatacgcgatcagcataccgaactgggtgccccagtcgccgacgtggttggcgcggatcaccttatgacccaggaactccagggtacggactga

SEQ ID NO: 6944 - DNA, 798 bp, Klebsiella pneumoniae
ggcggctgctacgccaagaccatcaatctcgatccgcaggcggagccggagatttatggcgccatccgccgcaatgcgctgctggaaaacgtggtggtgcgcgctgacggcagcgtggattatgccgacggcagcaaaaccgaaaacacccgcgtctcctatccgctgtcgcatatcgacaatatcgtcaagccggtgtcccgcgcgggccatccgtcgaaggtgattttccttgccgccgatgcgtttggcgtcctgccgccggtctcccgtctgaccaccgagcagatgcagtaccatttcctgtcgggtttcacctcgaagctggcgggcaccgagcgcggcattacccagccgacgccgaccttctccgcctgctatggcgcggcgttcctgctgcttcacccgacccagtacgccagcgtcctggcggcgaagatggcggaatccggtgccgaagcctggctggtcaacaccggctggaacggcgagggcaaacgcctgtcgctgcgcgatacccgcagcatcattagcgcgatcctcaacggcactaccggcccgctgcgcgaggagaccatcccggtgttcggtcttgcgatcccgcagagcattccaggggtagacagcgcggtgctggatccgcgtaatggctggagttcagcggataaatggcaggagaaggccgagagcctggctcagctgtttatggataacttcaagcagtacagcgataccgaagcgggcgcgcgtctggcgctggccggtccgcagctgcagaagagcgcggtcgaagcctga

SEQ ID NO: 6945 - DNA, 921 bp, Klebsiella pneumoniae
ctgccgcgctactgggggcgcctggctggggggtcctttgccttcgccggtatagcgctgacgccgccatcctttcgcgatccgctcctcggcaaactcggtcgtctggtagggcgtctggcgaaaagctcgcggcgccgggcgcagattaatttgctgtactgcttcccggaaaaaagcgagtacgagcgggaagcgattatcgacgccatgtatgcctcggcgccgcaggcgatggtgatgatggccgagctgggcctgcgcgatccgcagaaaatccttgcccgcgtcgactggcaggggaaagcgatcatcgacgagatgcagcgcaataatgagaaggtgatttttctcgttccgcatgcatggggtgtggatatcccggcgatgctgatggcctccggcgggcagaagatggcggcgatgttccataaccagggtaatccggtgttcgattacgtatggaataccgtgcgtcgtcgttttggcgggcgtatgcacgcgcgcaacgatgggatcaaaccgtttattcagtcggtgcgccagggctactggggctactatctgcccgatcaggatcacggcgccgaacacagcgagtttgtggatttctttgccacctacaaggccacgctgccggcgattggccgcttaatgaaagtatgccgcgcccgcgtcgtaccgctgttcccggtctacgatggcaagacgcatcgcctgacggtgctggtgcgcccgccgatggacgatctgctggacgctgacgatacgaccattgcccggcggatgaacgaagaagtggaagtgtttgttaagccgcacaccgagcagtatacctggatcctgaagctgctgaaaacgcgcaagccgggtgaaatcgagccctataaacgcaaagagctgttcccgaaaaagaaataa

SEQ ID NO: 6946 - DNA, 1803 bp, Klebsiella pneumoniae
gttaagggatatctcatgcgtacagaatattgcggacagcttcgacagtcccacgttgggcagcaggtgactctgtgtggttgggtcaaccgccgtcgcgatctcggtagcctcatttttatcgatatgcgcgaccgcgaaggcatcgttcaggtgtttttcgatccggatcgtgcggatgcgttgaagttagcctctgaactgcgtaatgagttctgcattcaggtcactggcaccgttcgcgcgcgtgaagagaaaaacatcaacgcggacatggccaccggcgctatcgaagtgctggcttccgatctgacgatcattaaccgctcagaatcgctgccgctggactccaatcacgtcaacaccgaagaagcgcgtctgaaataccgctacctcgacctgcgtcgtccggagatggcgcagcgcctgaaaacccgcgcgaaaattaccagctttgtgcgccgctttatggacgaccatggtttcctcgacatcgaaaccccgatgctgactaaagccaccccggaaggcgcccgcgattacctcgtgccttcccgcgtgcacaaaggcaaattctacgcgctgccgcagtcgccgcagctgttcaaacagctgctgatgatgtccggcttcgatcgctattatcagatcgttaaatgtttccgcgatgaagacctgcgtgccgaccgtcagcctgaattcacccagatcgacgtggaaacctcctttatgaccgcgccgcaggtgcgtgagatcatggaggcgatggtgcgtcagctgtggctggaagtgaaaggcgtcgacctgggcgagttcccgatcatgaccttcgccgaagccgaacgtcgctatggctccgataaaccggatctgcgtaacccgatggagctggtggacgtcgccgacctgctgaagtctgtggaattcgcggtctttgccggcccggccaacgatccgaaagggcgcgtggcggccctgcgcgtcccgggcggggcctctctgacccgcaagctgattgacgaatacggcaactttgtgaagatctacggcgcgaaagggctggcctatattaaagtgaccgagcgtgccaaaggcatggacgggatcaacagcccggtggccaaattcctgaccgctgaaatcgtggaagcgatccttgaccgcaccggcgcgcaggatggagacatgatcttcttcggcgccgacaacaagaaagtagtggccgacgcgctgggcgcgctgcgtctgaagctgggtaaagacctgagtctgactgacgagggcaaatgggcgccgctgtgggtgatcgacttcccgatgttcgaagacgacggcgaaggcggcctgacggcgatgcaccatccgttcacctcgccgaaagatatgaccgcggatgagctgaaagccgccccggaagaggctgtagccaacgcctacgatatggttattaacggttatgaagtcggcggcggttcggtgcgtatccaccgcggcgagatgcagcagaccgtatttggtattctgggcattaacgaacaggaacagcgtgagaaattcggcttcctgctggatgcgctgaagtacggtacgccgccgcatgcaggtctggccttcggtcttgaccgtctgaccatgctgctgaccggtaccgataacatccgcgacgttatcgctttcccgaaaaccaccgcggccgcctgcctgatgaccgaagcgccaagcttcgccaatccggcggcgctcggtgagctgggtattcaggttgtggagaaagaggcaaaagcgtctctggagaacaagtaa

SEQ ID NO: 6947 - DNA, 207 bp, Klebsiella pneumoniae
tcagggtcgtattttactgacctgaaccaggtacaaacaacgaacaataacggccgaatgcccaaatcatcgccgaatgttttcaccctgtgcggttttaccgccgcaaacgaaggggaaggctttcgggaaatacgtaaacacagtacagtgcagtgtaagaaaattacaaatatagcctggcaaaagcaccagactatcaactga

SEQ ID NO: 6948 - DNA, 2679 bp, Klebsiella pneumoniae
gtagcctttcagcgggtagaccggtatatccaccagccctttaagcatcgccgtcgagtaggagccgaaggccatcacataggcatcgcccttgataatctcatcgccgcatttcaccccggcaatgcgatcgccctcgtgcagcagcgcatccactgcggtgttgaagcggaaggtcacgccggcctgctccgccatcgccgccagacgggtggtaaacagctggcagtcgccggtttcatcatttggcagacgcaggccgccggtcagtttgtggctgacctccgccagcgccggctccacttccgccaaccgcttcgcttccagcagctgatacggcacgccggcgtcctccagcaccgcgatgtcgcgggtggcattttcatactgtttggcggtacggaacagctgcagcgtcccgccctggcgcccttcatactgaatgccggtggtgtcgcgcagcgccttcaggcagtcgcggctgtactccgccaggcgcaccatacggcctttgttctccatatagtggcgggtgtcgcagttgcgcagcatctgccacatccacttcaactggaacgaggtgccgtcaagaccgatcgccagcggcgcatggcgctgaaacatccatttgatcgccttcagcggcacccccggcgccgcccagggcgccgcatagccgggagaaatctgcccggcgttggccgcgctggtctcctctgccggaccgggctgacggtcgatgaccgtcacgtcatgacccgcctgactcaaataacacgcgctggctaccccaaccaccccacttcccagtatgacgacacgcatagcgactccgtaacagttaaagaacaatcatctaattacaaattgataactcagttgaaaatattattcaacatacgctttatttatggtgacttaactcacagcaaaccgcaccagccctgcgctgtgagatttacgatctcatgctgcgctttatttttacccagcattaaattctgcaaacaaggcaaaaaaacggctttgagatggggaaatcgcgaagaaaagcgattggcgtacagcacagtttgctgcaccgtgttctatgcttgtttagaggttttccgttcagagaaaaccaacaacaacgagggcgcgctaatggctacgattgactccatgaacagggacaccacccgtttaagcgatggacccgactggacgttcgagttactggaaacctacctggccgaagtggaccgggtcgccaagctctatcgtcttgacacctacccgcaccagatcgaagtcattacttccgagcagatgatggacgcctactccagcgtcggcatgcccatcaactatccgcactggtcgtttggcaaaaaatttattgagaccgagcaggcctataagcacggtcagcagggtctggcgtatgagatagtcatcaactccaacccctgtatcgcctacctgatggaggaaaacaccatcaccatgcaggcgctggtgatggcccatgcctgctacgggcataactcgttttttaaaaataactatctgtttcgcagctggaccgacgccagctcgatcatcgactatctgatctttgcccgtaagtacatcaccgagtgcgaagagcgctatggcgtcgacgaagtagagaaactgctcgactcctgccacgcgctgatgaactacggcgtcgatcgctataaacgtccgcaaaaaatctctctgcaggaggagaaagcgcggcagaaaagccgggaagagtatctgcaaagccaggtgaatatgctgtggcgcaccctaccgaagcgcgaagaggaaaaagcgattgaatcggctcgtcgctacccttccgaacctcaggagaacctgctgtactttatggagaagaacgccccgctgctcgaaccgtggcagcgcgagatcctgcgcatcgtgcgtaaagtcagccagtatttctacccgcagaaacagacccaggtgatgaacgaggggtgggccaccttctggcactacaccatcctcaaccatctctacgatgaagggaaagtgactgagcgctttatgctggagtttctccacagccataccaacgtggtgttccagccgccgtacaacagtccgtggtacagcgggattaacccctacgcgctgggcttcgccatgttccaggacatcaagcgcatctgtcagtcgcccacggaagaggataagtactggttccccgatatcgccggttctgactggctggaaacgctgcatttcgccatgcgcgactttaaggatgaaagctttatcagtcagttcctgtcgccgaagatcatgcgcgatttccgcttctttaccgtgctcgacgacgatcacaacaattatctggagatctcggcgattcacaacgaagagggttatcgcgagatccgcaataagctctccgcgcagtataacctcagcaatcttgagccgaatatccaggtgtggaacgttgacctgcgcggcgaccgatcgctgaccttgcgctatgtgccgcacaaccgcgtcccgctggacaaaggccggcgcgaagtgctgaagcatgtgcatcgtctgtgggggttcgatgtgctgctggagcagcagaacgccgacggcagcattgagctgttggaccgctgcccggcgcggccgaacgcgctatag

SEQ ID NO: 6949 - DNA, 255 bp, Klebsiella pneumoniae
ttaatgtctcaacatcttaccgaacacgacgagctggtttccgatgtggttgcctgccagctggttatcaaacagatcctcgatgtcattgacgtcattgcgccggtggaagtgcgtgaaaaaatgaccactcagctgaaagctatcgacttcgccagccatccggcttctgccgatccggtgacccttcgcgcggtgcaaaaagcgatcgcgttgattgagctgaagtttactccacaggaagaaacgcattaa

SEQ ID NO: 6950 - DNA, 2133 bp, Klebsiella pneumoniae
acacgtcatcattcaggcgccaccctgcggcctgaatgctcttgtgtcacgataaagcagcagaagaataacatgccacctaaagctaaacggatccctcacgccatgaccttgcatggcgatacacgcatcgataattattactggctgcgcgacgatgagcgcgcgcgacctgacgtgctggagtatctgcacgcggagaacgcttacggcaagcaagtgatggattcgcagctcagcctgcaggagcgtctgctgaaggagattatcgaccgcattccgcagcgggaagtctctgccccctacagtaaaaacggctttcgctaccgtcaggtgtatgagccgggctgcgaatacgctatctaccagcggcagtcggtgctgaaagaagagtgggatgagtgggagatcctgctcgatgccaaccagcgggcggcgaagagcgagttctacaccctgggcggactgggcattgcgcccaacaaccagctaatggcggtggcggaagattacctttcccgccgccagtacggcctgcgcttttgcgacctcagcaacggcgagtggtacccggaaatcctcgaaaatgttacctccggctttgcctggagcaacgattcacgctttgtttggtatgtgcgtaaacatcccaccacgctgctcccttatcaggtctggcgccacaccgtcgggacaccggcgcagagcgacgcgctggtctacgaggaaaaagatgagaccttctacgtcagcttgcataaaaccacctcccagcagttcgtggtaatttatctctccagcgccaccaccagcgaagtgctgctgctcaacgccgaactgccagacgccgagccggtctgctttctgccacggcgtaaagatcatgaatacagtcttgatcactatcagcacgctttctatcttcgttccaaccgggaggggaagaatttcggcctctaccgtaccgtgctgcgtgatgaagaacagtggaccacgctgatcccgccgcgtcacgacgtgatgctcgaaggatttaccctgtttaccgactggctggttgtggaagagcgtcagcgtggcctgaccagtctgcggcaaattaaccgcaagacccgggaggtggtggggatcgcttttgacgatccggcctatgtcacctggcttgcctataatccggagcccgaaacgtcgcgactgcgctacggctattcctccatgactacgccggattcgctgtttgaactggatatggataccggcgaacgaagagtgatcaaacagcaggaggtaaaggggctggatacgagctgctaccagagcgaacacctgtgggtgaccgcccgcgatggcgtcgaagtcccggtctctctggtctaccatcgcgaacattttcgcaaagggagcaacccgctgctggtctatggctatggctcatatggcgagagtatcgatgccgatttcagcgccagccggctgagcctgctcaaccgcggctttgtctacgccatcgcccacgtccgcggcggcggcgagctgggtcagcaatggtatgaagacggtaaattcctgtgtaagaaaaataccttcaacgactatctggacgtctgtgacgcgctgcttgcccaggggtacggcgatccgcggctctgctacggcatggggggcagcgccggcggaatgctgatgggcgtggccgtgaatgaacggccagagctgttccatggcgtgatagcccaggtgccgttcgtcgatgtggtgaccaccatgctggatgaaactattccgctgaccaccggtgaatttgaagagtggggaaatccgcaggatgaaacctattatcactatatgaaaagctacagtccctatgacggcgtgagggcgcaggcgtatccccacatgctggtgactaccggtctgcatgattcccaggtgcaatactgggagccggctaaatgggtggcgaaactgcgggaactgaaaaccgacgataacctgctgctgctctgcaccgatatggattccggacacggcggaaaatccgggcgctttaaaagctatgaaggggtggcgctggagtacgcctttttcatcgccctggcgcaggggacactgccgggaaaagcggcagtgtag

SEQ ID NO: 6951 - DNA, 807 bp, Klebsiella pneumoniae
acccgtggtcacttgcctcaatatatgagtgactataacatgccttttagtcttcggaatatcaccgcacttcggcggttgataaacagcaaattgagtaaggccaggatgtcaaatacgccaatcgaacttaaaggcagtagcttcacgttatctgtcgttcatttgcacgatgcaaatcccgaggttattcgtcaggcgttagaagacaaaatcgcccaggctcccgcttttttacgtcatgctccggtggtggtgaatatcgccagcatcgaggaggaggtggaatggcgcgccatcaacgaggctatcgccgcgaccggtttacgtattatgggcgttagcggatgcaaaattccgcgcctgaaaaccgaaatcgaccgcgccggcatcccgttattaaccgaagggaaagaaaaagcctctcgtccggcaccgtccgaacccaccccgccgccgccagttgctagtcagatcacaaaaacgcgtttgattgatcagccggtacgttccggtcagcgcatttatgcgccacactgtgatcttattgttacaaatcatgtgagtgccggtgcggaacttatcgctgacggaaatatccatgtatatggcatgatgcgaggacgcgcgctggcaggcgccggtggcgacagagacgcccagatattttgtacccaccttgcggcggagctggtctccatcgccggggaatattggctgagcgataacatcccggccgaattttatggcaaagcggcgcgcctgcgtttaggtgaaagcgctttggcaattcaaccgttaaattaa

SEQ ID NO: 6952 - DNA, 540 bp, Klebsiella pneumoniae
ccgaagcgccaagcttcgccaatccggcggcgctcggtgagctgggtattcaggttgtggagaaagaggcaaaagcgtctctggagaacaagtaatatgtcatttaagctgcccgtttcggtgctggtggtcatttacgccgaagatacgaaacgggtgctgatgttgcagcggcgcgacgatcccgcgttctggcagtcggtcaccggcagcctggaagctggagagactgcgctgcaggccgccgcgcgtgaagtaaaggaagaggtcgccattgacgttgcctgcgagcaactgaccttaatcgactgtcagcgcacggtggagttcgagatattttctcatttgcgtcatcgctatgcgccgggtgtagagcgcaatacggaattctggttctgtcttgcgctgcctcatgagcgggagattactttcaccgaacatctggcctatcgctgggtcagcgcgacggaagccgctgcgctgaccaagtcgtggagcaaccggcaggcgattgaagaatttgtaattaacgccgcctga

SEQ ID NO: 6953 - DNA, 276 bp, Klebsiella pneumoniae
gagcaacaacaacgcggtggcggaaacatcaggctgcggccatgcctgtcgctcaccgtgaagggagaagagcggcgtaaaatcgtcgctcacggtctctccagcgaccagaacatgacgcaagcaggcgtgtttgtgcgccatctgtcgggccagctctgcgtggttttccccgtgaataacgtaagcgacgggttgcgccagctcaatcagcgcgtcgatatccagcgcccgttgcgagggcatcgccagcacggggataacgcccagtcttaa

SEQ ID NO: 6954 - DNA, 2751 bp, Klebsiella pneumoniae
gaggctgaacatatggcaaagctgctcaaggcaatgaaacgcccggcggcgctgtggggggtgccaatggtgcccctgctggctgtcacgggtgtaaccatcatcgttgctatctggacttccgtcgctctcctgttcttacttcctgtgcaatttctggtgatgaagtcccttaccagaaatgaaccgatgcggttcaatctgattgccgtatggctgagagcgaagggaaagccggtagcaaaccgtttatttggcgcaacaacatttatgcccgttgagcatgatgatgttgatatcaaggagtttctcgacgccatgaaactaaatcagtgtgccaccatcaagaagtacatcccgtactcatcgcacattcatcagcatgtggttcgttcccctaagagcgatctgtactgcacctgggaattgatgggaacgccgttcgactgcgagtctgacgagtcgctccagttcgggacgaaccagttacacgggctaatccgctcattcgaaggtatgccagttactttctatatccataacgaccgcaatacgtttaccgacaatcttcataaagattccggcaacccgtatgccgatgaagttagccgtctttactacgcttctgtcggtctgttccggcgcaaccgcctgttcctgacggtctgctatcgcccgtttgtcagccttgaaaaagcagaacgcaaacggatgaaagacagccagaaactaaaggagctggacggtgctttgctggaaatgctggaaataaaaagcacgctcgataccgcgctgtcgcgctatggtgcgcgacctctcggtacgtttaccgaaggaaacgcggtgttttcgtcgcaactggctttctatgaatatctgctaacgcaccagtggcgaaaagtgcgcgtcacccgtaccccggcctatgacgtgatgggggcggcggcgttgttcttttcggctgaatccgggcagataaaccacgccaacggtacgcaatatttccgggggctggaggttaaagagttcgccgaagagaccgccacggggatgatggactcccttctttacgccccctgcgattacgtgatcacgcagtcctatacatgcatgtcacgcgaggaagcgaagaaagccattaagcgtacccgccgccttttgatgagtgccgacgacgatgctgtttcccagcggctggatctggatgtggcgcttgacctgctgacatcggggaaaatcgcttacggcaagcaccatttttccatcatggtgtattccccgtcgctggaaagcctggttgctgatacgaatgaaatcagtaacgcgctgaacaacatagggataacgcctgttccggcagaaatatcgctttcagcggcgtatatggcgcaactgccaggcaactacaacctgaggccacgtaaaggggagctgagtagccagaactttgtggagctggccgcgctccataatttctatccgggcaagcgcgataaagccccctggggggatgcgatggctttactgcgcaccccgtcaggcgatggctactatatcaacctgcataacacactggcagataaggacgaattcaacgagaagaacccggccagtacctgcatcctcggtacgaacggttcgggtaaaaccatgttgatgacgttctttgagatcatgcagcagaaatacgggcgcgaggatagcttctccccggatgccaaaaccaaacggctgacaaccgtttacctcgataaagaccggggcgcagagatgaacatccgggcgctgggtggccgttactatcgggttatcagtggtgagtctacagggtggaacccgttctcgttgccagcaaccaaacgcaatatcaatttcatcaagcaactgatgaaaatcctttgtacccgtaacggctcgacgatctccccacgcgatgaacgccgtctgagtgatgcggtcaatgctgtgatgaatgacgagccgcaatatcgcgtctacggcattacccgaatgctggaaaatttgcctgagccggctacgaaagaagcccaggaaaacggccttagcattcggttgtcacagtgggcgcagggcggtgagttcggctgggtgtttgataacgagtctgacacgttcgatatcagcaactgcgataacttcggcatcgacggaacggagttcctggacgatgcaagcgtatgtgcgccaatctcgttttatctgctgtaccgcattaccagcctgcttgacgggcgacgcctggtcattttcatggatgaattctggaagtggttacgcgacccggtgtttaaggactttgcttataacaagctgaaaaccatccgtaagctgaacgggatgctggtcgtcggtactcaatccccggcagagatcatcaaagatgatatcgccccggcagtgattgagcagtgcgggacacagattctggcggcgaaccccaacgccgaccgcgcacactatgttgacggtatgaagtttgaaccggaagtgttcgacgtggtgaaagggcttgacccgcaagcccgccagtatgttgtggtgaaaaatcagttcaagcgcggcgataccaaacgttttgccgctcgtgtcacgctcgacctgtcgggtatcggcagatacaccaaagtcatgagcggcgatgcccccaacctcgaaatattcgaatcgatttaccgggaaggaatgcagcctcatgaatggctcgatacctacctggctaaagcgctctga

SEQ ID NO: 6955 - DNA, 222 bp, Klebsiella pneumoniae
ggaattttgcaaatggcaaagattaaaggtcaagttaagtggttcaacgagtctaaaggttttggtttcattactccggctgatggcagcaaagacgtgttcgtacacttctccgctatccagggtaacggcttcaaaactctggctgaaggccagaacgttgagttcgaaattcaggacggccagaaaggtccggctgcagttaacgtaactgctatctga

SEQ ID NO: 6956 - DNA, 2682 bp, Klebsiella pneumoniae
ctattcttgcagttgaatggctggacagccgcttactttgggacgcacatgagtcaggaaacgcccgcttcgcagactgaagccagaataaaaaccaaacgccgtatttcgccattctggctgctgccggtcatcgcgttgctgattgccgcctggctaatctggaccagctttgacgaccgcggatcgacgattacgattgatttccagtccgcgaacggcatcgtgccgggacggacgccgatccgctatcagggggttgaagtcggcaccgtccaggatattagcctcagtaaagatctgagtaagattgaggtttcggccagcatcaaacgcgatatgaaagatgcgctgcgcaaagagacccagttctggctggtcacgccgaaagcctctctggccggcgtatcgggcctcgatgcgctggtgggcgggaactacatcggcatgatgccgggcaagggtgaacccgaagatcactttgtcgccctcgacacccaacctaaataccgcatcaacaacggcgagctaatgatccacctgcaggcgccggatcttggctctctgaacagcggctcgctggtctacttccggaaaatcccggtcgggcgagtgtatgattattccctgaatgccaataatcagggggtgaccatcgatgtgctaatcgagcgccggtttaccaatctggtgaaaaaaggcagccgcttctggaacgtctcaggcgtcaaggccgacgtcggcctgagcggggccaaagtgcaactggagaacctgtccgcgctggtgaacggcgccatcgcctttgactcccccgccgattcgcatgtcgcctcgcaaaacgatgaatatcacctgtatgaagatctggcgcatagccagcgcggcgtggtagtgaccctcgatctgcctgatggcgacggactgaaagcgggctcgacgccgctcatgtatcaggggctggaggtgggccagttaagcaaactgaatctaaaccccggcggcaaagttactggcgagatgaccgtcgacccgagcgtggtgacgctgctgcgggagaaaacgctgattcagatgaagaagccgaagctctccctcgataaccccagcattagcaccctgctcaccggcaatacctttgagctggtgcccggcgaaggcgagccacgcaatcacttctcggtaatgccggcggataaagcgctgctggatgagcccaacgtcgccaccgttaccctctcggcgccggagagctacggcatcgacggcggtcagccgctggtgctgcacggagtaaaagtcggccaggtgctggagcgtaaactgacggccaaaggggtaacctttcaggttgccattgaccctgaataccgcgatctaattcacggcgacagcaaatttgtggttaacagtcgtctggacgtcaaagtggggctcgacggcgtgcaggtgctgggcgccagcgccagcgaatgggtgaacggcgggatcagggtgatccccggcgaaaaaggcaaaatgcaaagcagctatccgctgtacgctaaccttgaaaaggcgcaggaaaatagcctgagcgaagtgccgaccactaccctgagcctgtctgctgagacgctgcctgacgttcaggccggctcggtggtgctgtatcgtaaattcgccgtcggcgagatcatcgccgtcaaaccgcgcaaggatgcattcgatatcgatctgcatatcaagccggagtaccgctacctgctgaccaacaacagcgtcttctgggcggaaggcggtgcgaaggtcaagcttgacggtaacggactcaccgtgcaggcctcgccgctggcgcgcgcgatcaaaggggcgatcagtttcgataacctcaatggcagcagcgccggagcacggctgaataacaaacgtatcctttatgcatctgaaacggcggcgcgcgccgtgggcggccaaatcaccctgcacgcgtacgacgccgggaagatggcggccgggatgccgattcgttatctcggcatcgacatcggtcaaatccagtcgctggagctaatcaccgccaaaaacgaagtgcaggcgaaagcggtgctctatccggaatacgtcggcaccttcgcccgcgccgggacccgcttctcggtgatcaccccgcaaatctccgccgcgggcgtggaacatctcgacaccctgttccaggcctacatcaacgttgagcccggccgcggcccggcacgacgcgattttgagatccaggatacgacgatcagcgattcgcgttatatcgacggcctgaacatcgtggtggaagcgccggaggcggggtcgcttggcatcggtacgccggtcctgttccgcggactggaagtcgggacggttaccggactgtcgctggggtcgatgtctgaccgggtgatggttaagctgcgcatcagtaagcgctaccagtacctggtacgtaataactcggtgttctggctggcctcgggttacagcctcgacttcggcctgattggcggggtggtgaaaaccggtaccttcaatcagtttatccgcggcgggatcgcctttgccacgccgccgggcacgccgctggcgccgaaggcccaggatggcaagcacttcctgctacaggagagcgagccgaaagagtggcgggagtggggcaccgctctgccgcagtaa

SEQ ID NO: 6957 - DNA, 924 bp, Klebsiella pneumoniae
agatgcctgcagcgccgcctccgccgagcagcatcagggcagcatgacgcatattttcccgcgcatcggccgggtgcgcagtaccgaggagatcctcacggcgctatgatttatattgggcttccccagtggtcgcacccgaaatgggtgcgccttggcatcaccagccttgaagagtacgcccgccactttaactgcgtggagggcaacaccaccctgtatgcgctaccgaagccggagattgtcgcccgctggtatgaacagactcacgatgacttccgcttctgcttcaaatttccggccaccatctcgcaccaggccgccctgcgccattgcgacgagttaagcagtgaattttttgcccgcctggcgccgctggcctcgcgcatcggccagtactggctgcagctgccggcgacgttcggtcctcgcgatctccccgcgctatggcattttctcgacggactgccgaaggatttcacctacggcgtcgaagttcgtcatcccgagtttttcgccaaaggggaagcggaacagcagctcaaccgcgggctgcacgagcgtaacgtcaaccgcgtgatcctcgacagccgcccggtccatagcgctgcggccaccagtccggcgatgatcgatgcccaacaaaagaaaccgaaggtgccggtacatgcggtgatgaccgcccggcagccaatggtgcggtttatcggcggtgacgatatggcccataaccgggaactgtttcgcgtctggcttcagaccctggcgaagtggcatcagtcggggaccccgtggttgttcctgcataccccggacattgctttcgccccggcgctggtggataccctgtggggtgacctgcgcgctgccctgccggcggcaggaaatgcgccgtcgattccgcagcaatcttctcttttctga

SEQ ID NO: 6958 - DNA, 633 bp, Klebsiella pneumoniae
accataacgcaggagccccacgtgataggcagactcagaggcatcattctcgaaaaacaacccccgctggtgttgctggaaacggcgggcgtcggctatgaagtgcatatgccaatgacctgcttctatgagctgccggaggccgggcaggaggcgatcgtcttcacccactttgtggtgcgtgaagatgcccagctgctgtatgggtttaacaacaaacaggaacgtaccctgtttaaagagctgattaaaaccaacggcgtggggcccaagctggcgctggcgatcctctccggcatgtcggcgcagcagttcgtcaacgccgttgaacgggaagaggtcgcctcgctggtgaagctgccggggattggcaaaaaaaccgctgagcgtctgatcgttgagatgaaagaccgcttcaaagggctgcacggcgacctgttcaccccggcggccgatctggtgctgacctctccggcaggcccaacggcggacgatgccgagcaggaagcggttgccgcgctggtcgcgctgggctataaaccgcaggaggccagccggatggtcagcaagatcgcgcgtccggacgccaacagtgaaacgctaattcgcgaagcgctgcgcgctgcgttgtga

SEQ ID NO: 6959 - DNA, 1176 bp, Klebsiella pneumoniae
ttgtacgcgcagaacacctggtgttctgaaacggaggccgggccaggcatgaacacattttttaaaatcaccgcgcttgcgggcctgctggcaatagcaggccatgcattcgctgttgatgacataacccgcgcagatcaaatccccgtgctgaaagaagagccgcagcacgcgacggtaagcgagcgcgtgacgtcgcgctttacccgctctcattaccgtcagtttgatctcgacaacgccttctcggcaaagatttttgaccgttacctgaacctgctggactacagccacaatgtgctgctggccagcgatgtggcgaagtttgcggctaaaaaagaccaaattggcgatgagctgcgcagcgggaaactggacgtcttttacgacctctacaacctggggcagcagcgccgcttcgagcgctatcagtatgcgctgaaggtgcttgaacgtccgatggactttaccggcaatgataatttcaaccttgaccgctccaaagcgccgtggccaaaagacgaggccgagctgaacaagctgtgggacgctaaggttaagtttgaccagttaagcctgaagctggcgggtaaagacgataaagagatccgcgacaccttaacccgtcgctataagtttgctatccgtcgcctggcgcaaaccaacagcgaagatgtcttctcgctggcgatgaccgccttcgctcgcgaaatcgatccgcacacaaattatctgtcgccgcgtaataccgagcagttcaacaccgaaatgagcctctcactcgaggggatcggcgccgtgctgcagatggatgatgactataccgtcattaattcgctggtggcgggcggtccagccgcgaaaagcaaagcgatcagcgtcggcgatcgcatcgttggcgttggccagaccgggaagtcgatggttgatgtcatcggctggcgtctggatgacgtcgtggcgctgattaaagggccgaagggcagcaaggttcgtcttgaaatcctgccgggccgtaaaggagccaagacgcgtattgtaacgctgacccgcgagcgcattcgtctgggagaccctgcgggggaagatgtcggggaaaaaccggccgggaaagaaaaagtcggcggtgctggatatttccaggctttttaccgttggcctgacccgatgacgtga

SEQ ID NO: 6960 - DNA, 570 bp, Klebsiella pneumoniae
gcccaagcgcatttaatgcttattttagtaggctgtacgtatcaggcagtaagacaacaaagtgaagatataatgagcaaaacagaattttacgcggatctgaaccgcgatttccaggcattaatggcaggtgaaaccagttttctggcgatgatcgccaataccagcgcgctgctgttcgagcggctgagcgaggtcaactgggccggtttctaccttctggaaggcgataccctggtgttgggaccgttccagggcaaactggcctgcgtgcggatcccggtcgggcgaggcgtatgcggcgcggcggtggcgcaggctcaggtccagcgcgtcgaggacgtccacgcctttgacggccacattgcctgcgatgccgccagtaattcggaaattgtcttccctctgcgcgtgaatggccagattatcggcgtgctggatatcgatagtccggcttacgggcgcttcaccgctgaagatgagcaggggttgcgcacgctggtcgagcatctggaaaaactcattgcggccacggattatcaaaaaatctttacccgtgtcgtgggataa

SEQ ID NO: 6961 - DNA, 213 bp, Klebsiella pneumoniae
cgatcaaagcatcgccataggggggccagctgctcattcagtgccgcagtctgcgccacatcaccgctacgtatcgctcttaccagcgccagtgagcagtggggaaagagtccgccgcagaccgaataccaggcttcgcagccggcctgcaacccggcagtggcccatgcatcgccgctgacgccaagcgtaacgcgagagggaagatgctga

SEQ ID NO: 6962 - DNA, 1368 bp, Klebsiella pneumoniae
cggatttggcaaggtacacgccgccgatggttccaccgtatcccggcaggtggaaagagtggaaaaaccggaatccaattaacctataaaaatatttttataaaaggaaacgtgcatatgaacgacgaaaacaaaatgcctgtgccggatgaagcgcaggcattcccggcacacgctgaggatgatattgccacgcttgagcgggaagcccgcgctaaaagggaggccgagcttctcaatgcgcaggacgacgaagagaaagacccggtacaacccgccgttaacaagctgaaaaagcgcaaacggggcaaagcaaccgcctttcttgccattgtcgcggtcacgcttatcttcctggcatggggtggtaactgggtttatcgcaatatcctgtggcagcctacggaagaaaagaaacaggacacagccccgcagacgaacaaaaccgattaccggcagcgtaacgatctcggtatgtccaccgatacagccgaagaagagccagagcaacaggataacggccagagcagcacggggggaacagggcaggtggctccggccgccccgccagaactcaacaaagccagcttccttattcgccgtgatggttcggccaccacacagaacccggtaaaaacccggcagcaggaaatgacgctgacatcggcaacgaccaccggacaacaggacagcagcgcggccacaaataccgccgcaccgccgccgggacaaagccccgcaccactgcgccgcataccctataaccctgacctgtacatcccggaaaatacctcgatcccctgctcactggatcgccgctttgtatctgaccgggcggggaaacttcgctgcacggtcactactgacatctggagcgccagcggcaacacgaagctgatagagaaaggcaccaccgcatcattactttaccgcgccatagcggaagaaggtatgaagcacgggcaagggcgggcattcatcattgcgacgaagctacgcacccgccagccgccttatctcgatatcccgttggttgataccagcgcggctggcgagctgggcgaggctggcgttgatggctggatagattcgcacttctgggaacggttcggcggcgcgttaatggtcggcatgatccccgatattggcgcatgggcatccaacagcgcgggtaaaaaagaccgcaatacggactatacggaaaacagccgccaggctatggcagatatggcacgtaccacgctagagaacagcatcaatattcccccaacgctctataagaatcagggcgagatcatcaacctaatcacaggcgaggatattgatttttccaacatctatacactgaggttgaaaaatgaccgctaa

SEQ ID NO: 6963 - DNA, 408 bp, Klebsiella pneumoniae
cgcgagcggcacattatggcagtcttgccgcagccgaatggaatgcttaaagaggaaaaagcaatgacaattacgcgtattgatgccgaagcccgttggtcagacgtggtgatccacaaccagaccctgtactacaccggcgtgccggcaaatctcgatgccgacgctttcgagcagaccgccaataccctggcgcagattgacgcggtgctggaaaaacagggcagcgacaagtcgcgtattcttgacgccaccatcttcctcgccgataaaagcgactttgcggcgatgaataaagcctgggacgcgtgggtggtggctggtcacgccccggtgcgctgcacggtggaagcgacgctgatgaacccgcagtataaagttgagatcaaaattatcgccgcggtgtaa

SEQ ID NO: 6964 - DNA, 1326 bp, Klebsiella pneumoniae
ttgttctttaactgttacggagtcgctatgcgtgtcgtcatactgggaagtggggtggttggggtagccagcgcgtgttatttgagtcaggcgggtcatgacgtgacggtcatcgaccgtcagcccggtccggcagaggagaccagcgcggccaacgccgggcagatttctcccggctatgcggcgccctgggcggcgccgggggtgccgctgaaggcgatcaaatggatgtttcagcgccatgcgccgctggcgatcggtcttgacggcacctcgttccagttgaagtggatgtggcagatgctgcgcaactgcgacacccgccactatatggagaacaaaggccgtatggtgcgcctggcggagtacagccgcgactgcctgaaggcgctgcgcgacaccaccggcattcagtatgaagggcgccagggcgggacgctgcagctgttccgtaccgccaaacagtatgaaaatgccacccgcgacatcgcggtgctggaggacgccggcgtgccgtatcagctgctggaagcgaagcggttggcggaagtggagccggcgctggcggaggtcagccacaaactgaccggcggcctgcgtctgccaaatgatgaaaccggcgactgccagctgtttaccacccgtctggcggcgatggcggagcaggccggcgtgaccttccgcttcaacaccgcagtggatgcgctgctgcacgagggcgatcgcattgccggggtgaaatgcggcgatgagattatcaagggcgatgcctatgtgatggccttcggctcctactcgacggcgatgcttaaagggctggtggatataccggtctacccgctgaaaggctactcattaactattccgatcgctcaggaggacggcgcgccggtttcaactatccttgatgagacttacaaaatcgccatcacccgcttcgatcagcgcattcgggtcggcggcatggcggagatcgtcggttttaacaaagcgctgctgcagccgcgtcgcgaaaccctggagatggtggtgcgcgatctgttcccgcgcggcggccacgtggagcaggcgactttctggacgggcctgcggccgatgacgccggacggcacgccggtggtcggccgcacagcgtataaaaatctgtggctcaacaccggccacggcacgcttggctggaccatggcctgcggctccgggcagcttatcagcgatctgatctccggccgcacgccggcgatcccttacgacgatctggcggttgcccgctacagccccggttttaccccggcgcgcccgcagcacctgcacggcgcacacaactaa

SEQ ID NO: 6965 - DNA, 1632 bp, Klebsiella pneumoniae
aaagtgcttaataaagtacaaagtggcattttgtacgagctaactacagttaaaggggatgatagtatgaatagaatgactattccccttggtgacatattaactcaatccggtcaccaccgtgcaggcaatcgagagcttccggtcctatcaataaccatgaaaaatggtttggttgaccaatcagacaaattcaagaagcggattgccagttcagacacgtctaaatatcgtattgtatacaagaatgaacttgttgttgggtttcctattgacgagggagttcttggattccagacaaaatatccggtaggaatcgttagcccagcttatggtatctggaaactcaaggatgaatcggtatgccatatcccttaccttgagcgttatctgcgctcctccgaggcaaggcgactctatgcatctcgtatgcaaggggttgttgcacgtagacgtagcttgacgaagtctgattttcttagtttggaagtaccttttcctcccatcaatgatcaggctcgtatagctaatttattggccaaggtagaagggctaattgaacagcgtaaacaacttttgcaatacctggatgacctactaaagagcgtattcgtcgatatgtttagtgatccggtaaaaaatgcaaaaggatgggaactaacaacaataggtgagttagctgtcgatgtaagatacgggacaagtgtatcagcgcaaggtggaaaatataaatacatacggatgaataacattactccggatggttactgggattttgagaatcttaaatatatcgatgtagataataaggatctggataaatattctcttcagaaaggagatctcgttttcaaccggaccaattcaaaagaattggttggtaaaacggcggtttacgatcgagatgaaactgttattattgctggctatctcattcgtgttaggttcgatcaacaaactaacccttggtttgtatgggggcacctgaactcaaagtttggaaaagcaaaattatttaatctttgtcgtaatattattggtatggctaacattaatgcccaagagttaagggccatccctattcttaagcctccactggagttacaaaataaattcgctactattgtagagaaagcgcatgctattaaatttcgctatcagcaaagtcttgctgatcttgagaccctgtatgatgttgttagccaaaaggctttcaagggggaattagaactttcgcgtgtgcctattccgacacagatatttttcccggtatcaggtgaagaacctgaacacggggatgccgtacaacatatagcagtgggtaattatctgcccgtaactaatagcttaccatccgcgttggataatgcagaggctcgcaagtcactgatcgaggaatggctagaggcctatatagcgcaattgggcaactcatcgttttcagtacatgagttcatgatgacggcgcaggcacggctggcggaattatatccggacgttgattctaagtttggtgaaagtgactatgagcatatcaaagcttgggtgttcaaagctctggctattggtacactgaagcaggtattcaatgacgctgacaattgcattgaacttaaggcggttttggtatga

SEQ ID NO: 6966 - DNA, 1755 bp, Klebsiella pneumoniae
tataatgttaacaaaatgtattatccaggggctgtgatgacgacgaataactatttcagaggtgatgcagtgaaaaaggtttggctaaaccgttatcccgcagatgttccggcggagataaatcctgaccgctatcaatccctggttgaactgtttgaacatgccaccacccgttacgccgaccaaccggcgtttatcaatatgggtgaagtgatgacctaccgtaagctggaggagcgtagtcgcgccttcgccgcttatcttcaggaggggttggggttacagaagggcgatcgcgtggccctgatgatgcctaacctgctgcagtatccggtggctctgtttggcatcctgcgcgccgggatgatcgtggttaacgtcaaccccttatataccccgcgcgaactggagcatcagctcaacgacagcggcgcggcggcgatcgtcatagtctccaactttgcccataccctggaaaaagtggtggcgaaaactcaggtccagcatgtgatcctgacgcgcatgggcgaccagctttccaccgccaaaggtacgctggtgaactttgtggtcaagtacattaagcgcctggtgccgaagtaccatctgccggacgccatctcgtttcgcagcgcgttgcagcacggctatcgcatgcagtacgtcaagccggagatcgttgcggaagatctggcgtttctgcagtacaccgggggcaccaccggcgtggccaaaggcgcgatgctcacccaccgcaatatgctggctaacctcgagcaggtcaatgccacctacggcccgctgctgcatcgcggcaaagagttcgtggtgaccgcgctgccgctgtatcacattttcgccctgaccatgaactgcctgctgtttatcgaactgggcgggcaaaatttgttgatcaccaacccacgcgatatccccgggctggtgaaggagctggcgaagtatccttttaccgccatgaccggggtcaataccctgttcaacgccttgctgaacaacaaagagttccagcagcttgatttctcctcgctgcatttgtccgccggcggtgggatgccggtgcagcaggcggtggccgagcgctgggtaaaactgaccgggcaatatctgctggagggctacggcctgacagagtgttccccgctggtcagcgttaacccgcacgatattgactaccacagcggcagcattggcctgccggtgccttccaccgaagccaaactggtggatgatgatgataacgaagtggcgccgggtcagccgggcgagctctgtattaaaggtccgcaggtgatgctgggctactggcagcgccctgacgcgacggatgagattatcaaagacggctggctgcacaccggggatatcgcggtgatggatgaagaggggttcctgcgcatcgtcgatcgcaaaaaagatatgatcctggtgtcgggttttaacgtctatccgaacgaaatcgaagatgtggtcatgcagcatagcggggtgctggaagtggcggccatcggcgtgccgtccggcagcagcggcgaagcggtgaagattttcgtagtcaagaaagatgctgcgttaaccgaagaggcgctgattacgttctgccgtcgccatttgaccggatacaaggtgccgaagctggtggaattccgtgatgaactgccgaaatccaacgtcgggaaaattttgcggcgagaactgcgtgacgaagcgcgcgctaaagtggacaataaaggctaa

SEQ ID NO: 6967 - DNA, 501 bp, Klebsiella pneumoniae
ccaacgagtaatacggtaatggcgatgaacggaacaatcacaacgtggtttaaagataaaggttttggatttatcaaagatgaaaacggcgaaaatcgttattttcacgtgattaaggtcgccaatcctgatcttatcaagaaagacgcggcggtgactttcgaacctaccaccaacaataaagggctgtcggcctacgcggtgaaggtcattccggaaagcaaatatatctatattgccggcgagcggttgaagctgacctccatcaaatcctatgtggtgtaccgggaagaagagccggtcgagacccgcgtcgataaagaaaacgccgtgctgtcggtcgggctgctgatgaacagcatccggccaaaagccacggtgcagccgggagagatgcgctcggtgaaaaagctggcgatcaccacctttcaggggacaaccctgatcttttcggaagacgaaatcgatatcgatgccacggtaaaactgcttaaggtgtaa

SEQ ID NO: 6968 - DNA, 537 bp, Klebsiella pneumoniae
cccgccggtaacggccagcatgcccacgcccaccgccacggcggccatctgctccggcgtacgggcaaaacggcgggcggtggcggccgggataatcagcagggaagtgatgatcagcgccccgacgaacttcatcgccacgccgatagtcagggcggtgaccagcatcaacagcagcttgacccgctgcagcttcacgccgtcgacaaacgcaaggtccggactgatggtcatcgccagcagatttcgccactgccagagcagaatgccaatcacaatcaccacgccagtggcaatggcgatcaggtcctgcggcgtaaccgccagcagatcgccgaacaggtacgccatcagatcgacgcggacgttagacatcagactgaccaccaccagccccagggacagcgcgctgtgcgccatgatgcccagcagggtatcgatcgccagatgcggtcgtttttccagccacaccagcccgccggccagcagcagggtcacggcgatcaccgcatagaacggattgacgttaagcaataa

SEQ ID NO: 6969 - DNA, 825 bp, Klebsiella pneumoniae
gacttaatcaacaggagaagtacaatggagattacccttcttcagattgtgctggtgttcatcgtcgcgtgtattgcgggtatggagtcggtacttgatgaatttcagttccaccgtcccctgatcgcctgtacgctgatcggcgccgttctcggcgatatgaaaaccggtattatcatcggcggtacgctggagatgatagccctgggctggatgaacatcggtgcggcggtagcccctgatgccgcgctggcgtccattatttccaccgtcctggttattgccggccatcagagcatcggcgccggtatcgcgctggctatcccgctggcggcggcaggccaggtgctgaccatcatcgtgcgcaccatcaccgtggccttccagcacgcggcggataaagcggcggagaatggtaacctgaccgccctgtcgtggctgcacgtctcgtccctgttcctgcaggcgatgcgtatcgctatcccggccgttatcgtggcgatttccgtcggcaccagcgaagttcagggcctgctgaatgctatcccggaagtggtcaccagcggtctgaacatcgccggcggtatgatcgtggttgtcggttatgcaatggtcatcaacatgatgcgcgcaggctatctgatgccgttcttctacctcggcttcgtcaccgccgccttcaccaacttcaacctggtggccctgggtgtgattggtgcggtcatggcaatcctctacatccagctgagcccgaaatataaccgcgtcgccggtgcgccggctcaggcggctggtaacaacgatctcgataacgaactggactaa

SEQ ID NO: 6970 - DNA, 1083 bp, Klebsiella pneumoniae
tcgtttcccaacacaacccgtcccgcaagggtaaaattgcacgcatactgcgcccttgcaggacagaacgatgccgggaaagcgaaccgtcaggcgatacgaagacgaaaatcacacactgacggagaaaaaaccatgacgatttccctttatacctcccggacaagcgcccctaacaccgcagcggcgaccagcgtatcctcgctggagcagtcaggctcctcaaaaacgaaattttctaaaaccagaacggatatttatcagaccgttaccgacagcatcattgcagcgctggaagccggtgtaaaaccgtggtcctgcccgtggctgcgtgtatccggcatgtctggactgccatccaattacgccactggcacggcttacagcggaatgaatatcatgttgctgtggtgcagcgcatctaaacagggtttcagcgattcccgctggatgacttacaaacaggcacaggcagcaggtggacaggttcgcaagggtgaacatggcacaacagccattttctatacgaccctggaaaaggaaaacgacgccggagaggttgaacaaattccgatgctgaaaactttcaccgtgtttaacgttcagcaaatcgacggtttgcccctgacaactgaaacagtcagcccggaagctacatttaacccgttgccgcaggctgagaacctgttacggaagagtggcgcaaacatcatcgagaaaggacaaaacgcctttttcagcccatcaactgatgaagtctggttaccggagcgccatttgttttcggatgcggctaacttctacgctaccggtctgcatgagctggttcactggagcgggggtaaaaaacgcctgaaccgtgaaatgaaagggaagtttggcagtgcggattatgcagaggaagaacttgtcgcggagctgggaagtgcctttctgatggctgatcttggcattgagggagaggtacaacatgaaagctatattgcttcctggctgaaagcgctgaaaaacgacaagcgttatattttcaaagctgtcagcgccgcctctaaagcgcattcttatctgatggataaactctga

SEQ ID NO: 6971 - DNA, 1950 bp, Klebsiella pneumoniae
tattgctgttttccgacggacagctcagggaaatggggaaccatacgcaactgttggcgcagggcggcctgtatcaacggctctggcaacactatcagcaggcgcagcattgggtgccgggtggaacacaggaagaggtggtggaaaatgaaagacaataatcctgcggataacctggcctggcgcgtcaactggcgccagcttatctccagcgttggcagtcaggccaggatgctgcgacgcagtatgctggcgctgttgctggcggcattcatgcaggggatcgcctttgcctgtctttatccgatcattgatgcgctgttacggggagacgcgccgcaacttcttaactgggctatggccttcagcgtcgccgcaattgtgacgctggtgctacgctggtatggcctgggctttgaataccgtggtcatctggcgcaggccacccatgagttgcgcctgcgacttggcgagcagttacgccgcgtgccgctggagaagctccagcgcggcagggcgggtgaaatgaacgccttgctgctgggcagcgtggatgaaaacctcaattatgttattgcgatagccaatattttgctgctcaccattgtcacgccgctgacggcgtcgctggcgacattgtggatagactggcggctggggctggtgatgttgctgatcttccctctgctggtgccgttttattactggcgccgcccggcgatgcggcgacaaatgcagacgctgggggaagcgcaccagcgtctgagcggcgatatcgttgaatttgctcaggggatgatggtattgcgcacctgcggcagcgatgccgataaaagccgggcgctgctggcgcatttcaatgcgctggaaaacttacagacccgcactcaccgtcagggcgctggcgcgacgatgctgatcgccagcgtcgtggagttgggcctacaggtggtggtgttatccgggatcgtctgggtagtgacgggcactctgaacctcgcctttttgattgccgccgtcgcgatgattatgcgcttcgcagaaccgatggcgatgtttatcagctacacctcggttgtggaactgatcgccagcgccctgcaacggattgagcggtttatggcgatagcaccgcttcccgtcgcagagcaaagcgagatgccggaacgttacgatatccgctttgacaacgtcagctatcgctacgaagaaggcgacggccacgcgcttaatcatgtttctttgacgttcccggcagccagtatgagcgcgctggtgggtgcctccggcgcaggcaaaactacggtcaccaaactgttaatgcgctatgccgatccgcagcaagggcagatttctattggcggcgtcgatattcgccgcctgacgccggaacagctcaatagcctgatttctgttgttttccaggatgtctggctgtttgatgacacgctgctggcgaatatccgtatcgcgcgcccacaggcgacgcggcaggaggtagaagaggccgcccgcgcggcgcagtgccttgagtttatttcccgtcttccgcaaggctggctgacgccaatgggagagatgggcggccagctatcgggcggcgagcgccagcggatttccattgccagagcgttattgaaaaacgcgccggtcgtcattctcgatgaaccgactgccgcgctggatattgaaagcgagctggcggtgcaaaaagcgatcgataacctggttcacaaccggacggtgattatcatcgctcaccgtttatccaccatcgccggggccggaaacattctggtgatggaagagggacaggtggttgagcagggtactcatgcacaattgctctcacatcatggacgttatcaggcgctgtggcaggcgcaaatggccgcgcgcgtgtggcgcgacgacggggtttccgcgtctggagagtgggtgcatgagtga

SEQ ID NO: 6972 - DNA, 222 bp, Klebsiella pneumoniae
ggagaatacaacgtgccagatgaaatcgatcgcgatcaggcgtttaatgaacggtgcctagaagtactgattgaacaaagccggttaagacccacaccgacaccttccctgcagcactgtcgattatgcggcaaggctattccggaaaaacgccgtcagacgctgccgggtgtaacaacctgtactgactgtcagtcgatactggagaaacgcagacgttaa

SEQ ID NO: 6973 - DNA, 1584 bp, Klebsiella pneumoniae
ccttgccgcaaaccggagtcgtacatggaattgttaatggatccctcaatctgggccggcctgttgacgcttatcgttctggaaattgtgctcggtatcgacaacctggtgtttattgccatcctggcggacaaactgccgccgaagcagcgcgataaagcgcgtctgattggcctgtcactggcgctggttatgcgcctggggctgctgtcggtcatctcctggatggtaacgctgacgaaaccactgattaccatcgccgatttctccttttccgggcgcgatctcatcatgctgctcggcgggatcttcttgttgtttaaggcgacaaccgagctgcatgaacggctggaaaaccgccagcacgatgccggtcacggtaaaggctatgccagtttctgggtagtagtattgcagatagtggtgctggatgccgtcttctccctggacgccgtgatcacggcggtcgggatggttaaccatctgccggtgatgatggcggcggtggtgatcgcgatgatcttgatgctgctggcctccaagccgttgacgcgctttgtcaaccagcacccgacggtggtcgtgctctgtctgagcttcctgttgatgattggcctgagcctggtggcggaagggtttggcttccatattccaaaagggtatctgtacgcggcgatcggtttctcgatcattatcgagttctttaaccaggtggcgcgccgtaactttgttcgccaccagtcgacgctgccgctgcgcgctcggaccgcggatgccatcctgcgcctgatgggcggccgcaaacaggcctccgtcagccatgacgcagacagtccagccgcggtgcccgttcctgagggcgcctttgcggaagaagagcgctacatgattaacggcgtgctgaccctggcccagcgctccctgcgcagcatcatgaccccgcgcggagaaatcagctgggtcgacgctgaacagagtgaagatgaaattcgtcgtcagctgctgtcgtcgccgcacagcctcttcccggtctgccgcggagagctggatgaaatcattggtatcgtgcgggcgaaagagatgctggtggccctggagtcgggggaaaacgtcgcggcgctggcttctgcctccccggcaattgtcgttccggaaacgctggacccgatcaatctgctcggggtcctgcgtcgggcgcgcggcagcttcgtcatcgtaactaatgaatttggcgtggtgcaggggctggtcacgccgctggacgtccttgaagccatcgccggtgaattcccggacgctgatgagacgccagagattgtcatcgatggcgatggctggcttattaaggggtcgaccgacctgcatgcgctgcagcaggcgctggggctggatccactgatcaatgacgatgaggatattgccaccgttgccgggctggtgatctccgccaatggtcatatcccgcgcattggcgacgtcgtgtcgcttccgccgctgcattttaccgtagtggaagcgaatgattaccgggtggatctggtgcgcgcggtggtcactcgtccgccgagcgacgaagaagagtaa

SEQ ID NO: 6974 - DNA, 207 bp, Klebsiella pneumoniae
atcgtcggcaaatggaaaaaatacccgactcatacggaatgtgtagagttttattattctgcaacagtgccgcgtgtcactattttatcttgtagttatccgcaggatccgctgacgcgcaccagtaaccccttcccggttaataaggatattttttatggcagttccaggaatggcacaaaagctaaacacccaaatgaatcttga

SEQ ID NO: 6975 - DNA, 1923 bp, Klebsiella pneumoniae
  unsure (1757): Identity of nucleotide at the above locations are unknown.
ccagggggcaatgtgatcgacgattttgcagcagacggccagctagccaaagccataccgggatttaaaccgcgcgagccgcagcgccagatggcggtggcggtcagcgaagcgattgaggcctcccggccgctggtggtggaagcggggaccggaaccggtaaaacctacgcttacctggcgcctgcgctgcgggcgaaaaaaaaggtgattatctccaccggctcgaaagcgctgcaggatcagctttacagccgcgatctgcccaccgtcgccaaagcgctcaaattcaccgggaaactggcgctgctcaaagggcgctccaactacctgtgtctcgaacgtcttgagcagcaggcgctggcgggcggcgatctgccggtgcaaaccctcagcgatgtgatcctcctgcgctcctggtcgaatcaaacccaggatggcgatatcagcacctgcgccagcgtcgcggaagactctcaggcctggccgctggtcaccagcaccaacgataactgtctcggtagcgactgcccactgtataaagattgcttcgtggtgaaggcgcgtaaaaaagcgatggacgccgacgtggtggtggtcaaccatcacctgtttctggccgatatggtggtcaaagagagcggctttgccgagctgatccccgaggcggaagtgatgatcttcgatgaagcccatcagctgccggatatcgccagtcagtactttggccagtcgctctccagccgccagctgctggacctggcgaaagacatcaccattgcctaccgcaccgaactgaaagacactcagcagctgcaaaaatgcgccgaccgcctggcgcaaagcgcgcaggatttccgcctgcagctgggagacccgggctaccgcggcaatctgcgcgagctgctggcggacagccacattcagcgagcgctgctgctgctcgatgacgcgctcgagctatgctatgacgtcgccaaactttcgctgggtcgctcggcgctgctcgacgccgcttttgagcgcgccaccctctatcgcgggcgcctgaagcggttgaaagagatcaaccagccgggctacagctactggtatgagtgtacctcgcgccactttactctcgcgctgacgccgctgaccgtggccgagaagtttaaagaggtgatggcgcagaagtcggggagctggatctttacctcggcgacgctgtcggtgaacgacgatctgcatcactttaccgcccggctggggatcgacgaggcgcagactctgctgctgccgagtccctttgactatcagcaccaggcgctgctctgcgtgccgcgcaacctacccctgccgaaccagcccggcgcggcgcgacacctggcggcgatgctcaagccgctgatcgaggccaacgatggtcgctgctttatgttgtgcacctcgcacgccatgatgcgcgatctggctgagcagttccgcgccaccatgacgctaccggtgctgctgcagggcgagaccagtaaaggccagctgctgcagcagttcgtcagcgccggcaacgcgctgctggtggctaccagcagcttctgggagggagtcgatgtgcgcggcgacgcgctgtcgctggtgattatcgataagctaccgttcacctcgccggacgatccgctgctaaaagcgcggatggaagattgccggctgcgcggcggcgatcccttcgatgaagtgcagctcccggatgcggtgatcaccctcaagcagggggtggngcgtctgatccgcgatatcgacgaccgcggggtgctggtgatctgcgacaaccggctggtgatgcgcccctacggcgcggtgttcctggccagtctgccgccggcgccgcgaacccgcgatatccgtcgggcggtgcgctttctcgccgtaccgccggcaaggtaa

SEQ ID NO: 6976 - DNA, 1425 bp, Klebsiella pneumoniae
  unsure (25),(32): Identity of nucleotide at the above locations are unknown.
tcaatgctaaactcatcattcaaanaaccgtntcatttaagactcatattcaccatggataaaaattcttctgatggcgtgccgttgccgcaacgctatggcgccattctgaccatcgtgcttgggctgaccatggccgtgcttgacggggctatcgccaacgtcgcgctgccgactatcgccagcgatctcaacgcctcaccggcggcttcaatctggatcgttaacgcctaccaaatcgccattgtcatcgccctgctgccgctctccttcctcggcgacatggtcggctatcggcgtatctataagataggcctggtggtgtttatctttacctcgctggcctgcgcgctgtcgcgtagcctcgaaatgctaaccttcgcccgcgtcgcgcagggattgggcggcgccgcgctgatgagcgtcaacaccgcgctgatccgtctgatttatccgcagcgctttcttggtcgcggcatgggcattaactcctttgtcgttgccgtctcttcggcggcaggcccgactatcgccgcagcgatcctctccctcgcctcatggcaatggctgtttttaattaacgtgcctctcggcatcgtcgcctttgttctggccatgcgctttctgccgcccaacagcgcgcgcagcaaaatcatccgcttcgatctgccgagcgccattatgaacgcccttaccttcgggctgctgatcaccgccctgagcggtttcgcccaggggcagtccactcagctggtgctggcggaggtcgccgctatgctggtggtggggttcttcttcgttcgccgccagctcacgatgcccgtccccctgctgccggtcgacctgctgcgtatcccactcttttctctctctatctgcacttccatctgctccttctgcgcgcagatgctggcgatggtctctctgcccttttttctgcagtcgatgatggggcgcagcgaagtggagaccggtctactgctaacgccgtggccgttagcgaccatggtgatggcgccgctggccggctatttgatcgagaaatgtcatgccgggctgctgggggctatcggtttgctgattatggcctgcggcctgttcggcctggcgctgctgccctcgtcgccctccgatctggatatcatctggcgcatggcgctgtgcggcgccggcttcgggctgtttcagtcgccgaacaaccataccatcgtcgcctcggctccgagccatcgtagcggcggcgccagcggcatgctgggcaccgctcgcctgctcggacagagcaccggcgcggcgctggaggcgctgctattcaatttgctcggtaacaacggcacccacaccgccctgctgctggccggcaccctggctatcgtcgccgcgctaattagcggtctgcgggtcactcagccgcgcgcagcctga

SEQ ID NO: 6977 - DNA, 1746 bp, Klebsiella pneumoniae
atatggctaaagatgcgcaaaggtacgtgcgacggcagcatcggggccgaccgaccagtgactgaccgccagcgttcaggctgccttggctttgcgcgctttggccgccggcacggcgtcatcacccgccggagaagtctcggcggtagccgacggcgcggaggcgtcctgtgcgggcgtctcttgctccggcagtcggccaactcgcaggatatgctgcagcgcttctttacgctcagccagccacatcgccatggtatcgcgctggacgtcatccatctccagcggcgatgccaccagccagtcattcagcacctctgccagatcgagcattttgtcgtaagcgtcggcctcttttttgctggcaaaagacattttttcctcaccttcgcggatcaccacatatttaatttcaaccgccatactgcagcctctcaacactgtatttttatacagtatagcaaatttccctctcggactcaactcacgcgcgttacgcgcgtaaagacatacgcaaacgttttcgtttataatcgctgccatctttttttactgcggatgagagttatgactgtattaggcaccgcgctgcgcccggcagccaccaaagttatgctgttaggttccggcgagttgggtaaagaagtcgctattgaatgtcagcgtctgggcattgaaaccatcgccgtagaccgctaccccgatgccccggcgatgcaggtcgcccaccgcgcccacgtcatcaatatgctgcacggcgagagcctgcgcgccctgattgaacaggaaaaacctgattatatcgtgccggagatcgaagctatcgctaccgacaccttggtcgaactggaacaggccgggcagaaagtggtccccacggcgcgggcggcaaagctcaccatgaaccgcgaaggcattcgccgcctggcggcggaagagctgcagcttcccacctcccgctatcgttttgccgacagcgaagaaggcttccgcgcggcggttaccgagatcggtttgccatgcatcgttaaaccggtgatgagctcctccggcaaaggccagagctttatccgctcggctgaccagctccgcgaagcctggcgctatgcgcagcagggcggccgcgctggcgccggacgggtgatcgtcgagggggtggtgaacttcgatttcgaaatcaccctgctcaccgtcagcgctgtcgatggcgtgcatttctgcgctccggttggtcatcgtcaggaagacggcgactaccgcgagtcctggcagccgcagcagatgagcgacctggccctcgagcgtgcccagaccatcgcccgcaaggtggtgctggcgctgggaggttatggtctgtttggcgtggagctgttcgtatgcggcgacgaggtgatcttcagcgaagtctccccgcgaccacacgacaccgggatggtgacgcttatctcccaggatctctcggaattcgccctgcacgttcgcgctttcctcgggctacccgtcggcgctatccgccagtatggcccggccgcctccgcggtgatccttccgcagttgtccagccagaacgtcagctttggccagctgcagtcggccgtcggggctggcctgcagctgcgtctgttcggcaagccggagattgacggtacccgccgcctgggggtaaccctcgccgtcgccgattcggttgaggaggccgtggcgcgggctaaagccgccgccgcggcggtcatcgtcgaagggtaa

SEQ ID NO: 6978 - DNA, 1614 bp, Klebsiella pneumoniae
agaaatataaaaacagtgtttcaaaaatataaaacacgaggtttattttttatggctagatacacggcttcagcctctgaagggctgcagggaagaccgatcttgttacgccatcagttagcctacggcggcggaaatctgttagggagcggcgcactggcgataagcggcgcatggctactctatttttatacgaccttttgcggcctgacgctgatcgaggcctcatttatcttctccgtcgccagcatcattgacgctatcagcaacccgctgatgggctatctgacggataattttggcaaaacgcgcctgggcaagcgcttcggccgccggcgtttctttctgctaatcggtattccgctgatgatgttctacccgctgctgtgggtggaaggcctgagtttctggtactaccttagcacctatgtggtgtttgagatcatctacacctctatcatggtgccttatgaaacgctggcgacagagatgaccgatgatttctcactgcgttcaaaactgaccggctataaagctatctttggtaagctggccaacttcctcgcggcgtttattcccggccagttcattctgctgtatggcaaagattctgccacccctttcttcctcaccggtctgacctatggcgcgatcctgatcgtcgctatttcctgcctgtggttgtgcagctgggagcgtgagcgcggggaagaggtggaaaccagcgcgaaaaaaggactgctgagcaccctgctgtcgctggcgaaagatatgcgttcgactttttatctacgcgtattccgcaaacatcttggtatgtacctgtgcggctttggcgcggaatggctgtttgcctccatcttcacctatttcgtgatcttcgttctacaacacgatccagcgatggtggccgggctgaacagcctgaactcgattctgcagctgatctctacggcgctgtttatcggcctttgcgtgaaaaagggcttcagcaaaccctatatcctggcgctggggatcgtgattttcgcggttctgctgtatacctcgctgtggtttttccatctaccgtccggcctggcgacagtgctgatgttcggcattaccgtgctgttcggcctgggtaccggcggggtttactatataccctggaccgtttacaccttcctggccgatgtcgatgagatctacaccggacgccggcgggaagggatctatgccggcgccatgaccttctcaggaaaaattctgcgctcgattgtggtgttctcgatgggggcgatcctgagcttctacggtttccagtcaaaagcgcacagccaaccggaaagcgcggtgaccgctatcgcagtggtattctgcgtcggggtgatcgcattagccctggccgccatcgtcttcagcaagcagatgaagctggaccggaaggcccatctggtggtgctgcaggaagtcgcgcggataaaagcgggcggcaaaattagcgatattgcgccggacgtgcgggttatcgtggaggatctggtcggccatcgctacgaagagtgctggggcaacagcaaattgttcaaagatgctgcccctgcgcctgcgcagaccgtcgtttcccattaa

SEQ ID NO: 6979 - DNA, 1284 bp, Klebsiella pneumoniae
atgccgataaaaacacccaccctcaaacctgcgaaaaagatggtcgtgcataccgtcagcacgccgcttccctatgcgcattatcagcgctgtacgcaatgtgacatgctcttccgcttaccggtgctcaaacgcaaccaaagcgcctggtgtccgcgctgtaacgcgaaggtgcgcgatggccgcgattggtcgctgacccgcctgggcagcatggccctcgcgatgctattgctcatgcctttcgcctggtctgaacctctgctacgcctgcatttgttgggtgtacgcatcgacgctaacgtcctgcaggggatctggcagatgaccgcgcagggcgatccgattaccgccgccatggtgctgttttgcgcggtggtcgccccggtgctgctggtggtctccatcagctatctctggctgggcaatgtgctggggatgaacctgcggccggtgctgctgatgctcggcaagcttaaagagtgggtgatgctggatatctatctggtgggcatcggcgtcgcctccatcaaggtgcaggatgacgccttcctgcagccgggcatcggtctggtggcgtttatctccctgacgttgttgagcatcctgacgcttattcatatgaacgtcgaagagctatgggagcgtttctatcccgagcgtccggcgacccgcgccgataataatctgcaggtgtgcaccggctgccattacaccggctatcgcgacgcgcgcggccgctgccgacgctgccacacgccgctgcatcatcgccgaccgcagagcctgcagcgcagctgggcggcgctgattgcctcgctggttttcctctttccggccaacctgttgccaatctccatcatctacgtcaacggcgcgcgccaggacgacacgatcctctcggggatcatctccctggccagcagcaatatcgccattgccggggtcgtgtttatcgccagtattttggtgccattcaccaaagttatagtgttatttaccctgctgctcagcatacaattcaagtgcgagcagggattgcgcacccgcatcctgctgctgcggctaatcacctggattggccgttggtcgatgctggatctgtttgttatctcactcaccatgtcgctaataaatcgcgatcagctcctcgccttcaccatggggccggctgcggtttactttggcggcgcggtaattttaactattcttgcagttgaatggctggacagccgcttactttgggacgcacatgagtcaggaaacgcccgcttcgcagactga

SEQ ID NO: 6980 - DNA, 276 bp, Klebsiella pneumoniae
  unsure (78): Identity of nucleotide at the above locations are unknown.
aaagcgataaacggtgcttttcgacatcatgacgcgctgggacagttcggtaatgccaatttcacgctcttcacccancgcctgttagatgccgaaaaccttcaataccgaagagacagaatctggctggttatccaattctgcacctgccatttatcacctcgtcgtacctgtttattaaaaattagaaccggtttttattataaattcgccgcctctgagccgcaatcattcttctgccacttcgttacaaatctgcgacatactgcgaattaa

SEQ ID NO: 6981 - DNA, 1257 bp, Klebsiella pneumoniae
cggattgcaaatccgtctagtccggttcgactccggaacgcgcctccactttatatcccgagcccggatggtggaatcggtagacacaagggatttaaaatccctcggcgttcgcgctgtgcgggttcaagtcccgctccgggtaccattgggaaatacagaataatcaaagcaataagcagtgtcgtgaaaccacctacgggtggtttttttgtttctgtactttcgccttctgatacctttcccgccagcctgacgccacggcgtttttcggttaactcttgccttacagtcaatttctcatttgtcccaggacaaaacgatcgcgccttgctactatcaaacggactctcagcccagcctgccggaggcagcatgttcagtggactttgcgcatttcctttgacacctttgcatcagcaaaaatttgatgaaaaagcgtttattcgtattctcgcccgtcttaccgatgccggagtcgactctctgggcatcttaggttcaaccggtagctacgcttatctcagccgtgagcagcgcagacgagtggtgcaggtggcgaaggcgcatgcggggtcgatcccgatgatggtcggcgtcggcgccattgcgactaacgaggtgctacgcctggtggaggatgctcaggaggcaggggcggatgcgttattactgccgatgatgtcctatcagccgctttccgcggaggagatctttgccttttatgaagaagtttgccggcatgtctcggtgccggtttgcctgtatgacaatccccgcactacccacgtaatgctggcggatgagctgcaggggcgcatcgccgccttgccggccattgcctcgattaaaattcccggcctgcccgcgccacaggcgagcgaacgtgtagcggccctgcgtcagcatcttccctctcgcgttacgcttggcgtcagcggcgatgcatgggccactgccgggttgcaggccggctgcgaagcctggtattcggtctgcggcggactctttccccactgctcactggcgctggtaagagcgatacgtagcggtgatgtggcgcagactgcggcactgaatgagcagctggcccccctatggcgatgctttgatcgctatggtggtagcctgcgagtgatagccagcgccgcagcgatgctcggactctgcgatccagactcgcttccccgtcctttgctttcgttaggggaggaggcctgtcgtgaggtggcgtcggcgctgcgcggcctggcctga

SEQ ID NO: 6982 - DNA, 780 bp, Klebsiella pneumoniae
catgctgcaaaggttgtctggatcagggagagaggaatggcggtactggaagtgtgttgctacagcatggcgtgcgcccgggaggctgagcgctgcggcgccgatcgtattgagctctgcgccgcgccgcaggaagggggattaaccccctcttatggggtgctggtctcggcccgcgaggcgattactctcccggtgcatccgatcgttcgcccgcgcggcggcgatttctgctacaccgaggaagagttcgccgcgatgcttaacgatattcgcatggtgcgggatctgggcttccccgggctggtgaccggcgtgctggatgctgatggccagatcgatatcccgcggatgaaaaaaataatggccgcggcggggccgctggcggtgacctttcatcgcgcgttcgatctgtgcgccgacccgcgtcaggcctggaaaacgctgggtgagctgggggtcaaacgtatcctgacttccggtcaacaatcctcggcggagaaaggtatttcattaattacggaacttattgccgcaggggatactccaatcattatggccggtgcgggagtccgcgccgcgaacctgccgctgtttctgcaggcgggggtgaaagaggtccatagctctgctggccactggttgccgtcggaaatgcgctttcgtcatccgggcgtttcgatgtcagccgatcccgatgccgatgaatacagacgctacgccgtgaatggcgcagcggtggcggagatgaaaaggattatctccgcctggagaagttaa

SEQ ID NO: 6983 - DNA, 195 bp, Klebsiella pneumoniae
tttccggcaaacggccaacccgccgccatgccgcccgaagtctattgggaaccgctaattaacaaaatggcgcgcagcttaacacattttagtgcggattaccttgccggcggtacggcgagaaagcgcaccgcccgacggatatcgcgggttcgcggcgccggcggcagactggccaggaacaccgcgccgtag

SEQ ID NO: 6984 - DNA, 234 bp, Klebsiella pneumoniae
tcatatcaaaataaaaattcacaacagtgcaacattaaaaacacaaccaacaaacaatcctatatacaaggcacatctccagaatataaaagcacagacaaacaacctaaaaaaacaacccgaattaataaaacctttacaattacacaccctcaactcaaaacaatttcgaaaactcaaagatttcatcggcaaaaacagtcattaacacatatattttttgaaattctgtag

SEQ ID NO: 6985 - DNA, 1404 bp, Klebsiella pneumoniae
atcaataaaaatagagctactgtgagccatggacaggagaaagccgggatgacacaaatactgggaaccggagagggaaaaacatcatcagccgcaaaagagccggttgttgaacgtaaacccgcacaggtgttttttgaatcaatggcgctggctgcctcaatgagtggttattatgcagggccaacagccacaacgctgggaaattcgctttcattaggggcggggactgcggcaggtgtcggagaaggcgtcgcgggcgcacgggtgctggctgcgcctaatcctctcaccgttgctctgctggctatcttctattctccgtcactgaatgaaggtgagacggaaacgctacaaaatatacgtggcgaccagctctatcagaatctgatccatggccagatgatggtgggcgcttttacccgtgtaaactcaacggtcattcagggggattatgtcccggaatatgaactccgggaaatagcccgacaaaacggcacagtgcgcacgagggtacgctttcgtattgaagaagatcctgagtcaggggaactggtttcccgcagctatgaggtgggggaaaaaagcgggctggatcgggtccgggtgcggtttgcaaaacagctggataaagagacatggggttttgaagatccttcaattaaaggaacatttgtctggtcccggtctgctgggcaggggcgatttgagtggggagccagccagacgactgttcatgacgggagcgctggcggctctaccacaccgcctacacccattccggaaccgcggagcgtcttgggattgcctaacccggccccggcatcgttaccgcccgtaccgggaacgccgatcccggaggaacagggaccaaatattgaaacattgcccatcgaagaccgggatttcaatgactttattattgttgacccgatggggggtgtcccggcaatctatgtttattttcagaaagcttcagttagagatttagaggttgactattacggaaattttgaaggtcgttcaaggcagggcctatatgaagtggatcatattccttcaaaggaagctgttaggatatatttgaaagggacatatccaaacctgaaagatgacattatagaacaaatgactgacagagtggctgctgtcgctataccgatagaagtacaccggcaatgtaatgaaacctatggtgggaaaaacaatagtaaatttagaacacaagacggaggattagtcactcaaaaagttctagatgccagtaatttagaagctgcagttgatgctaactgggatgccaatgctgagtgccttaggaatgaatatggtgtaagtgatgaaaaaattgaagagatcagggccaaactacatgagttaaaccggaaagcggggttatattaa

SEQ ID NO: 6986 - DNA, 261 bp, Klebsiella pneumoniae
gaggataaaaaacagatggagtggtgggtaaaaaaagtacaggacaacgcttcggccagcgtctgccgcgtcgtgcttcagagcggtgcgctagagatgatcgcagagattgaagcctgtcgcctccgcgtgcgggaaggggataaactcactccgctggccgatgcgcgctattgtctgaataataatccgatgcaaactttgaagatccgcaacgccactcattatagcagcgagcgttggacaaacgccggcaaataa

SEQ ID NO: 6987 - DNA, 909 bp, Klebsiella pneumoniae
atgatgaaaaagttaacgtttaccgcactggcactgatgatgtgcggcgcggcatgggctgcggccataccgcaggcaagccgctatgactcccgcgtgcagcaggttatctataacccgcagaacgtcactgtcgttaacaccaaacccggctttatgacaacgctagtctttgataacgatgaggcggtcataagcgccaaacctggctttgatgaggcgtgggaagccacgccggatgcaaaccgggtcaacgttcgcccggtcgcgctcacgcagggagcgcccggagaagatggcaacacaacgcaggtcgtgatccccccgaacagccgggactggcataccaatatgctggttgtcaccagtaagcgcctgtacaacgtcgagctgaacgtcatcgatgataaatcggcacaacaacccgctttccaggtgagctatcgctatccgggcgaagaacgggacaaagcgagccgggaggcgacggccagacagcgcgagtgggagcagaaacagcaacaggccagcgtccagaaagcgctgaactcggcgcagacgccccgcaactggagttacaccaaatatccgggcaaaggcagtttcaacattgttcccgattttgcttacgacgatggccgctttacgttcgtgggcttctccccgtctaagtccattccttccgtcaccaaagagctgaacggcaaagagcatgtggttaacagcagtatccagaagaaaggcgatttcaccgtactggtgattcaggaggtgacgccacgcctagtactgcgttccggtaatgccgttgtgggtctggaaaatagcggatttggcaaggtacacgccgccgatggttccaccgtatcccggcaggtggaaagagtggaaaaaccggaatccaattaa

SEQ ID NO: 6988 - DNA, 435 bp, Klebsiella pneumoniae
atgatgaaaaagttattttttgctggcatggtggtggcgctggccggttgcgtacaggttgatcgttatgaggacgtcgttatagcgccggcgccggctggccttgcaggtttctggcaaacgaaagggccgcagagcgcgatgatgagtcctgacgccattgccagcctgattgtcaccaaagaaggggacaccttcgactgccgccagtggcagcgcgtgattgcgcagccggggaaactgatgaatcgtgacagtgagatctacaacgtgaccgcttccctggacatctatcctgtcgagcgcgagggcaacacgatctcctacgatcggatgacgttgtcccgtgttgaacgtctcactccggagtgcgagaaggcgtgggccaaagcgcgagcgacggggcccgtcagcgcgccggcctccacgcgctga

SEQ ID NO: 6989 - DNA, 729 bp, Klebsiella pneumoniae
ccctcagaaaaaggaaagcctatggacctggttgactggcagcaacgatttgagcgctggatactgacgcaccatgcgcaggatgacgccgcacacgatctgtcccattttcgtcgcgtctgggcgaccgccactcagctggccgcgggggaggaagtcgaccggctggtactcctcacggcctgctattttcatgacatcgtcagcttgccaaaaaatcatccggagcgaagtcgatcctcgatgatggccgccgagaaaaccctcgccattctgcagtcggcctttgctgattttcctgcggatcgttacccggcggtcagccatgccatcgaggcgcacagcttcagcgcggcgatcccaccgcgcacgctggaggcgaaaatagttcaggatgccgatcgactcgagtcgctgggagccattggtctggcgagggtcttcgctgtcgccggcgctctgaataccatcttgtttgatgccgaagatccttttgctgatcggcgggcgctggatgaccgcaaatatgccctcgaccatttccagtgcaaacttctgcgcctgccggaaaccatgcaaactgacaaggggaaagcgatggcgcagcataatgcccgttttctcgtcgaatttatggctaagctcagcgcggagctgcagggggagccgctggcgctggatgaagcggttttgcgccgctttgcaccgcaggcgtcaaccgaccggtga

SEQ ID NO: 6990 - DNA, 1257 bp, Klebsiella pneumoniae
tgccgccgaaatgcatcatcagatgctcaacgcgtaagatgctgtcggtcatggcgcgactccttttcgcaacgcaaccccgctgcggctggtgcgcaccaggccgcgcggccgccagatcatcatcatcaccatcagcacgccgaacagcagcacccgatattcgtcaaaaccgcgcagcagctccggggtgaccgtcagaacaaacgccgccagtaccactcccaaggtggagcccattcccccgagcaccacaatcgccaggatcagcgccgactcaaaaaaggtgaacgacgtcgggttaacaaacccctgatagctggcgaagaacaccccggcgatgccggccgtcgacgcgccgagcataaacgccgagagcttcaccagcacgtggttgagccccatcgcccgacaggcgatctcatcctcgcgcagcgcctcccaggcgcggccgatgggcatccgcgtcaggcgatgcttcaccagcagcaccagcatcaccaccagacacagcacggcgtagagaaagatgaatttcaggttggggttgtagctgacgtggaaaaactcatggatggggatgccgccatccttggcccggcgggtaaactcgaggccaaacagcgtgggggatggcaccggtacgccgttagggcccccggtgaagctcacccagttgttaagcaccaggcggataatttcgccaaagccgagggtgacgatggccagatagtcgccatgcatacgcagcaccggaaaacccagcaacgccccggcgagggccgccatcaccgcccccagcggcagcatcgcccagaagccgaggcccaggtactggtagcccagcgccaggccgtaggcgccgatggcgtaaaacgccacatagcccagatcgagcagacccgcgaggcccaccacaatattcaaccccaggccaagcagaacgtagatcagcccaagaatggccacggtcagcagatattttgtggcgagaaacggaaagacaatggccagccccaccagcagcggtattatccagcgcagccgcgagcggtagcccggcggccggacgtacaccccgtcatccgccccctcaaagcgggcaataaaggcttttcccctgtggctctgcagcagcagactgagcgccagcctgccggccatcaccaccgccaccagaatcgccacccgcgcaggcgcgagggtaaaaccataccctttgagcaccacgccgacgatcgggccaaagacaattaa

SEQ ID NO: 6991 - DNA, 663 bp, Klebsiella pneumoniae
tgggctttgaatccccgcagggggcgcgttttcgcatcccggtatcggatacgcaggcctatcgtcagtttggcaactcggtggtggttccggtcttcgccgcggtggcgaaactcctggcgccgcgcatcgctcaggcggtggcgcgccgtgaagcggatgataatgatggcggatgttcacgataaagcgacgcgcagtaaaaatatgcgggcgatcgccacgcgcgatacggcgatcgaaaagcggatagcggcgctgctgaccggggcgggattcacctttgttgcccaggatcgcgcgctgccgggacgtcccgatttcactttacccgactaccgttgcgttatctttactcacggctgtttctggcatcaccatgactgctatctgtttaaggtgccggccacccgcacggcattctggctggacaaaatcgccggtaacgtggcgcgcgacgcccgcgaccggcaaaagctggccgaagagggctggcgggtattaatcatctgggaatgcgccctgcgcgggcgccttaggctgagtgatgcggcgctcaccgaacgtctggaagagtggatctgcggcgccggacacgacgcgcagatcgatacgcaggggatccgcgaactgacgactacttcgacgccttacaaggagtag

SEQ ID NO: 6992 - DNA, 510 bp, Klebsiella pneumoniae
atgagcttgaatgttgagaagttgataaagaaccttgggaaatcgtatctggatatttatgagcaaggattgatcccctacaaaacaaaaccaagtggtacggttagtgatgacatttatagattagatatgaaacgagagggggtatttttatcattttttaataatcaagataaaaatcttaaggaggtgaccttaaggttagaggatgagaataaaactgactggttatttcctaacttgctaccatttggtcttgaaccagtaatgacacagcgatgggtacgagaccgatttggtcatccgattacttacgttgatgcctgcgtgattatgactatttatgtcggggtggaggaaacatatattttaccgactccgaatcaaaatattgcagcggcattttcttacaataaagatttttttgttaacaggatcacatttattccggttgaacaggcgaaagaaatccagtctgcacttgagaaaaaacgacttggtggcaaatga

SEQ ID NO: 6993 - DNA, 810 bp, Klebsiella pneumoniae
ctaacgctgaagtgcgcgaacacagccagcaggcgcagcagcaataatacgggaataaccgcaatgacctactgtgtggccatgtgcctggcggatggactggtgtttgcttccgactcccgcaccaacgcgggcgtcgaccatattgccacttttaaaaagctgcacgttttccatcaggagggggaacgggtgctggtgctgcaatccgccggcaatctggccaccacccagagcgtgataagcctgctcagcgcgcgcatccgtacccagcaggagccgaatctgatgcaggtcacttccctctacgacgccgcgatgctgatcggtaaaacgctgctggaggtgatccagcgcgacagcagcaaccagcagacctgcagtaacaccaacttcaactgcaacctgctgcttggcggccagatcgccggcgaaacccatcgtctgttccatatttatccggagggcaactttattgaagccacccgcgacacgccttatttccagattggcgaaagcaaatacggcaaaccgatcatcgatcgggtgctgaccatcgacacgccgctggagcaggcgatgtgctgcgcgttgatctccattgactcgacgctgcgcagtaatctgtccgtcggcctgccgctggatacgctgctctaccgcagcggcagcttcagcagtgccgggcagcatcgcatcaccgacagcgatccctacttcaaccgcattcgcaaggcgtggtccgaagggctgttgcacaccttccagactctgccgacctggacgccagcggagcgggaagatgagtag

SEQ ID NO: 6994 - DNA, 948 bp, Klebsiella pneumoniae
gacgcgatgaatactttttctctgcctaaaacacagcatctggtagttttccaggaagtgatccgcagcgggtcaatcggggccggagcaaaagcgttaggactcactcagccggcggtcagtaaaattattggcgacatggagagttattttggcagcgaattaatcgtccggcgaaataccggcgtctcgctcaccgaggccgggcaggtatttctcaactggtcagaagcgatcacccgtgaaatgaaaaatatggtcaatgaaatgaatgctctgaccaacagcgcggtggtggatgtctcctttggtttcccttcgctggtcgggtttacctttatgtcggagatggtgcatcagtttaaaatgactttccccaaggcgcgggtctcgatgtatgaggcgcagctctccgcctttttgccggcaatccgcgacgggcgcctcgacttcgccatcgggacgctgagcgatgagatgaaactgcaggacctgcacgtcgagccgctgtttgagtctgagtttgtgctggtggcgaaccgggcgcggatcggcaacggcaccgtccgcctggcctcgctccagcacgagcagtgggtgctgccggagaccaatatgggctactacagcgaactgctgaccaccctgcagcgcagcggtatccgccgtgaaaatatcgttaataccgattcggtggtgacgatctataacctggtgctcaatgccgattttctgacggtgatcccctgcgacatgaccacgccgtttggctcgagccagtttgtcaccatccccattaaagaggccttgccggtggcgcgctatgcggcggtatggtcgaaaaattaccggttaaaaaccgccgcggcgtcgctggtggagatggcgaaatactattcctcggggcagggcaaccaccactggcagccattacaaattattgcgtaa

SEQ ID NO: 6995 - DNA, 192 bp, Klebsiella pneumoniae
tgcagcgcgaagctgggtcttgctgagattcatctcaccacccactcgctcaacgagatcctgaaaaattccgattttcagggggcgcgcttcaccttcagcgctaaagcactgcgggaaacgttcggccagaaaggcgataacttctttactgctattcaacttaggttgattttccatgaaatttcctga

SEQ ID NO: 6996 - DNA, 900 bp, Klebsiella pneumoniae
ggtaaaaagaaaattatgatgcgaatcgcgcttttcctgctgacgaacctggcagtgatggtcgtgttcgggctggtgttaagcctcacggggatccaatccagcagcatgaccggtcttctgattatggccctgctgttcggcttcggtggttctatcgtttcgctgatgatgtcgaagtggatggcgctgaagtcagtgggtggggaagtgatcgagcagccgcgcaacgaaacggaacgctggctgatgaataccgttgcgcagcaggcgcagcaggtaggtattgccatgccgcaggtagctatctatcacgcgcctgacattaacgccttcgccaccggcgcgcgtcgtgacgcctcgctggtcgccgtcagcaccgggctgttgcaaaacatgagccgtgatgaagcggaagcggtcattgcccatgaaatcagccacatcgccaatggcgatatggttaccatgaccctgatccagggggtggtgaacaccttcgttatctttatctcccgcgttatcgcgcagattgcggccggtttcctcggcggcaaccgggaagatgaaggggagagcagcaatggcaacccgctgatctacttcgcggtcgccacggtgcttgagctggtgttcggtattctggccagcataatcaccatgtggttctcgcgttaccgtgagttccatgctgacgccggctcggcgcgtctggtaggccgcgagaagatgattgcagccctgcagcgtctgaaaaccagctatgagccgcaggaagccagcagcatgatggcgttctgcattaacggtaaagcgaaatccatgagcgaactgtttatgactcacccgccgctggataagcgtattgaagccctgcgtagcggtgaatatctgaaataa

SEQ ID NO: 6997 - DNA, 2184 bp, Klebsiella pneumoniae
cagattcgtttttcacgcggcggcgtacaggagtaccagaccgcgttggttcaggatgatcttatgaacgtggctatttctcgaaaacgcccggggctgctgtatgcccttgcggtcgcactccccttcaccgcgcaagccgaagagacggtggtggtcactgccaccccgccggcgtccgccagcgcgccgacggagggctacagcgccagcacctcgctcggggcgacgaaaaccgaccagccgttaatcactaccgcccagtcggtgtcggtggtcacccgccagcagatggcggatcagggggcgaataccatcagccaggcgctggaatataccccgggggtctactccagcttcggcggcggcgccacccggttcgacgccatctccctgcgcggctaccacggcggcgacgtcgataacctgttcctcgacggcatgcgcctgatgagcgacggcggcagccataacgtattgcaaatcgacccgtggtttatcgaacgcgtggatgtgatccgcggcccctcctccgcgctctacgggcagagcgtgccgggcggcgtggtcaacctgacttccaaacgtccgcagttcagccagcagggccacatccgcctgaccggcggcacgcaaaataccaaaggcgcggccttcgattacaccgacgccatcaatgaccagtgggcatggcggctgatcgggatgacccgcagcagcgacacgcagtatgaccatacccgcgaagagcgctacgcgatttcgccttccctgctgtggcagccggacagcgacacctcgctgctgctgcgcgcctatctgcaaaaagatccttccggcggctaccacggctctttgccgctggacggcacccgctacgcgcacaatggccgtaagctctcccccagcaccaacgaaggcgatccgggagatggctatcaacgccgccagcagatctacagctatgagtttgaccaccagttcaccgacgtctggtcggtctattccgccgggagctacacccataccaacgtctccctcgatcaggtctaccaggtcggctggatagatgacagcgacatgctggcccgcggctacagcggttcgcgcggttcgctggacggctggtcaaccgataaccgcctgcgcgccgatttcaatacaggcgacctggcgcacaccctgatcctcggcgccgaatatcatcgcttccgtaacgacctgtggaccggcgccggcggcgcggcgccccttaacccgtttagcggctataccgcgcagaccggacataccgttacctacagcgacgacaataatcgccgctattaccagaccgggctgtatctgcaggatgagatggtctggaaccgctggcatgtggatgtttccgcccgctacgaccgcatcgtttcccagcaggtcagcgatacccaggggacctcaaaccgccgttcagacgaccatatcagcggccgcgcctcgctgttgtacgccctggacaacggtctgtcgccctacctgagctacagccaggcgatcactccggcgatgctgccgggcgcggacggcaaaccgttgaaaccgaccaccgccgaacaggttgaagccggcctgaagttccagccgccgggcagcagcgatctctatagcatcgcgatttacgacctgacgcaaaaggatgtcgccactcgcgacccgaacatcgccaccgccacctatattccggcgggtaaggtccattcccagggcgttgagctggaagcgcaccaccagatcaccccgcagctgagtactatcgcctcgtatacctggaatcgtctgcgtttccaggacacccaagacgggaccgacaataacacgccgcagctgaccccggatcagatggcctccttctgggcgcgctatcagttcccggcggggatctcagttggcgccggcgtccgctacatcggtaaacagtgggcggatgatgccaacaccgcgcggctgccgtcggtcacgctgatggacgccatgatgcgggccgacctcggcgtctggtcgccaacgctgaaaggcgcttatgtgcaggttaacgccaacaatatcggcgaccgcgagtatatttccggctgctatggcaccggcaactgttactggggagcagagcgcagcgttatagccaccgtgggctacgatttctga

SEQ ID NO: 6998 - DNA, 1287 bp, Klebsiella pneumoniae
ccctgtaacctattccggggcggatcactccgcctcgtcttccgcgacccgcaccccaaccttcagcacgtgatcgttctctttttcagctaccgtccacaccatcccggcgaactccacctggtcgcccaccaccggcgccgcgcccagcagctgctgcaccacttccccgagcgactgctgatgctcgcggaactcctcaccgccgtcgagaccgtagatttgcgccacatcggcgaagcgggcctcagcatcaagaatgaagtcgccgaaaaagcgctgatcgagcgccaccggcggcgactggctgaacattttgcccagcgccggcaggtcgtgctcccgaccaataacgcacaggatatcgccttcccgcaggcgggtgctgccggtggggtgcagcaggacattgttgcgaaacagcgcggcaatccgcgtctccggtggcatgtgcaagtcgcgcagcgccgcgccgatgcaccacttatcggcccccagctggtagacaaactgctcccacgggttttccgggtgaatatccagcccgacgcgggagatgggccagctgatgggcggcaccaccactttggcttttttcgccgcccacgacagcgaagtgccctgcagcagaagcgacaccagcaccacgaagaaggcgacattgaagaacaggcgggcgttgtccaggccggccatcatcgggaacaccgcgagaataatgggcaccgcgccgcgcaggccaacccagctgataaacacccgttcgcgcaggttaaagccgcgaaacggcagcaggccggcaaacaccgacaggggccgggcaatgaatatcatccacatcgacagcagcagcgccgggatagcgatcggcagcaggtcggagggcgtcaccagcaggcccagcaccaggaacatggcgatctgcgccagccacgccaggccgtcgaagttctgcaggatgccgtgccggttgcggatcggccggttgcccagcagaaagccgcagagatagacggcgaggataccgctaccgtcgagggaggtggtgacggcaaaaatcatgatcccgccgctcagcgccagcagcggatagaggccggcgggcagcacgatgcggttaatcatctgcagcagcaggtagccgccgccgaggccgatggcgatcccgaggccgaactgctgaatgatatgcacggcgaacatccagctgaggccggtttggtgctgctggatcatttcgatcagggtgatggtcaggaagaccgccatcgggtcgttactgcctga

SEQ ID NO: 6999 - DNA, 969 bp, Klebsiella pneumoniae
  unsure (905): Identity of nucleotide at the above locations are unknown.
tcccgatttgacgaaagccgtaatatcccctactctgcgcggcataatttattgttatttgctgtagggatagcgaaaagcgtgaaaaaccgcactctgggcagtattttaatcgtagctggcaccaccatcggtgcaggaatgttggcaatgccattggccgccgcaggcgtcggctttaccgtcacgttgggtttacttttcaccctgtgggcattgatgtgctataccgcccttttgctgctggaagtttaccagcatgtccctgccgatatggggctcggttctctggcggcgcgctatctgggccgttatgggcagtgggttaccggattctgcatgctgtttctgctgtacgccctcacggcagcctatatcagtggcgccggtgaattactcgcttccagcctcaaccagtggctggactggcagctaccgccggccgcaggcgtactgatcttcaccctcctcggcggggcggtagtgtgcattggcaccgcgctggtggatctgttcaatcgcttcctgtttagcgccaaaatcgtcttcctggtgattatgctggccctgctgatgccgcacattcatcaggtgaacctgctgacgctgccggttgagcaaggcctggccctgtcggccattccggtgattttcacctcctttggttttcacggcagcgtcccgagcatcgtcagctatctggggggggatattcgcaaattgcgccgggtatttatcatcggcagctttattccgctggtggcctatattttctggcagctggcgacgctgggcagtatcgacgccccggcctttaccgccctgctggcaaataacgctggtctgaacggcctgctggaggcgatccgcgaagtggtggcgtcaccgcatgtggagctggccgnttcacctgtttgccgaccttgcgctggcgacgtcattcctcggcgtctcgctcggcctgtttga

SEQ ID NO: 7000 - DNA, 192 bp, Klebsiella pneumoniae
cgaaatattgacataataagcaaacgccatgttgtaattcggcttcaccgacagcgcaatttagtcaccggcatgccgctgcgtcaatattgccacctgctccgtcagctgatccagcagctggaatcgccgccgatattcagcccgttttttactggcgatactctccagcgattttctttccagacatag

SEQ ID NO: 7001 - DNA, 1395 bp, Klebsiella pneumoniae
cgcggcattgacgtacagcgggaacagcgccgccgcggtcagttgattgcgcaccttgtggcttttcagatcgtagtcggcgtaccatccctctttatcattccacaggtatttctcgatggcctgctggcgggcgttagccagcgcatcgtactgcgtagcgccagcgctgtccccggatgccttgctggcgcgggcgagggttttctccagatggaacatcagggcattgagatcgaccgggacaatcgaggtggtgcgaatggtggcgagctgctgcggattgtccatccagcgggagctgaaatcccagccggaggcggcggcggagcgcaggtcgcgatagatctcggttgccggacgattcgggttgcttttggcggttttgacgtcgtcaagccaggactcgggacgcggggtgtcgttatcgtcccagtagcggttgagcagcgcgccgtccgccatccgcaccgcccgtttgtcggcgctgccgggagccagcgcgtccgctccggccatccagtagcgatactctttctccagctgcggctggtaggttttcagcacctggtcgccatcgtgcgtcgccagcaggctcaccataaaggagaagaaggggggctgcgaacggctgagataataggtgcggttgccgttggggatatggccccaggcgtcaatttctgcggcgaagttggcgaccatatcctcgactttatcccagtgaccgctttcggcaagacccagcatcgtgaaatagctgtcccagtaatagacttcgcggaaacgtcctccgggcaccacgtagggcttaggcagcggcagcagcgagtcccatttttccacctcgacggtgctgcgggtcaggaccggccacaggccatcgatatgttgacgcagagtttgccctttgggcggcacataggtgtcgttctctttcggcagcgtgaagttcagttcgacgaagtggcgcaggtcgaagctggcctggtttttttgcatccggtaatcggcaaggatcatcagcggatcgctgttagggatagcgtcggcgaaggttttctgatcggcaaacagcttcgcgctctggacatcattgaacagcgggcccagcagaatatccggcgaggggggcggcgcggttttgccgtcttccgcctgagcgttcaggctcatcagggcgatcagagcgccgccgatcgccaggcgcagggaacagggcaaaacagcgggacgacgtgcatcagtactcgtcatggggagttctccttatcattatcgactgcgggccacgacgtttggccatccaaaaaccttagacgaatatctgccgctgcgcgtgtcaggggtaacattttgcgcgaaaacagaggatttacctgccaggtcttctga

SEQ ID NO: 7002 - DNA, 1014 bp, Klebsiella pneumoniae
gggatgattgaagcagaccggctggtatcggcagacagcagcggctttgaagaggccgctgaccgcgccatccgcccaaaattgctggcagagtatgtcggccagccgcaggtgcgttcgcagatggagatctttatccaggcggcgaagctgcgcggcgacgccctcgatcacctgctgatttttggcccgccagggttggggaaaaccaccctggccaatatcgtcgccaatgaaatgggggtgaatctgcgtaccacctccggcccggtgctggagaaggcgggcgacctcgccgcgatgctcaccaacctcgaaccgcacgatgtactgtttatcgatgagatccatcgcctctcgccggtggtggaagaggtgctctatccggcaatggaagactaccagctggatattatgattggcgaaggtcccgcggcgcgttccatcaagatcgatctgccgccgtttaccctgatcggcgccaccacccgggccggttcgttgacctcgccgctgcgcgaccgctttggcatcgtgcagcgtctggagttctatcagatccccgatctgcagcatattgtcagccgcagcgcccgccatatggggctggagatgagcgacgagggcgcgctggaagtagcccgccgttcacgcggcacgccgcgtattgccaaccgtctgctgcgccgggtgcgtgactttgcggaagtgcgccacgacggcaccatctccgccgatattgccgcccaggcgcttgatatgcttaacgtcgatgcggaagggttcgactatatggaccgtaagctgctgctggcggtgatagataagttctttggcggcccggtggggctggacaacctcgccgccgcgattggcgaagagcgggaaaccattgaagatgtactggagccctacttaattcagcagggctttctgcagcgtacgccgcggggaagaatggcgacggtgcgcgcctggaatcatttcgggattacgccgccggaaatgccgtag

SEQ ID NO: 7003 - DNA, 1011 bp, Klebsiella pneumoniae
agcataactgagtcaggaggggccatgtcactgcaaaacttaacccgctttccgcgcctggaattgatcggcgcgccgacgccgctggagtatctcccgcgtctgtccgatcaccttgggcgcgaaatttttattaaacgtgatgatacgacgccgctggcgatggggggcaacaaactgcgtaagctggagtttctcgccgccgatgcgctgcgcgagggcgcggataccttaatcaccgccggcgcgatccagtctaaccatgtgcgtcagacggcggcagtcgctgcgaaactgggactgcattgcgtggcgctactggaaaatcccatcggcaccagggcggagaactatctgagcaatggcaaccgtctgctgctggatctctttaacacccaggttgagatgtgtgatgccctgaccgatcccgccgcccagctcgatgagctggcgacccgcattgaggcgcaggggtatcgtccgtatgttattccggtcggcggctccaatgccctcggcgcgttaggctatgtggaaagcgcactggaaatcagccagcagtgcgaagacgcggtggcgatctcgtcagtcgtggtcgcctccggcagcgccggcacccatgccggattggcggtcggccttgaacagctgatgccgcaggcggaactgattggggtgaccgtgtcgcgctcggtcgctgaccagttgccgaaagtggaggcgctgcagcaggccgtggccaacagtctcgagctacaggcgaaggctgaaattatactgtgggatgactactttgccccaggatacggtacgccaaacgaagatgggatggccgccgtgaagctgctggcgcagctggaaggtattttgctcgacccggtctataccggcaaagcgatggccgggcttatcgacggcatcacgcagaagcgctttaaggatgaagggccgatactgttcgtccacaccggcggagcgccggcgctgtttgcctatcatcctcacctctaa

SEQ ID NO: 7004 - DNA, 963 bp, Klebsiella pneumoniae
gtcgcgactgaggaagggaaaatgacgatgcggcgtgtgaaattactctgtacggcgctgatgctgcttgccagccacggcgcgctggccgtcagctatccgctgccgccggaggggagccgtttggtgggcagcgcatttaccattgccgttccggagaataacacccagccgctggaaagttttgccgcccagtacggccaggggttaagcaatatgctggaagccaaccccggggtcgatgtctatttaccacgctccggttcgacgctgactattccgcaacagctgatcctgcctgacaccgtgcgggaggggatcgtgatcaacgtcgccgaaatgcgtctctattattacccgccgctgggcaacagcgtggaagtcctgccaatcggcattggccaggccggacgcgaaacgccgcgtaactgggtgacggcagtagagcgtaagcaggaaggccccacctgggtgccaaccgccaatacccgccgcgagtatgcgaaagagggcaaaaccctgccggcgctggtgcctcccgggcccgataacccgatgggactgtatgcgatctacattggcaggctgtacgccatccacggtaccaacgccaactttggtatcgggctgcgtgtcagccaggggtgcatccgcctgcgcaatgacgatattaaattcctgtttgataacgtgccggttgggacgcgggttcagctgatcgatcagccggtgaagtacagcgtggagccggacggcagtcactggctggaggtgcacgagccgctgtcgcgcaaccgcgcggagtttgaatccgacagaaaagtccccttgccgatgacctcggcgctgcgcgactttacccaggggccgggagtgagccctgcccaggtcgagcagaccctgcagcgccgctccggcatgccggtgaatatcagcgccacagcggcgcagggaagtttgtag

SEQ ID NO: 7005 - DNA, 204 bp, Klebsiella pneumoniae
agacgcaatgaggagaagatgatgaacattaatatcccggcactcataaacttcgatcctgcaggtataaaaaaaagcacctgcatgtatatttcagacctgcccggtattgtgctatatgacactataccattcactgaatattcagctgaattactgagtacttattcagttaaggagtcaatttcatgcttccatccctga

SEQ ID NO: 7006 - DNA, 1197 bp, Klebsiella pneumoniae
gtaacgaatgagtcgcctgacgccggctacgccggcgttttttatgggcgcaagttaagagagtatgctttgaactatcagatgatcaccaccgacgatggcctgcgcgctgtctgcgaagcggcaagcgcggcctccgccgtcgctctggatacggaatttgtccgcacccgcacctattacccgcagctgggcctgctgcagctgttcgacggccagcaggtctctctgatcgatcccttgacgattaacgactgggcgccgatgcgcgacctgctgctcaaccaggatgtgactaaatacctgcatgccggcagcgaagatttagaagtcttccttaatgcatttaacctgatgccgcagccgctgattgacacccagatcctggcggccttctgcggccgcccaatgtcctggggcttcgcctcgatggtggaagagtattccggggtagcgctggataaaagcgaatcccgcaccgactggctggcgcgcccgctgactgagcgtcagtgtgaatatgccgcggccgacgtctggtatctgctgccgatcgccagccagttaatggcggagaccgatcgcgctggctggctgccggcggcgctcgacgagtgccgcgtgatgcagcagcgtcgtcaggaggtggtcgacccggccgaggcctggcgcgatatcggcaacgcctggcagctgcgtacccgccagctgggttgtctgcagctgttggcggagtggcgcctgcgcaaagcgcgcgagcgcgacctggcggtaaactttgtggtgcgggaagagcatctgtggagcgtggcgcgctatatgcccaccagcctgggcgagctcgacagcctcgggttgtccggtagcgaaattcgcttccacggcaaaacgctgattagcctggtcgaaaaagcgcaggcgctgccggagtcggtcctgccggcgccgctgcagaacctgatcgacatgccgggctaccgcaaagcctttaaagatattaaagcgctggtgcaggaagtgagcacggagaagggcgtaagcgcggagctgctggcgtcgcgtcggcagatcaaccagctgctgaactggcactggcagctgaaaacgcaagccggtgaacctgagctgatttccggttggcgcggggagctgatggccgagcggctgaagacgctgttaaacgactatccgcgctag

SEQ ID NO: 7007 - DNA, 222 bp, Klebsiella pneumoniae
atagtatgtgaacccgagcatgaggccaggatgtttgccttagtgttgtttatttgctatctggatggcggctgcgaggacattgtggttgacgtctaccgcgaggaaacgcagtgcttagtggcgatggaggatcagcggatccgccacggtggctgttacccgatagaagattttattgatggcttctggcaacccgccagcgaatacagcgacttttag

SEQ ID NO: 7008 - DNA, 1701 bp, Klebsiella pneumoniae
gagatgcgtgataacgctcgtcgtctgcttacgatactgaccgtcatcctggccctgtggctggtgctgggcttctggccgctgtccatcggcaaccaggtgatcttcagtctgtgcatcctgctggcgggcggcgcggcgctctggcgtcagcgtcgccgggcagtcagccgtcagcgatcggaaatcgtcctgccgcccgaggattttcagggggcagtggttctggtctgcggggataccgacggtctgtttcccgggcgttcggcgcacggcgaaacccgtcacggctggtatctacggggagacagcgcggagcagttgccgcggctggcgcagtacctggcggcggcgcgtccggcactggtatcgcaggtttccgtgctgctggcggtggtaccggagcaccacccctccggggagcatctggcgcagtcgctgcgcgactggcggcggagtatcgttcagtgccgaacctggctaaacggtctgccgccggtgtggagcgtgttctgggtgacgccgccaggcggccaggccgtggaaagccgctggtttaccgtcacgccggagaggcctggtctccaggtgcagcagaagggacaagcgccccaggcggttgccgggtggcagcgggagggcagccctgcctcacgcctgcatcagacgctgtggctggagagcattctgaccttggccgaaaacgctcttttccggccattccgcgcccggcaggcagaacttcctccgctgaacctgtgtgccgcgggcatctgccttacgccggtggcggcggtggcgaataacctctggcaacagcaaatcgccgggatcaccacgctctccccgggcaacgacgcggcgccaggtcctcacccgctgccggatcttcttctgtcgtcactgccgcaccgccacggggtcagccgccggatgcgcgatgccggtcttgccgctggggtgggcttcctctttctggcgctggcgatgctggcttcctttatcaacaaccagcgcctggtgcgcagcgtcggcgatcatctggcggtgtatcaccgcctcagcggcacgccgccgacgccgaagctgcaggcgcagcagcgtctgcgtgccgacagccgcctgctggatgactggttgcgccggggggagccgctgcgttatcggctggggctgtatcagggggggcggctgatccccttcgttgaagccgctatcaatgactgggcgccgcccccgccgccgcgtccggtcattaagcaggttgtgcaggggccgcagacgatccgcctcgatagcatggcgctgttcgataccggcaaatcggcgctgaaaccgggttcgacaaagctgctggtgaactcgctgctgggcattaaggccaaacccggctggctgatcgtggtggcaggccataccgacagcatcggcaacgatagatccaatcaacaactctccctgaagcgtgccgaggcggtccgcgactggatgcgcgataccggcgatgttccggagagctgttttgcggtgcagggctacggcgcaagccgtcctgtcgccagcaacgagacgccagagggacgggcgcaaaatcgccgggtggagatcagtctggtcccgcagaaggacgcctgtctgacgccgggcacggccaatacctcaggagcagagactaacggattaaaaagcgaaaccgagtaa

SEQ ID NO: 7009 - DNA, 1335 bp, Klebsiella pneumoniae
cgaggaagtgaatacgtgcaacagatagcccgcgctgtcactcaggcattcaacaatctgccacgacctcatcgcgttatgctggggtcgcttagcgttcttaccttagcggtcgccgtctggcgaccctacatttaccacccggaatccgcccccatcgtcagaaccattgaactggaaaaaagcgagatccgctccctgctgccggaagcctccgagccgatcgatcaggccccgcaggaagaagaagccattcctcaggatgagctcgacgaaaaagccgatagcgatgccggcgggcacgaatatgtggtgtcgaccggcgatacgctcagcagtattctgaaccagtacggtatcgatatgggcgatatcgcccagctttcctccgccgataaagagctgcgcaacctgaagattggccagcagctctcctggaccctgaccgccgacggcgatctgcagagcctgacctgggagatgtcccgccgcgagacccgcacctatacccgtgtggataacggttttaaaatgagcagcgagctgcagaaaggcgattgggtcaacagcgtgctgaagggcaccgtcggcgccagctttgtctccagcgcgcgtgatgccgggctgaccagcacggaaatcaatgcggtgatcaaggccatgcagtggcagatggatttccgtaagctgaagaaaggcgacgaattctcggtattgatgtcgcgcgaaatgctcgacggcaaacgtgagcaaagccagttactcggcgtgcgtcttcgctctgacggtaaggattactatgccatccgcgccgaagacggcaaattctacgaccgcaacggcacgggtctggcgaagggctttatgcgcttcccaacggcgcgtcagttccgcgtctcctctaactttaatccgcgtcgtctgaacccggtcaccggccgcgtcgcgccgcaccgtggcgtcgatttcgcgatgccgcagggaacgccagtgctggcggtgggcgatggtgaagtagtcgtggccaaacgcagcggcgctgccgggtattacgtcgcgatccgccacggccgcacctataccactcgctacatgcacctgcgtaagctgttagtgaagccggggcagaaagtgaagcgcggggatcgcattgcgctgtcggggaataccggacgctctaccgggccacacctgcactacgaagtgtggatcaaccagcaggcggtcaacccgctgacggctaagctgccgcgtaccgaagggctgagcggttccgaccggaccgactatctggcgcaggtcaaagaggtcgttccgcagctgcggtttgactaa

SEQ ID NO: 7010 - DNA, 915 bp, Klebsiella pneumoniae
tgcaatggtgaaggtgataagatgagaaaattaatcgtagttgcttctgttgccgccagtttactgctcgggtgcgaccagaagagtactgacaagcgtgaaaccttgtctgaaacgcttgttgctaagtcgctttctaacatggttcccgttaagggcggcgagttcttaatgggggatttcggcccattagtcggtgaaaaactgcctttcagcataaaccaggatgataaggtattacataaggttgtattaagcgatttttcgatatcaaagtttaaagttaccaacgatgattataataaatatctgcagataacaggaataaaaaaacctcccattaatattctggtaaaagagtacccatccttgcaaaaaggtgattactctgttggtgttacctggcaacaggcaaaagactattgtcagtggctaggtaaggagtccgatagaaatattgatttaccgacagaagcacaatgggaatatgcggcaaggtccagagggcaatacattccgtttgcaacgaataatggtgagttcctgcccggtaaaaacatccccagccaggatgagctgagtgaatatactgatggagcaggtattcctatttatccagtggggaaatatcccccaaaccccctgggtctgtatgacatgggacttagtggctctgaatggaccaatgactggtatgcgtcagattattactctcattctccggtaaacgatcctcagggacccgtaaaggggaccgaaaaagtcctgcgcgggaatgttggcggtgacagacaatacgctttaaccgtgttcagacaatcagatttgccagttccaaagatcaataaagacgatgactatgaaaaatatggtgttggtccgcagtatgttttccgttgcgtcatcaataaataa

SEQ ID NO: 7011 - DNA, 183 bp, Klebsiella pneumoniae
tcatgtttcgaactacaaccggccagaaaaacgactaaaataagcaaccatctcaatttcacacatctatccttatctacccaaacgccatcatgctacagaacgacggccgcggtacgtctcccgcctgccgacaacctgaaggatgacgggtgcggactgaagttagccacctggagatga

SEQ ID NO: 7012 - DNA, 957 bp, Klebsiella pneumoniae
cgcatactcgagggagacattgatgaaaagagaaggaaaatcattttggcaggaagtagtcttttaacattacttgatgatatcgccacgctgctggacgatatttccgtgatgggcaaggtagcggcgaaaaaaacggcgggggtgctgggcgacgatttgtctctcaatgcccaacaggttaccggcgtgcgggcgaatcgcgagttgcccgtggtctggggagtggcgaaagggtcgttcgttaacaaagtgatcctcgtgccactggctttgttgatcagcgccttcatcccctgggcgattacgccattgttgatgctgggcggcgcgtttctctgtttcgaaggggtggagaaggtactgcacagtctggaagcgcggaaacacaaagaggatcctgaacggcggcagcagcgtctcgccgcgctggcggagcgcgatccgctggcctttgagcgtgacaaagtaaaaggcgcgattcgcaccgattttattttgtccgcggaaattgtcgccattaccctcggcatcgtggcggaagctccgctgcttaaccaaatccttattctttcggggattgcgattctggtcactatcggggtgtatggcctggtgggggtgatcgtcaagctggacgacatgggttactggctggcggaaaaacgtagtgcgctggcgcagtggctgggtaaagggctcctggccgtcgctccccgcctgatgaaggtgttgtccatcgtcgggacgctggccatgttcctcgtcggcggggggatagtcgttcacggtattgcgccgctgcatcatgccatcgagcactggagcgcggggttgggtggggtgatggcctccacgctgccggtcgtcgccaacctggtgctgggttttatcatcggcgcggtggtgctggcgggcgttaaggcggtgagcagcctgcgtggcgctggaaagtag

SEQ ID NO: 7013 - DNA, 1005 bp, Klebsiella pneumoniae
cccccttccgacgaggaatactctgtcatgaaagcattagttctggaccagatcgacaaccgcaccgtcgccaccgtcaaagatatcgacctgcccgctcttgccgaaggcgacgtccgggtcgccatcgactggtcgagtctcaattataaagacgctctggcgatcaccggcaaaggcaaaattatccgtcagtttccgatggtgccgggcattgattttgccggtcaggtgaaagaaagccgcgatccgcgctttgttcccggccaggccgtgatcctcaccggctggggcgtgggcgaaaaccactggggtggcctggccaccgaagcctgcgttaaaggcgactggctggttgctctgccggagacgctcagcgcgcgccaggcaatgatcatcggcaccgccggctttaccgcgatgctatgcgttgatgctctcgttagtgcgggcgtcacccctgacagcggggatatcctggtcaccggcgccagcggcggggtcggcagcaccgcagtggtgttgctcaaagcccttggctaccgggtgatggccgtatcgggccgggaatcgacacacgattaccttcgccagctgggcgccgatacgatcctgccgcgcagcgacttcgcggagacccgtccgctggagaaacagctgtgggcgggcgcggtggataccgttggcggcccggtgttggccaaagtgctggcgcaaacgcaatatcgcggctgcgtcgccgcctgcggtctggccgggggcttcgatctgccgaccaccgtgatgccgtttattctgcgcaatgtgcgtctgcagggggtggattcggtgatggtgccgaccgctgaacgcgacgctgtctggcagcgtctggcccagcttctgccggagagctactaccagcaggcggccacagaaatcacgctggagcaggcgccagcgtatgccgcagatttcctcagcaataatattcatggtcggacgctggtcaatatcggccagtaa

SEQ ID NO: 7014 - DNA, 684 bp, Klebsiella pneumoniae
tacagaaacgacagcatgcaagaaagtatccaactggtcattgattccgccccttttctgctgaaaggggccgtctttacgctgcagctgagcattggcgggatgtttttcggcctggtgctgggctttatcctggcgctgatgcgcatgtcgccagtctggccggtaaaatggctggcgcgcatgtatatctccattttccgcggcacgccgcttatcgcccagctgtttatgatctactacggcttgccgcagttcggcattgagcttgacccgatcccggcggcgatgatcggcctgtcgttgaatactgcggcctatgcggcggaaacgctgcgcgcggccatcgcctcgattgataaagggcaatgggaagcggcggccagtatcggtatgacgccctggcagacgatgcgtcgggccattttaccccaggcggcgcgggtcgctttgccgccgctgtcgaacagttttatcagcctggtaaaagatacctcgctggcggcaacgatccaggtgccggagctgtttcgtcaggcgcagctaatcacctcgcgaaccctggaggtcttcaccatgtatctggcggcctccctgatctactgggtaatggcgacagtgctctcctcgctgcagaattattttgaaaaccagctgaaccgccaggagcgtgatccgaaatga

SEQ ID NO: 7015 - DNA, 528 bp, Klebsiella pneumoniae
agccgacgcctgcggcggccaatggcattgccaacattcctgcaccgatggtggtgccagctacgattaaaatactgcccagagtgcggtttttcacgcttttcgctatccctacagcaaataacaataaattatgccgcgcagagtaggggatattacggctttcgtcaaatcgggattacaagttgtgtaatgaaatgtttacataataagagggcgaaagcctgcgctggcgcaaggcgcgggttgacggtctggcctaagctggcggtttttgcaggaggggttatgtcttctattcatggtcatgaagttttacagatgatgctcgcctcgggtgagtcctggacggttgcctcgctggaggccgccattcgccgccgctttggcgaagaggcgcggtttcacacctgttcagcagagaatctaagcgccgcacagctggtggcgtttttagagaaaaaaggcaaatttattgccagagaggaaggttttactaccgcagaaaataagatctgccgacattaa

SEQ ID NO: 7016 - DNA, 864 bp, Klebsiella pneumoniae
caggtgagcgaaatggttgatatgactaaaaataccaccgagaaaaaactcacacagagtgatattcgtggcgtgttcattcgttctaacctgttccagggttcatggaacttcgaacgtatgcaggcgctggggttctgcttctctatggttccggcgattcgtcgtctgtacccggagaacaacgatgcgcgtaagcaggcgattaagcgtcaccttgagtttttcaacacccacccttacgttgccgctccggtactgggcgtaaccctggcgatggaagagcagcgcgccaatggcgcagagattgacgatggcgctatcaacggcatcaaagtcggtctgatgggaccgctggccggcgttggcgacccgatcttctggggtaccgtgcgtccggtgtttgcagccttaggcgccgggatcgcgatgagcggtagcctgctcggtcctctgctgttctttatcctgttcaacgcggtgcgtctgctgacccgttactacggcgtcgcctatggttatcgcaaaggcgtggatatcgttaaagatatgggtggcggcttcctgcagaaactgactgagggggcgtcaatcctcggcctgtttgtcatgggggcgctggttaacaagtggacgcatgtgaacataccgatggtggtgtcaaaaatcaccggctctgacggacaggttcacgtcaccacggtgcagacaatccttgatcagctgatgccgggtctggtgccgctgctgttgaccttcgcctgtatgtggctgctgcgtaagaaagttaacccgctgtggatcatcgttggcttcttcgtcatcggtatcgccggctacgcggtcggcctgctgggtctgtaa

SEQ ID NO: 7017 - DNA, 327 bp, Klebsiella pneumoniae
ctggcgcttttcgccccattgactacgctgaaaaataacggccataactggtcgtaccacaactcagctgaaaaatggggtgaagcgatgagtaaaaccaatgtccgcatcggcgcgttcgaaatagacgatgccgaactgcacggtgagcatcagggtgagcgaacgttaagcataccctgcaaatccgatccagacttatgtatgcagcttgacgcctgggatgccgacaccagcgtgcccgcgattctcaatggcgaacattctgttctctaccgtaaacattacgaccgccagtccgatgcctgggtcatgcgccttgcctga

SEQ ID NO: 7018 - DNA, 411 bp, Klebsiella pneumoniae
catcctggccttactcaatttgctgtttatcaaccgccgaagtgcggtgatattccgaagactaaaaggcatgttatagtcactcatatattgaggcaagtgaccacgggtctaattccgagtaaaactatgttttgtgtgatctatcgaagtactaaacgtgaacaaacctatttatacgtcgaaaaaaaggacgatttctcgcgcgttcctgacgagctaatgcgcagctttggcacgccgcaaatggcgatgctgctgccgctggatgggcgcaaaaaactggttaacgccgatctggaaaaagtgaaacaggcgttaagcgaacagggctattacctgcaactgcctccgccgtctgaaaatctactaaagaaacacctggcggaacaggggaaacaatccgattaa

SEQ ID NO: 7019 - DNA, 390 bp, Klebsiella pneumoniae
cgatggccagatagtcgccatgcatacgcagcaccggaaaacccagcaacgccccggcgagggccgccatcaccgcccccagcggcagcatcgcccagaagccgaggcccaggtactggtagcccagcgccaggccgtaggcgccgatggcgtaaaacgccacatagcccagatcgagcagacccgcgaggcccaccacaatattcaaccccaggccaagcagaacgtagatcagcccaagaatggccacggtcagcagatattttgtggcgagaaacggaaagacaatggccagccccaccagcagcggtattatccagcgcagccgcgagcggtagcccggcggccggacgtacaccccgtcatccgccccctcaaagcgggcaataa

SEQ ID NO: 7020 - DNA, 663 bp, Klebsiella pneumoniae
atctggcgagagaaaatcctgatgaaaaactggaaaacaacagcagaagcaatcctcacctccggtccggttgtcccggttatcgtagtgaaaaagctggaacacgcggtgccgatggcgaaagcgctggtggcgggcggcgttcgcgtgctggaagttaccctgcgcaccgagtgcgccctggaggcgatccgcgcgattgccaaagaagttccggacgcgattgtcggcgcgggcacggttaccaacgttgagcagttgaaagcggtaacggaagccggcgcgcagttcgctatcagcccgggtcttaccgaatccctgctgaaagcggcgaccgaagacggcaccatcccgctgatcccggggatcagcacggtatctgagctgatgctgggtatgcagtatggcctgaaagagtttaaattcttcccggcggaagccaacggcggcgtgaaagccctgcaggcgattgcgggtccgttcggccacattcgtttctgcccgaccggcggtatctctccggccaactaccgtgactacctggcgctgaacagcgtactgtgcatcggcggttcctggctggtgccagccgacgccctcgaagccggcgactacgatcgcatcaccaccctcgcgcgagaagcggtggaaggcgcgaaataa

SEQ ID NO: 7021 - DNA, 738 bp, Klebsiella pneumoniae
ggaagaggagacgcgccgatgagccagcctttgcttgcctttaatgaggtggatgtcttctacgggccgatccaggccctgaagcaggtctccctcaccgtcaacgagggggagacggtggcgctgatcggcgccaacggcgccggtaaatcaacgctgctgatgtcggtcttcggccagccgcgcattgccggcggggagattttctatcgcggggaggcgatcagccggaaatcgacccactttatcgccagcaacggcatcgcccaggccccggaagggcggcgcatctttcccgatatgaccgtcgaggagaatctgctaatggggaccattgccattggcaaccgctatcaggccgaggacaaggcgcgaatgtaccagctgttcccccggctggaagagcggcggggacagcgggcgatgaccctctccggcggcgagcagcagatgctggccatcgcccgggcgctgatgagccgaccgcgcctgctgctgctggatgagccgagcctggggctggcgccgctggtggtgaagcagatttttcagatcctgcgcgagctgacggcccaggggatgacgctgtttctggtggagcagaatgcccgccatgccctcaacctgtcggaccgcgcctacgtgatggtgaacggccagatccgcctgagcggtagcggccagacgctgctcaacgacccggaggtgcgtaaggcatatctggggatcagcggctga

SEQ ID NO: 7022 - DNA, 711 bp, Klebsiella pneumoniae
tatgtgggagataaagtatcagtagcgttatccctcattctggagattattcctttgatcaacgttcttcttgttgatgaccacgaactggtgcgcgcagggatacgacgcattctggaagatataaaagggattaaagtcgctggcgaagcctgctgcggcgaggacgccgtcaagtggtgccgggctaattccgcagatgtcgtcctgatggacatgaacatgcctgggatcggtggtcttgaagcgacgcgcaaaatcgcgcgctccgtggcgggcaccaaagtgatcatgttgaccgtgcataccgagaatcctttacctgccaaggtcatgcaggcgggcgcggcaagctatctcagtaaaggcgccgcgccgcaggaagtggtgaatgccatccgctgcgtcgcgtccgggcagcgctatattgcctccgatattgcccagcaaatggcgttaagtcagattgaacccgaaaagacagaatcgccgtttgccagtttgtctgaacgcgaattgcagattatgctgatgatcaccaaaggtcagaaggtgaatgagatctcagagcagctaaatctgagtcctaaaacggttaacagctaccgctatcggatgttcagtaaattaaacattcatggcgatgtcgagctgacccacctggcaattcgccatggcctgtgtaatgcggagtcgttagcaagccagtga

SEQ ID NO: 7023 - DNA, 594 bp, Klebsiella pneumoniae
cccgctgtggatcatcgttggcttcttcgtcatcggtatcgccggctacgcggtcggcctgctgggtctgtaatttccaggctgtacgccgggggcttgcccccggcttttttttatcaggagaaacgcaaagcaatgaccttcacggacctggtgatcatcctgtttatccttgcgctactggcctacgcgatatatgaccagtttattatgccgaggcgaaacggcccggtactgctggccatccccctgcttcgccgcagtcgcgttgacggcatgatctttgtcggcctcaccgccattctgatctataacaacatcacccagcacggcacggcgatcaccacctggctattatctgcgctggcgctgatggggctctatttattctggatccgtacgccgaaaatcatttttaaaccgcgcggctttttcttcgccaacgtgtggatagaatatcagcggattaaagagatgaatttatccgaggacggtgtgctggtgatgcaattagagcaacggcggctgctgatacgcgtacgaaatatcgacgatctggagaagatatacaaacttctcattacaactcaatga

SEQ ID NO: 7024 - DNA, 1461 bp, Klebsiella pneumoniae
gtacaaccggaggggatagccatgattaaaattacgctacctgacgggcattattatgacgagatgctgaccgcgcagggtgaacagcggccgcactataatgcctggtggcaatggtttcgcaacaccgatcaattctctatccggcagaaaaaagcgcaagcggaactgctttttcaccgtatcggcatcacctttaacgtgtacggcgaggatgaggggaccgagcggctgatcccgtttgacagcgtgccgcggatcatacccgccggggagtggcagcgcattgaccgcggcatacgccagcgggtgaaagcgctgaacgccttcctctatgacatctatcatgagcagaatatcctgcgcgcggggctgatcccggccgagcaggtgctggccaacgagcagtatcagccgtgcatgcagggcatcaacctgccaaacaacacctatgcccatatcaccggcgtcgatatggtgcgcaataacgacggtcagtactacgtgctggaggataatctgcgcacgccgtcaggcgtctcctacatgctcgaaaaccgtaagatgatgatgcgcctctatccggagatgttcgagcagcatcatattgcgccggtggagcgctacccgagctacctcctgcagaccctgcgcgaaagctcgctggtggatgatccctgcgtcgtggtgatgaccccgggtcgcttcaacagcgcctacttcgagcacagcttcctggcgcagcagatgggggtcgagctggtggagagcgccgatctgtttattaaaaacggcgcggtgtatatgcgcaccaccgaggggccgcggcgggtggatgtgatttatcgccgcatcgacgacgcctggctcgacccgctggccttccgcgccgattcgatgctcggcgtcccggggctgctgtccgtctatcgcgccggcggcgtagtgctggccaacgccatcggcaccggggtggctgacgacaaatcaatctatccgtacgtcccggagatgatccgcttttacctcggcgaacaaccgatcctcagcaatatccccacctggcagtgccggaaagcggaggacctgcgctacgtgctgagcaatctcgagctgatggtggtcaaggaggtccatggcgccgggggctacggcatgctggttggcccgcgttcgactaaagaggagcgggaggccttccgccagcgcctgctggccaatccggccaactatatcgcccaggacacccttgcgctgtcgacctgccccaccttcgttgatgaagggctgtcgccgcggcatatcgatttacggccctacgtgctgtccgggcaggagatgcggctggtgcccggcggcctgacccgcgtggccctcaccgaagggtcgctggtggtcaactcgtcgcagggcggcggaaccaaggatacctgggtgatggaggatgacgcatcatgctaa

SEQ ID NO: 7025 - DNA, 582 bp, Klebsiella pneumoniae
accatggcggatcgcgcccttaatctggatgattttctgtcccgctttcagcttctgcgcccgcagccttcgcgccatgcgctcaatcagcggcaggcggcggtgctggtgccgatcgtgcgccggccgcagcccggcctgctgctgacccagcgttcgccgctgctgcgcaagcacgccggccaggtcgcctttcccggcggcgcagtagataataccgacgcgacgcttatcgccgccgccctgcgcgaagctcaggaagaggtggcgatcccgccggaggcggtcgaggtgatcggcgtcctgccgccggtggacagcgtcaccggctttcaggtgacgccggtggtgggcattattcccccggatctgcactaccacgccagccaggacgaagtctccgcggtatttgaaatgccgctcgccgaagccctgcgccttgggcgctaccatccacttgatatccaccgccggggcaacgaccaccgcgtctggctctcctggtaccagcattattttgtctggggaatgaccgccgggatcattcgcgagctggcgctgcaaattggcgcacgtccttag

SEQ ID NO: 7026 - DNA, 282 bp, Klebsiella pneumoniae
tcacatgaggacatcataatgaagaagcgtttttccgacgaacagatcatcagtatcctccgcgaagctgaatctggagtttttgcccgggagctttgccgcaagcacgctatctctgatgctgcgtactacacttggcgcaagaagtttgatggcatggaaatgcctgaggtgaaacgtcttaagtcatttgaagaagagaacgcccacctcaaggagttgcttgcagaagtcatgatggataaagaagcgttgcaggtggccctgaaccgaaagttctga

SEQ ID NO: 7027 - DNA, 249 bp, Klebsiella pneumoniae
ttaaacgaggacactatgagaaagcctgtttattacgcgtatgttgcccaggaaagtcatccggactctcagggtgagaaaaatacctggtggacaaaggtcggagtcgcctttccccaccacggtaaatccggtctgaatattgtcctgacgcccggtattgccgtttccggcaaactggtcctgcttgagccccgggaggaaaataatccaccacagaatacgggccccatcgaaaccgtgtcgtaa

SEQ ID NO: 7028 - DNA, 1422 bp, Klebsiella pneumoniae
tggaagagggacaggtggttgagcagggtactcatgcacaattgctctcacatcatggacgttatcaggcgctgtggcaggcgcaaatggccgcgcgcgtgtggcgcgacgacggggtttccgcgtctggagagtgggtgcatgagtgatgttcagtcgaatgtgaaaccgctgacgttgacgaccgggcgggtgatttttgctattgccggcgtctatgtgacgcagagtctggtatcggcgctgtctatgcagtccttacccgcgctggtgcgcgctgctggcggatcgctggcgcttgccggtgcgacaaccctgttcatgctgccctgggcgctgaagtttatttgggcgccgtggatcgaacgctggcggcttccgcccggtagccaggaacgccgttcgcggatgttaatcctgcgtggtcaggtcgcgctagcggcgatcctgatgattgccgcagcgattggctggtttgggcgagaaggaggatttcccgatacgcaaatcgtcgcgttatttgttctgtttatggtggcaggcacggtcgcttccaccattgatatcgccagcgacggcttttgcgtcgatcaactgactcgcgcgggttacggctggggaaacagcgtgcaggtcggcggcagctatctgggaatgatgtgcggcggcggggtgttcctaatgttgtcggcagcatccggctggcctgtcgccatgctgatgatggcgatgctgattatggcgctgtcattcccgctgtggcgcattacggagccgacgcgaacagcgcctatcccgcatgttccggcgttaggttatgcgctaaggaggaagcaggcgcgcctgggcttactgctggtattaatgctgaattcaggtatgcggtttgtgctgcctcttctggcgccgctgttgttggatcatgggttgagcatgtctgcgttgggcgcgctgttcagcggcggcaatattgcagcgggcatagcaggaacgctggccggcggattactgatgaaatacacctcacccggcagagcgctgttgacggcttatggcgtccaggggatcgcgctgctggcggtgctgatgacgttcatgatggcgccgggtcatctgttgctgccgattctccagtgtctggtcattgtccagtccatttcgctggcctgcgcgctggtctgtctttacgccacgctgatgtcgctttcatcgcctttgcaggccggtgtcgacttcaccctctttcaatgtactgacgcggcaatcgccatcctggctggtgttatcggcggcgttgttgctcaacattttggctatgcggcctgcttcctgtttgccggggtattcacgttgctggcggcgtgggttgcttatatccggctgcattcggcaagagaactgatgacaagcgcaattgattga

SEQ ID NO: 7029 - DNA, 582 bp, Klebsiella pneumoniae
agatacggggataccatgttagaactcaatgcaaaaaacacggcgctggtggtaatcgatctgcaggaaggcattctgcctttcgccggcggcccgcatcgggctgacgaggtggtggcgcgcgccgctcgcctggcagacaagtgccggcaacagggttcgccggtcatcatggtccgcgtgggctggtcggccgatttcgccgaagcgctgaaacagcctgtcgacgctcaggccggggcgcatacgctgcccgaaaactggtggacctacccggccacgctgggtaagcaggagagcgatatcgaagtgaccaaacgccagtggggcgcgttctatggcaccgaccttgagcttcagctgcgccgccgcgggatcgacaccattattctctgcggcatctccaccaacatcggcgtcgaatccaccgcccgcaatgcctgggagctgggttttaacctggtcatcgctgaagatgcctgcagcgccgcctccgccgagcagcatcagggcagcatgacgcatattttcccgcgcatcggccgggtgcgcagtaccgaggagatcctcacggcgctatga

SEQ ID NO: 7030 - DNA, 225 bp, Klebsiella pneumoniae
cggcggggggagtcagtgaagccagcgctgagcagatgctctatgcctactgcgcgctgctcgatgagagcgtcctcaaccgcgccagtcaggatgatggctaccgcaggtggcgcaaggatccgctgcaggcgcgctttttcagcactctcaacgccggggaagagctctgggaacggatccgccagctgctgcgagagcccacggcggatgcggcagtgctga

SEQ ID NO: 7031 - DNA, 1035 bp, Klebsiella pneumoniae
gttgctggtttttattatttgttacctgggacaacagactttaacaatagcagatacgttaagtccattggcccggaggaaagggtgaacttccagcagctgaaaattatccgtgaggcggcccgtcaggattacaacctgacggaagtcgcgaatatgctctatacctcgcagtcaggcgtcagtcgccatatccgggaactggaagaggagctggggattgagatttttatccgccgcggcaaacgcctgttaggcatgaccgagccgggtaaagcgctgttatcgattgccgagcggatcctcaatgaagccagtaacgttcggcggctggcggatctcttcactaacgatgcgtcaggcgtcttaactatcgccaccacccatactcaggcgcgctacagcctgccgccggtcattaaagctttccgcgagctgttctcagatgttcgcgtcgagctggtgcagggtaccccgcaggaaatcgaagcgctgctgcataacggcggagcggatatcggcatcgccagcgagcgcctgagcaacgatccgacgctggcggctttcccctggttccgctggcatcacagcctgctggtgccgaaggatcatcctttgacgcaggtttctcccctgacgctggaggcgatcgcccgctggccgttaatcacctaccgccaggggatcactggccgttcgcgcattgatgaggcgttcaaccgcaaggggttgatgccggatatcgtgctgagcgcgcaggattccgatgtgatcaagacctacgtggagctggggctgggcgtcgggctggtcgccgagcagtccggtgatgcccgggaagcggacacctttacgcgtcttgatacccgccatctgttcgatgccaataccgtgtggttgggactgaagcggggccagctgcagcggaattacgtttggcgctttatcgaattgtgcaatgccggactgtcgctggatgagattaagcgtcaggcgatggagccggaagaggccgcaatcgactatcagatttaa

SEQ ID NO: 7032 - DNA, 1206 bp, Klebsiella pneumoniae
agccagccactggcaaatcatgatggaagccccccacgttcaggcttgtgcgcaacacattacgcgctggctttgcgcaacctcaacgcaaccggagaacacgttatgatgccgtccgcctccccaaaacaacgcgtactgattgtgggcgccaaatttggcgaaatgtacctgaatgcctttatgcagcccccggaggggctggaactggtcggcctgctggcgcagggaagcgcccgttcaagagagctggctcatgcgtttggcattccgctgtatacctcgccggaacagataaccaggatgccggatatcgcctgtattgtcgtgcgttcgaccgtcgccggaggaaccggtacgcagcttgccagacactttctgacgcgcggcgtacacgtcattcaggagcatcccctccacccggatgacatcagttccttacaaacgctggcgcaggaacagggctgctgctattgggtaaacacgttttatccgcatacgcgcgcgggacgcacatggcttcgcgatgctcagcagctgcgtcgctgcctggctaagacgccgccggtagtccacgccaccaccagccgacagttgctcaactccactctggatttgttgttgctggctctgggcgttgatgccgccgccgtggagtgcgacgtggttggcagctttagcgattttcactgtctgagactcttctggccggagggagaagcctgcctgctgcttcagcgctatctcgatcctgacgatccagatatgcatagccttatcatgcaccgcctgctgctgggctggccggaaggtcatctttcgctggaggcgagctacggccccgtcatctggtcatccagcctgtttgtcgcagaccatcaggagaacgcccacagcctctaccgcagaccggagatcctgcgcgatctgctgggtctgacgcgcagcgcggcgcccctgagctggcgcgactgctgcgaaaccgtcgggccggagggcgtcagctggttgctacaccagttgcgcagccatctggcgggcgaacatccaccagcggcctgccaaagcgtacatcagatcgcgttatcacgtttatggcagcagattttacgtaagaccggcaatgcggagatcagacgcctgacaccgccgcaccacgaccggttagccggtttctacaacgatgatgataaggaggcgctgtga

SEQ ID NO: 7033 - DNA, 282 bp, Klebsiella pneumoniae
acgcgccaactgctgaccttaataatttatgaggtatttatgttatcaaaaaaaattattttaatttcgacgatcaccctgtgcttttctattgttggatgcaaagaggaagctaaaacaacaaaatggtatagggatcaccctgacgaattaaaactagcttatgaaaagtgccaaaagagtggtgacgcttctgataattgcaagaatgcaaatgaagcccactatcaaatcaagcagctaaacgcaccaactccagacttaaataatttagaggagtaa

SEQ ID NO: 7034 - DNA, 1743 bp, Klebsiella pneumoniae
ataccatcttgtttgatgccgaagatccttttgctgatcggcgggcgctggatgaccgcaaatatgccctcgaccatttccagtgcaaacttctgcgcctgccggaaaccatgcaaactgacaaggggaaagcgatggcgcagcataatgcccgttttctcgtcgaatttatggctaagctcagcgcggagctgcagggggagccgctggcgctggatgaagcggttttgcgccgctttgcaccgcaggcgtcaaccgaccggtgatttatggtactctctgccaaaatcgtccgcgttggttgaggatatgccgcaaaagttaagcaaggaacacaggtcgttgtcgttggctgaacaggccggggaacacgctgaggcgctgctgcgtcagctgatgacgatctacgatgtaaaaacgctggttgccgaactggtgagcgtcggcgaacagcactggagcgcggcgatcctcaagcgcgtggtggcgcttggccgcgtggcggagcgtttgcgcccgcaggaagttgctcatctggcgacgctcctgccttcgccgccggcccatcatccgcactatgggttccgttttatcgatctgtttgccggtattggcgggatccgcagtggttttgaagccatcggcgggcagtgcgttttcaccagcgagtggaacaagcacgcggtacgcacctataaggccaactggtactgtgatccgcagcagcaccgttttaatgaagatatccgcgatattaccctcagccaacgctctgacgttagcgacgaggaggcggcgcggcatattcgcgaatctatccctcagcatgatgtgctgctggctggcttcccctgccagcctttctcgcttgccggcgtctctaagaaaaatgcgatgggccgtgcgcatggctttgcctgcgaaacccagggaacgctgttttttgacgtggtgagaattatcgcggctcgtcagccagcgatttttgtgctggagaatgtcaaaaacctcaaaagccacgatcaggggcgcaccttccgtatcatcatgcagacgctggatgagctgggatatgaagtagctgacgcggggcataccgggccggatgacccgaaggtgattgacgggcgccatttcttgcctcagcaccgggagcgcatcgtgctggtgggtttccgtcgcgatctgcagctgcatgctggatttacgctgcgcgacatcgcggcgcagtacccggcggtgcggccaacatttggcgagctgctggagccgacggtcgatgcgaaatttattcttacgccggtgctgtggaaatatctttatcgttatgcccgcaagcatcaggcgcggggcaatggctttggttatggcctggttgaccccgccaatccccacagcgtggcccggacgctttctgcccgctactataaagatggtgccgaaattctcgtcgatcgcggctgggaccggccgctcggtgagaagcattttgacgatccgctgaatcaacagcggcggcctcgccggttgacgccgcgcgaatgcgcccggctgatgggctttgaatccccgcagggggcgcgttttcgcatcccggtatcggatacgcaggcctatcgtcagtttggcaactcggtggtggttccggtcttcgccgcggtggcgaaactcctggcgccgcgcatcgctcaggcggtggcgcgccgtgaagcggatgataatgatggcggatgttcacgataa

SEQ ID NO: 7035 - DNA, 990 bp, Klebsiella pneumoniae
cttgcgaattgtcacatgacggcggttgaccgggaacggaacccggcggccgtctgcctggcggctggaggggctatgacggcgttttttctgcaacaactgatcaatgggctgacgctgggcgcggtgtacggcttaatcgccatcggctacaccatggtgtatgggatcatcggcatgatcaacttcgcccacggcgaggtgtatatggtctccgcctacctgtgcgccatcggcctggcgctgctctctttcttcgggatccactcctttccgctgctgattttcgccaccctggtgttcaccatcgtggtcaccggcgtatacggctgggcgatcgagcgcatcgcctaccggccgctgcgcaactcgacgcggctggcgccgctgatctcggctatcgggatgtcgctgatcctgcagaactatgtccagctgagccaggggccgaaccagcaggggatcccgacgctgcttagcggcgcgttgcgcatgacggtgggcgatggggtggtgcagatcacctggaccaaggtgtttattctcgtcgcggcgctggtggggatgcttatcctgacctggattattcagtatacccggctggggcgcatctgccgcgccacccagcaggaccggcgcatggcggcgatccttggcatcaataccgaccgggtgatctccctggtgtttgtcatcggcgcggcgatggccggtctggccggcgtgctggtgaccatgaactacggcaccttcgacttctatatcggatttattatcggcatcaaagccttcaccgccgcggtgctgggcgggatcggctcgctgcctggcgcgatgctgggtggtctgctgcttggggtggccgaagcccagttcgccgggctggtgaattcggattacaaagatgtcttttcctttgcgctgctggtggcgatcctgatttttcgcccgcaggggctgctgggacgtccgctggtggccaaggtctaa

SEQ ID NO: 7036 - DNA, 378 bp, Klebsiella pneumoniae
aatagacgttgcgcatttgcgcatagcggtcgcccggaaccagcaccgtattttcatctccttcaaccaccagcgtctccagcaccagctccccccctggcgccagctgatctttcagctgccacagatggtccagcggcgagcggcggtggtagagcacccccatcgagaacacggtgtcgaaggcctccagcgccggcagctgctcgatgcccagcggcagcaaatgcgcccgctggtcgttaccgagcagcttacgcaccgcttcaaactggcacaggaacagctgggtgggatcgataccgaccgccagatgtgcgccggcgccgatcatccgccacatgtgatagccgctgccgcagcctacgtcgaggatag

SEQ ID NO: 7037 - DNA, 1479 bp, Klebsiella pneumoniae
ggacgtggttgcaacatctggcgtatgacgcgcaaaccgaaaggagggatgaccatgagtcgtttagtcgtagtctctaaccgtatcgccttaccggacgataaaaaatcgagcgctggcggtctggccgtcggcatcctgggggcactgagagcggcggggggtctgtggtttggctggagcggcgagattggcgatgaccagcagccgctcaagcaggtctcccgcgggaatatttcatgggcgtcgttcaaccttaatgaacgggaccatgatgaatactacaaccagttctctaacgccgtgctgtggccggctttccactatcgccttgatctggtcagctttcagcgcgaagcctgggagggatatctgcgggttaacgccatgctggcggacaagcttctgccgctgattgagccagacgatacgctgtggatccatgattaccatcttctgcccttcgccagcgagctgcgcaagcgcggggtgaacaatcgcatcgggtttttcttacatattccgttcccgacgccggagatttttaacgctctgccgccgcacgctgagctgctggagcaactgtgcgattacgatctgctgggcttccagaccgaaagcgacagaaccgcttttctcgacagcattgctatgcagactcgcctatccgacctcggcgataaacgctatcaggcatggggtaaggcgttcagtaccgaggtttatccgatagggatcgatccggacgaaattacgcgcaacgctaaaggtccgctgccgccgaagctggcccagctgaagaacgagctgaaaaatgtgaagaatatcttctccgtggagcgtcttgactattcgaaagggttgccggagcgattcctcgcctacgagacgctgctcgagaagtaccctcagcaccacggcaaaatccgttatacccagatcgcgccgacctcccgcggcgatgtgcaggcctatcaggatatccgccaccagctggaaaccgcagccggacgcatcaacggacagtttggtcagcttggctggacaccgctctactatctgaaccagcattttgatcgtaagctgctgatgaaggtcttccgctactctgacgtcgggctggtgacgccgctacgcgatggtatgaacctggtggcgaaggagtacgtcgcggcgcaggatccagataaccctggcgtactggtcctgtcgcagtttgccggggcggcgcaggagctgaccagcgccctgatcgtcaatccttacgatcgcgacgaggttgccgccgcgctggatcgcgcgctcagcatgccgctggcggaacgtatcgcccgtcattcagcgatgctggacgtgatcagagaaaatgatattcataactggcaggcgcgctttgtcgaggatctgcagcatatttcaccgcgcagcgaggagagccgtctgcgggggaagatagccaccttccctaaactggcctag

SEQ ID NO: 7038 - DNA, 714 bp, Klebsiella pneumoniae
agaaacacctggcggaacaggggaaacaatccgattaacccacgagggaaaataatgtaccaacatcataactggcagggtgcgcttctggattatccagtaagcaaagtagtgtgcgtcggcagtaattatgcgaaacacatcaaggaaatgggcagtgcgacgccggaagagccggtgctgtttattaaacctgagactgcgctgtgcgatcttcgtcagccgttggtgcttcctgaggggctgggctcggtgcatcacgaagtcgagctggcggtgcttatcggcagcacgctgcgtcaggcgacggaagagcatgtgctgaaagggattgccggctatggcgtcgcgctggatctcacgctgcgcgacctgcaggcgaaaatgaaaaaagcgggacaaccctgggagaaggccaaaggcttcgataacgcctgtccgatctccggctttatcccggccgctgagttccacggcgacccgcagaatacgtcgttaagtctgaagattaatggcgaagtgcgccagcagggcaccactgccgacatgatccataggattgtgccgctgatcgcctatatgtcgcgcttctttaccctcaaagccggggatgtgatcctcaccggcaccccggaaggcgtggggccgctgcacagcggtgacgagctggaggtcggcttcaacggcctggcgctcactacccgcgtgctgtaa

SEQ ID NO: 7039 - DNA, 810 bp, Klebsiella pneumoniae
gattttgcctggcgtgagagccagcgagatgtcagacaacacgcggcgttggccaaaggccaccgagacattttccagcgttacaaggtttgtcatagtaatttaggggttgcacaagctagtgaatgttataatatcacatcacactcacttatttcgatgactagacgcattatgttacataaaaatacgcttctttgcgctggacttggcgctgtttttttgttcgcgcaggtaccgctggccagcgccgccgtggtgacttctatgaaaccgctgggctttatcgcggcggccatcgccgatggggtgaccgagacccaggtgctgctgcccgatggcgcctccgagcatgattattccctccgtccttctgatgtaaaacgcttacagaacgcagacttagtggtgtggattggtccggaaatggaagcctttatggataagtcgacgcaaagcattgcggcgaataaaaaggtgacgattgccgagctggatggggtcaaaccgctgctcatcaccggggcggacgacgatgacgatcaccatggtcatgaccatggcgcagcagaaaaaggtgacggcgatcaccatcacggtatttacaatatgcatctgtggttatccccagagatagcgcggctttcggcggttgcaatccacgataaattattggaacttatgccgcagagtcgagccaaactcgacagcaacctgcagcagttcgagaccgcgctggcggcgaccgacaagcacgtgagcaatgagctggcaccgctggaaagggaagggctatttcgtttttcatga

SEQ ID NO: 7040 - DNA, 447 bp, Klebsiella pneumoniae
  unsure (58): Identity of nucleotide at the above locations are unknown.
acggcctgctggaggcgatccgcgaagtggtggcgtcaccgcatgtggagctggccgnttcacctgtttgccgaccttgcgctggcgacgtcattcctcggcgtctcgctcggcctgtttgattatctggcggatatgtttcagcgtaaaaacagcgtcggcgggcgtctgcagagcgggataatcaccttcctgccgccgctggcgttcgccctgttctatccccgcggtttcgtcatggccctcggctacgccggggtggcattagccgtgctggcgctgataatgccggccctgctggtcatgaagagtcgccgagagcatccgcaggctacctggcgggtcgccggcggcgcaccgacgctatggctggttctgctgtgcgggatcggcatcgtggctattcagttcagcatcgctgccgggttgttgcccgcggtgggataa

SEQ ID NO: 7041 - DNA, 360 bp, Klebsiella pneumoniae
gcaatgagctggcaccgctggaaagggaagggctatttcgtttttcatgacgcctacggttactttgaaaaacactacggtttgacctcgctggggcactttaccgtcaaccctgaaatacagcccggtgcgcagcgtttacacgaaatcagaacacaactggttgagcagaaagccacttgcgtttttgctgagccacagttcaggccagcggttatcgaagctgttgcccggggcacgtctgtgcgcatggggaccctggatccactggggacaggaattacgctgggtaaaacgagttacccgcaattcctcacccaactggcgaatcagtattcgagctgcctgaaaggagattaa

SEQ ID NO: 7042 - DNA, 210 bp, Klebsiella pneumoniae
acgcagcagtgccgattccacttcagccgcggctattttttctccggcgcggttgatctgctcttttatgcgtccctcaacgtgcaggttccctacctcatccagcctgacattgtcgcctgtgcggtaaaacccttgcgcggtaaaggcctgcgcgttgtgggcaggggcgcggtaatagcccgaaatggtataagggccgcgcgttaa

SEQ ID NO: 7043 - DNA, 225 bp, Klebsiella pneumoniae
agccggtctcgggatggagcagaccgatcggcgtctgatggctatcgttggagaagcgcagaaagcgcattaatcaagcctttatcgctctgccagggggagcgcgtctgcgctgccccgcccggtttattaatccattacgtctattttttctcccctattattccgttcaagaataaaaaagttttaactcgatcccattccctcatcaccgttaccccataa

SEQ ID NO: 7044 - DNA, 474 bp, Klebsiella pneumoniae
tatgctcctcgccgcgcttgtcctccattcgcagcttattattggccggagtacgaatcacattgcgggtgctgtttttctccgtcacagggtcgacatgccgcgagtcatgcagcgcatgcgcaatatacggccggtcgggatcgccttcgtggaaagcaatcgccacctccgtgccctggatcagcgggaagtgaaagccgtacacgtcgccgccgtagggtttggcgagacgcaccggcatgctttcctgaccctgccctttatcctctctgtcagcgtcaaatttcacccggtacaggccggacgcatcttgccaggcatagatatcattcgccttcgcgctggtcacccgcgccgtcatggtgccagtcaccttcgggcgcggcagcagcggcggacgccagcacaatgtttcgctgtagggcaccgccagcagggacacccgcagcgcctcccggcggctggcggtaa

SEQ ID NO: 7045 - DNA, 195 bp, Klebsiella pneumoniae
acgcctgatcgcgatcgatttcatctggcacgttgtattctccttaccgtgttctttctttcgcaatgcgtgatgcagttccagacaacggtcagcgagggggcagtacacgatgaaaggttttctgtaaccagcatcatggcgtccagcgcctccggggaatcaatgttttcgacccgatatttttgccactga

SEQ ID NO: 7046 - DNA, 1230 bp, Klebsiella pneumoniae
aaacagcgtcggcgggcgtctgcagagcgggataatcaccttcctgccgccgctggcgttcgccctgttctatccccgcggtttcgtcatggccctcggctacgccggggtggcattagccgtgctggcgctgataatgccggccctgctggtcatgaagagtcgccgagagcatccgcaggctacctggcgggtcgccggcggcgcaccgacgctatggctggttctgctgtgcgggatcggcatcgtggctattcagttcagcatcgctgccgggttgttgcccgcggtgggataaaaaaggggcctgctggccccttgttcatttcgctaagcaacactgcttatactttttaccgctgccgcatgggcagggatcgttgcgtccgactttcgcttcatttcttattggctgcggggcctccaccggctgcggattcgctatcagtactggtaaagcgccagcgccgccggcgtgatacgctcgatgctggcgataaattcatccgccgtcagattatccagcgcgctaaactgttcttcgctgccgtggagcgcgatagcgtccagctccggctggagttcagcgggcaacgtcgaccagtcgctcagcgccacgccgcgcagatagccaaagcaccactcctcaactatggtcagctcctgaccttccgcttcgcgggtgccgaacagcggttcgaactgatcgggataagactccagccgttcggcgatatcgctcatatgctgcagcgtcagattgacaaagcgatcgcgctcgcgatcgttggcccagcgcgggacattatccgccccgccccaaatcgccagcagccactgagcgggttcgatgtcggtcggcgcagagaggatcgccgtcagcaggccatccagttcagagacatccagaatggcgccttcggcggcgtatttcgccagagtgtcatccagccattccagttcgttttcgttcaaaggtccggtattcattcacaggctcgcatggtaaaaatcgggcctacagtagccgaattgccgacagaaagccacccggcgatacctattgcgccggtgtcaacgatacgcgatcaggccaggccgcgcagcgccgacgccacctcacgacaggcctcctcccctaacgaaagcaaaggacggggaagcgagtctggatcgcagagtccgagcatcgctgcggcgctggctatcactcgcaggctaccaccatag

SEQ ID NO: 7047 - DNA, 291 bp, Klebsiella pneumoniae
tgccagagtcgagccaggcatctggccctgaccggatttataagcagagtggagtggatgatggaaagaaatctggccaaaatttcgcaagatgagatggataaagtcaatgtcgatctcgccgccgccggcgttgcttttaaggagcggtacaatatgccggtggtcgctgatttagtcgagcgtgaacagcctgcacatctgcgcgactggttccgtgaacgactgatcgcccatcggttggcctccgtctccctttcgcggctaccgtgggagccgaaacagaaataa

SEQ ID NO: 7048 - DNA, 936 bp, Klebsiella pneumoniae
cgcatcatgctaagtcgtacggcgagtgaactgttctggatggcccgctatctcgagcgggcggagagctacgcccgggtgctggacgtgacctggaaattatcgatgatcccccgtcacagccagcagtcgcgggatctggcgctgccgctgaatttgtcgatgacccacgagttgtttcaggcgcgccatgcccgctttaccatgagcaatctgctcaacttttttgcccttgatggcaacaacccctgcagtatttacagctgcgtggagatggcgtggaacaatgcgcacgccgtgcgcggcagtctgtcggccgaagtgtgggagagcatcaatgccacccgcattgaactgcgaagcctgcgccagcaggggctgggcgagctggggagcgatggcttttttgagtgggtgaaagagcgggtgcatctgtttcgcggggcagtgatcggcacgctgctgcgcaacgacgcgctgagctttatcggtatcggcaccctgattgagcgcgccttcgccaccacccagctgctgctgattaaggatcaacagctgaccaacgacccggatccggtgcgggaatactaccggctggataccctgctcaatgcggtcagcgcccgcgaagcctacaacagcctctaccgccagccggtcagtcgcgaaacggtgatggagctgctgatcctgcgcaacgatattccgcgttcgctgcgcgccagcattgccgacctggtgggcgaactggagaagatcgccaacgaccgctcctatcaaccgctgcgcctcgcccatcagctcaacgttgacctgcgcttcagcacccgtgacgacctggcgcaggcggacctgcagaccacccttaacgggctgctggcgagaattaacgcgctgtccgacagcatcagacaaacctacctggaggccttatga

SEQ ID NO: 7049 - DNA, 840 bp, Klebsiella pneumoniae
acgcccatccgggctttggcgagcaggcgggaggagaacatggctgaacgcatgacttttccgatgtatgccatccaccgccaacagacccaggccctgtggcaggcggtgcagtcgctgctggacgaacgcggcgtgatggtggcgggggaccctccggcggctgaccccggggatctgctggctcactggcgccagccgacgctgttgctgagccagacctgtggctacccgctggtgacccaattgccggaggtgcagacggtgggctgcttccactacgctgcgcccggttgcgaagggcgccgctatcgcagcctgctggtggtccgcgaagcggatagtcaccggatgctgggggacttttttggccgtcgggcggtgtgcaatgccgagcactcgcagtccggctacaacgtactgcgtaaaatggtcgcgccgctctcccgggaggggcgttttttttcagcggtgatgttcagcggcagccatcggcaatcgctgcgcgaactgcagcaggaaaacgccgatatcgccgccatcgactgcgtgacctacgctctgctgcagcgccatcagccgcaggctctggctggcctggtggcgatcggctggagcccggccgcgccagggctgccgctgatcaccgccggcgccaccccggcggcaacgctgaatagcctgcgcgaggcgctccagcagctggtaagcgatgatcgctatcgttccctgtgcgacgccttactgatctgcggctatagcgatatgtcgcgggaggcctatgcgccgctgctggcgtggcgggatgaggccgcggcgctgggggtcagccagctatag

SEQ ID NO: 7050 - DNA, 858 bp, Klebsiella pneumoniae
cgcgctgtccgacagcatcagacaaacctacctggaggccttatgaaactggtcatcgatcatctcacccgctatggctacgatgaagaagtgaagttttccacccagtatctgcgcctgacgccgcgcagtaccgcccggcagacgatcaccgcctggacgctgaccctgccggacggcgcggcggtgaccactaccgacggctggggcaatgtgctgcatgtgctgacgctggataacccgcacaaggagatcaccatccgcgccagcgggattgtcgatatcgccgacgaaggggaggagacgcgtgatgaagaggccgagctgctgtcgccgctggtttttctgcgctgtacgccgctaacccgcgccgatacggcgatccgtgagtttgcccagcgcctctatcgtcccgatgcggcggaagagagtctgaatcaactgatggcggatctgctgttaagaatgccatacttccccggcgcgacccaggtgcaggactccgccgccgacgccttcgcccgcgcgaagggggtgtgccaggatcatacccatgtttttctcgcctgctgccgcgcgctggagatcccggcgcgctacgtcagcggctatgtctacagcgataacgcccagcatgtggcgatgcatgcctgggcggaagtctggctcgacggccgctggctgtcgtttgatatcaccaataatacccgtcgcctgaatcagcatttacggctggcgaccgggctggattatctcgacgcctgcccggtacggggcacccggctgggcggcggcggggagattatgttaactaacgctgaagtgcgcgaacacagccagcaggcgcagcagcaataa

SEQ ID NO: 7051 - DNA, 1407 bp, Klebsiella pneumoniae
catcgttaccgcacccgcggtaaccctgtcaggagtattatcgtgattagtctattcgacatgttcaaggtggggattggtccctcatcttcccacactgttggcccgatgaaggccggaaaacagttcgtcgatgacctggtcgaaaaaggattgcttaatgcagtgactcgtgtggcggttgacgtctacggttcactgtcattaaccggcaaaggccaccatacggacatcgccattatcatgggactggcgggcaatcagcccgatacggtcgatattgacgcgatcccggcttttatccgtgacgtcgaagcgcgcggtcgtctgctgctggccaacggccagcacgaggtcgacttcccggcggatgacggcatgcgttttcgcagcgacaacctgccgctgcacgaaaacggcatgaccattcacgcctgggccggcgagaaagagatctactgcaagacctactactcgatcggcggcggctttattgtcgacgaagagcacttcggcaaggaaaacgccaacgaactgcaggtgccctacccatttaaatcggcgcaggaaatgctggcctactgcaaagagactggcctgtcgctctccgggatggtgatgcagaacgaactggctctgcacagcaaaaaagagatcgaggattatttcgccaacgtctggcagaccatgcgcgcctgtatcgaccgcgggatgaacaccgagggcgtgctgcctggcccgctgcgcgtaccgcgtcgcgcctcggcgctgcgtcgtctgctggtggccagcgataagctctccagcgatccaatgaacgttgttgactgggtcaatatgttcgcgctggcggtcaatgaagagaacgccgccggcggtcgcgtggtaaccgcgccgaccaacggcgcctgcggcatcgttccggcggtactcgcctattacgatcactttatcgagtccgtcagcccggagatctatattcgctactttatggcctgcggggcgatcggcgcgctgtataagatgaatgcgtccatttccggcgcggaagtcggctgtcagggcgaggtgggcgtcgcctgctcgatggcggcggcgggcctggctgaactgctcggcgccagcccggaacaggtttgcgtggcggcggagatcggcatggaacacaacctcggcctgacctgtgatccggtcgccggccaggtgcaggtgccatgcattgaacgtaacgccatcgcttccgtcaaggcgatcaacgccgcgcgaatggcgatgcgccgcaccagcgaaccgcgcgtctcgctcgataaggtgatcgagaccatgtatgaaaccggtaaagacatgaacgccaagtaccgcgaaacctcgcgcggcggcctggcgattaaagttcagtgtgactaa

SEQ ID NO: 7052 - DNA, 384 bp, Klebsiella pneumoniae
gcaataaaccgaaagcgacgccgagcagagacgcatgcgccagcgtgtcgccgaaataagacatgcggcgccagaccacaaaggagcccagcggaccagcggcgcaggccagcatcatcccggcaagccagccaggtaacagaagttcaatcattagcggctgtttccccgacgcagtacaattcgcccctgaaggtcgtggcggtgattatggtggtggcggtatatccccagctgttccgcgccgcgcgggccgaacatggagataaactccgggtgcatggagaccacctccggtgcgccagagcagcagatatgctggttcaggcacaaaacttcgtcggttttggccatcaccagacgcagatcgtgggataccattag

SEQ ID NO: 7053 - DNA, 1542 bp, Klebsiella pneumoniae
agactgaaccgagaacccagccacatgctacaaaacaaccctgaccttcaaagcgcgatcaaacgcctctgggataaattctggagtagcggcattagcaatccgctcacagccattgaacagattacctacctgttgtttatgaaacggctagatgaactcgatcataaaaggcaagacgaaggtgaaacgagtggtgagaaatacatttctaagtttgctggtacttggattccaccagaggaaagaaaccgccctgttgcggaacaacaccctatagataaacgcacgcttcgctggagcgagttcaagaaattgcagcccgaagagatgctgcaacatgtgcgagacaaagtttttccttttctgaaagatctgaatggtgctgaatctaacttcactcatcacatgaaaaacgcagtattcattatcccaaagtcagcattgttggtggaggcagtgaaggccattgacgaaatcttcgagatgatgaaaagggattctcaagaaaaaggccaagcttttcaagacattcaaggagatgtatatgaattcctgctgtcggaaatcgccaccgcaggcaagaacggccaatttcgcacaccacgccacattattaaattgatggcagatctggtccagccgcaactgggacaacgtattgccgaccctgcctgcggtacgggggggtttctgttaggtgcctaccagtacatccttactcagttgtctttatctcaaaacttaaaaagagataattcaaaaggatctactcatgatgaagatgggttctttcgcacttctgtgactgccgctctgaccaaaaaggcccggattcttttgcaagagagtctgtatggttatgacattgacgctactatggtgcgtttaggcctaatgaacttaatgatgcatggaattgatgagccgcatattgattatcaggacacactaagcaagagctatagtgaagaaaccaaatatgacatagtgctagcaaacccgccttttactggcagtatagacaggggggatattaatgagaatttgaaactctcaaccactaaaaccgaacttttgtttgttgagaacatctatcgtttgctgaaaaagggcggtaccgcctgtgtgattgtgcctcaaggagtattgtttggctcgggcaaggcattcaaagaactacggcaaactttagttgagcgctgcgacctcaaggctgtcattactctgcccagtggagtgtttaaaccctacgctggagtaagtactgccattttattgttctccaaagttttcgggccgggggataaaatttccaaacctgctaccgattatgtctggttttatgagatgtcttccgatggttactcattggatgacaaacgaaataagcttgaaggctacggcgacctgcaagacatcattcaaaaataccattcccgtgatgaggcgtctgacacagatcgtacagctaagtgttttatggtgccaagaatggatattgaagcggagaattacgatctttcgctgtctcgctattag

SEQ ID NO: 7054 - DNA, 1440 bp, Klebsiella pneumoniae
ctcgccggccgcagcggccggcgagcctggcgattactcttcttcgtcgctcggcggacgagtgaccaccgcgcgcaccagatccacccggtaatcattcgcttccactacggtaaaatgcagcggcggaagcgacacgacgtcgccaatgcgcgggatatgaccattggcggagatcaccagcccggcaacggtggcaatatcctcatcgtcattgatcagtggatccagccccagcgcctgctgcagcgcatgcaggtcggtcgaccccttaataagccagccatcgccatcgatgacaatctctggcgtctcatcagcgtccgggaattcaccggcgatggcttcaaggacgtccagcggcgtgaccagcccctgcaccacgccaaattcattagttacgatgacgaagctgccgcgcgcccgacgcaggaccccgagcagattgatcgggtccagcgtttccggaacgacaattgccggggaggcagaagccagcgccgcgacgttttcccccgactccagggccaccagcatctctttcgcccgcacgataccaatgatttcatccagctctccgcggcagaccgggaagaggctgtgcggcgacgacagcagctgacgacgaatttcatcttcactctgttcagcgtcgacccagctgatttctccgcgcggggtcatgatgctgcgcagggagcgctgggccagggtcagcacgccgttaatcatgtagcgctcttcttccgcaaaggcgccctcaggaacgggcaccgcggctggactgtctgcgtcatggctgacggaggcctgtttgcggccgcccatcaggcgcaggatggcatccgcggtccgagcgcgcagcggcagcgtcgactggtggcgaacaaagttacggcgcgccacctggttaaagaactcgataatgatcgagaaaccgatcgccgcgtacagatacccttttggaatatggaagccaaacccttccgccaccaggctcaggccaatcatcaacaggaagctcagacagagcacgaccaccgtcgggtgctggttgacaaagcgcgtcaacggcttggaggccagcagcatcaagatcatcgcgatcaccaccgccgccatcatcaccggcagatggttaaccatcccgaccgccgtgatcacggcgtccagggagaagacggcatccagcaccactatctgcaatactactacccagaaactggcatagcctttaccgtgaccggcatcgtgctggcggttttccagccgttcatgcagctcggttgtcgccttaaacaacaagaagatcccgccgagcagcatgatgagatcgcgcccggaaaaggagaaatcggcgatggtaatcagtggtttcgtcagcgttaccatccaggagatgaccgacagcagccccaggcgcataaccagcgccagtga

SEQ ID NO: 7055 - DNA, 255 bp, Klebsiella pneumoniae
gggtggttacgacacggtttcgatggggcccgtattctgtggtggattattttcctcccggggctcaagcaggaccagtttgccggaaacggcaataccgggcgtcaggacaatattcagaccggatttaccgtggtggggaaaggcgactccgacctttgtccaccaggtatttttctcaccctgagagtccggatgactttcctgggcaacatacgcgtaataaacaggctttctcatagtgtcctcgtttaa

SEQ ID NO: 7056 - DNA, 1656 bp, Klebsiella pneumoniae
gtccggctacgcaataatataagagagagcgtcatgaagcatctatttcgacactggcgaacgtcgggcgccgttatcggctcactgctgaaaaaagggagcattgcggtactggcgctgctggtggtctttctcgccgggcggatctatgagtcccagcgcggcccggccctgcatcgctggcatacctggagtggcaacgagatgtcggccgaagagatcgaccaggcgacctttgcccagtatctggcgcgggagaagacgattttcgccgatctccagcgtgaggtgacagaggctttgccggaggaagataaaactccggtcaaccgcttttatcgtcacagccgggtctggccggggcagtttcagcaggactggaaccgttcttttgtgttgatgccgctgggcaagccgcgcggcagcgtggtgctcctccatggcctgaccgattcgccctacagcgtgcgctatctggcgcaactctggcagcagcggggttatgtggcggtggtgccgcgtttgccgggacatggcaccgcgccgggggcgttaacggcggttgactgggagacctggctggcggcgacgcgtctggcggtacgcgaagcgacccgccttgccggggcggacgtgccgctgcatctggtcggctactctaacggcggcgcgctggcgctcaagtatgccctcgatagcctggaggatagccacctgcgtcagccgcagcagattattctgctgtcgccgatgatcggcgtgaccgcgtttgcccgtttcgccggcctcgccgggctaccgtccgtcttcccggcgttcgcccgcgcggcctggctgaatgtggcgcctgagtttaatccgttcaagtacaactcctttccggtcaaggcggcgagacaatcgtggttattgagccaggcgctgcagcagcagattatccgcgcggcccggcagggcgagctgaaagcgctgccgccgatcctcacctttcagtcggtgatggattccacggtcagcacccgcgcggtggtggagtccctgtatcgctatctgccggataacggcagcgagctggtggtgttcgatattaaccaggcggcggatctccgggtcctgtttcgccctgcgctctatgcggcggtgaatacgctgctggccccggcgccgcgggcctataccaccacggtggtgaccaacgcgacggcgcacacgctgcagaccgtcgcccggaccacgctggcccaggaacgggaagagcatcgttatcctttacacctggcctggccggcggatatgtactctttgtcgcatgtggcggtgccgtttcccctgagcgactcgctgtatggtcgcgagccggacgagaagaaccgctacggcattagcctgggcaccatttcactgcgcggagagaccgggacgctgagcgtggggctggagacgttaatgcgcgtcacctccaatccattctttccatggatgatgacgcgcgtcgatgagcgcatcgcctgcggcgaacaggcggcggtggcggcctgcctgaaagcgcaggccagagcagaggcgttaaaacaggatcaggtgcagaacggtacgcagcaggatgccgacgatcgccgcgggagccacgaagcggaacaggcggacaaaccgtga

SEQ ID NO: 7057 - DNA, 783 bp, Klebsiella pneumoniae
cgcacaatacgccgttttcgttttttcgggtttaacgttatgtctcaccgcgatacgcttttttccgcgccgattgccagcctcggcgactggacctttgatgaacgggttgctgaagtcttccccgatatgatccagcgttctgtgcccggctactccaatatcatctcgatgatcggcatgctggccgagcgcttcgttcagcccaacactcaggtttacgatcttggctgttcgctgggcgccgccaccctctccgtgcgccgcaatattagccatccgggctgtcgcattatcgccatcgataactctcccgcgatggtggagcgctgccgtcgccatattgacgcttataaagcgccgacgccggtcgaagtgattgaaggggatatccgcgacgtgaccattgaaaacgcctcgctggtgatcctgaactttactattcagttccttgagccgggcgatcgccaggcgatcctcaataaagtctatcaggggctgaatccgggcggcgcgctggtgctctcggaaaaattcagcttcgaagacgcccacgttggcgaactgttgttcaatatgcatcatgactttaagcgcgccaacggctacagcgaactggagatcagccagaaacgcagcatgctggaaaatgtgatgctgacggactctgtcgaaacccataaagcccgcctgcgtcaggctgggtttgaacatgccgaactgtggttccagtgctttaactttggctcgctggtggccgtgaaagccggggagcaggcatga

SEQ ID NO: 7058 - DNA, 213 bp, Klebsiella pneumoniae
gaatactcgctcaacgaaattaagaaaactctcaagcgcggtaatttacgttttgttacaccattatttgtgcaaactaccagggctgagattgtgcgccgttggcaggggctcgctggtttcagattggttataagatataagtatttgactacgagattcgtcgtagaagagaacggaataagttatttcattagtaatgtttcaggttga

SEQ ID NO: 7059 - DNA, 840 bp, Klebsiella pneumoniae
tcaccgccacgaccttcaggggcgaattgtactgcgtcggggaaacagccgctaatgattgaacttctgttacctggctggcttgccgggatgatgctggcctgcgccgctggtccgctgggctcctttgtggtctggcgccgcatgtcttatttcggcgacacgctggcgcatgcgtctctgctcggcgtcgctttcggtttattgcttaacgtcaatccgttctatgcggtgatcgccgtgaccctgctgctggccggcgggctggtgtggctggaaaaacgaccgcatctggcgatcgataccctgctgggcatcatggcgcacagcgcgctgtccctggggctggtggtggtcagtctgatgtctaacgtccgcgtcgatctgatggcgtacctgttcggcgatctgctggcggttacgccgcaggacctgatcgccattgccactggcgtggtgattgtgattggcattctgctctggcagtggcgaaatctgctggcgatgaccatcagtccggaccttgcgtttgtcgacggcgtgaagctgcagcgggtcaagctgctgttgatgctggtcaccgccctgactatcggcgtggcgatgaagttcgtcggggcgctgatcatcacttccctgctgattatcccggccgccaccgcccgccgttttgcccgtacgccggagcagatggccgccgtggcggtgggcgtgggcatgctggccgttaccggcgggttaaccttctcggccttctacgataccccggccgggccgtcggtggtgctctgcgccgcggtgctgtttattctcagcatgacgaaaaaagccgccagctga

SEQ ID NO: 7060 - DNA, 1641 bp, Klebsiella pneumoniae
aataagccacgcttaaccactcgtcctgtcgacagggtgtcgcacatgcagactgcacaaaaagtcattacggcctatcgtcacaaacgcattattgtctgcctgctggtagccctggcgaccctgggcgccacattagccatccgatttatttcgcagcgcagcgtaaatgaagattatattcgcacggccgccagccaacgggtggcggcgctcaatgacatcttgcgcccgctaagcgcgcagcgagccaccctgctccctctggtgggcaaaccctgccctgatatccatctgacgctgcgcaaaatggcggcctcgttgcaaaccattcgttccgtcgccctcgtcacgtcaggtatcgtttactgttccagtatttttggcccgcgacaggcagacttacatcgcctgcagcccgcgcttcctgcgccccgccctctgctgctcttctcgaacgacagctccttgctcaaaggctcgccggtactgatccaatggtatccagccgcggagagcggcctggacggcgtgatgctggtggtgaatattgagctgctgggaaccttaattcttaatgaaaaatcggccctgatcagcgacgtcagcctgcaggttggcgatcgttattttagcagccgccatgggcttctcgaaaaagcgcatgtcccgcagggcacggtgatttatcgccagcgctctacggagtttccgtttactgtcaatattaacggccctggcgcctcggcgattgcgcttgaggagctgcccggcgagctgccgctggcgctgatttttagcctgctaatgaccggcatcgcctggctggccaccgccggcagaatgagtttctcgcgggaaataagccttggcatttcggcccgggagtttgccctctggtgccagccgctgcaggatgcgcgcagcggcctctgctgcggggtggagatcctgctgcgctggaataatccccgccgtgggacgatttcgccggaggtatttatccccatcgccgaaggcaataatctgatcatccctctcacccgctatgtgattgccgaaaccgctcgccgcctggacgcttttcctcgcgaccgccattttcacatcgcgatcaatgtcgccgcgcgccatttcgctaacggactcctgctgcgcgacctgcacaattactggttcagcgtggatccggtgcagcagctggtggtcgagctaaccgaacgcgatgtcctgcaggatggcgaccagcatatggccgaacatctgcactttaagggcgtacagctggcgatcgatgattttggtaccggcaatacttcgctctcatggctggaaaagctgcgcccggatgttttgaagatcgaccgctcgttcaccagctcggtcggcatagatagcgtgaacgcgacggtgacagatattattatcgccctcgccaaccgcctgcatattgttaccgttgccgaaggggtggagacgctggagcaggaaaactacctgcgtagccacggcgtcgatgtgctgcaggggttttattatgcgcggccgatgccgttggaggcgttcccggcgtggctggccagcagggaggagagtgagggtgagggtgagggtgagggtgagagcgagacgacagaataa

SEQ ID NO: 7061 - DNA, 546 bp, Klebsiella pneumoniae
acatcaccgctgaaaaaaaacgcccctcccgggagagcggcgcgaccattttacgcagtacgttgtagccggactgcgagtgctcggcattgcacaccgcccgacggccaaaaaagtcccccagcatccggtgactatccgcttcgcggaccaccagcaggctgcgatagcggcgcccttcgcaaccgggcgcagcgtagtggaagcagcccaccgtctgcacctccggcaattgggtcaccagcgggtagccacaggtctggctcagcaacagcgtcggctggcgccagtgagccagcagatccccggggtcagccgccggagggtcccccgccaccatcacgccgcgttcgtccagcagcgactgcaccgcctgccacagggcctgggtctgttggcggtggatggcatacatcggaaaagtcatgcgttcagccatgttctcctcccgcctgctcgccaaagcccggatgggcgttcaccgccaccgcccggcggctaaaatggcgtcgccactcgccgtacccgcgcaccaggaacccctga

SEQ ID NO: 7062 - DNA, 213 bp, Klebsiella pneumoniae
gggataacgctactgatactttatctcccacatattaccgggttttattgctattttaaaaggcaaaaaaatgccttcgcctcgatttggctctcatttatggcaatgtctgtgcacactaagtggaaagtcattgagaacagtcagttgcccggctcttattttttaacaatactcatacagaaggcacaaaaaacacaacagattacgtag

SEQ ID NO: 7063 - DNA, 1170 bp, Klebsiella pneumoniae
tattttctgcgtcattccatgacgccaggctttacatcgctgaggaatatccgaatgtctttgaaactgaaaacaatgacgcttcatgttgtgatagcaggttgtatgagcatggccttttacgcccaggcagacgtgaagatcggcgtcgccgggccctttaccggccccaacgccacctacggcgcccagtactggaagggagcctcgcaggcggtggccgatatcaatgccgccggcggcatcaaaggcgaaaagattgtgctggtgcagggggatgacgcgtgcgaaccgaagcaggcggtggcggtggccaaccggctggtggatgaagcgaaagtctccgccgtggtggggcacttttgctcttcctcaacgatgccggcctccgaggtatatgacgaagccgggatcctgaccattacccccggctcgaccaacccgcagatcaccgagcgcggcatgaaagatctcttccgcatgtgtggtcgtgacgatcagcagggggcgatcgccgccaactatatgctggatgtgctgaaggcgaagaaaatcgccgtcatccacgataaagacacctatggtcaggggctggccgatgccacccgcgcggcgctggcgaagcggggtaccaaagaagtgttgtacgaaggcctttcccgcggtgaaaaagactttaacgccctggtgaccaagatcggcgccctcaagccggacgtggtctactttggcggctgccatccggaagcgggcccgctggtgcgccagatgcgcgagcagggggtgcaggccaaattcttctccggcgactgtatcgtcaccgaggagctggtcacggccgccggcgggccgcagttcaccaacggcgtgctgatgacctttggtcaggatccgcgcaccctcccggacggcaaagcggtgatcgagaagttccgcgccagcggctttgaaccggaaggttataccctctacgcctacgcctctattcaggctatcgccgcggcctggaacgccgtcggtaccgataacgccaaagccagcgactggctgaagagccacgacgtcgagacggtgatgggcaagaaagcctgggatggcaaaggcgacctcaaggtgtccgactacgtggtctatcagtgggacgacaagggcaaatatcaccagctctga

SEQ ID NO: 7064 - DNA, 1029 bp, Klebsiella pneumoniae
cactgcctgcggcgggcgacagccgaggaaatgcaaagctggcaagcaaattgcaaaagccagtgcatcatactcccagcgttgacgctggcgttccttacaggaggcaaaatgaacttaagacgactgaaatattttgtgaaaatcgtcgatatcggcagtctgacccaggccgctgaagtcttgcatatcgcccaaccggccctcagccaacaggtcgcgaccctggaaggtgaaatggaccagcagttgctgatacgcaccaagcgaggggtcacgccaacggaagccggtaaaattctctacacccatgcgcgcactatcctgcgccagtgcgagcaggcgcagctggcggtcaataacgtcggccagacgctgcgtggtcaggtgtcgatcggcctggcgccgggcaccgcggcctccgccattaccatgccgttgctgcaaacggtgcgcaatgagttgcccgaggtgatggtctatctgcaggagagcagcggcacagcgctgaatgacaagctgctggcgggccagctggatatggcggtgctctatgagcgttcgccggtggcaggcatcgtcagccagccgctgctgaaagaagacctttacctggtcggcacccgcgactgtccggggcagagcgtggatctcactgcggtggcggagatgaacctgttcctgccgcgcgattacagcgcagtgcgggcgcgggtcaccgaggcattcaccctgcgtcgtctgtcggcgaaaattatcggcgagatcgaatccatcacaaccctgaccgcggccatcgccagcggcatgggggcgacggtgttaccggaatccgctgctcgttccctatgcggggcggcgaacggctggatggcgcggatcagcacgccttcaatgagcctgtcgctgtcgctgaacatgtcggctcgcggcagtctgtcgccgcaggcgcaggcggtgaaagagatcctgctgtctctggtgagccgcccatcgctggaaaaccgtgaactgcagctggtcagttag

SEQ ID NO: 7065 - DNA, 219 bp, Klebsiella pneumoniae
atacagacgctacgccgtgaatggcgcagcggtggcggagatgaaaaggattatctccgcctggagaagttaaacggttttttgctgcacatcatgtcgcccaatatgatgattgcccgtaccaggcccctgcccattaaacaggggctttttttatctcgcttttttcgccagcgactgctgggtttccggtttggtggcaatgatcacagcccgtaa

SEQ ID NO: 7066 - DNA, 702 bp, Klebsiella pneumoniae
ccacccatgcgaattttggctatcgataccgccacagaggcctgctccgcggctctgtggaatgatggcacccttagtgctcatttcgaaatttgtccccgcgaacatacccaacgtatcctgccgctggtgcaggaggtcctcaccgagagcggcaccacgctgagcgagctggacgcgctggcctttggccgcggtccgggcagctttaccggcgtgcgcatcggcatcggtatcgcccaggggctggcgctgggcgccgaactgccaatgattggcgtttccacgctggccaccatggcgcagggcgcctggcgcaaaaccggcgccacccgtgtgctggcggccattgatgcgcgtatgggcgaagtctactgggccgagtaccagcgcgacgagcagggcgtctggcatggcgaagagacggaagcggtgctcaaaccggacgcggtagccgaacgactggcacagctttccggcgaatgggccaccgtcggcaccggatggcaggcgtggccggatctggcgaaagcgagcggactgaccttaagcagcggcgaaattgaattgccggcggcggaggatatgctgccgttagcctgttacctgctggcggcggggaaaaccgtggccgtggagaaagcggagccggtttatttgcgaaacgaggtggcgtggaagaaacttccaggccgcgagtga

SEQ ID NO: 7067 - DNA, 768 bp, Klebsiella pneumoniae
aagggcgcgctttttggagagttttttatggcaggtcatagtaaatgggccaacaccaaacaccgcaaagcggcacaggatgccaaacgcggtaaaatctttacgaaaatcattcgcgagctggtcaccgccgcgcgtctgggcggcggcgatccggcttccaacccgcgtctgcgtgcggccgttgataaagcgctgtctaacaacatgactcgcgacaccctgaaccgcgccatcgcgcgcggcgtcggcggcgatgaagacgcgaacatggaaaccatcatttatgaaggctacggccctggcggcaccgcggtgatggtggaatgtctgtccgacaaccgtaaccgtaccgttgcggaagtgcgtcacgccttcaccaaaaccgggggtaacctcggcaccgatggttccgtctcctacctgttcagcaagaaaggcgttatctccttcgagaaaggcgatgaagacactatcatggaagcggcgctggaagcaggcgcagaagacgtggtgacctatgacgacggcgccatcgacgtctacaccgcctgggaagagatgggcgctgtgcgcgacgcgctggaagccgccggcctgaaagccgacgctgccgaagtctcaatgattccgtccaccaaagcggatatggatgccgagacggcgccgaagctgctgcgtctgatcgatatgctcgaagactgcgacgacgtgcaggaagtgtaccataacggcgagatctccgacgaggtcgcagccaccctgtga

SEQ ID NO: 7068 - DNA, 369 bp, Klebsiella pneumoniae
acgcaggcgcgccgctttgccataaaattcggccgggatgttatcgctcagccaatattccccggcgatggagaccagctccgccgcaaggtgggtacaaaatatctgggcgtctctgtcgccaccggcgcctgccagcgcgcgtcctcgcatcatgccatatacatggatatttccgtcagcgataagttccgcaccggcactcacatgatttgtaacaataagatcacagtgtggcgcataaatgcgctgaccggaacgtaccggctgatcaatcaaacgcgtttttgtgatctgactagcaactggcggcggcggggtgggttcggacggtgccggacgagaggctttttctttcccttcggttaa

SEQ ID NO: 7069 - DNA, 414 bp, Klebsiella pneumoniae
ggctgggcgcgctggcgctgctggccgtcagtctgtttgccacctgggaaccttattgaattaactggcaaaatcatgaaaaaaattgttctgaccatgttgttactggcaagctccggggctgctctggcagcgccacaaattatcaccgtgagccgttttgaggtggggaaggagagctgggcgttcaaccgggaagaggttatgttgacctgtcgaccgggtaacgcgctttacgccatcaacccgagcacgctggttcagtatccgctcaatgaggtggctgagcagcaggtcaaagccggcaaaaccaccgcgcagccgatctcagtgatccagatcgacgatccgcagcatccgggacaaaaaatgagcctcgcgccctttatcgagcgagcgcagaagctctgctaa

SEQ ID NO: 7070 - DNA, 1470 bp, Klebsiella pneumoniae
aacaaggagcgaatcatgaatatcaaggccgccagtctgaccccggaacaagcgcttgccgagctggaagcgcgctatgaagcctcggtcacggcgttacgcaaagccatcggcgactatatcgaccataatacgctccccgataccgaagcccgcgcggaaggtctttttgtctatccgcagctgtcggtctcctgggacggcgccgatcataaagccctcaaaacgcgcgcctggggacgtttcacccatgccggttgctataccaccaccattacgaatccgaaactgttccgcaactatttgctggaacagctgaccctgctgtatcaggactatggcgcgcatatcagcgtcgagctgtcgcagcatgagatcccctatccttacgtgatagatggttccaccctgacactcgaccgctcgatgagcgccggtctgacgcgctatttccctaccaccgagctgtcacaaattggcgatgagaccgcggatggcctgttccatcccaccgagttctatccgctgtcgcactttgacgcccgccgcgtcgatttttcgctggcgcgtctgcgtcactacaccggcacgccggcggaacacttccagccctacgtgctgttcaccaactatacccgctacgtggatgagttcgtcagctggggctgcagccagatcctcgatcccgacagcccctatatcgctctctcctgcgccggcgggatctggatcaccgccgagaccgaagcgccggaacaggccatttccgatctggcgtggaagaagcaccagatgccggcctggcatctgatcacccacgacggcaaagggatcaccctgattaacattggcgtcggcccggccaacgccaaaaccatctgcgatcatctcgcggtactgcggccggacgtctggttaatgatcggccactgcggcggcctgcgcgaaagccaggccatcggcgactatgtgctggcccacgcctatctgcgtgacgatcatgtactggatgcggtgctgccgccagatattccgatccccagcattgccgaagtgcagcgcgccctttacgacgccaccaagcaggtgagcgggatgcccggcgaagaggttaagcagcggctgcgtaccgggacggtggtcaccaccgacgaccgtaactgggagctgcgctattccgcttcggcgctgcgctttaatctcagccgggcggtagctatcgatatggagagcgcgaccatcgccgcccagggctatcgcttccgcgtcccctacggcacgctgctctgcgtctcggacaagccgctgcacggtgaaatcaagcttcccggccaggctaaccgcttttacgagggcgctatctccgagcatctgcagataggcatccgggcgattgacctgctgcgcgccgagggagatcacatgcactcgcgtaagctgcgcaccttcaacgagccgccgttccgttaa

SEQ ID NO: 7071 - DNA, 822 bp, Klebsiella pneumoniae
atgcgacagctacgatattttatacatataaataagatttatgtgttagttttctgtatttataataatgattatcaatcaggagttatatgcacagctatgagggacaatgattttttcagctggcggcgggatatgctgcaccaatttcagtccatggccaccggcgaggaggtttataatctcctgcaacgtgaaaccgaagcgctggaatatgattactacacgctttgtgtgcgccacccggtgcctttcacccgcccccgcgttacgttccagtcgacttacccccgcgcatggatgtcgcactatcaggcagaaaattatttcgcgatagatcctgtgttacggccggagaattttatgcgtggccatctgccatggaacgacagcctgtttcgtgatgcgccggcactgtgggacggggcgcgtgaccatggtctgcaaaagggcgtgacgcagtgcctgacgttgccaaaccatgctcagggatttctctctgtctccgcgaacaatcgtctgccgggcggttaccctgaagatgagcttgagctgcgtctgcgaacgctgactgaactaagcttgctgacgctgctgcgtctggaagatgagatggtgatgccgccggagatgaagttcagccgccgcgaactggaaatcctcaaatggacggcggaaggaaagacttcggcggaggtggcgatgattctctcgatttcggaaaatacggtgaatttccatcagaagaatatgcagcggaaatttaatgcgccgaataaaacgcaaattgcctgctacgccgtggcgactgggctaatctga

SEQ ID NO: 7072 - DNA, 930 bp, Klebsiella pneumoniae
  unsure (65),(70),(71),(92),(100),(114): Identity of nucleotide at the above locations are unknown.
aaagtgcagctgcagaagctgaaaaacaagacgtcaacaagcatcatcattgacctgcgcagcancgcgnncgaagcgctgacagagcggtnatcgcttncgggtctgtttatnccgtccggtccggtggtgcaggtgcgggataataatggcaaagtgcgcgaagacagcgacaacgatggcgtggtttactacaaagggccgctggtggtgctggttgaccgctttagcgcctcggcgtctgagatcttcgccgcagcgatgcaggactatggccgcgcgctgatcgttggcgaaccgaccttcggtaaagggacggtacagcagtatcgctcgttgaatcgtatttacgatcaaatgctgcgtccggagtggccggcgttgggttccgtccagtacaccatccagaagttctatcgtattaacggcggcagtacgcagcgcaaaggcgtgacgccggatatcatgatgccaaccggcaatgaagatcgcgaaaccggcgagcagtatgaagacaacgcgctgccgtgggatagcatcaacgcggccacctatgtgaagtccggggatctgaccccgtttggaccggagctgctcaagcgccacgacgagcgtattgcgcaggatcctgaattccagtacatcatgaaggatattgcccgttataacgcgatgaaggacaaacgtaacatcgtctctctgaactacgcccagcgtgagaaagagaacgaagaagatgatgcgattcgtctggcgcggattaacgatcgcctgaaacgcgaaggcaagccgccgttgaaaaaactggacgatctgccgaaggattaccaggagccggatccgtatcttgatgaaacggtccatatcgcggtagacctggcgcatctggaaaaagcgcgcccggcggtggaaccgccggccagcaaataa

SEQ ID NO: 7073 - DNA, 192 bp, Klebsiella pneumoniae
caagaaaatagcacctacaccaggataagattgcatgcttggggagcggagaggatcacggaaagcaaaaatcccgctcaggtttccctgagcgggatttttaaatttggctcctctgactggactcgaaccagtgacatacggattaacagtccgccgttctaccgactgaactacagaggaatcgtgtga

SEQ ID NO: 7074 - DNA, 246 bp, Klebsiella pneumoniae
gcgacgctcagcgagggggtaatgatgaagcaccaattaacaggccagaccggggacgaccttgacgtcaacgtagatgccctgctggcggcaattaatgagatcagcgaaagcgaagtccatcgcacgctggacgacccgcagcgcgccagcattgatggccgcgggtcacatacctggcgtgagctggcggaggcattcgaactcgatattcacgatttcagcgccagtgaagccaaccgttag

SEQ ID NO: 7075 - DNA, 360 bp, Klebsiella pneumoniae
gcgggtatcagggcgaacgagagagagaaaatgaaaccgctatttgtctatgggacgctctgtcccggtcgcagcaatgcgcatattctggaggcgatcgggggcgagtggcgtcccggctacgtcaccggcaccttttacgcgcgcggctggggcgcagccgccgatttcccggggatcgtcctcgacgctcacggcccacgggtcaacggctatctgttcctgtccgatcggctggcggcgcactggcccatgctggacgactttgaggaagggtacgatcgggtgccggtggaagtgaccaccgacgatggacagcagatcagcgcctggatttatcagcttcagccccgggggtaa

SEQ ID NO: 7076 - DNA, 1278 bp, Klebsiella pneumoniae
aggcgcatcagggagatttcagtcaccaggattaaccccctgcgcgctttgcaggcgcagaggggcacgaaaagtttagtcacactgaactttaatcgccaggccgccgcgcgaggtttcgcggtacttggcgttcatgtctttaccggtttcatacatggtctcgatcaccttatcgagcgagacgcgcggttcgctggtgcggcgcatcgccattcgcgcggcgttgatcgccttgacggaagcgatggcgttacgttcaatgcatggcacctgcacctggccggcgaccggatcacaggtcaggccgaggttgtgttccatgccgatctccgccgccacgcaaacctgttccgggctggcgccgagcagttcagccaggcccgccgccgccatcgagcaggcgacgcccacctcgccctgacagccgacttccgcgccggaaatggacgcattcatcttatacagcgcgccgatcgccccgcaggccataaagtagcgaatatagatctccgggctgacggactcgataaagtgatcgtaataggcgagtaccgccggaacgatgccgcaggcgccgttggtcggcgcggttaccacgcgaccgccggcggcgttctcttcattgaccgccagcgcgaacatattgacccagtcaacaacgttcattggatcgctggagagcttatcgctggccaccagcagacgacgcagcgccgaggcgcgacgcggtacgcgcagcgggccaggcagcacgccctcggtgttcatcccgcggtcgatacaggcgcgcatggtctgccagacgttggcgaaataatcctcgatctcttttttgctgtgcagagccagttcgttctgcatcaccatcccggagagcgacaggccagtctctttgcagtaggccagcatttcctgcgccgatttaaatgggtagggcacctgcagttcgttggcgttttccttgccgaagtgctcttcgtcgacaataaagccgccgccgatcgagtagtaggtcttgcagtagatctctttctcgccggcccaggcgtgaatggtcatgccgttttcgtgcagcggcaggttgtcgctgcgaaaacgcatgccgtcatccgccgggaagtcgacctcgtgctggccgttggccagcagcagacgaccgcgcgcttcgacgtcacggataaaagccgggatcgcgtcaatatcgaccgtatcgggctgattgcccgccagtcccatgataatggcgatgtccgtatggtggcctttgccggttaa

SEQ ID NO: 7077 - DNA, 1515 bp, Klebsiella pneumoniae
atgaccaccagcaccgaaacgggcagcttaaatgacatattacttgttctccagagacgcttttgcctctttctccacaacctgaatacccagctcaccgagcgccgccggattggcgaagcttggcgcttcggtcatcaggcaggcggccgcggtggttttcgggaaagcgataacgtcgcggatgttatcggtaccggtcagcagcatggtcagacggtcaagaccgaaggccagacctgcatgcggcggcgtaccgtacttcagcgcatccagcaggaagccgaatttctcacgctgttcctgttcgttaatgcccagaataccaaatacggtctgctgcatctcgccgcggtggatacgcaccgaaccgccgccgacttcataaccgttaataaccatatcgtaggcgttggctacagcctcttccggggcggctttcagctcatccgcggtcatatctttcggcgaggtgaacggatggtgcatcgccgtcaggccgccttcgccgtcgtcttcgaacatcgggaagtcgatcacccacagcggcgcccatttgccctcgtcagtcagactcaggtctttacccagcttcagacgcagcgcgcccagcgcgtcggccactactttcttgttgtcggcgccgaagaagatcatgtctccatcctgcgcgccggtgcggtcaaggatcgcttccacgatttcagcggtcaggaatttggccaccgggctgttgatcccgtccatgcctttggcacgctcggtcactttaatataggccagccctttcgcgccgtagatcttcacaaagttgccgtattcgtcaatcagcttgcgggtcagagaggccccgcccgggacgcgcagggccgccacgcgccctttcggatcgttggccgggccggcaaagaccgcgaattccacagacttcagcaggtcggcgacgtccaccagctccatcgggttacgcagatccggtttatcggagccatagcgacgttcggcttcggcgaaggtcatgatcgggaactcgcccaggtcgacgcctttcacttccagccacagctgacgcaccatcgcctccatgatctcacgcacctgcggcgcggtcataaaggaggtttccacgtcgatctgggtgaattcaggctgacggtcggcacgcaggtcttcatcgcggaaacatttaacgatctgataatagcgatcgaagccggacatcatcagcagctgtttgaacagctgcggcgactgcggcagcgcgtagaatttgcctttgtgcacgcgggaaggcacgaggtaatcgcgggcgccttccggggtggctttagtcagcatcggggtttcgatgtcgaggaaaccatggtcgtccataaagcggcgcacaaagctggtaattttcgcgcgggttttcaggcgctgcgccatctccggacgacgcaggtcgaggtagcggtatttcagacgcgcttcttcggtgttgacgtgattggagtccagcggcagcgattctga

SEQ ID NO: 7078 - DNA, 801 bp, Klebsiella pneumoniae
ggaggaaacagggtggataaccagatatctgtaccgcctgcgctaaccggaaactacgcttttttctttgacctcgacggtactcttgccgatatccaaccgcaccccgatcaggtggtgatacccgacagcacgctgcaggcgctcaatgcgctggcccagcagcaggggggcgcggtggcattgatttcagggcgctcaatggctgaacttgacgcgctaacccatccctggcggctaccgctggccggcgttcacggggccgagcgccgtgatatcaatggtaaaacctacatcgtctctctgccgacagcgctgcgcgatgagatcgcggctgagctgacgtcggcgctggaagcgctcccgggatgtgagctggagagtaaagagatggctttcgcgctccactaccgccaggccccgcagcagcagagcgccgtgctggagctggcgcagcggattgttcagcgctatccgctgctggcgttacagcttggcaagtgcgtggtggagattaaaccccgcggcgtcaacaaaggggaggcgattaccgcgttcatgcaggaggcgccattcgccggccgcgaaccggtttttgtcggcgatgatttgaccgacgaagcgggattcagcgtcgttaatcaactgcagggaatgtcggtaaaagttggcgccggggaaactcaggcgcattggcggttggcggatgccgccgctgtaaggacgtggttgcaacatctggcgtatgacgcgcaaaccgaaaggagggatgaccatgagtcgtttagtcgtagtctctaa

SEQ ID NO: 7079 - DNA, 693 bp, Klebsiella pneumoniae
ccgcccggcagccaatggtgcggtttatcggcggtgacgatatggcccataaccgggaactgtttcgcgtctggcttcagaccctggcgaagtggcatcagtcggggaccccgtggttgttcctgcataccccggacattgctttcgccccggcgctggtggataccctgtggggtgacctgcgcgctgccctgccggcggcaggaaatgcgccgtcgattccgcagcaatcttctcttttctgatatcctgctatcatatccggagccatctgccagagttaaagggagttttcgtatggtcagcgcgctgtatgccgttttaggtgcgttattgttagtgaagttctcatttgacgtggtgcgtctgcgcacccaataccatgtaggctacggtgacggcggctttagcgagctgcaggttgccatccgcgttcacggcaatgccgtcgaatatgtgccgattggcctcattttgttgttatttatggagatgaacggcgctcagacctggatggtgcacgtttgcgggattttattgattgtcgggcgactgatgcactcctggggttttcatcaccgcgtctactactggcgccgctccggcatgagcgccacctggtgcgcgttgttgctaatggtgctggccaatctctggtatatgccctgggagttggttttctccctccgttag

SEQ ID NO: 7080 - DNA, 1026 bp, Klebsiella pneumoniae
aactgcttaaggtgtaagccctggcgcgcggtttcccgcgcgcccgaagtcctgcccgatatgctacccgccatcgcccctcgccggacggggcgatggcgccagagagccgataaggatgccgccatgcccgtaaattttgacttcaacgatctctacgcctttcgcgccctgatggaatatggcagttttcggctggcggccgaatccatctgcctgtcgcagtcggcccttagccgacgcatcgaaaagctggagacggcgctgggcaaccggctgttcgatcgcaccacccggcgggtgaccctcacgctgtatggacaaaattttgccgaacgttcggagcagctgctggcccatgtcgagacggtgctggcggatatcagccaggtcagcaaggcgcgcaccgggctggtgacggtggcgacagtgccttccgccgcctactactttatgccggaaatcatccgcagctttcaggcgcgttatccccaggtgcgcatccggttgattgacagcagcgtcgggaatgtgatcgaggcggtcagcagcggacaggctgactttggcctctgctttgccaaaaacctgccagccagtatcgaattcacccctcttgccgacgaccgctatgtggccgcctgtcggcacgatcatccgctggcgcgcaagacgcacctaagctggcaggcgtattttgaacaggattatattggcctggatcgggtctccggcaaccggacgctgcttgaccgggagctggcgcatctgacgccggcgcggccaagtatctgcgaaacccgccacgtcaccacgatgctggggatggtggaagcgggcatcggcattgccgccgtgcccgcgatgtcgatgcccgccggggagcattccgttctccgcgctgtgccgctcaccgacccggtggtcacgcgtacggtaggcctgatccgcctcagcggccgtattcagtcctacgtggcggcagagctggagaagctgattattgaacagtatccttctggctga

SEQ ID NO: 7081 - DNA, 831 bp, Klebsiella pneumoniae
ttgtgttcaagtgacgactttgcgagcaatatgatgtttaaatggccctggaaagcagatgatgagtccggcaacgcagagatgccctgggagcaagcgcttgccattccggttttagcccatctttcgtccactgagcagcacaagctcacgcagatggctgcccgttttttacagcaaaagcggctggtggcattgcaggggctggagctgaccccgctgcatcaggcgcgcattgctatgctcttttgtctgccggtgcttgagctgggcattgagtggctggatggcttccatgaagtgctgatctaccctgcccctttcatcgtcgatgatgaatgggaggatgatattggtctggtccacaaccagcgggtggtacagtcgggacaaagctggcaacagggtcctgtagtgctgaactggctggatattcaagactcttttgatgcgtcaggctttaaccttgtggtgcatgaagtggcgcataagcttgatacgcggaacggcgaccgggccagcggcgtgccgcttatcccgttgcgtgaagttgccggctgggagcatgatctccacgccgcgatgaacaacattcaggatgagatagatctggtcggcgaaagcgccgccagtattgacgcctatgccgccaccgatcccgcagagtgctttgctgtcctctcggaatattttttcagtgcgcctgaactgttcgcgcctcgcttcccggccctgtggcagcgtttttgccacttttaccgccaggatccgctggcgcgtagacgtgagaatggcctgcaggacgaaggcgatcggcgcattgttcactaa

SEQ ID NO: 7082 - DNA, 1515 bp, Klebsiella pneumoniae
cctggcaaaagcaccagactatcaactgaggagaatgacatggcggtaacgcaaacggcccaggcatgcgacctggtcattttcggcgcgaagggcgacctggcgcggcgtaaattgttgccttccctgtatcagcttgaaaaggcgggccagatccacgctgacaccagaatcattggcgtcggccgtgccgactgggataaagcggcttataccaaagtcgtgcgcgaagcgctggaaaccttcatgaaggaaaaaattgatgaaggtttgtgggataccctgagcggacgcctggagttctgtaatcttgacgtcaatgacaccagcggcttcacccgcctgggtgagatgctggatcaaaagaaccgtgtcaccatcaactatttcgctatgccgccgagcacctttggcgcgatctgtaaagggctgggcgaagcgaagcttaatgccaagcctgcgcgcgtggtcatggaaaaaccgctcggcacctcgctggaaacctcccgtgaaatcaacgaccaggtcggcgagttttttgaagagtgtcaggtctaccgtatcgaccactatctcggtaaagagacggtcctcaacctgctggcgctgcgcttcgccaactccctgttcgtcaataactgggactgccgcaccatcgatcacgtcgaaatcaccgtcgcggaagaggtgggtattgaagggcgctggggttacttcgaccaggccgggcagatgcgcgacatgatccagaaccacctgctgcagatcctgtgcatgattgccatgtcgccgccgtccgatctcagcgccgacagcatccgtgatgaaaaggtcaaggtgctgaaatccctgcgccgtattgaccgctccaacgtgcgcgagaaaaccgttcgcggccagtataccgccggctttgcccagggcaaaaaagtgcctggctatctcgaagaggagggggccaacaagaccagcaacaccgaaaccttcgtggcgatccgcgtcgatatcgataactggcgctgggctggcgtaccgttctatctgcgcaccggcaaacgtctgccgaccaaatgctcagaggtagtggtttacttcaaaaccccggaactgaatctgtttaaagagacctggcaggagctgccgcagaacaagctgaccattcgcctgcagccggacgaaggggtagatatccaggtactgaacaaagtgccgggcctcgatcataaacataacctgcagatcactaaactggatctgagctattccgagacctttaaccagacgcacctggccgatgcctatgaacgtctgctgctggagaccatgcgtggcatccaggcgctgttcgttcgccgcgacgaagtagaagaggcgtggaaatgggttgactccattaccgaagcctgggcagccgaccgcgatgcgccgaaaccgtatcaggccgggacctggggaccggttgcgtcggtggccatgatcactcgcgacggtcgttcatggaacgagttcgagtaa

SEQ ID NO: 7083 - DNA, 675 bp, Klebsiella pneumoniae
ttaccgctgagaggtaattatatgtatcaacgtattaacggcagcgactggcgtaatatctggctgatgggcgatctgcatggctgctttgcgctgctgatgaatcgcctgcgtcagctgcgttttgatccctgggccgatctgctgatctcggtgggcgatctgatcgatcgcgggccgcagagcgccgattgtcttggcctgttgcgctgtcgctggttcagggccgttcgggggaatcatgagcagatggcgctggaggcgctggagagcggagatatgcggctctggcagatgaacggtggcgactggtacgtcaagggtgatgcgcggcagcgggccgacgtcgatcggctgctggcgcactgtcggcggctaccgttgattattgaagtgcaatgcgagaaagcgcggcatgtgatcgcccacgccgattacccggcgccggtctatcgctggcagcagccggtggatccccaacgggtactatggagccgccatcgtctgagtgaacacctggcggggcgccatggcgctattggcggcgcagaccatttctggtttggccatacgccgcttcaggcgcgttatgaccacgataatcaacactatattgatacgggcgctgtgtttggtgggacgctgacgctggtggcgctgcagtcggcaggctaa

SEQ ID NO: 7084 - DNA, 690 bp, Klebsiella pneumoniae
acagtcatgagtgaacagaaattaatagctgaatcccgcacttttgagcagcaaatgattgagcgggataaacgcgccacaaaagccggttttgttgttggcggtatgggtctgctgattgcggtactggcgctcgtcgccgtggtcgtgatgttgccgctgaaacagacggacgttgagctgtataccttggataaccacacaggacgggtggaacacgttacccggacatcgaaaaccagcctgaccgcaacagaagcctatcaaaaggcgatggccgcaaactacgtcaaagtgcgtgagcggtatgtctatccctctttgcaggacgactacgagacggtacaggtctacaacgctccccaggtaaacgatgactatctggcgctttacgccggaaaaaacgccccagacaaggtttataagaacggggcgcacaccgtgaaagtggagatcttgtccaaccagatcaccgatgcgacagcccctgatagggtcgccaccatccgctacaagaagattatccgccgtctggctgataacagcacccgcaacgaatattgggatgcccggttcacgttccattctaaccctgacaaggaaatgagcgatgcggaacgcgagatcaactacttcggctttaccgtcaccagttggcagaccgaccgcgaaatccggggaggtgaatga

SEQ ID NO: 7085 - DNA, 759 bp, Klebsiella pneumoniae
tccgaaatgagtgcgatagaagtgaaaagcctggtaaaaaaattccatggccagacggtgctccatggtatcgacctggaggtacagaaaggggaagtggtggcgatcatcggccccagcggctcgggcaaaaccaccctgctgcgtagcatcaacctgctggagcaaccggagagcggcactatccgcgtcggcgatgtgacgatcgacgccggtcgcagcctcgggccgcagaaagggctcattcgccagctgcgccagcacgtcggctttgtcttccagaactttaatctgtttccccaccgtacggtgctggagaacattattgaagggccggtcatcgtaaaaggtgaagataagcaggagtccatggcgcgggcgcgcgaactgctggcgaaggtggggctcagcggaaaagagaatagctatccgcgccgtctctccggcgggcagcagcagcgagtggctattgcccgcgcgctggctatgcgtccggacgtgatcctgtttgatgaacccacctcggctctcgatcctgagctggtgggggaggtgctcaacaccatccgtcagctggcgcaggaaaaacgcaccatggtgatcgtgacccatgaaatgagtttcgcccgcgacgtagccgatcgggcgatatttatggatcagggacgcattgtcgaacaaggcgaggcaaaagcgttgttcgcttcgccccagcagccgcgtacccgtcagttccttgaaaaattcctgatgcagtaa

SEQ ID NO: 7086 - DNA, 1536 bp, Klebsiella pneumoniae
gtgcagaagagcggagtcgttatgcaacagtctaccccttatctctcatttcgcggcatcaccatgacgttccctggcgtaaaggccttgtccgatatcagttttgactgctacccgggacagatccacgcgctgatgggcgaaaatggcgcaggcaaatcgacgctgttgaaaattctcagcggcaactatatcccgaccgcgggccatctgcagatcggcggccagcagatggcattcgccaataccatggaggcgctgaatgccggcgtggcaattatctaccaggagctgcatctgatcccggagatgaccgtcgccgaaaatatctatctcggtcagctgccgcacagaggcggcatcgtcaatcgctcgttgctcaactatgaggcccgcctgcagctggagcatctgggtctggatatcgacccggagacgccgctgaaatatctctccattggtcaatggcagatggtggagattgccaaagcgctggcgcgtaacgccaagattatcgcgttcgatgagccgaccagctcgctctccgccagagagatcgacaacctgtttcgcgtcatccgcgagttgcgggaggagggaagggtcatcatctatgtttcacaccggatggaagagatttttgccctcagcgatgccatcaccgtctttaaagatggccgctacgtttgcacctttgacgatatgccgagcgtcagccacgacgccctggtccaggcaatggtaggccgcaatctgggcgatatttatggctggaagcctcgcccctatggcgaggagcggctgcgcctggaggaggtcaaagcgccgggcgtgcgcacgccggttagtctctcggtgcgcagcggtgaaattgtcggtttgttcggactggtgggtgccgggcgcagcgaactaatgaaaggcctgtttggcagcacgcagataaccggcggtcaggtgtatatcgatggccagcccgtctccattcgcaaaccggcccaggccatccaggccgggatgatgctgtgtccggaggatcgtaaagcggaggggattattccggtgcattccgtgcgcgataacatcaatatcagcgcccggcgcaagcatattcacgctggctgcctgatcaacaacgcctgggaggcggacaacgccgatcaacatatccagtcgctgaatattaaaacgccgggcccggaacagctgattatgaacctgtcgggcggcaaccagcagaaagcgatccttggccgctggctgtcggaagagatgaaggtgatcctgcttgatgagccaacccgcggcatcgacgtcggcgccaaacatgaaatttacaatgtgatctatggcctcgccgcctccggtgtcgccgtggtgtttgcctccagcgacctgccggaagtgctgggcgtcgctgaccgcatcgtggtgatgcgcgaaggacaaatcgccggcgaactgctgcatgaagaagccaatgaacagcaggcgttaagccttgcgatgccaacagtgagccaggctgtcgcctga

SEQ ID NO: 7087 - DNA, 183 bp, Klebsiella pneumoniae
gaacaggagagcgacggaagtccagatagcaacgatgatggttacacccgtgacagccagcaggggcaccattggcaccccccacagcgccgccgggcgtttcattgccttgagcagctttgccatatgttcagcctcttagctcatcagcagagcgccgatttcactgcctccgccaattaa

SEQ ID NO: 7088 - DNA, 861 bp, Klebsiella pneumoniae
tttgtcaggagttccatgtcacaacaaattgaatcagtaaaaatggctctgcaggagctggggattaatgcaagcggcgaattctattacaaccctgattacgatttgcttattgcacatgaaacctctcctgagctgaccggcgcggcccgcggcgtgatgaccgactctggcgctgtggctgttgataccgggatcttcaccggccgttcgccgcgcgataaatacatcgtccgcgacgaacagactcgcgacaccgtctggtgggcagactccggcctcggccgcaacgacaacaaaccgttatcgccagacgtgtggcgcagcctgaaaagcctggtcgcgggccagctgagcggcaaaaaactgtacgtcatcgacgcctggtgcggcgccagcccggacacccgtcttggcgtacgcttcgtcaccgaggtggcgtggcaggcccactttgtcaaaaacatgttcatcgtgccaagcgccgacgagctggccagctttacgccagacttcgtggtgctcaacggcgcgggctgcaccaatgccaactggcaggcgcaggggatgaactccgagaactttgtcgcctttaatctgagcgagcgtattcagctcatcggcggtacctggtacggcggcgaaatgaagaaagggctgttctcggtcatgaactacctgctgccgcagaaaggcatcgcgtcgatgcactgctcggccaaccgtggcgaagcaggggacgtggcgctgttcttcggcctctccgggaccgggaaaaccaccctgtcgaccgatccgcatcgtcagctgatcggcgatgatgagcacggttgggacgatgacggcgtgtttaacttctaa

SEQ ID NO: 7089 - DNA, 1797 bp, Klebsiella pneumoniae
ggcggttttggtatgaagctattacgcctaaaaatctctgatccgtccggcttccgtagtctgccctgtggttttgaacactattttagaaccgaatgggatttacaggaagaattgaatcaacatgaaggctttgcgccttttgtgtgtgctggtcccaacggcagtggtaaatccaatctgcttgaagcattagcagctatcttctttcagttggaaattttgcgggtccgtcgaagttttttgcctgaggtattgcaaagtaccgatcatgatttatcaccaatctcatttgagctggattatctaattcgagtaccagaagagtttcgaatctctggcggacaagaatgggcaaaagtctccgtgtggaaaaacaacggggaatctgtgcgtttccattgggtaaatcagagtgactttgacacaaatgctgatgaagttttcaagggaagccatgccgatattctattgcctcagtatgtgttgggctactcgtctggcgagaatgaaattctcagtctaccgtttttcaaaatgcgctttgtacagttcgacgagtactggaatgccttgactcgacaactgagctactctggccatccggagtcgaggttggcctatcttgacagtggtttcagccaagctattttactttgtaatctgctttttcaaaacgaaactgcgcttcaacctttccgtgaggatgttggtatagaggcgttgcgggagtttcgtattattatccgtcgcagtattcctcttgcgccggagcagttgacctcgtttgccagcgaggataaaaaccagcaccaatcacttgatgacattttgaatagtaaccctgctcttcatgtggatatggatgaagaaagtggtcaaagttaccatttaaacctgatgcagctgctggaaggggatgacaaatcctccttggtagtcagcgcgcttaaacgctgcgctagcttgtattacgaggacgagtgtaacgacactctaattctggactactgggttaatgatgctactcgacaggcttttcgcgagaattttaatggttcggcactggctctattccaggcgttccaagtattgctgacactcaatttgtataaggtgagtgataatctcaaaactgatctgtatcgctcaacaagtcactatgtcagtgaaacggtaccaacgttggcgtccgacgaacgaattatgcgcttcaagtttgtgcgttttactaaacaaggagtggaagagccaatgatgctcaaggaactctcggacggtgaacaccaattgcttcatagcctaggtctatgtttactgtttagagaaaccaacagcctgtttctgttagacgaaccggagactcatttcaacccacattggcgtgccagttttatcactcggatgcgccaatgtttatgtaacactgagaatgtggagcaggaaatgttgatcactactcatacacctttccttatctcagatagtaaacccgaaaaagtactggttttttctaaggataaatatagcggtgcggtcacaataagcatacctaaatacaacacacttggtgcatcaatcaataaaattactatgaataccttcggcaaacgtgaaactatcggtggccatgcgcaagcagtactggatgatttacgcagacgttttaacgaaggcattgaagacaaggaaactctgatcacagaaattgatgaacaattgggtgactcggtggaaaaagtattactcctcaaggctatttttgatagcgacaatccaacgaatgacgaggtttag

SEQ ID NO: 7090 - DNA, 1077 bp, Klebsiella pneumoniae
tatatgagtggcggtctttttgttggggttgagaaatacctgataggaggaattacagacgccacaaagagattgatgatgtcgtactcttctatgatgatggggttggcagcagcgtcagctaccatctacatcatgtggcgtggataccagactttggctggtaagctatctacgcctatggaagacacgatgtgggacatcatgaggatggcgatcatcctgtccttcgtggctaatttaggcggctacctcgatggcgttattgatgccataaacggaataaaggagggtttttctggtagtgataatatatggcagttattagacaccctatggaataaggctaaagtgttagggaaaacgctacatgacatggataattctacatatgtaaaagatgagggaatgactgctcaattttgtgtatggcttggaatattcgcacttatgattctagcgggctttgtttcaatggttgccgaagtaatgattctactattaggaataactgcacctattttcatattctgccttatgtatggtttcctccgccccatgttcaataactggttgcaaaatatatttgcaggaatattaacaattctatttaccgctctctcattgagaattgtagtgaattacttgaatctcgttcttaataaggcgacgaaggtagcagacagttcaacaattgttgaacttggtgctcaagtctgccttgcaggtattttcgctgcaatactggtgtatatttccgctaaggtagccgcagctctggccggggcaagcgctaccgtatccatgcaggggctggccgctgtaggtatcggtgcggctgcttttggtgccgggaagctagccgggggtgcagttaaagaaaccaaacgttccgcccaggacaacattcagggctggaaggatgcgaatgcaggtaagcccggcaagcccggaggtgagttaggctataacgcatctaaagcgcggaagtacgcgattgagcagatgatagcccggaacgaagcgcggaggctggcacagtcgagagaatccgcggttaagaagttcaacagctag

SEQ ID NO: 7091 - DNA, 546 bp, Klebsiella pneumoniae
atgaataccggacctttgaacgaaaacgaactggaatggctggatgacactctggcgaaatacgccgccgaaggcgccattctggatgtctctgaactggatggcctgctgacggcgatcctctctgcgccgaccgacatcgaacccgctcagtggctgctggcgatttggggcggggcggataatgtcccgcgctgggccaacgatcgcgagcgcgatcgctttgtcaatctgacgctgcagcatatgagcgatatcgccgaacggctggagtcttatcccgatcagttcgaaccgctgttcggcacccgcgaagcggaaggtcaggagctgaccatagttgaggagtggtgctttggctatctgcgcggcgtggcgctgagcgactggtcgacgttgcccgctgaactccagccggagctggacgctatcgcgctccacggcagcgaagaacagtttagcgcgctggataatctgacggcggatgaatttatcgccagcatcgagcgtatcacgccggcggcgctggcgctttaccagtactga

SEQ ID NO: 7092 - DNA, 549 bp, Klebsiella pneumoniae
tatttagccggatgtcgggacgtgtggtgtatttatcaaatgagtattgatgttgaaacacttgtgaaacaattaggtaaaccttatcaggatatttataagcaaggattagtcccctacgaaacaaaaccaagtgttacggttagtgatgatatttatagattagatatgaaacgagagggggtgtttttatcgttttttaataatcaagataaaaatcttaaggaagtggccttaaggttagaggatgagaataaaactgactggttatttcctaacttgctgccatttggtcttgaaccagtaatgacacagagatgggtacgaaaccgatttggtcatccgattacttacgttgctgccaacgtgattatgactatctatgtcggggtggaacaaacatatattttaccaactccaaatcaaaatattgcagcggcattttcttacaataatgttctttttgtcaacaggatcacatttattccggtggaacgggcgaaagaaattcagtctgcacttgagaaaaaaagacttggtggcaaatga

SEQ ID NO: 7093 - DNA, 675 bp, Klebsiella pneumoniae
actctttgcggtactgcgctcatgaatacctctgaaagcgatctgatcaacaaaactttttacccgggctggctgatggtcagccagttacgctgcggccagccggtgacggatggcgaggcgctctatcgccaggcctgtcgatgggtgaccgaggcgcgcgaggcgctgacggcggggggagtcagtgaagccagcgctgagcagatgctctatgcctactgcgcgctgctcgatgagagcgtcctcaaccgcgccagtcaggatgatggctaccgcaggtggcgcaaggatccgctgcaggcgcgctttttcagcactctcaacgccggggaagagctctgggaacggatccgccagctgctgcgagagcccacggcggatgcggcagtgctgacctgcttctttcgtactttacagctgggatttgtcggacagtaccgcgccgaggatgacgaacggcgtgaggacgtggcgcaagcgcttggcgcgcgggtcccgccgttcagcctgacccaggaggcgccggtggtggttcgtgcctcccggctgcgcagcggacggcggatgtactggtgcgcctgggcggctggcattgtggcgctggcggcgctgtggttgacctgctccgccatgctgtcacagatggtggcgcagatagcagggcagggataa

SEQ ID NO: 7094 - DNA, 336 bp, Klebsiella pneumoniae
atgctgtgcgggcctgcccgcagaatgtcattggcgttgactgcactctactaccttgaaaacaaactttcaaattttatgaaaagttgttttaaaatttacgcagtgcttcacactttcgcaagctccccctgtctgttgacctcagccctctgcatgctggcgcatccgcttcgtcctcccttaccacccgccggcgacaaagtcctgaccgcccaggcaataatgaataataaattaaaagcattctcatttattattaaactgccaatgcgtgttattcccattagcattttaaataaaacatttttaaatttactttttgcaaataattaa

SEQ ID NO: 7095 - DNA, 375 bp, Klebsiella pneumoniae
gggcatggcgggcattctgctccaccagaaacagcgtcatcccctgggccgtcagctcgcgcaggatctgaaaaatctgcttcaccaccagcggcgccagccccaggctcggctcatccagcagcagcaggcgcggtcggctcatcagcgcccgggcgatggccagcatctgctgctcgccgccggagagggtcatcgcccgctgtccccgccgctcttccagccgggggaacagctggtacattcgcgccttgtcctcggcctgatagcggttgccaatggcaatggtccccattagcagattctcctcgacggtcatatcgggaaagatgcgccgcccttccggggcctgggcgatgccgttgctggcgataa

SEQ ID NO: 7096 - DNA, 756 bp, Klebsiella pneumoniae
attgccggcggcggaggatatgctgccgttagcctgttacctgctggcggcggggaaaaccgtggccgtggagaaagcggagccggtttatttgcgaaacgaggtggcgtggaagaaacttccaggccgcgagtgaatctcagtaacaagaagactgagaaaaggagtcgcatcatggcgggtcaaaaacagggcgttcgctggctgttagccgcggcggttgccgttgcgctaagcggctgcgtgtcagtgccggatgccatcaaaggcaccagcccgacgccgcagcaggatttagtgcgggtgatgaacgccccgcagctgtacgttggccaggaagcgcgctttggcggtaaggtggtcaatgtgcaaaaccagcaggggaaaacccgcttagaaatcgccaccgtaccgctggacagcggcgcgcggccagtgctgggcgagccgtcccgcggaaggatttttgctgacgtcaatggcttcctcgatccggtggatttccgcggtcaactagtgaccgtagtcggaccgatcgccggggtggttgacggcaaggtgggcagcacgctgtataaatttatgctgatgaacgccaccggctacaagcgctggaacgtagtgcagcaggtggtgatgcctccgcaacctatcgacccgtggatgctgggtccgcgcccctggggctacggctatggcggctggggctggtacaatcccggccctgctgaggtgagaaacgttgtaaccgaatga

SEQ ID NO: 7097 - DNA, 1236 bp, Klebsiella pneumoniae
tccggctcaggccacgcggagtacaacatgactgaatttccggtagtactggtgattaactgcggctcgtcgtcgatcaaattttccgtcctggacgccgcaagctgcgactgcctgctcaacggcgtggccgagggcatcaacgcggaacgggcgtctctctcgctcaacggcggcgagccggtggcgctggcgcagcgcggctacgaaggcgccctgcaggcgattgccggagcattagcccaacgcgacctcatcgacagcgtggccctgattggccaccgcgtcgcccacggcggcgacctgttcaccgagtcggtcattattagcgaggaggttatcaataacattcgccaggtatcgtccctggccccgctgcataactacgccagtctcagcggcatcgcctcggcgcagcggctgttcccggaggtgatgcaggtggcggtctttgataccagctttcaccagaccctggccccggaagcttttctctatggtctgccgtgggagtattaccagaatctcggggtacgccgctacggtttccacggcacctcgcaccgctatgtgtcccatcgcgccctgtcgctgctcgggttgccggagcaggagagcggcctggtgatcgcccacctgggcaatggcgcctcgatctgcgcggtgcgtaacggccgcagcgtggacacctccatggggatgacgccgctggaggggctgatgatgggcacccgcagcggtgatgtcgacttcggcgccatggcgtggattgccggggaaacccggcagaccctcagcgacctgcagcgggtggccaacaccgcctccggcctgctggggatctccggtctttcctccgacctgcgggtgctggagcaggcgtggcatgagggccatgcccgcgcccgcctggcgattaaaacctttgtccatcgtatcgcccgccatattgccggccacgccgcggcgctgcagcgtctcgacggcattattttcaccggcgggattggcgagaactcggtgctgatccgtcggctggtgagcgagcggctgacggtctttggccttgcgatggacgccgcccgcaatcagcagcccaattcggccggcgagcgcctgatctccgccgacggcagccgggtgcgctgcgcggttattcctaccaatgaagagcgcatgattgccctcgatgcgatccgcttaggccggatccacaccgcggcggcgctggcctga

SEQ ID NO: 7098 - DNA, 1572 bp, Klebsiella pneumoniae
cgaaaatcagggctttcctcaccctttttgctggatatctcccatactgcaaaggtcagcctgttgacgtctggagcatggaagatgaaaaaccccaccttattgcaatgttttcactggtactaccccaccggcggcgagctgtggcctgaggtcgaagcgctggcgcccagcctgaatgaaatcggcatcaatatggtctggttgccacccgcctacaaaggcgcctcgggcggttactccgtcggctatgatacctacgatctctttgacctcggcgagtttgatcaaaaagggtctgtcgccaccaaatatggcgacaaagcgcagttgctggcggcgatcaacgccctgaaggagcacaatatcgccgtgctgctggatgtggtggtcaaccataaaatgggcgctgatgaaaaagaggctctgcgcgttcagcgcgtcgatgagcaggatcgtacgcaaattgacgaggagatcatcgagtgcgaggcatggacgcgctacaccttcccggtgcgcgccggacagtattcgcagtttgtctgggactacaaatgttttagcggcattgaccacatcgagaacccgacggaagacggtgtgtttaaaatcgtcaacgattacaccggcgaaggctggaatgaacaggtcgatgatgagctcggcaactttgactatctgatgggcgccaatatcgatttccgcaatcatgcagtgaccgaggagatcaaatactgggcgcgctgggtaatggagcagaccggctgcgacggttttcgtcttgacgcggtcaagcatatccccgcctggttttataaagcgtggatcgagcatgttcaggaggtggccccgcagccgctgtttattgtagcggaatactggtcccatgaagtggagaagctccagcagtatatcgacctggtcgagggcaaaacgatgctgtttgatgccccactgcagatgaaatttcatgaagcgtcgcgccagggccgcgattatgacatgagccagattttcagcgggacgctggtcgaagccgaccctttccatgccgtcactctggtcaccaatcatgatacgcagccgctgcaggccctcgaggcgccggttgaaccctggttcaagcccctcgcctatgcgctgatcctgctgcgggagaatggcgtgccctcggtcttttatgccgatctcttcggcgcttcctatgaggataccggcggcgacggagagacctatgccattgagatgcccgttatcgaacaactccacgagctgatcgacgcccgtcagcgttttgcccatggcgtgcaaaccctttggttcgatcatcctaactgcatcgcctttagtcgtagcggtactgacgacgatccaggctgcgtggtgatcatgtccaatggcgatgagggcgaaaaggcgctgacgctgggcgaaaactatggcaacaaacgctggcgggattttctcggtaaccgggaagagattgtcgaaaccgatggcgaaggctgcgcgacctttacatgtaacggggggagcgttagcgtgtgggtgttagaggaggtgctgtag

SEQ ID NO: 7099 - DNA, 363 bp, Klebsiella pneumoniae
agccccacaggagctcacatgtcatctttactgatccccgcagactggaaagttaaacgctccaccccgttctttactaaagagaacgtccccgccgccctgctgagccatcacaacaccgcggccggcgtcttcggtcagctgtgcgtcatggagggagcggtcacctattacggttttgccaatgagcaggcgacggagccggagaaaaaagtcgtgattcatgccggacagtttgccaccagtccgccgcagtactggcaccgcgtcgaactcagtgacgacgcccgcttcaatattcacttctgggtggccgaagaaaccgacggtgaaaacgggctgtttcacgcgaagaaagcgtga

SEQ ID NO: 7100 - DNA, 1029 bp, Klebsiella pneumoniae
tccgccagaggattaagcttgtcagtggctcgctttaaaatagggggaaatcacaacgaggtgtttatcgtgacagacaatagcctgcattcatccggcgtgctagcgccgcgctcgcatcttattgccgatctggtgatgggcagattgacacctgcccccatctggcggcaaaaaaattaccgctttaagtttttgctgcgcacggccttattttataacgccaccagagcgatgctggaagcgctcagcgctcgggatgattttaatcagctgctggccgcgcaggctacgctgccgggcaaagtacaccgtcaatatctgacccgcgatctcaacgcctggcagcgggcggtggcggtaatcaaccattatcgctatatcgacaccctacgcggatcgcggctggcgcacgctatgaccgcggtatctgaggtcccgctgctgacgttaaacggaaaagaggaccgccggtttactctttatgcctcctcggcaggcaaagccgaacgtgagggtgaaaccactctgtggctgcgcgacagcgaccacaccctgctggccagcgccaccttcagcgtaacccgtgatcacgatgcctggcagctggttatcggcggtctgcaggggccgcgacgtcacgtttctcatgaggtgattaagcaggcgactcgcgcctgctacggcctgtttccgaagcgcctgctgctggagtttatctggcagctggccgcgcacagccaaatcgcggctatttacggcgtcagcgataatggtcacgtgttccgcgccctgcgctatcgcctgagcaaaggccgccatttccacgccagctacgacgagttctggcagtctatcgacggccagccggaaagcccctggcgctggcggctaccgctatgtctggaaagaaaatcgctggagagtatcgccagtaaaaaacgggctgaatatcggcggcgattccagctgctggatcagctgacggagcaggtggcaatattgacgcagcggcatgccggtgactaa

SEQ ID NO: 7101 - DNA, 723 bp, Klebsiella pneumoniae
  unsure (7),(137): Identity of nucleotide at the above locations are unknown.
caggcgntgggtgaagagcgtgaaattggcattaccgaactgtcccagcgcgtcatgatgtcgaaaagcaccgtttatcgctttttacagaccatgaaatcactgggctatgtggcacaggaaggagagtctgaganatactctctcaccctcaagctgttcgaactgggcgcgcgcgcgctgcagaacgtcgacctggtgcgcagcgccgatattcagatgcgcgaactttcgcgactgacgaaagagaccatccatcttggggcgctggatgaagacagtatcgtctacatccataaaattgactcgatgtataacctgcggatgtactcgcgtattggccgccgcaacccgctgtacagtaccgcgattggcaaggtgctgctggcatggcgcgatcgcagcgaagtggagcagatcctcgacggcgtggagtataagcgcagcaccgagcggaccattaccagcaccgaggagttgctaaaagtgctggatggcgttcgcgagcagggctatggcgaggataatgaggaacaggaagaggggctgcgctgcattggcgtgccggtgtttgaccgtttcggcgtggtcatcgccgggctgagcatctctttcccaacgctacgtttctctgaagaacgcttgcatgaatacgtggcgatgctccaccaggcggcgcgtaagatttctgaacaaatgggatacaacgactatccgttctga

SEQ ID NO: 7102 - DNA, 990 bp, Klebsiella pneumoniae
cgaatatcgggtgctgctgttcggcgtgctgatggtgatgatgatgatctggcggccgcgcggcctggtgcgcaccagccgcagcggggttgcgttgcgaaaaggagtcgcgccatgaccgacagcatcttacgcgttgagcatctgatgatgcatttcggcggcatcagagcgctgaatgatgtcaatctggaggtggagcgggggtcgatcaccgccctgatcggccccaacggcgcgggcaagaccacggtgtttaattgcctgaccggtttttatcgggcgacggggggcagtatcgtgctgcgggcgcgggaaaaggtcaccgatgttattcaggtgctggggcagaagcttcacccggacgattttctccacccggcgcagctggggaggcggatctattacaagatgttcggtggcacccatctggtgaaccgcgctggcctggcgcgcaccttccagaatatacgtttattccgcgagatgtcggtgatcgagaacctgctggtggcccagcatacccaggtcaaccgccatctgctggccgggatcctcaatacccgtgggtatcggcaggcggagagtcaggcgctggatcgcgctttttactggctggaggtggtggagatggtggactgcgccaaccgtctggcggggaccctctcctacggacagcagcggcggctggagatcgcccgcgccatgtgcacccgtccggagatgatctgtctggacgagccggccgccggcctcaacccggtggaaacccaggcgctgagccggattattcgctttctgcgccagcagcacggcattacggtgctactgatcgagcatgatatggggatggtgatggagatttcggatcatatcatcgtcctcgatcacggggacgtcatcgcccgcggcgcgccgcaggcgatccaggccaacgccagcgtgattgccgcctatctaggcgctgaggaagaggagacgcgccgatga

SEQ ID NO: 7103 - DNA, 390 bp, Klebsiella pneumoniae
tcggctgggggaagggcttcctttacggggctttattcgcctcgttttaccacccatgaaaaaaaatgtaaaaaaaagggtttacacaactccaggtggctcaacgccctctttatgccgatctggtcgctgtcgtggactttaccctgcgcttttaaaggcgcccgtgacgtacgctacaccatgtgggtgtcgatgctcggcatgtggggctgccgggtggtggcgggctataccctgggcatcgtgctggggatgggggtgattggcgtctggttagggatggtgctcgactgggcggtgcgcggcgtgctgttttatttccgcatggtgagcggccgctggctgtggaaatatccgcgcgtgaaggcttcatcggaggaaagctga

SEQ ID NO: 7104 - DNA, 1821 bp, Klebsiella pneumoniae
ggagcctttatgaattcgacaatgttacgggtaacaaatcgcattatcgaacggtcgcgtgacacccgcgcggcttacctcgcaaggattaaccaggccaaaaccgacaccgtgcatcgtgcgcaactggcctgcggcaatctggctcacggattcgcggcctgccaggctgacgacaaagcctccctgaagagcatgttgcgcaacaacattgccatcatcacctcctacaacgacatgttgtccgctcaccagccctatgaacactacccggagatcatccgcaaagcgctgcacagcgccaatgcggtcggccaggtcgccggcggcgtgccggcgatgtgcgacggcgtaacgcaggggcaggacgggatggagctttcactcctgagccgcgaggtgatcgctatgtccgccgccatcggcctgtcgcataacatgttcgacggggccctgtatctcggggtctgcgataaaattgttcccggtctgaccatggcggcgctctcatttggccatctgccgtcggtctttattccctccggtccgatggccagcggcctgccgaataaagagaaggttcgcattcgccagctgtatgcagaagggaaagttgaccgtatggcgctcctggagtccgaagccgcctcttatcacgcgccggggacctgtactttctacggaacggcgaacaccaaccagatggtggtcgaatttatgggcatgcagctgccgggctcgtcctttgtccatccggatgctccgctgcgggaagcactgaccgccgccgccgcgcgccaggtcacccgcatgaccggcaacggcaatgagtggatgccgctgggcaaaatgtttgacgaaaaagtggtagtcaacggcatcgtggcgctgctggcgaccggtggctccaccaaccacactatgcacctggtggcgatggcccgcgcggcgggaattatcattaactgggacgatttctccgacctgtcagacgtggtgccgctgctggcgcgcctctatcccaacggcccggcggatatcaaccacttccaggcggcaggcggcgttccggtactggtgcgcgagctgctgaaaggcggcctgctgcatgaggatgttcacaccgtggccggctttggcctgtcgcgctacaccctggagccatggctgaataacggcgagctggactggcgcgaaggggcgacagcgccattggacgaccaggtcatcgcgacctttgaaaaaccattctcccgccacggcggcaccaaggtgctgagcggcaacctgggacgcgcggtgatgaaaacttcggcggtcccggtggagaaccaggtgattgaagcgccggcggtggtatttgagagccagcacgacgtgttgccggcctttgaagcggggctgctggacaaagactgcgtggtggtggtccgtcatcaggggccaaaagcgaacgggatgccagaattacataaacttatgccgccacttggtgtattattggaccgccgtttcaaaatagcgctggtgaccgatggccgactctctggcgcctccggtaaagttccgtcagccattcacgtcacgcctgaagcgtatgatggcggcttgctggcgaaagtgcgcgatggcgatcttattcgcgtgaacggacagacgggggaactgacgctgctggtggatgaggccgaactggcggcgcgtcagccgcatatccctgacctcagcgcgtcgcgcgtgggaaccggtcgggagatgtttggggcgctgcgtgagaagctctctggcgcggagcagggcgcaacctgcatcactttttaa

SEQ ID NO: 7105 - DNA, 1296 bp, Klebsiella pneumoniae
ggaggctttatgggtgaaattacgcgccagcctgcgcgggctatccaaaacgcgctgatcgacagcgtactggccggcctttgcgcgttaattgtctttggcccgatcgtcggcgtggtgctcaaagggtatggttttaccctcgcgcctgcgcgggtggcgattctggtggcggtggtgatggccggcaggctggcgctcagtctgctgctgcagagccacaggggaaaagcctttattgcccgctttgagggggcggatgacggggtgtacgtccggccgccgggctaccgctcgcggctgcgctggataataccgctgctggtggggctggccattgtctttccgtttctcgccacaaaatatctgctgaccgtggccattcttgggctgatctacgttctgcttggcctggggttgaatattgtggtgggcctcgcgggtctgctcgatctgggctatgtggcgttttacgccatcggcgcctacggcctggcgctgggctaccagtacctgggcctcggcttctgggcgatgctgccgctgggggcggtgatggcggccctcgccggggcgttgctgggttttccggtgctgcgtatgcatggcgactatctggccatcgtcaccctcggctttggcgaaattatccgcctggtgcttaacaactgggtgagcttcaccgggggccctaacggcgtaccggtgccatcccccacgctgtttggcctcgagtttacccgccgggccaaggatggcggcatccccatccatgagtttttccacgtcagctacaaccccaacctgaaattcatctttctctacgccgtgctgtgtctggtggtgatgctggtgctgctggtgaagcatcgcctgacgcggatgcccatcggccgcgcctgggaggcgctgcgcgaggatgagatcgcctgtcgggcgatggggctcaaccacgtgctggtgaagctctcggcgtttatgctcggcgcgtcgacggccggcatcgccggggtgttcttcgccagctatcaggggtttgttaacccgacgtcgttcaccttttttgagtcggcgctgatcctggcgattgtggtgctcgggggaatgggctccaccttgggagtggtactggcggcgtttgttctgacggtcaccccggagctgctgcgcggttttgacgaatatcgggtgctgctgttcggcgtgctgatggtgatgatgatgatctggcggccgcgcggcctggtgcgcaccagccgcagcggggttgcgttgcgaaaaggagtcgcgccatga

SEQ ID NO: 7106 - DNA, 756 bp, Klebsiella pneumoniae
ggagcgcttatgctgatttcatcatttcacgagcgccagacgcgtaacaacgaaaaaataaaacaactgctgaacttcctgaaagaagaaacttacagtgattttaaaactctgatgctgttatttggtttccgggatcataagtcgctttattcgctactggcaaaaacagagcgaatggggttaatccagaagcatgtgcttgaatcacgaacaatgaagatttcattatgggggatcaccagcgacgggctggcggtggtgttaaccccggatgataaaatctttcctcctcggtttgaaccatcaaaaatcaccggctggacgctggaacaccatcttgataatcaggccgccaggcttattctggagaagaaaggcgcgtcgggatggattaacggcgaccgggccacctttctcagccagtatcaggtaaaacatcgcccggacgggttgatcatcttgcctggcagcaccgtgatcgccattgaaaccgagcgtcgcctgaaaacccgagcccgctaccagtcgattattgccagccacctgctggcccgtacccgcaaactgtggattcatgttttttatgtcattcctgacccacagaaaaaacgggcacttgagctcctatttgacagcatcagacatgtcatcatcaaccatcagcacgtcccgctggaagaacgccaccgtcgggtatttcgcatttatacccttgatgaattaaagcgcttgtcattagacagctatacgtaa

SEQ ID NO: 7107 - DNA, 927 bp, Klebsiella pneumoniae
caaggaattatcatgtctcagttttatctggtcgcgccatccgggtattgcatcaaccagcaggcggcagcccgcggcgtcgagcgtctgcagcaggccggacacgaggtggcccaccagcaggtcattccccgccggcagcagcgtttcgccgggactgaacatgaacggctggccgatattaaccagctggcccagttgcccggccgcaaccggatcgtcctcgccgtgcgcggcggctacggcgccagtcgcctgctgccgcatatcgactggcaggggctggttgcccgccagcagcgcgacccgctgctgatttgcggccacagcgatttcaccgctatccagtcgggcctgctggccatgggcaacgtcatcaccttcagcgggccaatgctcgccggcaacttcggcgcggagaccctcgacccgtttaccgagcaccatttctggcaggcgatacgccagccggaattcaccctcgaatggccgggcgaagggccgaactgccgggtggaaggcactctgtgggggggaaatctggcgatgctgacctcgcttatcggcacgccgtggctgccggcgatccgcgacggcatcctggtggtggaggatatcaacgagcacccgttccgcgtcgagcgcatgctgcttcagctgttgcacagcggcgtgctggcggcgcagaaagcggtgatcttcggcagcttcaccggcagcgcgccgaacgactatgacgcaggatacgatttgccgcaggtctttgattatctgcgccagcagctccccctgccgctgattagcggactggagtttggccacgagcagcgcacggtgaccctgccgctgggcgcccgcgcgcgcctggtgaatcaggcggcggccaccaccctgactatcggcggccatccggtgctgacagaataa

SEQ ID NO: 7108 - DNA, 1167 bp, Klebsiella pneumoniae
attcgacatatacccgaggttaacaacatgaaagtttggccggtcaaacatagcccattactgcgtcagcctgagcgttttatcgcccgcagcgaactgcaggcgctgatccgcaacgtgacgcaaaacctggtgaatattaaggatgagagcgggcaatttttactacgcctggatgacgggcgcgtgatcgataccaaaggctgggccggctgggagtggacccacggcgttgggctgtacggcatctatcagtattaccagcaaaccggcgatatcgagatgcgtgatatcatcgatcgctggtttgccgaccgtttcgccgagggggcaacgaccaaaaacgtcaatactatggccccgtttctgaccctggcttaccgctttgaagagaccggccgtatggcgtatctgccgtggctggagagctgggcggagtgggcgatgcacgagatgccgcgcaccgagcagggcggtatgcagcacatgactctggcggaggagaaccatcagcaaatgtgggatgacacgctgatgatgaccgtgttgccgttagccaaaattggcaagctgcttaaccgcccgcagtatgtggaggaggcaacctaccagttcctgctccatgtgcagaacctgatggaccgggagaccgggctgtggtttcacggctggaactatgaggggcggcataactttgcccgggcgcgttgggcgcggggcaacagctggctcaccatggtgatcccggattttctggaactggtggatctccccgaggggaacgcggtacggcgctatctgattacagtcctcgacgcacagattgccgccttagcagaatgccaggacgacagcggcctgtggcataccttgctggacgacccgcactcttatcttgaggcctcggcgaccgccggctttgcctacgggattctcaaagcggtgcgcaagcgttacgtcgggcagcactacgccggggtggctgaaaaagcgattcgcgggattgtgcagaatatttcgccgcagggggagctgctgcagacctcatttggcaccgggatggggtcagacctcgacttttatcgacagatcccgcttacctcgatgccctacggtcaggcgatggcgatcctttgtctgacggagtatctacgcaagtacttctga

SEQ ID NO: 7109 - DNA, 189 bp, Klebsiella pneumoniae
tcaacaaatattattatcagcccgcccgtcatcattcatgcacacacacaccgtgccagtaatacgttaatttcacatacttttttatcattccttccggtatttattttcccgttaaaatttcattacccctcctgcatcctgaccatgctctttaacaatatggagcgggctgtcacacaaccataa

SEQ ID NO: 7110 - DNA, 183 bp, Klebsiella pneumoniae
cttaaaaatatagccagcgctatattattcccgttagcagcggagaaatattatagccacggctatatttcccgcctaaccttatcttttttattaactattttttcacttataaatttaaatgaaaatcgttatcacttggttattaaaatagccctcttctgttattgttttatattctaa

SEQ ID NO: 7111 - DNA, 2439 bp, Klebsiella pneumoniae
aacaggaatataatggatacctcttcaataattaccggcaccacccttaaccgttaccagctggatattccttcatgtaccgcatcgctggatgtggaagaattcagtggggcagaaaaactgagtgaactttattattacactattacgtttaccagcgcagagaaaaatattgatgccgcacagctcctgagcaaacccgccatgctgacgatgggcggcggcgcactgcagcagttggcggactgcaaacgcgtccatggcgtggtgactgccttccggcgtatcagcagttcagaagatcagtcgaaatatcagataaccctcgaacccttcctctccttactggataaacagtttcgcagccaccgttttttcgtgaataaatcggtgccggaggtggtggagcaggtattgcaggaacatcacctgcatgactgggagtatgagttttatctcaagcaacactatccacggcgcgagcaaattaatcagtatcaggagagcgacctggcgtttatccagcgcctgctggcagaggtagggatattttatttcttcaccctgcaggaagaggcgcagagcgaagtggtccacttcgccgacgcgcagcgggcgctgacgtttgataagacactccctgtaaacagcccgtcggggatgagcgacagcggtgcggaatcgatatggggtctgagcatcacccacaacgtcgtagaggcgaacgttactacccgggattataacccccgcgatgcgcagagcgttctccagtcggcaacagcggatatgacccggggaaatggtgaaggcatcacttacggtgaggtataccactataagcttcgccaccgggagcgtggcgataaaatcgacccgcagacggagaccgccaacttctatgcccgcctcgaccatgagcgttttctggctcaccagacgcttattaccgcgatcagtactgcagcctggctggcgccggcccaggtgctgaccgttaccgacagcctgccgtcgaccctgcctgcgcccgtacaggatccgctgttaatcaccggcaccggttttaccgccagccgccgggaggcgctgcgggtgtccctgctggcggtgccctacagcgaaacattgtgctggcgtccgccgctgctgccgcgcccgaaggtgactggcaccatgacggcgcgggtgaccagcgcgaaggcgaatgatatctatgcctggcaagatgcgtccggcctgtaccgggtgaaatttgacgctgacagagaggataaagggcagggtcaggaaagcatgccggtgcgtctcgccaaaccctacggcggcgacgtgtacggctttcacttcccgctgatccagggcacggaggtggcgattgctttccacgaaggcgatcccgaccggccgtatattgcgcatgcgctgcatgactcgcggcatgtcgaccctgtgacggagaaaaacagcacccgcaatgtgattcgtactccggccaataataagctgcgaatggaggacaagcgcggcgaggagcatatcaagctcagcaccgagtacggcggcaagacgcagctgaacctggggcataacgtgaatgcgcaaagggagttgcggggcgagggtgcggaactgcgtacggataaatgggtgagcatccggggcggtgcgggagtgtttatcagtgcggataaacagccttcggcaggcgacaggatgctggcaatggaggaggcgattgcgcagcttgaaaatgccctgggtattgcgaaaagcctggcgtcggcagcggaatcggctcaggccctgccatcggataccggcaaccagcagacgctgaacgatgcgctgaaagagctggcgcagccggggatagtgctgaatgcgccgcagggcgtgagcatcagcagtccgcaggcggtacggttgtcttcgggtagcgccagcgtggggattgtgtcacagcagaatacggacatcagtgcgctgaaacgttttacggtggcggcgggagaagccgtcagcctgctggcgcgaaaggcggggatgaagctgtttgcggcgaagggaaagatggaaatccaggcgcaggatgatgcgctggaggcgacggcgaaaaaggatatcacagttaccagcgtggaaggccgggtggaaatcacggcggcgaatgaactggtggtgaactgtgcgggagcgtatatcaggctaagtggtggcaatatcgagctgggctgcccggggaatattctgctgaaatcggccaatgtgcagaaaatgggtaaggcggattttcgggtgcctccgctggaattgcctaaagggttcgaacagcgttttactgtcaaagatcagaagaccggtgaaattgttccgtttgcccgttaccgcatcaccactgtaaaaaggccaggtattcgaaggccgggcagatgctga

SEQ ID NO: 7112 - DNA, 1341 bp, Klebsiella pneumoniae
ggacaggatatgagtacgactgagagcattgcatccagccagacaagcctttcgtcctggcgtaaatctgacaccacctggaccctgggcctgtttggcaccgctatcggcgccggggtgctgtttttcccgatccgcgccggcttcggcgggctgatcccgatcctggtgatgctggtgctggcctatcccatcgccttttattgccatcgggccctggcccggctatgcctgtcgggggctaacccctccggcaatatcaccgaaacggtggaagagcattttggcaaaaccggcggggtggtgatcacctttctgtacttcttcgccatctgcccactgctgtggatttatggcgtcacgatcaccaatacctttatgactttctgggagaaccagctgcagatgccggctctcaaccgcggggtggtggcgctgctcctgctgctgctgatggcgtttgtcatctggtttggtaaagacctgatggtcaaggtgatgagctatctggtgtggccgtttatcgccagcctggtggtgatctccctgtccctgatcccctactggaatagcgcggtgattgaccaggtcaacctcagcgatatcgccttaaccggtcacgacggcattctggtgacggtatggctgggcatctccatcatggtgttctccttcaacttctcgccgatcgtctcctcgtttgtggtctccaaacgcgaagagtatgaagcgcagtttggccgcgagtataccgaacgcaaatgctcacagatcatctcccgggccagcatgctgatggtggcggtggtgatgttcttcgccttcagctgcctgtttaccctctcaccgcagaacatggcggacgccaaggcgcagaatatcccggtgctctcctatctggcgaaccactttgcctcgatgtcgggcaccaaatccacctttgccaccctgctggagtatggcgcgtcgatcatcgccctggtggccatcttcaaatcgtttttcggccactatctcggcacgctcgaggggctgaacggtctgatcctgcgctttggctataaaggggataaaacccgggtctccagcggcaagctcaataccctgagcatggtgttcatcatgggctcgacctgggtggtggcgtatgccaaccccaatatcctcgacctgattgaggccatgggcgcgccgattatcgcctcgctgctgtgcctgctgccgatgtacgccattcgtaaagcgccttcgctggccaaataccgtggccgtctcgacaacctctttgtgaccgctatcggtctgctgaccatcctcaacattgcttacaaactgttctaa

SEQ ID NO: 7113 - DNA, 339 bp, Klebsiella pneumoniae
tttagcatcttccagggaaatgattatgttgcaatatttaaaccagtgctcaaggggacgcggtgcctggctcctgatggcgttgaccgcttttattctcgaactcgttgcgctgtggttccagcatgtgatgctgctgcagccgtgtgtcatgtgtatttacgaacgctgcgcgctgttcggcatcatgggcgcggggctggtcggcgccatcgcccccaaaacgccgctgcgctatgtcgccatggtgatctggttgtacagcgcaatacgtggactgcagctggcgtgggagcatacgatgatccagctgcacccttcgccgttccagacctgtga

SEQ ID NO: 7114 - DNA, 1203 bp, Klebsiella pneumoniae
cgcagcatctttcttgactacgaaaatcttcaccgcttcgccgctgctgccggacggcacgccgatggccgccacttccagcaccccgctatgctgcatgaccacatcttcgatttcgttcggatagacgttaaaacccgacaccaggatcatatcttttttgcgatcgacgatgcgcaggaacccctcttcatccatcaccgcgatatccccggtgtgcagccagccgtctttgataatctcatccgtcgcgtcagggcgctgccagtagcccagcatcacctgcggacctttaatacagagctcgcccggctgacccggcgccacttcgttatcatcatcatccaccagtttggcttcggtggaaggcaccggcaggccaatgctgccgctgtggtagtcaatatcgtgcgggttaacgctgaccagcggggaacactctgtcaggccgtagccctccagcagatattgcccggtcagttttacccagcgctcggccaccgcctgctgcaccggcatcccaccgccggcggacaaatgcagcgaggagaaatcaagctgctggaactctttgttgttcagcaaggcgttgaacagggtattgaccccggtcatggcggtaaaaggatacttcgccagctccttcaccagcccggggatatcgcgtgggttggtgatcaacaaattttgcccgcccagttcgataaacagcaggcagttcatggtcagggcgaaaatgtgatacagcggcagcgcggtcaccacgaactctttgccgcgatgcagcagcgggccgtaggtggcattgacctgctcgaggttagccagcatattgcggtgggtgagcatcgcgcctttggccacgccggtggtgcccccggtgtactgcagaaacgccagatcttccgcaacgatctccggcttgacgtactgcatgcgatagccgtgctgcaacgcgctgcgaaacgagatggcgtccggcagatggtacttcggcaccaggcgcttaatgtacttgaccacaaagttcaccagcgtacctttggcggtggaaagctggtcgcccatgcgcgtcaggatcacatgctggacctgagttttcgccaccactttttccagggtatgggcaaagttggagactatgacgatcgccgccgcgccgctgtcgttgagctgatgctccagttcgcgcggggtatataa

SEQ ID NO: 7115 - DNA, 315 bp, Klebsiella pneumoniae
ggatttatcatgaaaaaaaccgttatcgcggcgacggtattatgcctgaccgcaggaacgccgatttattcctttgccgctgacccgtgcgaagttgttctttgcatgtacggaaaagctacaggtaatagtggtgggagtgaatgcagttcagcagaacgcgcattttttaaaatcaacgcatttaaaaaacaccatcgtttcaatccgggtaaaacattcgatatgcgaaaagaatttttaggggagtgcaaagccgcagaccctgaatcaataagtaaaatcctttcaaaatttggcagagtgaaaggataa

SEQ ID NO: 7116 - DNA, 933 bp, Klebsiella pneumoniae
atggatgtcataagcatcattatggcggcgggcaagtcgtccgttgacgtcgcgctgtatacgctgttgccgatcatggtgatcatgctgatcatcatgaaataccttgaggtccgcggtatcctcgatgtgattgttcgctgggtggccccgctgctgaagcccttcggcttaaccgggatgagcgccttcgccctgatccagattaactttgtcagctttgccgccccgctcgccacgctgtcgattatggataaacgcggcgtctcggaccgacaaatggccgccacgctggccatggtgttcgctatggggcaaggcaacgtcttctatcctcttaccccttttggtctgcactggctggcctcgatcgttatctcggtggtcggcggcctgtgcgcggccgccgtcgcctggcacgtcaccggacggcgcttatcggtcgccgagagcccccgcgcggaagcgctgccgaacgccgagcagaacagccagggaattctggccgtgattaacagcgccggctccgacgccatccgcctggcgctcggcgcggtgccaatgctgatcctgtcgttaaccatcgtcgggctgctgcagggcgccggggctatcgacctgctgcagcagctgctgaagccgcttctcagctggctgcacatcccccagaactttgtgctgccggcgctggtgaagtgcgttgccgggggcaccgcctactttggcgtcatttccgagctgatccagcagggcaaagtcacagtagaccaggtcaacgcctcggcaggtctactgatccagacctttgatcttcccggtatcggcatttttcttggcatcagctcacggtttgtccgcctgttccgcttcgtggctcccgcggcgatcgtcggcatcctgctgcgtaccgttctgcacctgatcctgttttaa

SEQ ID NO: 7117 - DNA, 633 bp, Klebsiella pneumoniae
ggatgggtcatgtcaacgatgattatggatttgtgcagctatacccggttgggattgacgggatatctgaccagtcggggaattaaaaaacaggaaatcattgaggtcaacagtgctgcggatctgcagaaacactgtacgtcgtgttgcccggcggtggtgtttctgaatgaagactgtttcgtgcatgatgatgaaagtaatggcattattcgccagatcattacgcaaaacccggcgacgctgtttgttatctttatgtcgctggcgaacatccattttgaccgctatttgcgggtacggaagaatctgctaatcagttcaaaatcgataaccccaaaagaccttgatgttattctggttaattatcttaaatacaaaaacaccagtgtagggcagttaactttaccgacattgtcactgagtaaaacagaatcaaatatgctgcaaatgtggatggccgggcatggtacttcgcaaatctcaacgcaaatgaacatcaaagcgaagacggtatcgtcgcataaaggcaatattaaaaagaaaatacaaacgcataataagcaggtgatttatcatatcgttcggctgaccgaaaacatcacctccggtattcaggtaaatatgcgctga

SEQ ID NO: 7118 - DNA, 291 bp, Klebsiella pneumoniae
cgaagaaccataacaacagaccaacaagcagcagcgccacggacacagccagcgatgccagatttaaaatcccaggatttagtaactcactcatttcaccacctcaaagagaaggcgttcattctaccacccgcggcgcagaaggaaatcagtcggcagaaaaatgtcttaccacggaataaatttattaatagtgcaaatgccgctgaaaaactgaacatcctggtcgcacattacgttaagcatctgagtccacagcaacaggcagcctgctatgatgactatcagtaa

SEQ ID NO: 7119 - DNA, 237 bp, Klebsiella pneumoniae
aggcttgccattttcccgctcgccgcacagaaacatagcgtttttctcccatcatgttctacaccctgccaagggcgatgggaagcggtgtatacggccgtgggagtcaatagcgcaaagacatgtcgcgggggcgttaccccgccgcgagagtgggctaaacgcggcggctcccgcgaagttgagccgccgcgccagcccatgctttactgcatcaggaatttttcaaggaactga

SEQ ID NO: 7120 - DNA, 1413 bp, Klebsiella pneumoniae
acatccgccatcattatcatccgcttcacggcgcgccaccgcctgagcgatgcgcggcgccaggagtttcgccaccgcggcgaagaccggaaccaccaccgagttgccaaactgacgataggcctgcgtatccgataccgggatgcgaaaacgcgccccctgcggggattcaaagcccatcagccgggcgcattcgcgcggcgtcaaccggcgaggccgccgctgttgattcagcggatcgtcaaaatgcttctcaccgagcggccggtcccagccgcgatcgacgagaatttcggcaccatctttatagtagcgggcagaaagcgtccgggccacgctgtggggattggcggggtcaaccaggccataaccaaagccattgccccgcgcctgatgcttgcgggcataacgataaagatatttccacagcaccggcgtaagaataaatttcgcatcgaccgtcggctccagcagctcgccaaatgttggccgcaccgccgggtactgcgccgcgatgtcgcgcagcgtaaatccagcatgcagctgcagatcgcgacggaaacccaccagcacgatgcgctcccggtgctgaggcaagaaatggcgcccgtcaatcaccttcgggtcatccggcccggtatgccccgcgtcagctacttcatatcccagctcatccagcgtctgcatgatgatacggaaggtgcgcccctgatcgtggcttttgaggtttttgacattctccagcacaaaaatcgctggctgacgagccgcgataattctcaccacgtcaaaaaacagcgttccctgggtttcgcaggcaaagccatgcgcacggcccatcgcatttttcttagagacgccggcaagcgagaaaggctggcaggggaagccagccagcagcacatcatgctgagggatagattcgcgaatatgccgcgccgcctcctcgtcgctaacgtcagagcgttggctgagggtaatatcgcggatatcttcattaaaacggtgctgctgcggatcacagtaccagttggccttataggtgcgtaccgcgtgcttgttccactcgctggtgaaaacgcactgcccgccgatggcttcaaaaccactgcggatcccgccaataccggcaaacagatcgataaaacggaacccatagtgcggatgatgggccggcggcgaaggcaggagcgtcgccagatgagcaacttcctgcgggcgcaaacgctccgccacgcggccaagcgccaccacgcgcttgaggatcgccgcgctccagtgctgttcgccgacgctcaccagttcggcaaccagcgtttttacatcgtagatcgtcatcagctgacgcagcagcgcctcagcgtgttccccggcctgttcagccaacgacaacgacctgtgttccttgcttaa

SEQ ID NO: 7121 - DNA, 1215 bp, Klebsiella pneumoniae
actccagccattacgcggatccagcaccgcgctgtctacccctggaatgctctgcgggatcgcaagaccgaacaccgggatggtctcctcgcgcagcgggccggtagtgccgttgaggatcgcgctaatgatgctgcgggtatcgcgcagcgacaggcgtttgccctcgccgttccagccggtgttgaccagccaggcttcggcaccggattccgccatcttcgccgccaggacgctggcgtactgggtcgggtgaagcagcaggaacgccgcgccatagcaggcggagaaggtcggcgtcggctgggtaatgccgcgctcggtgcccgccagcttcgaggtgaaacccgacaggaaatggtactgcatctgctcggtggtcagacgggagaccggcggcaggacgccaaacgcatcggcggcaaggaaaatcaccttcgacggatggcccgcgcgggacaccggcttgacgatattgtcgatatgcgacagcggataggagacgcgggtgttttcggttttgctgccgtcggcataatccacgctgccgtcagcgcgcaccaccacgttttccagcagcgcattgcggcggatggcgccataaatctccggctccgcctgcggatcgagattgatggtcttggcgtagcagccgccttagaagttaaacacgccgtcatcgtcccaaccgtgctcatcatcgccgatcagctgacgatgcggatcggtcgacagggtggttttcccggtcccggagaggccgaagaacagcgccacgtcccctgcttcgccacggttggccgagcagtgcatcgacgcgatgcctttctgcggcagcaggtagttcatgaccgagaacagccctttcttcatttcgccgccgtaccaggtaccgccgatgagctgaatacgctcgctcagattaaaggcgacaaagttctcggagttcatcccctgcgcctgccagttggcattggtgcagcccgcgccgttgagcaccacgaagtctggcgtaaagctggccagctcgtcggcgcttggcacgatgaacatgtttttgacaaagtgggcctgccacgccacctcggtgacgaagcgtacgccaagacgggtgtccgggctggcgccgcaccaggcgtcgatgacgtacagttttttgccgctcagctggcccgcgaccaggcttttcaggctgcgccacacgtctggcgataa

SEQ ID NO: 7122 - DNA, 1080 bp, Klebsiella pneumoniae
ggagcttgcatgacccgtccggtagtggccagcatcgacctgctggccttgcggcagaatttacagatagtgcgtcgcgcggcccccgggtcgcgcctgtgggcggtggtcaaggccaacgcctacggccacggcgtggcgcgcgtatggagtgcgttaagcgcggcggatggtttcgccttgctcaacctggaagaggcgatcctgctgcgcgagcagggctggaaaggcccgatcctgctgctggagggcttcttccatgccgatgagctggcggtgctggatcaatatcgtttaaccaccagcgtccacagcaactggcagattaaggccctgcagcaggcgaagctgcgcgcgccgctggatatctatctcaaggtgaacagcggcatgaaccggctgggctttatgcctgagcgggtccacaccgtctggcagcagctgcgggcgataagcaacgtcggcgagatgacgctgatgtcgcacttcgcggaggcggagaacccgcagggaattgtcgagccgatgcgccgtatcgaacaggcggcggaggggctggattgcccgcgctcgctggccaactcggcggcgaccctctggcatccggaagcgcattttgactgggttcgtccaggcatcgtgctgtatggcgcgtcgccttccgggcagtggcaggacatcgccaacaccgggctgaagccggtcatgacgctgcgcagcgaaatcatcggcgtgcagaacctgcgccccggcgaggcgattggctatggcggcctgtaccgcaccacccaggagcagcggatcggcatcgtcgcctgcggctatgccgatggctatccgcgggtggcgccgagcggcacgccggtgctggtggatggcgtacgcaccaccaccgttggacgcgtatcgatggatatgctggcggtcgatttaacgccctgcccgcaggccgggatcggcgcgccggtcgagctgtggggcaaagagattaaaatcgacgacgtggcggccagcagcggcaccgtcggttatgagctgatgtgcgccctggcgccgcgggtgccagttgtgaccctgtaa

SEQ ID NO: 7123 - DNA, 357 bp, Klebsiella pneumoniae
ccaggtcgcatgcctgggccgtttgcgttaccgccatgtcattctcctcagttgatagtctggtgcttttgccaggctatatttgtaattttcttacactgcactgtactgtgtttacgtatttcccgaaagccttccccttcgtttgcggcggtaaaaccgcacagggtgaaaacattcggcgatgatttgggcattcggccgttattgttcgttgtttgtacctggttcaggtcagtaaaatacgaccctgatcatgtaatgaaaaaaaacaacatcatttcacgtcattcctcaccgcttgcgcttgcggaggggtatattcttgctaaaacgcccaatgatttcacccattaa

SEQ ID NO: 7124 - DNA, 783 bp, Klebsiella pneumoniae
ccacccttaattctgttcccacggcatgcagtatcagcagaccctgcatgtcacttgtttactgaggtcaccatgctttccaccacagcctttctggcgatagccatgcagtgcgccgccagcattcatccgtccacggcattcgacgtggcacgggtggaatccggttttaacccttatgccatcgctgagattgtcccgaaggccggcccctctttcggcgatcaacacattatttctcacctgccagccagccggggagatgcagagcatattctccgtcgcctgtcagcacaggatcgccgttactctgtcgggctgatgcaaatcaccagcaccaatttccgccattatggtgtgtccgccacagagctacttgatccctgtaccaatctgtccgtcttcgaacacattctcagagactgctaccggcgcggcggcacgctgaaaagggcgctgagttgttattattccggcaatttcagtaccgggcaacaacctgaaacggcgttttccggaacgagctatatccagcgaatcggttatccgccgggatcatcccgctatgcggtccccggaacccgtgaggacaaatcatcagttgccgttcccctgaaaaccgcccctgccagtgactcatcccgtcaccacgtgttctggcccggagtcgtcgtccgtggcgtccctgcgaaactccgccaagaaaaaatcttcatcgcacctttctccgcgccgtcagtgcgccggagtttctccctgtcaccccgtgaggaggaggaataa

SEQ ID NO: 7125 - DNA, 1635 bp, Klebsiella pneumoniae
atgtcgctaattgctatcgtgctggtctttatcatggccatcgtggtgaccgtgttcctgtcccatcttctgcccgttaaagtgccgctaccgctgatccaaatcgccgcgggcgccgcgctggccgccagtggctttcaggtcgattttgacccgcatatttttttactgctgtttatcccgccgctgctgttcctcgatggctggcgcatccccaaagacgcttttttccgcgatatgaaaccgattttatcgctggcgataggcctggtgatggtgactattctcggtattggcctgtttattcactggctgatcccggctatcaccgtggcggcagggttcgccctcgcggctattctgtcgcctaccgatccggtggcggtatcggcaatgaccgccagctcgccgcttccctcaaggatggcgcatattctcgaaggggagtcgttgttaaacgatgcttcagggctcgtcgcctttaacttcgccatcgccgcggtgctgaccggcagcttctccccgggagacgcggtggtgaaatttttcctgatggccttcgggggcatcctcagtggcctcgtggtggtgtgggtcaccggcaaatgtaataactttctggttcggcgcacccgcgaggagccagccatccagatcctgatcagcctgcttatccctttcgccgcctacctgctggccgaggcgttccatgtctcgggcattcttgccgccgtcgccgccggcattgcgatgcattatgagcagctgtcggggccccggcttccggcgacgcgcatgaaaagcagcgcggtatggtccatgctgcagaccaccctcaacgggatgatctttctgatgctgggcgagcagctgccgcgcatgctcaggacgctgccggcggtagccagccaggccggcgtctcttcgccctggtatctgctactgtacgccgtggccatcaccctggcgctcggtctgatgcgcttcgcctgggtatggctgtcgatgaagctgacaatttttcgccgtaaacgtcggggcaaggccatcaccgtccgtccacgattcagtatcctcgccgtcatggcgctggcgggagtgaagggctctgtgaccctcgccggtattctgacgctgccggtggtgctggcagatggttcgccgttcccgggccgtgaactactgatctttctttcgatggcggtgatcctgatgtcgctggtggtggcggctatcggtttgccgtttatgactcgttatcttgccgatgatctaccgcatgacaccggtaaggacgacattggcgccgtgatgaccgaggtggccattaaccgtcttaacgcgctactggacgagccggtggaggatcccagtgagcaggccctgcgggccgatgccggcaatatgctgctcgagacctatcagcggcggcttcactataacgacaatgacgaggggcaggatgtcgggctggagctggctaagcgcgccaggctggagaaatatatgcaacgagaggtcattatcgcccagcgtcaggagctgttccggctgcgccgcgcccataacatcagcgatatcactttttatgaggtgctgcgggagatagatctgaaggaagagagtttacgctaa

SEQ ID NO: 7126 - DNA, 192 bp, Klebsiella pneumoniae
ttgaggataatgtttcaacgcatcggatttcccggtgtaacgaattttcaagtgcttcttgcattagcaagtttgatcccgactcctgcgagtcgggatttttttcgcctgccgctaacggttggcttcactggcgctgaaatcgtgaatatcgagttcgaatgcctccgccagctcacgccaggtatgtga

SEQ ID NO: 7127 - DNA, 1179 bp, Klebsiella pneumoniae
ttcatagtaattattattaaaagggaatatataatgaaaagaaaagtactggcactcatggttccggcattattaatggctagcgccgctaatgccgccgaaatctataacaaaaacggtaataaactggacctctacgggaaagttgacggcctgcattacttctctgacgacgcttcagaggacggcgaccagacctatgttcgctttggtctgaaaggcgaaacgcagattacttccgagttaaccggctacggtcagtgggaatacaacattcaggcgaacaccagcgaaaaagaaggcgcgaattcttggacccgtctcggctttgccggcctgaagtttgccgactgcgggtcgctggactatggccgtaactacggcgtggtctacgacattgaatcctggaccgatatgctgccggaattcggcggcgatacctacacccagaccgacgtttacatgaccggccgtactaacggcgtggccacctaccgtaacagcgatttcttcggcctcgtcgacggcctgcatttcgccctgcagtatcagggtaataatgaaaacgccggttctggcgaaggcactaataacggtgggaaacgtaagctggcgcgggaaaatggcgacggttttggtatctccagctactatgatctcgatatgggcatcagcttcggggcagcatattcgtcttctgaccgtacccataaccagctggcggccgcgcgtagcagccagcgttatgccaacggcgataaagccgatgcctggaccgtcggcgcgaaatatgacgccaataacatctatctggccgccatgtatgctgagacccgcaacatgaccttctatggcaacgatagttttggcggaattgccaacaaaacgcagaacttcgaagtggtcgcgcagtatcagttcgacgactttaatttaccgctgcgtccgtcggtggcctatctgcagtcgaagggtaaagatctctacgcctattctcgctacggcgacaaggatctggtcaagtatgtcgacgtgggcatgacctactacttcaacaaaaatatgtccacctatgtggattataaaatcaacctgctggatgaagacgaccgcttctacaaaaacagcggtatcgcgaccgatgatatcgtcgccctcggcctggtctatcagttctga

SEQ ID NO: 7128 - DNA, 696 bp, Klebsiella pneumoniae
agagattcaatcaggcgagaccatagatacatcactgctgtacgtattgctcagccattgagcggctccgcgtatgtttactgggggcagcgatgtgtcatatggattatccccggtcaggacacgcacatgaatttatccgctaccattcttctcgctttcggcatgtccatggacgccttcgcagcctccatcggcaaaggcgccaccctgcataaacccaaattttcagaggcagtacgcaccgggctgatttttggcgccattgaaaccctgacgccgctggtcggctgggggcttggcatgctggccagccagtttatcctcgagtggaatcactggattgcctttattttactggtgtttctcggcgggcgaatgatcgtcgaaggttttcgcggcgacagcgacgaggcgtgcgaggcgcctcaccgacatggtttctggcttctggtcaccaccgccttcgccaccagccttgacgcgatggccgtcggcgtcggtctggccttcctgcaggtcagcattgtgaccaccgcgctggcgatcggctgcgccacctttatcatgtcgacgctggggatgatggtcggtcgctttatcggcccgctgcttggcaaacgagccgaaattctcggcggtatcgtgctgattggcatcggcagcgaaatcctctggagccatttcgccggttaa

SEQ ID NO: 7129 - DNA, 1308 bp, Klebsiella pneumoniae
gggatgaaaatcagtgaatttttacacctggcgttaccagaggaacaatggctgccgacgatttctggcgttttacgccagttcgcagaagaagagtgttatgtctatgagcgtcaaccctgttggtatttaggcaaagggtgcctggcacggttgcacattaatgccgacggaacgcaggcgacatttattgatgatgccggggagcaacaatgggcggtggattccattaccgactgcgcgcgtcgttttatggcacatcctcaggtgaaaggacgtcgggtttatggacaggttgggttcaactttgcggcgcatgcgcgggggattgcctttaacgccggggagtggccgctgctgacgttaaccgttccccgtgaagaacttatttttgaaaagggaaatgtcaccgtttatgcggactccgccgacgggggccgacgtttgtgtgagtgggtaaaagaggccagtacaacgacgcagaacgcaccactggcggtggataccgccctcaatggcgaggcgtataaacaacaggttgcacgcgccgttgcggagatccgccgtggcgagtatgtcaaagtgattgtctcgcgcgctattcccctgccatcgcggattgatatgcccgccacgctgttatacgggcggcaggcaaatacacctgtgcgctcgtttatgttccgtcaggaaggacgcgaagcgctgggctttagcccggaactggtgatgtcagtgacgggcaataaagtggtcactgaaccgcttgcgggcacccgcgatcgcatgggaaacccggagcataataaggcgaaagaggcagaactgctgcacgacagtaaagaggtgcttgagcatatcctttctgtcaaagaagcgattgctgaattggaggccgtttgcctgccgggcagcgtggtggttgaagatttaatgtcggttcgccagcgcggcagcgttcagcatctggggtccggcgtgagcggtcagcttgcggaaaacaaggatgcctgggatgcgtttaccgtgctgtttccgtcgattaccgcctcaggtatccctaaaaacgctgccctgaacgcgattatgcaaattgagaagacgccgcgagagctctattccggcgcaattctgctgctggacgatatgcgcttcgatgcggcgctagttctgcgttccgtatttcaggacagccagcgctgctggatacaagcgggggcgggaatcatcgcgcaatctacaccggaacgcgaactgacggaaacccgggagaaattagcgagcattgcgccctatttaatggtgtag

SEQ ID NO: 7130 - DNA, 300 bp, Klebsiella pneumoniae
ggtggtgaaatgagtgagttactaaatcctgggattttaaatctggcatcgctggctgtgtccgtggcgctgctgcttgttggtctgttgttatggttcttcgtcaaccgcgccagttcgcgggcgaatgagcagatagagctgctgcaagcgctgctggatcagcaaaagcggcagaatgcgctgttacgtcgcctgtgcgaagctaatgcgccagagaaagaggatgtggctgagccgaccgtcgccggcaaggcgaaaggggaggatgagtttatccgcctggtagctgaacgttaa

SEQ ID NO: 7131 - DNA, 306 bp, Klebsiella pneumoniae
ggaggaggaataatgatacttttccgcaagctaaaagctgtggtcccccccgtttcggcctgtacgctgacgactttttctgcaaccccggcactggccgacggatttcagcgggcaaatactgtcatgcaaaaagtgtcacccgggctgcatggtctggcggcaatcacgatcaccgtgcccgtgatctggattggctataagaccctgtggaaaggcgagagcctgtcgcagtgcggctacatcatcattggcggcattttaattggcggaggcagtgaaatcggcgctctgctgatgagctaa

SEQ ID NO: 7132 - DNA, 393 bp, Klebsiella pneumoniae
caaaagggaatgacgaatatgcgacttcttgctggacgcgcgttgcgcctctccgttgcgcttgccgggatgttaaccgcggcgggcgccttcgcccacgctcacctgcagcagcagatcccgaccgccggggcgcagctttcagcttccccacagacgctgacgctcagtttttccgaaggtattgaacccgcattcagcggcgtgaccgtcaccggtccgcagcagcatgcggtggctaccggaaaactgacccgcagcgccgataatccggccgaggtcacgttacctttggcggaagccttgccgccgggagagtacaccgtggcatggcatgtggtctcggtggatggtcataaaaccaaagggcaatatacctttagcgtgaagtaa

SEQ ID NO: 7133 - DNA, 1854 bp, Klebsiella pneumoniae
attgtcgtttttggcgtccgtaaaaattcatcaggaaattcagttactcccatgtcatctcaatcatccaatactgaatcgctgtcccgatttcctctctggcaggtgattacaccggttcgcaggaaggttattttagctatggcgctggcggggctggcggcattaaccagcctgggggcgctcctttttctagcgtggagcctgcgtgacattcgcgcgacgcctgacgctattccggcctggccgctgggcggcgtgatcggctgcgtggtcttaacttttgttctgcgcttacaggcgttcaacacctctcattacgcggcttttcatctggagaacattctgcgcagcaggttagcccgtaaagcattgcagcttccgcctggcgtgttacagcaaatgggcagcgggtcagtggcgaaagtgatgctggatgacgtgaagtcgttacatatttttgtggccgacagcacgccgctctatgcccgcgcgatcatcatgccgctggcgacaatcgttatcttgttctggctggactggcggctggcaatcgcgacgctgggggtactggcgtttggatcggttgttctcgtgctcgcccgccagcgttcggaagatatggctcagcgttatcataaggcgcgcgagcaggttagcgcggcggtgattgagttcgtgcaggccatgcccgtggtgagaacgtttgatagcggcagcaccagttttttgcgctatcaacgagcccttgaagagtgggtcgatgtgctcaaaacctggtatcgcaaagccggtttttcagcgcgtttttccttctcgattctgaatcctctcccgaccctgtttgtcctgatctggtcgggatacggcctgctgcactatggcagtttcgattttatcgcgtgggtggccgttttactgctgggcagcggaatggccgaagccgtaatgccaatgatgatgctcaataacctggtcgcgcaaacgcgtttaagcattcagcgtatttatcaggttctcgcgatgccggagttatcgctgccgcagtctgaccagcagccgcaagaggcgagcattacctttgagcaggtgagctttcattatccgcaagcgcgtactggcgccgcgttgcaggaggtgagctttcatgtgcctgccgggcaaattgtggcgctggtcgggccaagcggcgccggaaaaagcaccgtggcgcgcttgctgctgcgttacgccgacccggacaaaggccatatccgtattggaggcgtggatctgcgtgatatgcagacggacaccctgatgaagcaactctcgtttgtgtctcaggacaacttcctttttgccgacacgatagccaataacattcgtctgggcgcgccggatacgccgctggaggcggtaatagcggcggccagagtggcgcaggcccatgattttattagcgctctgccagaaggttacaacacacgagtcggggaacgtggggtatttctctccggcggccagcggcagcgcattactatcgcccgggcgcttttgcaggatcgccccatcctggtgctcgatgaggcgacggcgtttgctgacccggaaaacgaagcggcgcttatcaaggcgctcgcggcggccatgcgtggccggacggtcatcatggtcgcgcatcgtctctcaatggtgactcaggccgatgtgatattgctgttttccgacggacagctcagggaaatggggaaccatacgcaactgttggcgcagggcggcctgtatcaacggctctggcaacactatcagcaggcgcagcattgggtgccgggtggaacacaggaagaggtggtggaaaatgaaagacaataa

SEQ ID NO: 7134 - DNA, 975 bp, Klebsiella pneumoniae
caagtgacgattgctattgtaataggcacacatggttgggctgcagaacagctgctgaaaacagcagaaatgctgttgggcgagcaggaaaacgttggctggatcgatttcgttccgggtgaaaatgccgaaacgttgatcgagaaatacaacgcccagttggcaaaactggataccagtaaaggcgtgctatttctcgtcgatacatggggaggcagccctttcaacgctgcgagccgcattgtcgtcgataaagagcattacgaagttatcgccggcgtcaatatcccgatgctggtggaaaccttcatggcccgcgacgacgatccttcctttgatgaactggtcgccttagcggttgaaaccggcagcgaaggcgtgaaagcgcttaaagccaaaccggtggaaaaagcggcccctgcgcccgcgcctgccgcagcgccaaaagccgccgctccggccaaacccatgggcccgaacgactacatggtaattggccttgcgcgtatagacgaccgtctgatccatggtcaggtcgccacccgctggaccaaagagaccaacgttacccgcatcatcgttgtcagtgatgaagtggccgcggataccgtgcgtaaaactctgctgacccaggttgcgccgccgggcgtcaccgctcacgtggtggatgtggccaaaatgatccgcgtctacaacaaccccaagtatgccggacagcgcgttatgctgctgtttactaacccgaccgacgttgaacgtatcgtcgagggcggcgtgaaaatcaccagcgtcaacatcggcggtatggcgttccgccagggtaaaacccaggttaacaacgcgatttcagtcgatgccaaagatattgaggcgtttaaaaagctgaacgcccgcggtatcgagctggaggcacgtaaagtgtccaccgacccgaaactgaaaatgatggatctgatcgctaaggttgataaataa

SEQ ID NO: 7135 - DNA, 276 bp, Klebsiella pneumoniae
tcgcaggcgatcgcgctatcgaatgaaaccggtttgcggctaagccttctcacatcagccttgcagcccggtcagtcaccaggcgccaacattctcaatattttgcgtcatgaatatctcttgtcatgcaaaataattgaggataatgtttcaacgcatcggatttcccggtgtaacgaattttcaagtgcttcttgcattagcaagtttgatcccgactcctgcgagtcgggatttttttcgcctgccgctaacggttggcttcactggcgctga

SEQ ID NO: 7136 - DNA, 903 bp, Klebsiella pneumoniae
ggtgataagatgagaaaattaatcgtagttgcttccgttgcagccggtttactgaccgggtgcgaccagaagagtactggcaagcgtgaaaccctgtctgaagcgcttgttgctaagtcgctttctaacatggttcccgttaagggcggcgagttcttaatgggggattttggcccattagtcggtcaaaaactacctttcagcataaaccaggatgataaggtattacataaggttgtattaagtgatttttcgatatcaaagtttaaagttaccaacgatgattataataaatatctgcaaataacaggggtaaaaaaatcacccatccatatttttttaaaaaattatccatccttgcaaaaaggagattattctgttggtgttacctggcaacaggcaaaagactattgtcagtggttaggtaaggggtctggtaaaaagattgatttaccaacagaggcgcaatgggaatatgcagcaagatccagaggtcaatactttcagtttccaacaaataatggtgagtatttacctggaaaaaatgttccgggtaaagatgaattagataaatatacagatggttttggtttcccattttatccagtaggcaaatatcccccaaaccccctgggtctgtatgatatggggctcagtggctctgaatggactaatgactggtatgcagcagattattactctcattcaccggtaaacgatccccagggacctgcgcagggtactaaaaaagtcctgcgtggatatattggtggcgacagacagtacgctttaaccatgttcaggcaatcaaaattgccagttccgaagatcgataaagacgatgactatgaaaaatatggtgttggtccgcagtatgtatttcgttgtgtcgttaataaataa

SEQ ID NO: 7137 - DNA, 363 bp, Klebsiella pneumoniae
ggtgataagatgataaaattaatcgtagttgcttccgttgctgccggtttactgacagggtgcgatcagggaaataccaccgggagtgaaaaagcagctaaagcacttgtggataaatcggtttctaatatggtccccgttcagggtggtgagtttttaatgggtgattttggtccattagttggtgaaaaattacctttcagcatacaacaggatgataaaaatttacataaggttattttaagtgatttttcgatatcaaaatataaagtcactaacgatgattttaatgtttatttgaaagtaacagataaaaaaatccacctgtggatatactggcaaaacgtcatccttctctgctaa

SEQ ID NO: 7138 - DNA, 273 bp, Klebsiella pneumoniae
ggtgataagatgagaaaattaatcgtagttgctactgttgccgccagtttactgctcgggtgcgaccagaagagtactggcaagcgtgaaaccttgtctgaagcgcttgttgctaagtcgctttctaacatggttcccgttaagggcggcgagttcttaatgggggatttcggcccattagtcggtgaaaaactgcctttcagcataaaccaggatgatgaggtattacataaggttgtattcctatgccgtttggtctggaacgagttatga

SEQ ID NO: 7139 - DNA, 642 bp, Klebsiella pneumoniae
accatgaagattgcactgatgatggagaacagccaggcgaacaaaaacgccatcatcctcaaggagcttaacgcggttgccgacgaaaaaggattcccggtctataacgtcggcatgagcgatgagaacgatcatcatctgacctacatccatcttgggatcatggccagtattctgctgaattcgaaagcagttgacttcgtggtcaccggctgcggtaccggtcagggggcgctgatgtcgctgaacatccatccgggcgtggtctgcggctactgtatcgatccggcggatgcgttcctgtttgcccagatcaacaacggtaatgcgctgtcgctgccgtttgccaaaggcttcggctggggcgccgaactgaatgtgcggtttatctttgaaaaagcctttaccggccgcaacggcgaaggctatccgccggagcgcaaagaaccgcaggtgcgcaatgccgggatcctcaaccaggtcaaagcagcagtagtaaaagagaactacctcgataccctgcgcgccatcgatccgcagctggtgaaaaccgcagtctccggcccacgcttccagcagtgcttcttcgaaaactgccaggataaagcaatcgaagactttgttcgccagatcgtcgcttaa

SEQ ID NO: 7140 - DNA, 186 bp, Klebsiella pneumoniae
ataataaggatctggataaatattctcttcagaaaggagatctcgttttcaaccggaccaattcaaaagaattggttggtaaaacggcggtttacgatcgagatgaaactgttattattgctggctatctcattcgtgttaggttcgatcaacaaactaacccttggtttgtatgggggcacctga

SEQ ID NO: 7141 - DNA, 1200 bp, Klebsiella pneumoniae
cattcgaggatgaaagtaaaaccaactggctatttcctaatccatcagtatattgacattagcgcactggcccaactgatgcgctacagccatggagcgggtgcatcagcggaatataatccgtcagaaaaaaaactggagggcaaaattgaaggtcatgccagttttgcaatgggggaggcgaaggccgaaacggccctgtacctgccggacaggttaggtgtcagccttttatttccggcgaaaaaagtgacgccacagacaccggatggtgtctgtaatatgggagcgctgcgttttgccatgaaactggtattgtcaggtagcgttggtgccagtgctgcaattgaattaggggtgacagtagactggagtggagaaatgggaaagggctatggcattaaaggccgtcctgcaaccctgactgctccaccgttgccaggacagcagcaggtgaatttaaagacctcaacgatacctgaagcacaggggggaggtgaaattggtgtttttgttggtgctcaggcgggaggtaatatcagtggtgccattgagtggtttgacccgcatcctgatgatacgccagtagctataggtgtcgagaaagataacaaacccattgtcaataaagagaagaagtttgccgcgatagccaaactggaagcggggatgacggtgcaggcaggcgctgggggaagtggggttttttatatcacctatattcagggacgttttcgtatttactgtaaagcggctttatgttggggagtgggggccaaaggggaagtcggttttgaagttgatggcagcagctttgcggcttttatgaagagctttatgtatatgcagaggaatgtggattatcagaagcttgagcagatgatggcaggggatgcctttcgatctttatgtgcaattcctattattatggcggcgcaagggatacaggtgggtgaggccatgcttaagaatatggtcgtaatattgcaacaaattagagcagatcttaaggatgaaaacaaacgcgttaatttgatggacagtattttgtctaatcctgatcagcttaaatatacccctccggaaacaaaaggggcagtgattgccacattaattgatcagaactgggcggactggcttgatccacgaaatcagaataatgatttttttccgttaacagctggaagctcggtcctttaa

SEQ ID NO: 7142 - DNA, 237 bp, Klebsiella pneumoniae
aaacacaactttacattttgtagcatcttgctgacagcggcagcacaggttgacattttgttagatgagctgaatggcgatgacaacgcgcacaaaaaaaacgggcacctctcagggtgcccgttagcaacttatttgctggccggcggttccaccgccgggcgcgctttttccagatgcgccaggtctaccgcgatatggaccgtttcatcaagatacggatccggctcctggtaa

SEQ ID NO: 7143 - DNA, 291 bp, Klebsiella pneumoniae
ataagggttttgcatcccttatttagggctcaccagctttctctcaggcttccactgtgtttttttattctccggccaccgtttatttcagtcacaggaggatatatgacatcttatcagttactacgcctcagacaggttgagcaaaaaacagggctgaagcgttcacagatatacctttatatgaaagagggtgcatttccccgttcaataaaaataggccctgctagtgttgcctggctcgagtctgagattgacgagtggatcaacaaaaagttatctgaccgataa

SEQ ID NO: 7144 - DNA, 813 bp, Klebsiella pneumoniae
ggaggcgctgtgacgcaatctgcaatgtgcatcccgctgtggcccgcccggaacggcaatactgcgcatctggtcatgtgccctttcgctggcggcagcagtagcgcgtttcgccactggcaagctgagcaactggctgattgcgcgctttctctggtgacctggccggggcgcgatcgccttcgccatctggaaccgctcagaagcattacacaactggcggcactgctggcgaacgagctggaagcatccgtatcgcctgacacgccgcttttactcgccgggcacagcatgggggcgcaggtggcgtttgaaacctgccgacttctggagcaacgggggcttgcgccacaaggactgattatttccgggtgccatgccccgcatctgcattctgaacgccagctcagccatcgcgatgatgccgactttatcgctgagctgatagacattggcggatgttctcctgaactgcaggaaaaccaggaattaatgtcgctgtttcttcctcttctgcgcgctgatttttacgccaccgagagctatcactacgactcgcccgacgtctgtccgccgctgcgcacgcctgcgctgttattgtgcggcagccacgatcgcgaagcctcctggcagcaggtcgatgcctggcgtcagtggctgagccacgttacaggcccggtggtgattgacggcaatcatttctatcccattcaacaagcccggtccttttttacgcagattgtccgccattttccccacgcattttctgcaatgaccgcgttgcaaaaacagcccagtacttcagaaaggtga

SEQ ID NO: 7145 - DNA, 882 bp, Klebsiella pneumoniae
ggagaatatgttgcaggaggcagtatgaataatgaaaatacgtatggctacgtatatatactggtatcagataaaacaccgtatattaaaattggtggcacggattatttgccagagaagcggtgtaaggagattaatacccagccaccctattgtttatatgccccatggcgggtagcagactaccgtagcgtacctgactggcataatgtcgaaacctggctgcactatctttttcgcgattctcgcgtgcggactattgcaaatcagaaagagctatttaatgtcacgcctgaactggctgcccatcatcttgccagccttgatcaacaaccgttgacgactaaacctaaaatcgaccgactttttcatcaccaggggttgagagattacctggtaaaactattcgctatcgccggttgtgagaaatggcgacataaagaaggggtttgggtgtttagtctattcccaggggcgcatagcggatggtcccggtattttacgcttagtatccatagccacgaagtcgctttttcaacgcggtcccgcgattgtcaaattcatatgttattagcagatgagcttatcatggactatcccgatattgttcagtgggtaacggaccataaaggagggtttgaaaaaccaatttataaaacagccttatcgcacgcgcagcaaatctggtttgagggtgagtttgaagtgggtcttcagttactctcgttccctgaagtccagcaggctgttgccacctactgggaccgcgcattaacaaaatacgattatagtcttcaggcgaagtatcataaccggatagcagttgaggagatcttcaaacagttacaagtacaacggcagcgagaatcgagcgcaatgtaa

SEQ ID NO: 7146 - DNA, 198 bp, Klebsiella pneumoniae
ggaactgatgtcatccgggtggaggggatgctcctgaatgacgtgtacgccgcgcgtcagaaagtgtctggcaagctgcgtaccggttcctccggcgacggtcgaacgcacgacaatacaggcgatatccggcatcctggttatctgttccggcgaggtatacagcggaatgccaaacgcatgagccagctctcttga

SEQ ID NO: 7147 - DNA, 870 bp, Klebsiella pneumoniae
cgtaacgatgttggtgtcagggcgttaagcgccttacactacaggaaaatcctaaccttcggggtatctatgaaattagcacttctgggtcgtcaggcgatgatgggcgcgatggccgttgttttgatggctggcgttagcgtgaaaacttttgcggcggaaaacctgctcaatcagattaaagagcgcggcaccctacgcgtgggcctcgaaggcacctaccctccctttagtttccagggggatgacggcaagctgaccgggtttgaagtggaattcgctaacgaactggcgaaacatcttggcgtgaaggccgatctcaaaccgaccaaatgggacggtatgctggcctcgctggactccaagcgtatcgacgtggtgattaaccaggtcactatctctgacgaacgtaagaagaaatacgatttctccaccccatataccgtctccggcgtgcaggcgctggtgaagaagggtaacgaaggcgtgattaaaaccgcggcggatctgaaaggcaagaaagtgggcgtcggactgggcactaactatgaagagtggctgcgtcagaatgtccagggcgtggacgtccgtacctatgatgacgatcccaccaaataccaggatctgcgtgtaggccgtattgacgccattctggtagaccgtctggcggcgttggatctggtgaagaaaaccaacaatacgctggcgttaaccggcgaagccttctctcgtcaggaagctggcgttgcgctgcgtaaaggcaacgacgacctgctgaaagcggtagatggcgcgattgcagacatgcagaaagatggcagcctgaaggcgctgtccgagaaatggtttggcgctgacgtgacgaaataa

SEQ ID NO: 7148 - DNA, 1902 bp, Klebsiella pneumoniae
tggggcgatgtcatggggcgaatcgctgacgaaggaggcatgatgattttaaataagcttaccgcttcactgtccccgatagtgaacgggatgctggcggtgctggcttttgtgcaacagaaacaactggtgctggcattattagcggggctgacgatgccgttttttgcatcaatgaaaagcgatgaacggcagaaagcgccgctctggaaaaagctgattattgctttttccctgctgtgttttctctccggcacactggctccggtcgttatcggatcctttcagtggctgtataagatcagacccaccagtgataatacggtactggcgtggtcagtacggattgctttcactgtaaccgggattatttttcatattatgcttcgccggatattcacaccggaactggacaaaataaagaaacgccttgttaaaaagaccacccttgaacgggaattgcgcaccgatgtccgcaccgtaaagtccctgctgccggaaacactgcattataacccgctggattatatcgacctgaataaaggcatttttaccggcatgggcagggaaaatgaaccaatgtatctcccgttaaaagactggcagaaacaacacgcggatattatcggcaccacaggggccggtaaaggggtagccgccggcatattactttatcaaagtattctggccggtgaaggtgtttttgttatggaccccaaagacgatgaatgggcaccgcatctttaccgcaaagcctgcgaggatgcaggcaagccttttgccttaattgacctgcgaaaacagcaataccagttaaatctgattgaagatatcacgcccgatgagctggaagaattgtttgttgcaggtttcagcctggcagaaaaagggcaggaatctgatttttatcgcattgatgaccgaaaagccgcccgtatagccgcacaatttgtcagcgataatccatcgacaacaatccgggatgtttataacggtgattacgttcagagtattgccgaaaagatcaaagcctttttcggaaaaattgaggaactggcattactcaatgccattaactcaccagaaggcttttcgcttaagcacatatttgatgagggcggctgctgttatgttgtcggctccatgcgaaacagcaaaattattaccgcccagcgcatgctactggttcgcctttaccagctggcagaaaagcgcgatcgagtaatagacgtcccccgccccattgctgtttatctttccgaactgaaataccatttatccaggtcagcactggagggattaggggcagcgcgtgataaaggcgtgcatattattatggaccaccagtccattgccgatttaaaagactgcccggcagatttgaaaggtgacgccgttgtcggtgcggtcgttgaaaatgccaaattcaaactggtttaccgggttatggacccggatacagcggaatgggtagcgagaatgtcaggcactattctggtggatgacgaactccgtaaggctaaaacagataatatgctcacggagaccatcgacagtgagcgcacaatccgccaggccgaacgtttctttattgacagcaatatgatcctgaacctgcccgattttgtcagctttatctttacgacaaaaacgctaccttctgcttcactgatctcgccgataaaggtcagaaagcgccagctaaaaactttttcggtttcccctgatattgccgcaacggtagcccccgtgaagatcatgctggatttttgcgaggatgataaacccgccatgtcggatgtgatgacaacacacccggctcttttcttcgacgaaagcgaagtcaaaccggtaaagccgaaacctgatgatgaagaacacctgtccccgctggatttttaa

SEQ ID NO: 7149 - DNA, 195 bp, Klebsiella pneumoniae
aaaatctgcttcaccaccagcggcgccagccccaggctcggctcatccagcagcagcaggcgcggtcggctcatcagcgcccgggcgatggccagcatctgctgctcgccgccggagagggtcatcgcccgctgtccccgccgctcttccagccgggggaacagctggtacattcgcgccttgtcctcggcctga

SEQ ID NO: 7150 - DNA, 1854 bp, Klebsiella pneumoniae
tgcggagtcgttagcaagccagtgagtgatgtttttgacgcaaaagctttcctgaaaacggtgaccagccagcccggtgtgtatcggatgtatgatgctggcggaaccgtcatctatgttggcaaagccaaagatctgaaaaagcggctcagtagctacttccgcagcaaccttgcgtcgcgtaaaacggaagcgctggtagcgctgatcgcgcaaatcgacgtgaccgtcacccacaccgagacggaagcgctgctgcttgagcacaactatattaagctgtaccagccacgttacaacgtgctgttacgcgacgataaatcgtatccttttatttttctcagcggcgatactcatccgcgtctggcgatgcatcgcggcgccaaacatgcgaagggcgaatattttggtccttttcccaacggctatgccgtgcgcgagaccctggcgctgctgcagaaaatctttcccatccgtcagtgtgaaaacagcgtctaccgcaatcgctcccgcccctgtctgcagtatcagattggtcgctgcctggggccgtgcgtggccgggctggtcagcgaagaagagtatgctcagcaggtagagtatgtgcggctgtttctcgccggcaaggatgaccaggtgctgacccagctcatcgcgcggatggagaaggcgagccagaacctggagttcgaagaggccgcgcgcatccgcgaccagattcaggccgtccgccgcgtgacggagaaacagtttgtctccaacaccggtgacgacctcgacgtgatcggcgtcgccttcgatgccggcatggcctgcgtgcatgtgctgtttatccgtcagggcaaagtgctgggcagccgaagctacttcccgaaagtgccgggcggcaccgagctgggagaggtcgtggagacctttgtcggccagttctacctgcagggcagccaaatgcgcacgctgccgggggagattttgctcgactttaaccttggggataagacgctgctggccgactcgctgtcggagctggcgggtcgtcgaatcaatgtgcagactaagccgcgcggcgacagagcgcgttatcttaagctggcgcggaccaacgccgcgacagcgttaacgaccaaattgtctcagcaatcgaccattcatcagcgtttgcaggcgctggccagcgtactggagctgccggccgtcaagcgaatggagtgttttgacatcagccacaccatgggcgaacagaccgtagcatcctgtgtggtgtttgacagcaatggcccactgcgcgcggagtatcggcgctacaacatcaccggcattacccctggcgatgactatgcggcgatgaatcaggtcctgcgccgtcgctatggtaaagcgattgatgacaacaagatcccggatgtgatcctgatagacggcggcaagggacagctggcccaggcgaaagccgtgtttgctgaactggacgtcccctgggataaacatcatccgctgctgctgggcgtggcgaaaggtagcgatcgaaaagcgggtctggaaacgttattctttgagccggaaggggaagggtttagcctgccgccggattcgccggccctgcatgtgatccagcatattcgcgatgaatcgcacgatcatgcgatctccgggcatcgcaaaaaacgggcgaaagtgaagagcaccagctcgcttgagactatcgagggggtggggccgaagcgtcgtcagatgctgctgaagtatatgggtgggctgcaggggctacagcaggccagcgtcgaagaaattgctaaagtaccgggcatctctcacgctctggcagaaaagatcttctactcgttgaaacattag

SEQ ID NO: 7151 - DNA, 366 bp, Klebsiella pneumoniae
tttttttccgttaacagctggaagctcggtcctttaaagagacgaaaacaagcggtgtttatggcattgaagtgggtacaaagtcaggcagattataacaatatcatgcagcatttgacgttgtcgccaggggagaagaaaggcagtaaagaactgaatgaaaaagatgtgattaagtttttaggcattggagaacgaaaattgtttttctataccaattatggcgaaaagctcaccttactgcataataacctcccggtttttgttgacccggatgagccatttaaacccatacctgacatcctgatgtcagaatatcttgccatgatcgacgaccagcacccgacgggtacaatgactgcctga

SEQ ID NO: 7152 - DNA, 1407 bp, Klebsiella pneumoniae
gggatatccgtccgggcatttggtcctgtctgcagaccaatgaaagcgaaaggcacaggaggtgcaatgaagattttccgcccattatggcgcgacggggcttttctggtcccgcagcagtttcagcaacaggcccgctgggacgcgcacgtcgccgatacggtctcccgcatggcgctcgcccacccgtggggggtattgcgcgcggagtttgacgcgagcgcgctcaccctttcccggctcaacgctacccggctgatcgtgcgtttcaccgacggaacgctgattgacaccgagctggcggatattttgccaccggtccgcgatgtatcggacgtgatgcaggacagcgtggcggttctgctcgctctgccgctgctcagcgccagcggcggcaatcttgatgacggccaggagagcgcccgcccgcgccgctggcgcgccgagcaggtgaccgtccaggagctggccggccatgaacgcagcgagctggccgttctgcggcacgcgctaacgctgcgtctctccaccgaggaaaatgcagccttcctcacctgcccggtagcgcgtctggtgcgcgacgcccaggggcagtggatcgttgacccggaattcatcccgccgctgctgtcgctggcggcaagcccgacgctggtcagcgagctgggcgagctgttacatcgcctgcaggcccgacgcagacgcctgatggccatgcgtcgtgaaagcaatgcgcggatggctgattttgccgtggcggatgtttccctgttctggctgctcaacgcgctgaacagcgctgaaccggtgctcagcgagctgcatctggatccctcgcgccatccggagctgctttatcgcgaactggccaggctggccggcagtctgctgactttctcccttgaacatcatctggaagcaatcccccgctaccggcatgcctcgccagagcaggtattcccaccgctgtttgccctgctggatacgctgctcgaagtcagcctgccctcaagggtgatcgccatcgttctggagcagggcgccgaccgggagatctggcggggcaggctgcacgatgcgcggctgcgcgagggggcggatttttatctgtcggtgcgctcttcactcccccctcaccagctacagagccgctttccgcagctctgtaaggcgggtagccatgatgatgtcgccgaggtcgtcaatattgccctcagcggcatcgcgatcaaaccgctgagccatgtgccggcggccattccgctacgtctggaaaaccaatatttcgctctggatctctccaccgatgccgcccgcgcgatgctggaggccggcaactgcaccttctataccccggaatcgcttggcgacgtgaaacttgaactctttgcggtactgcgctcatga

SEQ ID NO: 7153 - DNA, 645 bp, Klebsiella pneumoniae
catgatggcgtttgggtagataaggatagatgtgtgaaattgagatggttgcttattttagtcgtttttctggccggttgtagttcgaaacatgattacactaacccgccgtggaaccccgaggtcccggtgaagcgggcgatgcagtggatgccgatcagtgaaaaagccggcgccgcctggggcgtggatccgcagctgatcacggcgatcatcgccatcgagtcgggcggtaatcctgcggtggtgagtaaatccggcgccgtcgggctgatgcagctcaagccctcgacctccggacgcgatgtctatcggcggatggggtggcgcggcgagccgtcggtcagtgagctgaaaaacccggaacgtaatatctcgatgggggccgcctatctgagcattctggagaacggtccgctggcggggatcaaagacccgcaggtgatgcgctatgcggtggtggtctcctatgccaacggcgctggcgcgctgctgcgtaccttctcctcgaaccgcctggacgccatcgaggagattaacgatctcgacgccgatgagttcttcgagcatgtggtgaaaaaacacccggcaccgcaggcgccgcgctatatctggaaactacagaaagcgctggacgccatgtaa

SEQ ID NO: 7154 - DNA, 1401 bp, Klebsiella pneumoniae
aatgcattagtggatgcgtttattacgcttatttcgttcccggttctgtttcagtcttcagcgacaggcgcgcgacaacgcgtggataacaaactggagacctgcatgcattcaacaacctcacagatgagtacccgtgaccggatcggcgccattctgcgcgtcacgtccggtaactttctcgaacagttcgactttttcctgttcgggttttatgccacctacatcgcccataccttttttccggcgagcagtgaattcgcctcgctgatgatgaccttcgcggtctttggcgccggctttttgatgcgccccatcggcgctatcgtacttggcgcctatatcgacaaggtggggcggcgcaaggggctgatcgtcaccctgtcgatcatggccaccggcaccttcctgatcgtgctgatcccctcttatcagaccattggcctgtgggcgccgctgctggtgctgatcggccgtctgctgcagggcttttccgccggcgccgagctgggcggggtgtcggtctatctggccgagatcgccacctcgggccgcaaaggcttttacaccagctggcagtcgggcagtcagcaggttgccatcatggtggcagccgcgatgggctttgccctcaacgcggtactggagccgagcgctatcagcgactggggctggcgtattccgttccttttcggctgcctgattgttccgttcatttttatcctgcgccgtaagctggaggagacccaggagtttactgcccgccgccatcatctggcgatgcgccaggtattcgccaccctgctggcgaactggcaggtggttatcgccgggatgatgatggtggcgatgaccaccaccgcgttctacctgatcaccgtctatgccccgacctttggtaaaaaggtgctgatgctcagcgcctctgacagcctgctggtcacgctgctggtggcgatttccaacttcttctggctgccggtgggcggggcgctgtccgaccgctttggccgccgatcggtgctgatcgccatgaccctgctggcgctggctaccgcctggcctgcgctgaccatgctggcgaacgccccgagctttttgatgatgctgagcgtgctgctgtggctgtcgtttatctacggcatgtacaacggggcgatgatcccggcgctgaccgaaattatgcccgccgaagtgcgcgtggcaggtttctcgctggcctacagcctggcgaccgcggtgtttggcggcttcacgccggtgatttccacggcgctgattgagtataccggtgataaagcgtctcccggctactggatgagctttgccgccatctgcggcctgctggccacttgctacctctatcgccgtagcgccgttgcgctacagacggcacgttaa

SEQ ID NO: 7155 - DNA, 318 bp, Klebsiella pneumoniae
gtgacaatagtctgttgtgtcacggagaggaatgagatggaagagcaggcaaaacgcagcccgggagggaaacttgcgctctgggcgttgtatgctttttgcggatattgtgtctgggtcattgtgcgttactggtgggtagtgggaaaaattcacagcgttcccggcgccagcgtggagggtgattttggaacaacggccgggaaatggcttggcgccctgttgggtatgctggtcctcggcggcattggctctattctcggcgcggtcgtctggtatacgcgtccatcccgcggcgagcaggatcatcagcgctaa

SEQ ID NO: 7156 - DNA, 552 bp, Klebsiella pneumoniae
cgcgcaccagtaaccccttcccggttaataaggatattttttatggcagttccaggaatggcacaaaagctaaacacccaaatgaatcttgagtttcacgcctctaacgtttacctgaacttaagtgagtggtgcgcccgacatcgcttcgacggcgccgcgacgtttctgcgcacccgcgcgcaaagcagcatcaccctcactatgcgcgtatttgactacctgaaaaaagccggcagctggccgatcgtcaatcccgaccacgcctgtaaccctgagtgcacctcgctggaagatctgtttacccaaaccctgagcgattaccaacagcgcagtcgtctgctgagcggtctcgctcaggaagccaaagcgcaaagcgatgacagcacctggcggtttctcacgctgttggcggaagagcagcagcaggatggcctgctattgcaaagcgtgcttgaggaaattcgtaatgccgataaagccggtctcgggatggagcagaccgatcggcgtctgatggctatcgttggagaagcgcagaaagcgcattaa

SEQ ID NO: 7157 - DNA, 426 bp, Klebsiella pneumoniae
caccgcgcagtccagttcatggcgcagctggttgataagatcgtagagcgccacctggccgttgacgtcaacaccctgtgtcggttcatccagcaccagcagctgcggacggttgagcagggcgcgggccagcagtacgcgctgcgtttcgccgccggagagcttttgcatcggcgcatcgatcagatgccccgcctgcacgcgcttcagcgccggcaggatgtcgtctttacgggtgcccgggcgcaaacgcaggaagcggctaacggtcagcggcagcgtggcgtccagatgcagtttctgcggcacatagccgatgcgcaggcgtgcgtcacgcttgataacaccctctgtcggtgctaccagcccgagaaccacccgcacaagggtcgatttgccggcgccgttggggcccagcagggttaa

SEQ ID NO: 7158 - DNA, 390 bp, Klebsiella pneumoniae
accagcggctttccacggcctggccgcctggcggcgtcacccagaacacgctccacaccggcggcagaccgtttagccaggttcggcactgaacgatactccgccgccagtcgcgcagcgactgcgccagatgctccccggaggggtggtgctccggtaccaccgccagcagcacggaaacctgcgataccagtgccggacgcgccgccgccaggtactgcgccagccgcggcaactgctccgcgctgtctccccgtagataccagccgtgacgggtttcgccgtgcgccgaacgcccgggaaacagaccgtcggtatccccgcagaccagaaccactgccccctgaaaatcctcgggcggcaggacgatttccgatcgctgacggctga

SEQ ID NO: 7159 - DNA, 1575 bp, Klebsiella pneumoniae
tcaataaaagttgataacaagcagtaccccattacaccttcgataacgatccggctttgcgacgttgcaggctggcgctaccgaatccatgttcacgcaacaccaaagttgtatcagtcaacggagtattacatgtccagaaggcttcgcagaaccaaaatcgttactaccttaggcccggcaactgaccgcgataacaacctggaaaaggttatcgccgcgggcgcaaacgtagtacgtatgaacttctctcacggcaccccggaagatcatcagctccgtgccgacaaagtgcgtgagattgcggcaaaactgggccgtcatgtggccatcctcggcgacctccagggaccaaaaattcgcgtatcgaccttcaaagaaggcaaaattttcctcaacgtcggcgataaattcctgctcgacgcaaaccttggcaaaggcgaaggcgacaaagagaaagtcgggatcgactataaaggcctgccggcggacgtcgtgccgggcgatatcttattgctcgacgatggtcgcgtgcagctgaaagtcctcgaagttcaggggatgaaagtgttcactgaagtgaccgtcggcggcccgttgtccaacaacaaagggatcaacaagctgggcggaggcctgtctgccgaagcgctgaccgacaaagataaagctgatatcgtcaccgccgctaaaatcggcgtcgactacctggccgtctctttcccgcgctgcggcgaagacctgaactacgcccgtcgcctggcgcgcgatgccggctgcgatgcgaaaatcgtcgccaaagttgagcgtgccgaagcggtttgcgatcaggatgcgatggacgacgtgatcctcgcctccgatgtggtaatggttgcccgtggcgacctcggcgtcgagatcggcgatcctgagctggtgggcatccagaaagcgctgatccgtcgtgcccgtcagctgaaccgttccgtcattaccgccacccagatgatggagtcgatgatcaccaacccgatgccgactcgcgcggaagtgatggacgtggccaacgccgtgctggatggtaccgatgcggtgatgctctccgcggagaccgctgccggtcagtatccttcggaaaccgtggccgcgatggcgcgcgtgtgtctgggcgcggaaaaaatccctagcctcaacgtctccaaacaccgtctggacgtccagttcgacaatgtggaagaagcgattgccatgtcggcgatgtatgccgccaaccacctgaaaggcatcaccgccatcatcaccatgaccgaatcgggccgtaccgcgctgatgacttcgcgcattagctccggtctgccgattttcgccctctcccgccacgagcgcaccctgaacctgaccgccctctaccgcggggtgacgccggtgttcttcgacagccagaatgacggggtggccgccgcgcacgacgccgtcaatctgctgcgggacaaaggctatctggtctccggcgacctcgtggtcgttacccagggtgacgtgatgagcaccatcggcagcaccaacaccacccgtatcctcaccgtcgagtaa

SEQ ID NO: 7160 - DNA, 1743 bp, Klebsiella pneumoniae
ggtattccggtgaatattcaggctcttctctcagaaaaagtcagccaggccctgatcgcggcaggcgcgcctgccgattgcgaacctcaggtccgccagtcagcaaaagttcagttcggtgactatcaggccaacggcgtgatggctgtcgccaaaaaactgggcatggcgccgcgacaacttgcagagcaggtactgtctcatcttgacctcaacggcattgccaacaaggttgaaatcgccgggccgggctttatcaatattttcctcgatcctgcttttctggcggacaacgtcaaccgcgcgctgcagtctgagcgcctgggcgtcacgaaaccgcaggcgcagactatcgtcgtcgactactcggcacccaacgtagcgaaagagatgcacgttggccatctgcgttcgaccatcattggcgatgcttcagtccgtaccctggagttcctgggtcataaggtgatccgcgccaaccacgtcggcgactggggcacccagttcggtatgctgatcgcgtatctggaaaaacagcagcaggaaaacgccggcgaaatggccctggccgacctcgaaggtttctatcgcgaagcgaaaaagcactatgacgaagacgaagccttcgccgagcgcgcgcgcagctacgtggttaagctgcagggcggtgatgagtacttcctgcagatgtggcgtaagctggtcgacatcaccatgtcgcagaaccagatcacctacgatcgcctgaacgtcaccctgacccgcgatgacgtgatgggtgagagcctgtacaacccgatgctgccggggatcgtcgccgatctgaaagccaaagggctggcggttgagagcgaaggcgccaccgtggtcttccttgatgagtacaaaaacaaggaaggcgaaccgatgggcgtcatcatccagaaaaaggatggcggctacctctataccaccaccgatatcgcctgtgcgaagtatcgctatgaaacgctgcacgccgaccgcgtgctctactacatcgactctcgtcagcaccagcacctgatgcaggcgtggaccatcgtgcgcaaggcaggctacgtgccggactccgtgccgctggagcaccatatgttcggtatgatgctggggaaagacggcaagccgtttaaaacccgcgccggcggtaccgtgaagctggcggatctgctggacgaagcgctggagcgcgcccgtcgcctggtggccgagaagaacccggatatgtcggctgacgagctggaaaatctggcgaaagtggtgggtatcggcgcggttaaatatgccgacctgtcgaaaaaccgcaccaccgactacgtcttcgactgggataatatgctggcgttcgaaggcaacaccgcgccgtatatgcagtatgcctatacccgcgtgctctccgtgttccgcaaagccggcatcgacgaaaacgcgatgatcgacgcgccggtggtcatcgccgaagatcgcgaagctcagctggccgcgcgcctgctgcagtttgaagagaccctctccgtggtcgctcgcgaagggacgccgcacgtgatgtgcgcctacctctacgatctggcgggcctgttctccggcttctacgagcactgcccgatcctcagcgcggaaagcgaagagacccgcaacagccgtctgaagctggcgctgctcacggcgaaaaccctcaagctgggtcttgataccctcggtatcgaaaccgtcgagcgtatgtaa

SEQ ID NO: 7161 - DNA, 1668 bp, Klebsiella pneumoniae
tgtagccaggtacccactcccttccggtggcaaatccggaacgattgtcggcgttcttttataaaaagacacaggatcacggcgatgaaaacacgaaaaattggactggctaactatctggcctacggcgcgggcgattttctcggcgccggcacgacggcgctaaccgccgcatggctgctctacttttacacgaccttttgcggactgaccccgattgaggccacgcttatttttgctgccgcccgcgtgctggacgcggtggtaagcccgctgatgggctttctcaccgataactttggcaccacctggcttggtaagcgcttcggccgcagaaaattctttattctgctcggcatcccctgcgtattcagctattcagcgatgtgggtcggcgagatgggcttctggtactacctggcgacctatctgctgtttgatatggtctataccatgattctggtgccctatgagacgctggtgccggagatgaccgatgactttaaacagaaaaccaaattctccggcgcgcgcatttcgatggcgcagatgtcggcgattttagcctccttcctgccggggatccttctctcctggctcggcaaagataatgccagctcgttcttctatgccagtctggtgttctcggtgctgtgcgcggtgatgctgactctggtctggtgtttcacctgggaacgaccgcgggaggcgtggtcggaagcggccctgcgggcggaagcggaaaaacaaaacttaacccttgctcagagcctcaatcgcctggtgattgagctgagttctacgctgcggataaaaattttccgccagcacctcggcatgtatctggggggctatatcgcccaggacgtcttcaatgccgtgtttacctattacgtggtctttgttctgatgcaggaagccgccgtcgcctcgaacctgctggggacgatggccatcttccagtttattgcagtaatcgccatgatcccgctgtgcattcgttttggccccgcgccgtcgtaccgcatggtggtggtcctgtttggcctgagctcactctcctacgcgctgctctattacgccggactgagcgacgtctattccttattgctgctcatctctgctgtcgccggactgggacgcggcgggataaattacgtaccgtggaatacctacacctatattgccgacgtcgacgaagcgatcaccggccagcgccgggaggggatttttgccggcatcatgaccctgacccgcaaagcctcgcaggcgggggcggtgatgctggtggggatcattatgcagttgtcggggtttgtttccgggcaaaaaatacagcctgaaggggtcagccataccattctgctgatcctcagcgtcggcactctggtggtgttagcctgcggcttcctcgtctcgctgcgcttcaagctcaacctgcacacccacagcgtcctgcgcagcgagaccctcagaatgcgcgagctcggctacgctcagtcggaacagaccagtgcggaacaccgcgcggtggtcgagctgctggcggggatgccttacgactgtctgtggggcaataacaatattggctatctgaatcgtcataaacctgctgccccggcgctcattaagggtggcgctttgaattcgacatatacccgaggttaa

SEQ ID NO: 7162 - DNA, 792 bp, Klebsiella pneumoniae
tccccgcaggtgaaaagcagcgatgctgctcccaaccttatggctacagactttcgatccggcggtaaccgctgggtctgccgctgcgtagcagacatggaggatgctgaaaacagcctgtccagtgcggcgatgacgcccaggggacggctacgggtggatgtaccgagtccgctggcccgccttattctggtgccggcgctaccggctttccacgcccgctaccctgatatccagatcgacatgggtgtgagcgaccgggtagtggatctgatcggcgacaacgtggattgcgttctgcgcggtggtcaaatcaccgaccagtccctaatcgcacgccatgtcggcgatttgcaaatcggcgtctacgtcgcccccagctacgtggaacgccttggcgctcccgcacacccgcgcgagctgcaaaatactgaccattgcatagtgggattcttgtcctcacgcaccagtaagattgatcctttggtactgtgcagtgagaatgaacgtattgaaatcacgggcaactacgtacttgccgtggatgatggcaatgcttacctcgaagctgggttagttggcttaggcgtgattgcgctgcccaactatatggcggcagcgcatcaggccgttggcgctttgattccattatttacacaatggcggattagcccaatgcctctgtacctggcgtttccaccgaaccgccatgtcaacgccaagctgcgcgtttttattgactggatcgttgaagtgatgctgcagcatgtccccattgccaaccatcagtga

SEQ ID NO: 7163 - DNA, 1716 bp, Klebsiella pneumoniae
cgccgcgaggtttgcgcaacgtattgcgagagaaagatggataagccactgcggttgaagttaaaaaagtgctaccacctggctcgcccggcgcatgtggttaacgcttgttttatcgcagtgctgtttttctccacgctgctgatctggcgtgaaatcaatgtcctggaagaggcctacgtggccaaccagcgtaacaatctggctaacgtcgctcatgaaatggatggactgttgcagttcaacatcgacagaatgatgttttttcgccatgggatgcaggcggcgctcgaacagccgcttgatatcgatgtattgcgtaaggccagccaacgctatctgagccagcgccatcagcaggcctggcgggtggcgctaccgaatcggcgtacgctgccggtgtttggcatctcaggcagcgtcgctggccacaaccctatcctgctggtggacgatccgctggcggctgatgaactaatggcgacgctcgagctgggttatctgctaaatctgacgcagcacgatcgcgatttcgccgagcggatgcagtatatctctcgtagcggcttttttacctcgaccctgccgctgcgggatgagtcgcaggtgataacgcactattcccaagccctcagcgctccgtggtttacccgccagacccagcgaaataatccggggcgaggcgttatctggcaaacctttcctgacgatgacccgcagctggaagagcaggtggtcaccgcttcgataccgttggattttgccggttactggcgtggcgtgctggcgatggatttctcagtcagtgaaatcaaagcgtttttggttagcgccatgcaggggggacaagagggagagtaccaactttatgatagccatttgaacctgctggcttcttccacgccggggaatgtcctgaccctgctgtcgccgcgcgagcaggagctgctgagccgcgcgtttgtccatgataaccagggagggctgcgtctgctgacgcgctatatcagctgggccaaactgcgcaattttgacggcgtgctgctgcggatccacactctgcgggaaggcgtccgcgggaactttggcaccatcaccatcgccctgaccctgatgtgggtcctcttcaccttgatgctgttgctctcctggctggtgatccgccgcatggtccgcaacatgagcgttctgcaaacctctctggagtggcaggcatggcatgatgccttgacccgcctgctcaatcgcggggcgctgtttgaacaggcgatggcggtagccagcgactgccagcgcagcggacggccgctggcggtgatccagctcgatctggatcattttaagcacatcaacgatcgctatggtcatcaggcgggggacagggtgctgtcgatggtggccagtacgctgtccagcgcggttcggcagggcgatctgctgggcagagtgggcggagaagagttttgtatcgtgatgccgaataccaccctgcaggaagcggcggcggtggcggagcgattgcgccagcgtatccagggacgggaagtctttttgcataacaacgtgacgctgcgggttagcgcctcgttaggggtgagcgccagcgaagagcggggggagtatcagtttgaagcgctgcagtcggtggccgatgggcgactctatctggccaagcaaaatgggcgtaaccaggtctgttttcgcagcgcagcgtga

SEQ ID NO: 7164 - DNA, 528 bp, Klebsiella pneumoniae
catctattatttaattccaggagtgcaacgatgctgaaaacggacatgattgacaaactcaatgaacagatgaatcttgaactctattcttctcttctttatcagcagatgagcgcctggtgcagttaccacagttttgaaggcgccgcggccttcctgcgtcgccatgctcaggaagagatgacccatatgcagcgcctgttcgactatctaaccgataccggcagcctgccgcggatcaacgctatcgcctccccgtttgccgaatatgcctcactcgacgagctgttccgccagacctacgagcatgagcagctgatcacgcaaaaaataaatgaactggcgcacgcggccatgaccagccaggattatccgacctttaatttcctgcagtggtatgttgctgaacagcatgaagaagagaaattatttaaatcggtgatcgataaactgaccctcgctggaaaaagcggcgaaggtctgtactttatcgataaagagctggctaccctcgacgcgcagaattaa

SEQ ID NO: 7165 - DNA, 594 bp, Klebsiella pneumoniae
cgagcattattgacgagcaaacccatggcaaactggcagcaaattgaacaactggccgatattacggcggatctcccgcgattttccgatgcgcttcagcgcttcactgcgcgactgggactggagatcgccgggctcgacgccgaccatatctccctgcgctgtcatcagaataccactgcggaacgctggcgccgcggtctggaacagtgcggaaccctgctgtcggagaatatgatcaacggccggcccatttgcctgttcaagctggcggagccggtctgcgtggcgcactggcgcttccatatcgttgagctgccgtggccgggtgaaaagcgttatccccatgaaggctgggagcatatcgaaatcgtcctgcccggcgatccggcaaccttaaatgcccgcgcgctggcgctgctggccgatgacggactcagccagccggggatcgtggtcaaaaccagctcgccgaaaggggagcatgagcgcctgccgaaccccaccctggcggtgaccgacggcagcgtgacggtcaaatttcatccgtggtctattgaacaaatcgtcgccagcgagcaagccgatacgtaa

SEQ ID NO: 7166 - DNA, 918 bp, Klebsiella pneumoniae
tttcacccattaatgaaatcgtttccattgatgagcgccctgttactaatgaacatgctggaaaaaatccagtcccgactggaacaccttagcaaatctgaacgcaaagtggcggaagtgatcctcgccacccccgagcaggccattcattcgagcatcgccgccctcgcccttgaggccggggttagcgaaccgaccgtcaatcgcttctgccgtagtctcgaaacccgcggattccctgacttcaaactgcatctggcccagagccttgcgcacggcacgctctatgttaaccggaatgtcgatgaagacgacagcgttgagtcatacacgggaaaaatattcgaatcggccatggcgagtttagatcaggtgcaccattctctcgacatgtcggcggtaaatcgcgcggtggatctgctgactcaggccaaaaaaatcgcctttttcggcctcggctcctcagcggcggtcgctcacgacgcgatgaacaaatttttccgctttaacgtgccggtcatctattccgacgacattgtcctgcaacgcatgagctgtatgaattgcgatgacgatgatgtggtggtgattatctcgcataccggaagaaccaagagcctggtggagctggcgcagctggctcgtgaaaacgatgccatggtgatcgcgctcacctccgccggtacgccgctagccagggaagccacgctcgccattacccttgatgtgccggaagataccgacatctatatgccgatggtctcccgtttggcccagttgaccgtcattgatgtgttggcgactggctttatcttgcgtcggggggcaaaattcagagataacttgaagagggtcaaggaagcgctgaaggaatcgcgttttgataaagaaccattcgtacccagtgataatcaataa

SEQ ID NO: 7167 - DNA, 2088 bp, Klebsiella pneumoniae
ttatcattttcaattcaccattgtcggtatttttggcgtttcgccgtcttacagggactcacaacaatgaaaatgacacggctttatcctctggccttggggggattattgctccccgccattgctaatgcccagacttcacagcaagacgaaagcacgctggtggttaccgccagtaaacaatcttcccgctcggcatcagccaacaacgtctcgtctactgttgtcagcgcgccggaattaagcgacgccggcgtcaccgccagcgacaaactccccagagtcttgcccgggctcaatattgaaaatagcggcaacatgcttttttcgacgatctcgctacgcggcgtctcttcagcgcaggacttctataaccccgccgtcaccctgtatgtcgatggcgtccctcagctttccaccaacaccatccaggcgcttaccgatgtgcaaagcgtggagttgctgcgaggcccacagggaacgttatatggcaaaagcgctcagggcgggatcatcaacatcgtcacccagcagccggacagcacgccgcgcggctatattgaaggcggcgtcagtagccgcgacagttatcgaagtaagttcaacctgagcggccccattcaggatggcctgctgtacggcagcgtcaccctgttacgccaggttgatgacggcgacatgattaaccccgcgacgggaagcgatgacttaggcggcacccgcgccagcatagggaatgtgaaactacgtctggcgccggacgatcagccctgggaaatgggctttgccgcctcacgcgaatgtacccgcgccacccaggacgcctatgtgggatggaatgatattaagggccgtaagctgtcgatcagcgatggttcaccagacccgtacatgcggcgctgcactgacagccagaccctgagtgggaaatacaccaccgatgactgggttttcaacctgatcagcgcctggcagcagcagcattattcgcgcaccttcccttccggttcgttaatcgtcaatatgcctcagcgctggaatcaggatgtgcaggagctgcgcgccgcaaccctgggcgatgcgcgtaccgttgatatggtgtttgggctgtaccggcagaacacccgcgagaagttaaattcagcctacgacatgccgacaatgccttatttaagcagtaccggctataccaccgctgaaacgctggccgcatacagtgacctgacctggcatttaaccgatcgttttgatatcggcggcggcgtgcgcttctcgcatgataaatccagtacacaatatcacggcagcatgctcggcaacccgtttgtcgaccagggtaagagcaatgacgatcaggtgctcgggcagctatccgcaggctatatgctgaccgatgactggagagtgtatacccgtgtagcccagggatataaaccttccgggtacaacatcgtgcctactgcgggtcttgatgccaaaccgttcgtcgccgagaaatccatcaactatgaacttggcacccgctacgaaaccgctgacgtcacgctgcaagccgcgacgttttatacccacaccaaagacatgcagctttactctggcccggtcgggatgcagacattaagcaatgcgggtaaagccgacgccaccggcgttgagcttgaagcgaagtggcggtttgcgccaggctggtcatgggatatcaatggcaacgtgatccgttccgaattcaccaatgacagtgagttgtatcacggtaaccgggtgccgttcgtaccacgttatggcgcgggaagcagcgtgaacggcgtgattgatacgcgctatggcgcactgatgccccgactggcggttaatctggtcgggccgcattatttcgatggcgacaaccagttgcggcaaggcacctatgccaccctggacagcagcctgggctggcaggcgactgaacggatgaacatttccgtctatgtcgataacctgttcgaccgtcgttaccgtacctatggctacatgaacggcagcagcgccgtcgcgcaggtcaatatgggtcgcaccgtcggtatcaatacgcgaattgatttcttctga

SEQ ID NO: 7168 - DNA, 825 bp, Klebsiella pneumoniae
caaggaatttctatggcacgcattattgttgtgacttcgggtaaagggggcgttggcaagaccacctccagcgcggccatcgctacaggtttggcccagaagggaaagaaaaccgtcgttatcgacttcgacatcggcctgcgtaacctcgacctgattatgggctgcgaacgtcgcgtcgtttatgatttcgtcaacgtcattcagggcgatgccacactgaaccaggcgctgattaaagataagcgcacggaaaatctctacattctcccggcttcccagacccgggataaagacgctctgactcgcgaaggcgtcgacaaggttctcgaagaactgaagaaaatggaattcgatttcatcgtctgtgattccccggcaggcattgaaaccggtgcgctgatggcgctttactttgctgatgaagccatcatcaccactaacccggaagtctcctccgttcgcgactccgaccgtatccttggcattctcgcctctaaatcccgccgcgcggaaaatggcgaagagccaatcaaagagcatctgctgctgacccgctacaatccaggccgcgttaataaaggcgatatgctgagcatggaagacgtgctggaaattctgcgcatcaacctggtaggcgtgatcccggaagaccagtcagtcctgcgcgcatccaaccagggtgagccggtgatcctcgatgccgcctcggacgcaggcaaagcctatgccgataccgttgaacgtctgctcggagaagaacgccctttccgcttcattgaagaagagaagaaaggattcctcaaacgcctgttcggaggataa

SEQ ID NO: 7169 - DNA, 267 bp, Klebsiella pneumoniae
tcgcatgaattgccaaatcgtttagattttgcttattttatttatcatacaaatatgtatactagcaggcttccgatgttggcccgccagttaacctgcacgccgggcctgtttaggtgcaggttttttcttttctccgccctcgtttacggttccaccgttgccacctccccttccacaggatgcgatttatgtgtaaatgaattgtgtatgctaaaaacggtgtgctataacgggacatccagaggccagcgggtgtttgactga

SEQ ID NO: 7170 - DNA, 1035 bp, Klebsiella pneumoniae
attgttaattccgatttttccctacatgaaagcgaattaaagctggagtttaccatgcacaaatttactaaagcgctggcggccattggtctcgctgcggttatgtcacaatcagctatggcggaaaatcttaaactgggttttctggtgaaacagccggaagagccatggtttcagactgagtggaaatttgctgataaagcaggaaaagatttaggctttgacgttattaaaattgcggttccggatggagagaaaaccctgaatgccattgacagcctggcggccagcggcgcgaagggctttgtcatttgtacccccgatcccaagctcgggtcggcgattgtcaccaaagcgcgtggctatgacatgaaggtgattaccgtcgatgaccagttcgtcaatgcgaagggcaaaccgatggagagcgtaccgctggtgatgatggcggcgagcgaaattggcgcccgtcaggggcaggaactctataaagagatgcaaaagcgcggctgggatgtcaaagacaccgccgtaatggcgatcaccgccgatgagctggataccgcgcgccgtcgcaccaccggctccatcgatgccctgaaggcggccggtttcccggacgcgcaaatctaccgcgtgccgacaaaatccaacgatatcccgggagcgttcgacgccggtaactcgatgctggtccaacatccgcaggttaaacactggctgatcgtcgggatgaacgacaacaccgtcctcggcggcgtgcgcgcgaccgaaggtcagggctttaaagctcccgatgtgattggcatcggcatcaacggcgtggatgccgttaacgaactgtcgaaggcgcagccgaccggcttctatggctctctgctgccaagcccggatatccacggctacaaaaccagcgaaatgctctacaactgggtcaccaagggcgtcgagccgccgaagttcacggcggtgaccgatgtggtgttgattacccgcgataacttcaaagaagagctggcgaaaaaagggctgtaa

SEQ ID NO: 7171 - DNA, 1581 bp, Klebsiella pneumoniae
cgcatgaattcttcctttaaatctctgattgaacagtatcccttacccattgccgaacagttgcgccactgggcggcccgttatgcctcgcgaattgccgtcgttgatgcaaaggggtcgttaacctacagcgcgcttgatgcacaagttgacgaacttgccgcaggtctgtcatcactgggtttgcgttcgggggagcatgtaattgtgcagcttcccaacgacaacgcgtttgttaccctgctgttctccttgttaagactgggcgttatccccgtgctggcgatgccctcgcaacgggcgctggatatcgacgcgctgattgagctggcgcaacccgtcgcttacgttattcacggggaaaaccacgcagagctggcccgacagatggcgcacaaacacgcctgcttgcgtcatgttctggtcgctggagagaccgtgagcgacgattttacgccgctcttctcccttcacggtgagcgacaggcatggccgcagcctgatgtttccgccaccgcgttgttgttgctctcaggcggcacaaccggcacgcccaaactcatcccgcgccgacatgccgactatagctataacttcagcgcttctgctgaactgtgcggcatcagccaacagagcgtgtatctcgccgtcctcccggtggcgcataactttccgctggcctgccccggtattctgggaacgcttgcctgcggcggaaaagtggtgctgaccgacagcgccagctgtgatgaggtgatgcctttaatcgcgcaggaaagagtgactcacgtcgccctggttccggcgctggcgcaattatgggtgcaggccagggagtgggaagacagcgacctttcgtcgctgcgcgtcattcaggcaggcggcgcccggctcgacccgacgcttgctgagcaggttatcgccacctttgactgtaccctgcaacaggttttcggtatggcggaaggcctgctctgttttacccggctggacgatccgcatgccaccattctccacagccaggggcgcccgttgtcccctctggatgaaatccgcatcgttgatcaagacgagaacgacgtcgcgccgggcgaaaccgggcaattgttaacgcgcggcccttataccatttcgggctattaccgcgcccctgcccacaacgcgcaggcctttaccgcgcaagggttttaccgcacaggcgacaatgtcaggctggatgaggtagggaacctgcacgttgagggacgcataaaagagcagatcaaccgcgccggagaaaaaatagccgcggctgaagtggaatcggcactgctgcgtttagcggaagtgcaagattgcgcggtggtcgccgcgccggacacgctgcttggcgagcggatttgcgcgtttatcatcgcgcagcaggtgccaactgactatcagcagttgcgtcaacaactgacccgtatggggctcagcgcgtggaaaattcctgaccaaatcgagtttctggaccactggccgctcaccgccgtcggcaagatagacaaaaaacgcctgacggctctcgccgtcgaccattatcgccattctgcccaataa

SEQ ID NO: 7172 - protein, 246 aa, Klebsiella pneumoniae
LKSSSMAKKASFIVMVDGEHVLPMATSQDHKRVGNGDTGPNTGGMGAYSPAPVVTDEVHQRTMERIIWPTVKGMAAEGNTYTGFLYAGLMIDKQGNPKVIEFNCRFGDPETQPIMLRMKSDLVELCLAACAGKLDEKTSEWDDRASLGVVVAAGGYPGSYNTGDEIYGLPQQEVADGKVFHAGTKLSDDQRVVTNGGRVLCVTALGDSVAQAQQRAYQLLTDIRWDGSFSRSDIGWRAIEREKANG

SEQ ID NO: 7173 - protein, 227 aa, Klebsiella pneumoniae
LPRPRRRNLPETGGSLMYQPDFPPVPFRLGLYPVVDSVAWIERLLEAGVRTLQLRIKDRRDSEVEDDVIAAIALGRRYHARLFINDYWQLAIKHQAYGVHLGQEDLETTDLSAIRQAGLRLGVSTHDDMEIDVALAARPSYIALGHVFPTQTKQMPSAPQGLEQLARHIQRLADYPTVAIGGISLEKAPGVLATGVGSIAVVSAITQAADWRAATDQLLTLAGAGDE

SEQ ID NO: 7174 - protein, 163 aa, Klebsiella pneumoniae
RTWPAFAFLTASATFGVTVPTFGFGIRPRGPRTCPSWPTTRIASGEAITTSKFISPFLICSARSSIPTSSAPAALAASAFAPWVNTATRTERPVPCGSTVAPRTFWSDLRASMPRLTATSTLSVNLAVASSFSRAMASLMSYCLVASTFSRITRMRLVSLAIS

SEQ ID NO: 7175 - protein, 152 aa, Klebsiella pneumoniae
SVNTHFEDLRMAKKVQAYVKLQVAAGMANPSPPVGPALGQQGVNIMEFCKAFNAKTDSLEKGLPIPVVITVYADRSFTFVTKTPPAAVLLKKAAGIKSGSGKPNKDKVGKISRAQLQEIAQTKAADMTGADIEAMTRSIEGTARSMGLVVED

SEQ ID NO: 7176 - protein, 121 aa, Klebsiella pneumoniae
MSITKDQIIEAVSAMSVMDVVELISAMEEKFGVSAAAAVAVAAGPVEAAEEKTEFDVILKAAGANKVAVIKAVRGATGLGLKEAKDLVESAPAALKEGISKDDAEALKKSLEEAGAEVEVK

SEQ ID NO: 7177 - protein, 635 aa, Klebsiella pneumoniae
LECAMSTTKLTRREQREHAQRFIDTLAGTAFPNSRRIYVHGSQADIRVPMREIQLSPTLVGGDKDNPRYETNEPIPVYDTSGPYGDPDISIDVRQGLAKLRQPWIDARNDCAPLSERSSAYTKARLADDGLDELRFSGLLTPKRAVAGKCVTQLHYARQGIVTPEMEFIAIRENMGRERIRSEVLRQQHAGEGFGAHLPENITPEFVRDEVAAGRAIIPANINHPESEPMIIGRNFLVKVNANIGNSAVTSSIEEEVEKLVWSTRWGADTVMDLSTGRYIHETREWILRNSPVPIGTVPIYQALEKVNGIAENLTWQVFRDTLLEQAEQGVDYFTIHAGVLLRYVPMTAKRLTGIVSRGGSIMAKWCLSHHQENFLYQHFREICEICAAYDVSLSLGDGLRPGSIQDANDEAQFSELRTLGELTKIAWEYDVQVMIEGPGHVPMQMIRRNMTEQLEHCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPFTARAYHDETLPQESGKVAHFCSMCGPKFCSMKITQEVRDYAAKQSIEAGMADMSNNFRARGGEIYLKQEEA

SEQ ID NO: 7178 - protein, 1421 aa, Klebsiella pneumoniae
RPAAECANSDGSKSVKDLLKFLKAQTKTEEFDAIKIALASPDMIRSWSFGEVKKPETINYRTFKPERDGLFCARIFGPVKDYECLCGKYKRLKHRGVICEKCGVEVTQTKVRRERMGHIELACPTAHIWFLKSLPSRIGLLLDMPLRDIERVLYFESYVVIEGGMTNLERNQILTEEQYLDALEEFGDEFDAKMGAEAIQALLRNMDLEQECEQLREELNETNSETKRKKLTKRIKLLEAFVQSGNKPEWMILTVLPVLPPDLRPLVPLDGGRFATSDLNDLYRRVINRNNRLKRLLDLAAPDIIVRNEKRMLQEAVDALLDNGRRGRAITGSNKRPLKSLADMIKGKQGRFRQNLLGKRVDYSGRSVITVGPYLRLHQCGLPKKMALELFKPFIYGKLELRGLATTIKAAKKMVEREEAVVWDILDEVIREHPVLLNRAPTLHRLGIQAFEPVLIEGKAIQLHPLVCAAYNADFDGDQMAVHVPLTLEAQLEARALMMSTNNILSPANGEPIIVPSQDVVLGLYYMTRDSVNAKGEGMVLTGPKEAERIYRAGLASLHARVKVRITEYEKDDNGEFVAKTSLKDTTVGRAILWMIVPKGLPFSIVNQALGKKAISKMLNTCYRILGLKPTVIFADQTMYTGFAYAARSGASVGIDDMVIPEKKYEIISEAEAEVAEIQEQFQSGLVTAGERYNKVIDIWAAANDRVSKAMMDNLQTETVINRDGQEEQQVSFNSIYMMADSGARGSAAQIRQLAGMRGLMAKPDGSIIETPITANFREGLNVLQYFISTHGARKGLADTALKTANSGYLTRRLVDVAQDLVVTEDDCGTLEGITMTPVIEGGDVKEPLRDRVLGRVTAEDVLKPGTADILVPRNTLLHEHWCDLLEANSVDSVKVRSVVSCDTDFGVCAHCYGRDLARGHLINKGEAIGVIAAQSIGEPGTQLTMRTFHIGGAASRAAAESSIQVKNKGSIKLSNAKSVVNSSGKLVITSRNTELKLIDEFGRTKESYKVPYGAVMAKGDGEQVAGGETVANWDPHTMPVITEVSGFIRFTDMIDGQTITRQTDELTGLSSLVVLDSAERTAGGKDLRPALKIVDAQGNDVLIPGTDMPAQYFLPGKAIVQLEDGVQISSGDTLARIPQESGGTKDITGGLPRVADLFEARRPKEPAILAEISGIISFGKETKGKRRLVITPVDGSEPYEEMIPKWRQLNVFEGERVERGDVVSDGPEAPHDILRLRGVHAVTRYIVNEVQDVYRLQGVKINDKHIEVIVRQMLRKATIESAGSSDFLEGEQVEYSRVKIANRELEANGKVGATFSRDLLGITKASLATESFISAASFQETTRVLTEAAVAGKRDELRGLKENVIVGRLIPAGTGYAYHQDRMRRRAAGELPAAPQVSVEEASANLAELLNAGLGGSDND

SEQ ID NO: 7179 - protein, 512 aa, Klebsiella pneumoniae
RFMALHNRKLSFTTPIVVGFAGILLSFMLIAIFVTLAQQKDFLEDYHDINRNFTHNLAINYTETLLRENDFILGRAAAFFARNDELNRAVNVEPEKGLTTLMQLQNMMPSVSSISLADTEGHYLRAPEVLENEDSRAFDPRTRPWFIKQAEASTFSHYTSPYMDYFTHHPTITIFKPIITPEGKLKGSLAFHLDLTSMGFALRQMVAPVQGEFFVVQRDGKVVLHSDPGALFKPFVRDELMDKMTSGEGQLYDPGSDTWYYYYSFTNPDWFVIFRVDNATLVNLTRHETNLVIGGFTLAAIIIILFGLYLRHASRTVLMNIINAIKTGDVKRAPRLEAMLSKAIETNKQRELSYVRQATIDALTGCKNRRAFDSDIAALMNDHQPFALALVDIDNFKSINDTWGHLNGDIVLRNVAREGLQVLQPLEISLYRYGGEEFAVVFPAEHIDNARTLLETWRINVERRTWREDGLTVTFSAGLGEWNMEPLDKLVVSVDEALYKAKQQGKNRILRT

SEQ ID NO: 7180 - protein, 235 aa, Klebsiella pneumoniae
DRVAVNSFIEGAIKPLLSVWRRPLALAGILLLTACSHDTSLPPFTASGYADNQGAMRIWRKDSGDEVHLLAAFSPWRHGDTSTSEYRWQGDQLALIELNVYGKPPEHIRARFDAQGDLSFMQREVDGQKQQLSSDQVALYRYRAEQIRQTSDALRQGRVVLRQGRWNAAAHTVLTCEGQTVTPDLDSRALAHIERRQSHASAAVSIAWLEAPEGSQLLLVANENFCTWQPTEKSF

SEQ ID NO: 7181 - protein, 183 aa, Klebsiella pneumoniae
HYIYILVSRFKSKLAESIMLNQLENLTERVGGSNELVDRWLQVRKHLLVAYYNLVGLKPGKESFMRLNEKALDDFCQSLVDYLSSGHFSIYERIIGEMEGDTPLLAATRLYPQLEANTQQMMDYYDTCLENAIDHDNYLEFQQALSDIGESLEARFALEDKLIALAVAHNLSNDVRDNIAPTA

SEQ ID NO: 7182 - protein, 101 aa, Klebsiella pneumoniae
RVIYVHYPSAEGFHLVGVPIFHAQANVEKAETVNSGSAEPDQANTCEGNKSKLLFASVRQGRSHLLLHPSSDKPCPFLTGMRYVYYQTNPSGTTRARAAIH

SEQ ID NO: 7183 - protein, 551 aa, Klebsiella pneumoniae
YFHLLLHELMAEVAHVGEDHGDAVFVSGGNHFVVTDRAARLNNAGDAYRGCGIDAVAEREESVRGHGGTFHFQTFITGFNSGDFRRVDAAHLTGAYTDGHIIFGINDGVGFDEFRYFPAEQRIAQLLLARLTFADHAQFARGDHTEIAVLNQQTTVNAFEIEAGNASIPLAAGQYADVLLRGGDFQRFFAGGRRDDHFDELARDDRLRGFSIQLAVKGNDAAERGGRVGFVSAIVGVKNRVADGNAARVGMLDDNAGRLVELFHALQRRIGIGNVVIGERFALQLSGGRHGGLFYILFYIESRLLVAVFAVAHILLLNEVQIQGTREAASGFFAFAVIGRNHAAEVVGDHAVVSGGVFEGFNGEVEAGGQREGTFVGVHLINDGVVVAALNYDGDIFMVLRRGAHHGRAADIDVFHRVFQRASFTSDGLGERVKVNDNHIDRRDTVLLHDTVILTATTEDAAVYFRMQGLHASIHHFRETGVVRDFGNRQAFICQQASGAAGGQQLDTTSGKRLREFDDTGLVRNTEQSAADWTTLLHGIKSPGFEHYRER

SEQ ID NO: 7184 - protein, 547 aa, Klebsiella pneumoniae
AKTHLTLSVMFKSWGFNTMQQRRPVRRALLSVSDKAGIVEFAQALSARGVELLSTGGTARLLADKGLPVTEVSDYTGFPEMMDGRVKTLHPKVHGGILGRRGQDDGIMQQHGIAPIDMVVVNLYPFAQTVAREGCSLEDAVENIDIGGPTMVRSAAKNHKDVAIVVKSSDYDAIINEMDANEGSLTLATRFDLAIKAFEHTAAYDSMIANYFGSMVPAYHGESKEAAGRFPRTLNLNFIKKQDMRYGENSHQQAAFYIEENVKEASVATATQLQGKALSYNNIADTDAALECVKEFNEPACVIVKHANPCGVAVSDSILDAYDRAYKTDPTSAFGGIIAFNRELDAETAQAIISRQFVEVIIAPSASEEALKITAAKQNVRVLTCGQWDTRVAGLDFKRVNGGLLVQDRDLGMVTAGELRVVSKRQPSEQELRDALFCWKVAKFVKSNAIVYAKDNMTIGIGAGQMSRVYSAKIAGIKAGDEGLEVKGSAMASDAFFPFRDGIDAAAAVGITCVIQPGGSIRDDEVIAAADEHGIAMIFTDMRHFRH

SEQ ID NO: 7185 - protein, 181 aa, Klebsiella pneumoniae
SEFQSIGSGKHPGAKLMALNLQDKQAIVAEVSEVAKGALSAVVADSRGVTVDKMTELRKAGREAGVYMRVVRNTLLRRVVEGTQFECLKDTFVGPTLIAYSMEHPGAAARLFKEFAKANAKFEVKAAAFEGELIPASQIDRLATLPTYEEAIARLMATMKEASAGKLVRTLAAVRDAKEAA

SEQ ID NO: 7186 - protein, 200 aa, Klebsiella pneumoniae
FMEQQMKVLVIGNGGREHALAWKAAQSPLVDTVYVAPGNAGTALEPSLQNVAIGVTDIPALLRFAQDENIDLTIVGPEAPLVIGVVDAFRAAGLNIFGPTEGAAQLEGSKAFTKDFLARHHIPTAEYQNFTEVEPALAYLREKGAPIVIKADGLAAGKGVIVAMTLEEAEAAVKDMLAGNAFGDAGHRIVIEEFLDGEEG

SEQ ID NO: 7187 - protein, 235 aa, Klebsiella pneumoniae
EMAKLTKRMRVIREKVDATKQYDINEAIALLKELATAKFTESVDVAVNLGIDARKSDQNVRGATVLPHGTGRSVRVAVFTQGANAEAAKAAGAELVGMEDLAEQIKKGEMNFDVVIASPDAMRVVGQLGQVLGPRGLMPNPKVGTVTPNVAEAVKNAKAGQVRYRNDKNGIIHTTIGKVDFDADKLKENLEALLVALKKAKPTQAKGVYIKKVSISTTMGAGVAVDQAGLNASAN

SEQ ID NO: 7188 - protein, 91 aa, Klebsiella pneumoniae
LMNKTQLIDVIADKADLSKAQAKAALESTLAAITESLKEGDAVQLVGFGTFKVNHRAERTGRNPQTGKEIKIAAANVPAFVSGKALKDAVK

SEQ ID NO: 7189 - protein, 358 aa, Klebsiella pneumoniae
RNVKMTELKNDRYLRALLRQPVDVTPVWMMRQAGRYLPEYKATRAQAGDFMSLCKNAELACEVTLQPLRRYPLDAAILFSDILTIPDAMGLGLYFEAGEGPRFTSPVKSKADVDKLPIPDPEQELGYVMNAVRTIRRELKGEVPLIGFSGSPWTLATYMVEGGSSKAFTVIKKMMYAEPQALHALLDKLAKSVTLYLNAQIKAGAQSVMIFDTWGGVLTGRDYQQFSLYYMHKIVDGLLRENEGRRVPVTLFTKGGGQWLEAMAETGCDALGLDWTTDIADARRRVGNKVALQGNMDPSMLYASAPRIEEEVATILAGFGQGEGHVFNLGHGIHQDVDPEHAGVFVEAVHRLSAPYHQ

SEQ ID NO: 7190 - protein, 195 aa, Klebsiella pneumoniae
ASKNDSPDPGGTGHFYSLSSAKASAGPHRRAFSDWHGRCNTEGNHTGENAMKRNRTLPLALVTFAALTFASNAAWANHHWGNNNGMGNQGYSQLTQEQQATVQKLHNDYYAQTSALRQQLQSKRYEYNALLTAQKPDSGKIEAVAQEMEGLRQKLDQQRVKFDIALAEAGVPRGAGMGYGGCRGSADGHMGMHHW

SEQ ID NO: 7191 - protein, 800 aa, Klebsiella pneumoniae
GPGKRRKIDNKKSRSGNLTGFLAVHQRLIVVRTAQTCVQQLCQVGRRFFHAHLRCRRQLASSATAHTILVIRITGTGRDQTTHDDVLFQTAQFVAFARNGCFGQHASGLLERCRGDEGLGGQRRFGDTQQIAGERCAHFAVRFQFAVRDLDAGVFHLLAFEEVGAACAFDGGFTQHLTNDNFDVLIVNLNALQTVYVLDFVNNVTGHSMYATQTQNVVRCFRTVGNHITTFHTFTFEHVELTPFRDHLFVRLATVYRGDNQATFPFGFFTEGNDTADFSQDSRLFRTTCFEQVRNARQTTGDILGTAGFLRNTRQGVTRADLYAIFQLNNRFTRQEVLSRHISAWDQNVVALSINDFQCWTQIFTTCGTFCRVQNHQRRQTGQLVSLTSNGLAVDHVSETDETANFGDNRHGVRIPVCDGFTAGNLLTVAFRHNRTVRYFIALFGTTEFVDQLQLGITGSDNQLTTGVHNRLRVAELDATFVFHLDAGFSSRTRCRTTDVERTHRQLCTRLTDGLCRDNADSLTFVDEVATRQVTTIAVRADAKVGVTGYNGTHFDGVNGVRFQQVTPVLMQQRVAWNQNIRGTRLQNIFRSHTTQYAIAQRLFNVATFDNRRHGDAFQGAAVVFSDDQVLCNVNQTASQVTGVRCFQCGIRQTFTSTVGRDEVLEYVQTFTEVRGDRRFDDGAIRLRHQTTHTSQLTNLCRRTTRTGVGHHVDAVEGNLLLFLTVTVNHGFGLQVIHHRFGYTIVRRSPDIDNFVVAFARGHQTGLELFLNLSNFRFRFADDFVFFLRDDHVIDTNGCT

SEQ ID NO: 7192 - protein, 301 aa, Klebsiella pneumoniae
PSSNSSSRALRWRSINTSCRATGGKIISCRKAIGSCFFRLSLEADMLRIADKTFESHLFTGTGKFAAPEVMVEAIRASGSQLVTLAMKRVDLRQRNDAILAPLLAAGVNLLPNTSGAKTAEEAVFAARLAREALGTHWLKLEIHPDARWLLPDPIETLKAAELLVREGFVVLPYCGADPVLCKRLEEVGCAAVMPLGAPIGSNQGLETKAMLEIIIEQATVPVVVDAGIGVPSHAAQALEMGADAVLVNTAIAVADDPVAMARAFRMAIDAGLLARQAGPGARSTQAQATSPLTGFLEALA

SEQ ID NO: 7193 - protein, 1360 aa, Klebsiella pneumoniae
KTALCGQMGRLVSELRNPMVYSYTEKKRIRKDFGKRPQVLDVPYLLSIQLDSFQKFIEQDPEGQYGLEAAFRSVFPIQSYSGNSELQYVSYRLGEPVFDVKECQIRGVTYSAPLRVKLRLVIYEREAPEGTVKDIKEQEVYMGEIPLMTDNGTFVINGTERVIVSQLHRSPGVFFDSDKGKTHSSGKVLYNARIIPYRGSWLDFEFDPKDNLFVRIDRRRKLPATIILRALNYTTEQILDLFFEKVVFEIRDNKLQMELIPERLRGETASFDIEANGKVYVEKGRRITARHIRQLEKDDIKHIEVPVEYIAGKVAAKDYIDEATGELICPANMELSLDLLAKLSQSGHKRIETLFTNDLDHGPYISETVRVDPTNDRLSALVEIYRMMRPGEPPTREAAESLFENLFFSEDRYDLSAVGRMKFNRSLLRDEIEGSGILSKDDIIEVMKKLIDIRNGKGEVDDIDHLGNRRIRSVGEMAENQFRVGLVRVERAVKERLSLGDLDTLMPQDMINAKPISAAVKEFFGSSQLSQFMDQNNPLSEITHKRRISALGPGGLTRERAGFEVRDVHPTHYGRVCPIETPEGPNIGLINSLSVYAQTNEYGFLETPYRKVTNGVVTDEIHYLSAIEEGNYVIAQANSNLDENGHFVEDLVTCRSKGESSLFSRDQVDYMDVSTQQVVSVGASLIPFLEHDDANRALMGANMQRQAVPTLRADKPLVGTGMERAVAVDSGVTAVAKRGGTVQYVDASRIVIKVNEDEMYPGEAGIDIYNLTKYTRSNQNTCINQMPCVSLGEPIERGDVLADGPSTDLGELALGQNMRVAFMPWNGYNFEDSILVSERVVQEDRFTTIHIQELACVSRDTKLGPEEITADIPNVGEAALSKLDESGIVYIGAEVTGGDILVGKVTPKGETQLTPEEKLLRAIFGEKASDVKDSSLRVPNGVSGTVIDVQVFTRDGVEKDKRALEIEEMQLKQAKKDLSEELQILEAGLFSRIYAVLVSGGVEAEKLDKLPRDRWLELGLTDEEKQNQLEQLAEQYDELKHEFEKKLEAKRRKITQGDDLAPGVLKIVKVYLAVKRRIQPGDKMAGRHGNKGVISKINPIEDMPHDANGTPVDIVLNPLGVPSRMNIGQILETHLGMAAKGIGDKINAMLKQQQEVAKLREFIQRAYDLGADVRQKVDLNTFSDEEVLRLAENLRKGMPIATPVFDGAKEAEIKELLQLGDLPTSGQITLFDGRTGEQFERPVTVGYMYMLKLNHLVDDKMHARSTGSYSLVTQQPLGGKAQFGGQRFGEMEVWALEAYGAAYTLQEMLTVKSDDVNGRTKMYKNIVDGNHQMEPGMPESFNVLLKEIRSLGINIELEDE

SEQ ID NO: 7194 - protein, 472 aa, Klebsiella pneumoniae
KRDDKDSPMKIKSLSRDAAAGALSWLLTGTVVLLVMLFSAMIVRDYGRETTAARQTIEEKGSVLIRALESGTRVGMGMRMHHAQLQALLEEMAWQPGVLWFAVTDENGKIIAHSDPQQVGKTLYSPAQMRALAVGEQARWRRLSEPQPALEIYRHFRPLNPARGHHMGMMNRGNSALAQATVPQVIFIAFDSRELDAAQARGQRNMAIMLGAAALVIAATILAQFWFRRYRRSRKQLLEAMARKEKLVALGHLAAGVAHEIRNPLSSIKGLAKYFAERTPPGGESHQLAQVMAKEADRLNRVVSELLELVRPAHLNYQTVDINALIRHSLQLVSQDAQSRGIALQFTPRPELTTISADPDRLNQVLLNLYLNAMQAIGRDGVIRVTASEADRQRVKIVVTDSGKGMSDEELQAIFTPYFTTKADGTGLGLAVVQNIIEQHGGTIRAESQPGAGAIFTLWLPVDAQRREDEQR

SEQ ID NO: 7195 - protein, 106 aa, Klebsiella pneumoniae
SMEDLETIIMELLVNAGSARSAALTALQLARKGDFVAAEQAMAESHEFVKHAHKIQTQLIGMDEGSGKLPVNLITVHSQDHLMNAMVIQDLATDMIELYRRLPLAQ

SEQ ID NO: 7196 - protein, 257 aa, Klebsiella pneumoniae
RWRERAMNDHDFMRYSRQLLLEDIAIEGQQKLLASRVLIIGLGGLGSPAALYLAGAGVGTLTLADDDAVHLSNLQRQILFTSADIDRPKAAAAQTRLSQLNPQIKLVALQQRLSGEALRAEVAKADVVLDCTDNMVTRQAINAACVALDTPLVTASAVGFGGQLMVLTPPWTQGCYRCLWPESDEPQRNCRTAGIVGPVVGMMGTLQALETIKLLSGMATPRNTLRLFDARTSNWRALALQRSRSCPVCGGRHADLV

SEQ ID NO: 7197 - protein, 74 aa, Klebsiella pneumoniae
LCSWMFARAYALELTSLNSTKRASKYGEQKQARISKNNLSVLSPSTQGIKFLAKHLRSSTEAWIGQAPTNKFFL

SEQ ID NO: 7198 - protein, 116 aa, Klebsiella pneumoniae
WAPCRRWRRLSCSAAWRRRATPCGCSTPAPATGAPLRYSAPGAARCAEGGMQIWFNDEPLACADNLSVSALLTQLEQQQPGVALALNQHILPRDRWEDHLLQEGDRVLLFQVIAGG

SEQ ID NO: 7199 - protein, 155 aa, Klebsiella pneumoniae
LMRLAARRRAFGKIFRQPFNRRERVADLVRDPRRQMAKRHQLFLAGHRLQQLFPRATIAAEPELSEDRRRYHQRGGTQHDGHIPLPAGLRGIQLAAIKGDKNHLRDGGLSQGAIAAVHHSHMVAAGRIKRAKMAIDLQRRLRFAKPAPAGLFANR

SEQ ID NO: 7200 - protein, 123 aa, Klebsiella pneumoniae
SGCRIARAAIKIRHHGTQGPLTMKNIVLCCAAGMSTSMLVQRMQDAAQKKGVEVSIKAVPVAEFKDNLAAADIILLGPQVKYEQAKLQALADPFGKKVAVIDMMDYGMMKGDAVLDKALKMLE

SEQ ID NO: 7201 - protein, 1401 aa, Klebsiella pneumoniae
HIPLPGVNPAAVNLFERELLVFQFDVDAQRANFFQQYVEGFRHARFHLVIAVHDVFIHLGTTVHVIRLNGEHFLQGVGRAVCFQRPHFHLTEALTTELCLTTQRLLSNQAVRTGGTSVHFVVDQVVQFQHVHVTHGYRTFELFTGAAIKQGDLTGSRQVAQLQQLFDFSFFRTVEYRRCDRHAFTQVFSQTQNFFIAEGIQVNFLANVSAQIVSTLDEFAQFRDFLLLFQHGVDLIADAFCSHTQVSFKDLTDVHTRRYAQRVQYDIYRRTVSIVRHIFDRVDLRDNTLVTVTTRHLITRLDTAFNGQIYLNNLQHARCQIVALGDFTAFRFEFFLELVFQFVILLSQLFQLILFLFVGQAQFQPAIARQLVELLSFNATGDQHRVDTTEQTGFEDLQFFRQVFFGLLQLHLFDFQSTFVFFYAVTGKDLNVDNGTRDTVRYAQRRVFNVRRFLTEDRAQQFLFRRQLGFTFRRYLTNQNVAAGHFRTDINDTGFIQFGERSFTHVRDVSGDLFRPQLGVTGHARQFLNVDSGETVFLDNTLGNEDGVFEVVTVPRHERYTHVLTQRQLTEVGGRAVCQHVAALNRFAQGHARHLVDAGVLVRTGVLGQVINVDTCFARVHLVFVNFDNDTGSIHVLNGTATFSHGSNTGVNGNSTFHTGTNQRLISAQSRNRLTLHVRTHQCTVGVIVFQERDQGRTDGYHLLGGYVHVVNLVAAEQAGFAFATAGNQIFYEVAVFIQVGVRLSDNVVAFFDSRQVVNFVSNHTVGHFTIRRLKEAIFVGLRVHGQGVNQTDVRTFRRFDRTYATVVGRVYVSNFEACALTGQTAWAECGDTTFVRNLRQRVVLVHKLRQLAGTKELFHCCGNRLGVDHILRHQGIQIAKRQTLFHRTLYTYQANAELVFRHFANGTDTTVAEVVDIVHFAFTVTDIDELLHHFDDVVFAQDTGTFDFVAQQRTVELHTTNRGQIVAVFREEQVLKQTFSGFTSRRLARAHHAVDFYQRAQTIVSRVDAYRFRDVRAVVQIVGEQRFDTLVARLAQLSQQIQAQLHVRRADQFASRFIDIVFSRHFARDIFNRHFDMLDIVFFQLTDMTSRDATAFLNVHFAVGFDIEGGSFTAQTLRNQLHLQLVVANFKDHFFEEQVKDLLSGVIQRAQDDGSRQLTTTVDTNEQVVFRVEFEVQPGTAVRDDTCVIQNLTGGVGLTFVTVKEDARATVQLRNDNTLGTVDNKGTVVGHERNFAHVDFLFFNVFDGAFWRFALVDHQTQFYAQRCRISHATDLTFFNVKNRFAQTVADVLQLGITAVALNREYGTESSFQTILPFRILLDKLLERVKLDRKEIWHIQNLWTFTKILTNTFFLGIGVNHRVPQLADKSTHLPAEGSFLCNTILLTGKWNTFRNACCYHA

SEQ ID NO: 7202 - protein, 264 aa, Klebsiella pneumoniae
SKGSAIDMDRIIEKLDRGWWVVSHEQKLWLPGGELPHGEAVNFDLVGQHALHIGEWQGESVWMVRQDRRHDMGSLRQVLDQDPGLFQLAGRGIQLAEFYRSHKFCGYCGHPMHASKSEWAMLCSHCRERYYPQIAPCIIVAIRRDDAILLAQHTRHRNGVHTVLAGFVEVGETLEQAVAREVMEESGIRVKNLRYVTSQPWPFPQSLMTAFMADYADGEIVVDKKELLTADWYRYDDLPLLPPPGTVARRLIEDTVAMCRAEFE

SEQ ID NO: 7203 - protein, 495 aa, Klebsiella pneumoniae
TTGRGRLRGGDAAGCADRLQSGAGNQSHAGDYYRAGDGPGGGRRRDRRPEPCGAGAGDGRGRGAGQYRHCRRRRPRGHGPRLPYGDRCRITGASGRTGGTQYAGAGHQPAHRIPGGAGMKTFSDRWRQLEWDDIRLRINSKTAADVERALAAKQLTRDDMMALLSPAAANYLEPLAQRAQRLTRQRFGNTVSFYVPLYLSNMCANDCTYCGFSMSNRIKRKTLDAAEIARECAAIRNLGFEHLLLVTGEHQGKVGMDYFRRHLPAIRSQFASLHMEVQPLATEEYAELKTLGLDGVMVYQETYHESMYAQHHLKGKKQDFFWRLDTPDRLGAAGIDKIGLGALIGLSDSWRVDCFIVAEHLLWLQQRYWRSRYSVSFPRLRPCAGGIEPASLMDERQLVQTICAFRLLAPEVELSLSTRESPWFRDRVIPLAINNVSAFSKTQPGGYADDHPELEQFAPHDDRRPEEVASALAARGLQPVWKDWDSWLGRASQTS

SEQ ID NO: 7204 - protein, 157 aa, Klebsiella pneumoniae
NATGALQRKKAGDQKVTSLSLISQAATGRVGLFNFNFSASFFQRFFQSFSVVFADAFFQCSRSRFYQVFSFFQTQASCATYCFDNSNFVSASSFQNYVEFSFFFSSFNRASSYSYSSSSGNTEFFFHCRDQLNNVHYGHSGYCFNDLIFSDRHLNCS

SEQ ID NO: 7205 - protein, 478 aa, Klebsiella pneumoniae
PHLMLLPVRRRNNPDRQVGIIFRSEWTGSGGCMEFAIQLIIILICLFYGARKGGIALGLLGGIGLVILVFVFHLQPGKPPVDVMLVIIAVVAASATLQASGGLDVMLQIAEKLLRRNPKYVSIVAPFVTCTLTILCGTGHVVYTILPIIYDVAIKNNIRPERPMAASSIGAQMGIIASPVSVAVVSLVAMLGNFTFNGKHLEFLDLLAITIPSTLLGILAIGIFSWFRGKDLDQDEAFQAFIALPENRHYVYGDTATLLDKKLPTSNWIAMWIFLASIAVVALLGAFSELRPAFDGKPLSMVLVIQMFMLLSGALIIIITKTNPASISKNEVFRSGMIAIVAVYGIAWMAETMFGAHMTEIKGVLGEMVKEYPWAYAIVLLLVSKFVNSQAAALAAIVPVALAIGVDPAYIVASAPACYGYYILPTYPSDLAAIQFDRSGTTHIGRFVINHSFILPGLIGVGVSCVFGWVFAAMYGFL

SEQ ID NO: 7206 - protein, 74 aa, Klebsiella pneumoniae
SSRMYKPWVRTQVASGTPADRISSLLLNYNSEAFMYRDLYSAIMCRPLLSAERQGENEEEKVRPGQRPLLTRAE
